United States Patent 11,464,842 (COMPOSITIONS AND METHOD FOR OPTIMIZED PEPTIDE VACCINES USING RESIDUE OPTIMIZATION) - sequence listing, part 11

SEQ ID NO: 179849 - protein, 11 aa, Artificial Sequence
  Description of Artificial Sequence: Synthetic peptide
  Seed: FWPPVTNTEMF (TYRP1_HUMAN)
FYPPVTNTEMI

SEQ ID NO: 179850 - protein, 9 aa, Artificial Sequence
  Description of Artificial Sequence: Synthetic peptide
  Seed: REVWPLRFF (TYRP1_HUMAN)
RKVWPLRFY

SEQ ID NO: 179851 - protein, 10 aa, Artificial Sequence
  Description of Artificial Sequence: Synthetic peptide
  Seed: TPQFENISIY (TYRP1_HUMAN)
TGQFENISIY

SEQ ID NO: 179852 - protein, 10 aa, Artificial Sequence
  Description of Artificial Sequence: Synthetic peptide
  Seed: GPAFLTWHRY (TYRP1_HUMAN)
GQAFLTWHRY

SEQ ID NO: 179853 - protein, 9 aa, Artificial Sequence
  Description of Artificial Sequence: Synthetic peptide
  Seed: FSHEGPAFL (TYRP1_HUMAN)
FLHEGPAFF

SEQ ID NO: 179854 - protein, 9 aa, Artificial Sequence
  Description of Artificial Sequence: Synthetic peptide
  Seed: WPPVTNTEM (TYRP1_HUMAN)
WPPVTNTEA

SEQ ID NO: 179855 - protein, 9 aa, Artificial Sequence
  Description of Artificial Sequence: Synthetic peptide
  Seed: LQNPNQSVV (TYRP1_HUMAN)
LTNPNQSVL

SEQ ID NO: 179856 - protein, 9 aa, Artificial Sequence
  Description of Artificial Sequence: Synthetic peptide
  Seed: TTHPLFVIA (TYRP1_HUMAN)
TLHPLFVIA

SEQ ID NO: 179857 - protein, 9 aa, Artificial Sequence
  Description of Artificial Sequence: Synthetic peptide
  Seed: DAVFDEWLR (TYRP1_HUMAN)
DLVFDEWLR

SEQ ID NO: 179858 - protein, 10 aa, Artificial Sequence
  Description of Artificial Sequence: Synthetic peptide
  Seed: RRYNADISTF (TYRP1_HUMAN)
RRYNADISTV

SEQ ID NO: 179859 - protein, 11 aa, Artificial Sequence
  Description of Artificial Sequence: Synthetic peptide
  Seed: EILGPDGNTPQ (TYRP1_HUMAN)
EVLGPDGNTPR

SEQ ID NO: 179860 - protein, 10 aa, Artificial Sequence
  Description of Artificial Sequence: Synthetic peptide
  Seed: HNCGTCRPGW (TYRP1_HUMAN)
HTCGTCRPGW

SEQ ID NO: 179861 - protein, 9 aa, Artificial Sequence
  Description of Artificial Sequence: Synthetic peptide
  Seed: FSHEGPAFL (TYRP1_HUMAN)
FIHEGPAFM

SEQ ID NO: 179862 - protein, 9 aa, Artificial Sequence
  Description of Artificial Sequence: Synthetic peptide
  Seed: YTYEIQWPS (TYRP1_HUMAN)
YRYEIQWPI

SEQ ID NO: 179863 - protein, 10 aa, Artificial Sequence
  Description of Artificial Sequence: Synthetic peptide
  Seed: LPYWNFATGK (TYRP1_HUMAN)
LNYWNFATGR

SEQ ID NO: 179864 - protein, 9 aa, Artificial Sequence
  Description of Artificial Sequence: Synthetic peptide
  Seed: MCCPDLSPV (TYRP1_HUMAN)
MTCPDLSPV

SEQ ID NO: 179865 - protein, 10 aa, Artificial Sequence
  Description of Artificial Sequence: Synthetic peptide
  Seed: NYFVWTHYYS (TYRP1_HUMAN)
NDFVWTHYYY

SEQ ID NO: 179866 - protein, 10 aa, Artificial Sequence
  Description of Artificial Sequence: Synthetic peptide
  Seed: YNADISTFPL (TYRP1_HUMAN)
YVADISTFPV

SEQ ID NO: 179867 - protein, 9 aa, Artificial Sequence
  Description of Artificial Sequence: Synthetic peptide
  Seed: TADSRPHSP (TYRP1_HUMAN)
TADSRPHSV

SEQ ID NO: 179868 - protein, 9 aa, Artificial Sequence
  Description of Artificial Sequence: Synthetic peptide
  Seed: TASYLIRAR (TYRP1_HUMAN)
TMSYLIRAR

SEQ ID NO: 179869 - protein, 10 aa, Artificial Sequence
  Description of Artificial Sequence: Synthetic peptide
  Seed: LLFQQARAQF (TYRP1_HUMAN)
LKFQQARAQY

SEQ ID NO: 179870 - protein, 9 aa, Artificial Sequence
  Description of Artificial Sequence: Synthetic peptide
  Seed: NVARPMVQR (TYRP1_HUMAN)
NMARPMVQR

SEQ ID NO: 179871 - protein, 10 aa, Artificial Sequence
  Description of Artificial Sequence: Synthetic peptide
  Seed: EIIAIAVVGA (TYRP1_HUMAN)
ESIAIAVVGI

SEQ ID NO: 179872 - protein, 9 aa, Artificial Sequence
  Description of Artificial Sequence: Synthetic peptide
  Seed: SPNDPIFVL (TYRP1_HUMAN)
SANDPIFVY

SEQ ID NO: 179873 - protein, 9 aa, Artificial Sequence
  Description of Artificial Sequence: Synthetic peptide
  Seed: LLVALIFGT (TYRP1_HUMAN)
LTVALIFGL

SEQ ID NO: 179874 - protein, 8 aa, Artificial Sequence
  Description of Artificial Sequence: Synthetic peptide
  Seed: TEMFVTAP (TYRP1_HUMAN)
TEMFVTAA

SEQ ID NO: 179875 - protein, 10 aa, Artificial Sequence
  Description of Artificial Sequence: Synthetic peptide
  Seed: YNADISTFPL (TYRP1_HUMAN)
YCADISTFPY

SEQ ID NO: 179876 - protein, 9 aa, Artificial Sequence
  Description of Artificial Sequence: Synthetic peptide
  Seed: HYYSVKKTF (TYRP1_HUMAN)
HYYSVKKTY

SEQ ID NO: 179877 - protein, 9 aa, Artificial Sequence
  Description of Artificial Sequence: Synthetic peptide
  Seed: RQCATVEAL (TYRP1_HUMAN)
RLCATVEAM

SEQ ID NO: 179878 - protein, 9 aa, Artificial Sequence
  Description of Artificial Sequence: Synthetic peptide
  Seed: QEMLQEPSF (TYRP1_HUMAN)
QEMLQEPSI

SEQ ID NO: 179879 - protein, 10 aa, Artificial Sequence
  Description of Artificial Sequence: Synthetic peptide
  Seed: VDFSHEGPAF (TYRP1_HUMAN)
VTFSHEGPAY

SEQ ID NO: 179880 - protein, 10 aa, Artificial Sequence
  Description of Artificial Sequence: Synthetic peptide
  Seed: AVFDEWLRRY (TYRP1_HUMAN)
ATFDEWLRRK

SEQ ID NO: 179881 - protein, 9 aa, Artificial Sequence
  Description of Artificial Sequence: Synthetic peptide
  Seed: RYHLLRLEK (TYRP1_HUMAN)
RIHLLRLEA

SEQ ID NO: 179882 - protein, 9 aa, Artificial Sequence
  Description of Artificial Sequence: Synthetic peptide
  Seed: SVFSQWRVV (TYRP1_HUMAN)
STFSQWRVW

SEQ ID NO: 179883 - protein, 10 aa, Artificial Sequence
  Description of Artificial Sequence: Synthetic peptide
  Seed: AVRSLHNLAH (TYRP1_HUMAN)
ATRSLHNLAA

SEQ ID NO: 179884 - protein, 9 aa, Artificial Sequence
  Description of Artificial Sequence: Synthetic peptide
  Seed: DQRVLIVRR (TYRP1_HUMAN)
DVRVLIVRK

SEQ ID NO: 179885 - protein, 9 aa, Artificial Sequence
  Description of Artificial Sequence: Synthetic peptide
  Seed: RSLHNLAHL (TYRP1_HUMAN)
RRLHNLAHM

SEQ ID NO: 179886 - protein, 11 aa, Artificial Sequence
  Description of Artificial Sequence: Synthetic peptide
  Seed: MLQEPSFSLPY (TYRP1_HUMAN)
MQQEPSFSLPV

SEQ ID NO: 179887 - protein, 10 aa, Artificial Sequence
  Description of Artificial Sequence: Synthetic peptide
  Seed: YNMVPFWPPV (TYRP1_HUMAN)
YSMVPFWPPV

SEQ ID NO: 179888 - protein, 9 aa, Artificial Sequence
  Description of Artificial Sequence: Synthetic peptide
  Seed: ARAQFPRQC (TYRP1_HUMAN)
ARAQFPRQY

SEQ ID NO: 179889 - protein, 9 aa, Artificial Sequence
  Description of Artificial Sequence: Synthetic peptide
  Seed: RRNPAGNVA (TYRP1_HUMAN)
RFNPAGNVM

SEQ ID NO: 179890 - protein, 9 aa, Artificial Sequence
  Description of Artificial Sequence: Synthetic peptide
  Seed: SVFSQWRVV (TYRP1_HUMAN)
SLFSQWRVI

SEQ ID NO: 179891 - protein, 10 aa, Artificial Sequence
  Description of Artificial Sequence: Synthetic peptide
  Seed: SVPEIIAIAV (TYRP1_HUMAN)
SAPEIIAIAL

SEQ ID NO: 179892 - protein, 9 aa, Artificial Sequence
  Description of Artificial Sequence: Synthetic peptide
  Seed: IGHNRQYNM (TYRP1_HUMAN)
ISHNRQYNF

SEQ ID NO: 179893 - protein, 9 aa, Artificial Sequence
  Description of Artificial Sequence: Synthetic peptide
  Seed: HYYSVKKTF (TYRP1_HUMAN)
HWYSVKKTF

SEQ ID NO: 179894 - protein, 10 aa, Artificial Sequence
  Description of Artificial Sequence: Synthetic peptide
  Seed: ISPNSVFSQW (TYRP1_HUMAN)
IWPNSVFSQW

SEQ ID NO: 179895 - protein, 10 aa, Artificial Sequence
  Description of Artificial Sequence: Synthetic peptide
  Seed: SIYNYFVWTH (TYRP1_HUMAN)
SAYNYFVWTK

SEQ ID NO: 179896 - protein, 10 aa, Artificial Sequence
  Description of Artificial Sequence: Synthetic peptide
  Seed: FVWTHYYSVK (TYRP1_HUMAN)
FMWTHYYSVW

SEQ ID NO: 179897 - protein, 9 aa, Artificial Sequence
  Description of Artificial Sequence: Synthetic peptide
  Seed: MAKRTTHPL (TYRP1_HUMAN)
MTKRTTHPS

SEQ ID NO: 179898 - protein, 10 aa, Artificial Sequence
  Description of Artificial Sequence: Synthetic peptide
  Seed: FSLPYWNFAT (TYRP1_HUMAN)
FMLPYWNFAL

SEQ ID NO: 179899 - protein, 9 aa, Artificial Sequence
  Description of Artificial Sequence: Synthetic peptide
  Seed: NADISTFPL (TYRP1_HUMAN)
NMDISTFPV

SEQ ID NO: 179900 - protein, 10 aa, Artificial Sequence
  Description of Artificial Sequence: Synthetic peptide
  Seed: LLFQQARAQF (TYRP1_HUMAN)
LYFQQARAQW

SEQ ID NO: 179901 - protein, 9 aa, Artificial Sequence
  Description of Artificial Sequence: Synthetic peptide
  Seed: LIFGTASYL (TYRP1_HUMAN)
LEFGTASYF

SEQ ID NO: 179902 - protein, 11 aa, Artificial Sequence
  Description of Artificial Sequence: Synthetic peptide
  Seed: FSHEGPAFLTW (TYRP1_HUMAN)
FTHEGPAFLTL

SEQ ID NO: 179903 - protein, 9 aa, Artificial Sequence
  Description of Artificial Sequence: Synthetic peptide
  Seed: SVPEIIAIA (TYRP1_HUMAN)
SIPEIIAIR

SEQ ID NO: 179904 - protein, 9 aa, Artificial Sequence
  Description of Artificial Sequence: Synthetic peptide
  Seed: FLTWHRYHL (TYRP1_HUMAN)
FYTWHRYHL

SEQ ID NO: 179905 - protein, 11 aa, Artificial Sequence
  Description of Artificial Sequence: Synthetic peptide
  Seed: LISPNSVFSQW (TYRP1_HUMAN)
LASPNSVFSQW

SEQ ID NO: 179906 - protein, 9 aa, Artificial Sequence
  Description of Artificial Sequence: Synthetic peptide
  Seed: FVWTHYYSV (TYRP1_HUMAN)
FLWTHYYSF

SEQ ID NO: 179907 - protein, 9 aa, Artificial Sequence
  Description of Artificial Sequence: Synthetic peptide
  Seed: MSAPKLLSL (TYRP1_HUMAN)
MWAPKLLSY

SEQ ID NO: 179908 - protein, 9 aa, Artificial Sequence
  Description of Artificial Sequence: Synthetic peptide
  Seed: LFDTPPFYS (TYRP1_HUMAN)
LYDTPPFYF

SEQ ID NO: 179909 - protein, 9 aa, Artificial Sequence
  Description of Artificial Sequence: Synthetic peptide
  Seed: RSLHNLAHL (TYRP1_HUMAN)
RLLHNLAHK

SEQ ID NO: 179910 - protein, 10 aa, Artificial Sequence
  Description of Artificial Sequence: Synthetic peptide
  Seed: SREFSVPEII (TYRP1_HUMAN)
SLEFSVPEIL

SEQ ID NO: 179911 - protein, 9 aa, Artificial Sequence
  Description of Artificial Sequence: Synthetic peptide
  Seed: FYSNSTNSF (TYRP1_HUMAN)
FKSNSTNSL

SEQ ID NO: 179912 - protein, 9 aa, Artificial Sequence
  Description of Artificial Sequence: Synthetic peptide
  Seed: YTYEIQWPS (TYRP1_HUMAN)
YYYEIQWPK

SEQ ID NO: 179913 - protein, 10 aa, Artificial Sequence
  Description of Artificial Sequence: Synthetic peptide
  Seed: REFSVPEIIA (TYRP1_HUMAN)
REFSVPEIIY

SEQ ID NO: 179914 - protein, 10 aa, Artificial Sequence
  Description of Artificial Sequence: Synthetic peptide
  Seed: LSLGCIFFPL (TYRP1_HUMAN)
LTLGCIFFPV

SEQ ID NO: 179915 - protein, 9 aa, Artificial Sequence
  Description of Artificial Sequence: Synthetic peptide
  Seed: MAKRTTHPL (TYRP1_HUMAN)
MAKRTTHPA

SEQ ID NO: 179916 - protein, 10 aa, Artificial Sequence
  Description of Artificial Sequence: Synthetic peptide
  Seed: FLNGTGGQTH (TYRP1_HUMAN)
FVNGTGGQTM

SEQ ID NO: 179917 - protein, 9 aa, Artificial Sequence
  Description of Artificial Sequence: Synthetic peptide
  Seed: FVWTHYYSV (TYRP1_HUMAN)
FSWTHYYSY

SEQ ID NO: 179918 - protein, 10 aa, Artificial Sequence
  Description of Artificial Sequence: Synthetic peptide
  Seed: GNVARPMVQR (TYRP1_HUMAN)
GDVARPMVQK

SEQ ID NO: 179919 - protein, 10 aa, Artificial Sequence
  Description of Artificial Sequence: Synthetic peptide
  Seed: SIYNYFVWTH (TYRP1_HUMAN)
STYNYFVWTR

SEQ ID NO: 179920 - protein, 9 aa, Artificial Sequence
  Description of Artificial Sequence: Synthetic peptide
  Seed: ISIYNYFVW (TYRP1_HUMAN)
IYIYNYFVM

SEQ ID NO: 179921 - protein, 10 aa, Artificial Sequence
  Description of Artificial Sequence: Synthetic peptide
  Seed: LTWHRYHLLR (TYRP1_HUMAN)
LYWHRYHLLR

SEQ ID NO: 179922 - protein, 9 aa, Artificial Sequence
  Description of Artificial Sequence: Synthetic peptide
  Seed: GSRSNFDST (TYRP1_HUMAN)
GVRSNFDSK

SEQ ID NO: 179923 - protein, 9 aa, Artificial Sequence
  Description of Artificial Sequence: Synthetic peptide
  Seed: SFRNTVEGY (TYRP1_HUMAN)
SFRNTVEGL

SEQ ID NO: 179924 - protein, 9 aa, Artificial Sequence
  Description of Artificial Sequence: Synthetic peptide
  Seed: SRSNFDSTL (TYRP1_HUMAN)
SISNFDSTF

SEQ ID NO: 179925 - protein, 10 aa, Artificial Sequence
  Description of Artificial Sequence: Synthetic peptide
  Seed: AEEYEKLQNP (TYRP1_HUMAN)
AEEYEKLQNI

SEQ ID NO: 179926 - protein, 10 aa, Artificial Sequence
  Description of Artificial Sequence: Synthetic peptide
  Seed: YFVWTHYYSV (TYRP1_HUMAN)
YIVWTHYYSI

SEQ ID NO: 179927 - protein, 9 aa, Artificial Sequence
  Description of Artificial Sequence: Synthetic peptide
  Seed: APIGHNRQY (TYRP1_HUMAN)
ATIGHNRQL

SEQ ID NO: 179928 - protein, 9 aa, Artificial Sequence
  Description of Artificial Sequence: Synthetic peptide
  Seed: SVKKTFLGV (TYRP1_HUMAN)
SFKKTFLGK

SEQ ID NO: 179929 - protein, 10 aa, Artificial Sequence
  Description of Artificial Sequence: Synthetic peptide
  Seed: YFVWTHYYSV (TYRP1_HUMAN)
YWVWTHYYSI

SEQ ID NO: 179930 - protein, 9 aa, Artificial Sequence
  Description of Artificial Sequence: Synthetic peptide
  Seed: ALIFGTASY (TYRP1_HUMAN)
AGIFGTASY

SEQ ID NO: 179931 - protein, 9 aa, Artificial Sequence
  Description of Artificial Sequence: Synthetic peptide
  Seed: SLGCIFFPL (TYRP1_HUMAN)
SMGCIFFPW

SEQ ID NO: 179932 - protein, 9 aa, Artificial Sequence
  Description of Artificial Sequence: Synthetic peptide
  Seed: RVLIVRRNL (TYRP1_HUMAN)
RSLIVRRNW

SEQ ID NO: 179933 - protein, 9 aa, Artificial Sequence
  Description of Artificial Sequence: Synthetic peptide
  Seed: NMVPFWPPV (TYRP1_HUMAN)
NLVPFWPPL

SEQ ID NO: 179934 - protein, 9 aa, Artificial Sequence
  Description of Artificial Sequence: Synthetic peptide
  Seed: FLTWHRYHL (TYRP1_HUMAN)
FRTWHRYHI

SEQ ID NO: 179935 - protein, 9 aa, Artificial Sequence
  Description of Artificial Sequence: Synthetic peptide
  Seed: AQCLEVGLF (TYRP1_HUMAN)
AQCLEVGLL

SEQ ID NO: 179936 - protein, 10 aa, Artificial Sequence
  Description of Artificial Sequence: Synthetic peptide
  Seed: THPLFVIATR (TYRP1_HUMAN)
TSPLFVIATR

SEQ ID NO: 179937 - protein, 11 aa, Artificial Sequence
  Description of Artificial Sequence: Synthetic peptide
  Seed: YNMVPFWPPVT (TYRP1_HUMAN)
YLMVPFWPPVT

SEQ ID NO: 179938 - protein, 10 aa, Artificial Sequence
  Description of Artificial Sequence: Synthetic peptide
  Seed: VLLHTFTDAV (TYRP1_HUMAN)
VHLHTFTDAV

SEQ ID NO: 179939 - protein, 10 aa, Artificial Sequence
  Description of Artificial Sequence: Synthetic peptide
  Seed: FVWTHYYSVK (TYRP1_HUMAN)
FQWTHYYSVV

SEQ ID NO: 179940 - protein, 10 aa, Artificial Sequence
  Description of Artificial Sequence: Synthetic peptide
  Seed: GLFDTPPFYS (TYRP1_HUMAN)
GSFDTPPFYL

SEQ ID NO: 179941 - protein, 9 aa, Artificial Sequence
  Description of Artificial Sequence: Synthetic peptide
  Seed: YNYFVWTHY (TYRP1_HUMAN)
YMYFVWTHL

SEQ ID NO: 179942 - protein, 10 aa, Artificial Sequence
  Description of Artificial Sequence: Synthetic peptide
  Seed: YFVWTHYYSV (TYRP1_HUMAN)
YWVWTHYYSL

SEQ ID NO: 179943 - protein, 10 aa, Artificial Sequence
  Description of Artificial Sequence: Synthetic peptide
  Seed: FWPPVTNTEM (TYRP1_HUMAN)
FFPPVTNTEL

SEQ ID NO: 179944 - protein, 10 aa, Artificial Sequence
  Description of Artificial Sequence: Synthetic peptide
  Seed: FVWTHYYSVK (TYRP1_HUMAN)
FMWTHYYSVA

SEQ ID NO: 179945 - protein, 9 aa, Artificial Sequence
  Description of Artificial Sequence: Synthetic peptide
  Seed: YTYEIQWPS (TYRP1_HUMAN)
YKYEIQWPV

SEQ ID NO: 179946 - protein, 10 aa, Artificial Sequence
  Description of Artificial Sequence: Synthetic peptide
  Seed: GLFDTPPFYS (TYRP1_HUMAN)
GAFDTPPFYV

SEQ ID NO: 179947 - protein, 10 aa, Artificial Sequence
  Description of Artificial Sequence: Synthetic peptide
  Seed: FLNGTGGQTH (TYRP1_HUMAN)
FTNGTGGQTL

SEQ ID NO: 179948 - protein, 9 aa, Artificial Sequence
  Description of Artificial Sequence: Synthetic peptide
  Seed: QESFGEVDF (TYRP1_HUMAN)
QESFGEVDA

SEQ ID NO: 179949 - protein, 10 aa, Artificial Sequence
  Description of Artificial Sequence: Synthetic peptide
  Seed: EIIAIAVVGA (TYRP1_HUMAN)
ENIAIAVVGV

SEQ ID NO: 179950 - protein, 9 aa, Artificial Sequence
  Description of Artificial Sequence: Synthetic peptide
  Seed: RGRCEAVTA (TYRP1_HUMAN)
RARCEAVTK

SEQ ID NO: 179951 - protein, 9 aa, Artificial Sequence
  Description of Artificial Sequence: Synthetic peptide
  Seed: NVARPMVQR (TYRP1_HUMAN)
NGARPMVQR

SEQ ID NO: 179952 - protein, 9 aa, Artificial Sequence
  Description of Artificial Sequence: Synthetic peptide
  Seed: LSKEEKNHF (TYRP1_HUMAN)
LAKEEKNHY

SEQ ID NO: 179953 - protein, 9 aa, Artificial Sequence
  Description of Artificial Sequence: Synthetic peptide
  Seed: RTTHPLFVI (TYRP1_HUMAN)
RATHPLFVK

SEQ ID NO: 179954 - protein, 9 aa, Artificial Sequence
  Description of Artificial Sequence: Synthetic peptide
  Seed: VARPMVQRL (TYRP1_HUMAN)
VLRPMVQRY

SEQ ID NO: 179955 - protein, 10 aa, Artificial Sequence
  Description of Artificial Sequence: Synthetic peptide
  Seed: YNYFVWTHYY (TYRP1_HUMAN)
YCYFVWTHYK

SEQ ID NO: 179956 - protein, 10 aa, Artificial Sequence
  Description of Artificial Sequence: Synthetic peptide
  Seed: FGTASYLIRA (TYRP1_HUMAN)
FITASYLIRI

SEQ ID NO: 179957 - protein, 9 aa, Artificial Sequence
  Description of Artificial Sequence: Synthetic peptide
  Seed: FSLPYWNFA (TYRP1_HUMAN)
FVLPYWNFY

SEQ ID NO: 179958 - protein, 9 aa, Artificial Sequence
  Description of Artificial Sequence: Synthetic peptide
  Seed: IYNYFVWTH (TYRP1_HUMAN)
IINYFVWTR

SEQ ID NO: 179959 - protein, 10 aa, Artificial Sequence
  Description of Artificial Sequence: Synthetic peptide
  Seed: NYFVWTHYYS (TYRP1_HUMAN)
NFFVWTHYYC

SEQ ID NO: 179960 - protein, 9 aa, Artificial Sequence
  Description of Artificial Sequence: Synthetic peptide
  Seed: SPNDPIFVL (TYRP1_HUMAN)
SQNDPIFVL

SEQ ID NO: 179961 - protein, 9 aa, Artificial Sequence
  Description of Artificial Sequence: Synthetic peptide
  Seed: LHTFTDAVF (TYRP1_HUMAN)
LQTFTDAVY

SEQ ID NO: 179962 - protein, 9 aa, Artificial Sequence
  Description of Artificial Sequence: Synthetic peptide
  Seed: YTYEIQWPS (TYRP1_HUMAN)
YFYEIQWPI

SEQ ID NO: 179963 - protein, 9 aa, Artificial Sequence
  Description of Artificial Sequence: Synthetic peptide
  Seed: GLFDTPPFY (TYRP1_HUMAN)
GMFDTPPFI

SEQ ID NO: 179964 - protein, 9 aa, Artificial Sequence
  Description of Artificial Sequence: Synthetic peptide
  Seed: TEMFVTAPD (TYRP1_HUMAN)
TEMFVTAPA

SEQ ID NO: 179965 - protein, 9 aa, Artificial Sequence
  Description of Artificial Sequence: Synthetic peptide
  Seed: MAKRTTHPL (TYRP1_HUMAN)
MVKRTTHPI

SEQ ID NO: 179966 - protein, 9 aa, Artificial Sequence
  Description of Artificial Sequence: Synthetic peptide
  Seed: SLHNLAHLF (TYRP1_HUMAN)
SIHNLAHLL

SEQ ID NO: 179967 - protein, 10 aa, Artificial Sequence
  Description of Artificial Sequence: Synthetic peptide
  Seed: FVWTHYYSVK (TYRP1_HUMAN)
FTWTHYYSVR

SEQ ID NO: 179968 - protein, 9 aa, Artificial Sequence
  Description of Artificial Sequence: Synthetic peptide
  Seed: SGRGRCEAV (TYRP1_HUMAN)
SPRGRCEAF

SEQ ID NO: 179969 - protein, 9 aa, Artificial Sequence
  Description of Artificial Sequence: Synthetic peptide
  Seed: QWPSREFSV (TYRP1_HUMAN)
QYPSREFSF

SEQ ID NO: 179970 - protein, 10 aa, Artificial Sequence
  Description of Artificial Sequence: Synthetic peptide
  Seed: RQCATVEALR (TYRP1_HUMAN)
RFCATVEALK

SEQ ID NO: 179971 - protein, 10 aa, Artificial Sequence
  Description of Artificial Sequence: Synthetic peptide
  Seed: FYSNSTNSFR (TYRP1_HUMAN)
FDSNSTNSFK

SEQ ID NO: 179972 - protein, 9 aa, Artificial Sequence
  Description of Artificial Sequence: Synthetic peptide
  Seed: AVRSLHNLA (TYRP1_HUMAN)
ASRSLHNLS

SEQ ID NO: 179973 - protein, 9 aa, Artificial Sequence
  Description of Artificial Sequence: Synthetic peptide
  Seed: NMVPFWPPV (TYRP1_HUMAN)
NYVPFWPPM

SEQ ID NO: 179974 - protein, 9 aa, Artificial Sequence
  Description of Artificial Sequence: Synthetic peptide
  Seed: SLGCIFFPL (TYRP1_HUMAN)
STGCIFFPR

SEQ ID NO: 179975 - protein, 11 aa, Artificial Sequence
  Description of Artificial Sequence: Synthetic peptide
  Seed: VTAPDNLGYTY (TYRP1_HUMAN)
VPAPDNLGYTF

SEQ ID NO: 179976 - protein, 9 aa, Artificial Sequence
  Description of Artificial Sequence: Synthetic peptide
  Seed: IATRRSEEI (TYRP1_HUMAN)
ITTRRSEEW

SEQ ID NO: 179977 - protein, 9 aa, Artificial Sequence
  Description of Artificial Sequence: Synthetic peptide
  Seed: ISIYNYFVW (TYRP1_HUMAN)
IWIYNYFVL

SEQ ID NO: 179978 - protein, 9 aa, Artificial Sequence
  Description of Artificial Sequence: Synthetic peptide
  Seed: MAKRTTHPL (TYRP1_HUMAN)
MKKRTTHPY

SEQ ID NO: 179979 - protein, 9 aa, Artificial Sequence
  Description of Artificial Sequence: Synthetic peptide
  Seed: MSAPKLLSL (TYRP1_HUMAN)
MAAPKLLSF

SEQ ID NO: 179980 - protein, 11 aa, Artificial Sequence
  Description of Artificial Sequence: Synthetic peptide
  Seed: FWPPVTNTEMF (TYRP1_HUMAN)
FYPPVTNTEML

SEQ ID NO: 179981 - protein, 10 aa, Artificial Sequence
  Description of Artificial Sequence: Synthetic peptide
  Seed: FSLPYWNFAT (TYRP1_HUMAN)
FNLPYWNFAL

SEQ ID NO: 179982 - protein, 9 aa, Artificial Sequence
  Description of Artificial Sequence: Synthetic peptide
  Seed: LQNPNQSVV (TYRP1_HUMAN)
LSNPNQSVY

SEQ ID NO: 179983 - protein, 9 aa, Artificial Sequence
  Description of Artificial Sequence: Synthetic peptide
  Seed: VTAPDNLGY (TYRP1_HUMAN)
VKAPDNLGF

SEQ ID NO: 179984 - protein, 10 aa, Artificial Sequence
  Description of Artificial Sequence: Synthetic peptide
  Seed: LLHTFTDAVF (TYRP1_HUMAN)
LMHTFTDAVF

SEQ ID NO: 179985 - protein, 9 aa, Artificial Sequence
  Description of Artificial Sequence: Synthetic peptide
  Seed: RQCATVEAL (TYRP1_HUMAN)
RFCATVEAY

SEQ ID NO: 179986 - protein, 10 aa, Artificial Sequence
  Description of Artificial Sequence: Synthetic peptide
  Seed: IAVVGALLLV (TYRP1_HUMAN)
IQVVGALLLV

SEQ ID NO: 179987 - protein, 10 aa, Artificial Sequence
  Description of Artificial Sequence: Synthetic peptide
  Seed: LSLGCIFFPL (TYRP1_HUMAN)
LMLGCIFFPL

SEQ ID NO: 179988 - protein, 9 aa, Artificial Sequence
  Description of Artificial Sequence: Synthetic peptide
  Seed: MAKRTTHPL (TYRP1_HUMAN)
MIKRTTHPV

SEQ ID NO: 179989 - protein, 10 aa, Artificial Sequence
  Description of Artificial Sequence: Synthetic peptide
  Seed: MSAPKLLSLG (TYRP1_HUMAN)
MNAPKLLSLW

SEQ ID NO: 179990 - protein, 9 aa, Artificial Sequence
  Description of Artificial Sequence: Synthetic peptide
  Seed: HYYSVKKTF (TYRP1_HUMAN)
HSYSVKKTF

SEQ ID NO: 179991 - protein, 9 aa, Artificial Sequence
  Description of Artificial Sequence: Synthetic peptide
  Seed: RYNADISTF (TYRP1_HUMAN)
RENADISTF

SEQ ID NO: 179992 - protein, 9 aa, Artificial Sequence
  Description of Artificial Sequence: Synthetic peptide
  Seed: QDVAQCLEV (TYRP1_HUMAN)
QEVAQCLEL

SEQ ID NO: 179993 - protein, 9 aa, Artificial Sequence
  Description of Artificial Sequence: Synthetic peptide
  Seed: LIFGTASYL (TYRP1_HUMAN)
LLFGTASYC

SEQ ID NO: 179994 - protein, 9 aa, Artificial Sequence
  Description of Artificial Sequence: Synthetic peptide
  Seed: QCATVEALR (TYRP1_HUMAN)
QAATVEALR

SEQ ID NO: 179995 - protein, 9 aa, Artificial Sequence
  Description of Artificial Sequence: Synthetic peptide
  Seed: SMDEANQPL (TYRP1_HUMAN)
SSDEANQPF

SEQ ID NO: 179996 - protein, 10 aa, Artificial Sequence
  Description of Artificial Sequence: Synthetic peptide
  Seed: FWPPVTNTEM (TYRP1_HUMAN)
FQPPVTNTEF

SEQ ID NO: 179997 - protein, 9 aa, Artificial Sequence
  Description of Artificial Sequence: Synthetic peptide
  Seed: SLHNLAHLF (TYRP1_HUMAN)
SWHNLAHLM

SEQ ID NO: 179998 - protein, 9 aa, Artificial Sequence
  Description of Artificial Sequence: Synthetic peptide
  Seed: ALIFGTASY (TYRP1_HUMAN)
ALIFGTASR

SEQ ID NO: 179999 - protein, 9 aa, Artificial Sequence
  Description of Artificial Sequence: Synthetic peptide
  Seed: AQFPRQCAT (TYRP1_HUMAN)
ARFPRQCAF

SEQ ID NO: 180000 - protein, 11 aa, Artificial Sequence
  Description of Artificial Sequence: Synthetic peptide
  Seed: FSHEGPAFLTW (TYRP1_HUMAN)
FSHEGPAFLTL

SEQ ID NO: 180001 - protein, 10 aa, Artificial Sequence
  Description of Artificial Sequence: Synthetic peptide
  Seed: MVPFWPPVTN (TYRP1_HUMAN)
MTPFWPPVTY

SEQ ID NO: 180002 - protein, 10 aa, Artificial Sequence
  Description of Artificial Sequence: Synthetic peptide
  Seed: RRYNADISTF (TYRP1_HUMAN)
RGYNADISTI

SEQ ID NO: 180003 - protein, 9 aa, Artificial Sequence
  Description of Artificial Sequence: Synthetic peptide
  Seed: ALIFGTASY (TYRP1_HUMAN)
AIIFGTASW

SEQ ID NO: 180004 - protein, 9 aa, Artificial Sequence
  Description of Artificial Sequence: Synthetic peptide
  Seed: LIFGTASYL (TYRP1_HUMAN)
LSFGTASYR

SEQ ID NO: 180005 - protein, 9 aa, Artificial Sequence
  Description of Artificial Sequence: Synthetic peptide
  Seed: AACDQRVLI (TYRP1_HUMAN)
ASCDQRVLL

SEQ ID NO: 180006 - protein, 9 aa, Artificial Sequence
  Description of Artificial Sequence: Synthetic peptide
  Seed: QCATVEALR (TYRP1_HUMAN)
QSATVEALK

SEQ ID NO: 180007 - protein, 9 aa, Artificial Sequence
  Description of Artificial Sequence: Synthetic peptide
  Seed: YTYEIQWPS (TYRP1_HUMAN)
YVYEIQWPA

SEQ ID NO: 180008 - protein, 10 aa, Artificial Sequence
  Description of Artificial Sequence: Synthetic peptide
  Seed: VGLFDTPPFY (TYRP1_HUMAN)
VLLFDTPPFK

SEQ ID NO: 180009 - protein, 9 aa, Artificial Sequence
  Description of Artificial Sequence: Synthetic peptide
  Seed: FSVPEIIAI (TYRP1_HUMAN)
FIVPEIIAY

SEQ ID NO: 180010 - protein, 10 aa, Artificial Sequence
  Description of Artificial Sequence: Synthetic peptide
  Seed: YNADISTFPL (TYRP1_HUMAN)
YTADISTFPL

SEQ ID NO: 180011 - protein, 10 aa, Artificial Sequence
  Description of Artificial Sequence: Synthetic peptide
  Seed: KLLSLGCIFF (TYRP1_HUMAN)
KVLSLGCIFY

SEQ ID NO: 180012 - protein, 9 aa, Artificial Sequence
  Description of Artificial Sequence: Synthetic peptide
  Seed: LVALIFGTA (TYRP1_HUMAN)
LPALIFGTV

SEQ ID NO: 180013 - protein, 9 aa, Artificial Sequence
  Description of Artificial Sequence: Synthetic peptide
  Seed: FLTWHRYHL (TYRP1_HUMAN)
FGTWHRYHY

SEQ ID NO: 180014 - protein, 9 aa, Artificial Sequence
  Description of Artificial Sequence: Synthetic peptide
  Seed: KYDPAVRSL (TYRP1_HUMAN)
KYDPAVRSI

SEQ ID NO: 180015 - protein, 9 aa, Artificial Sequence
  Description of Artificial Sequence: Synthetic peptide
  Seed: NYFVWTHYY (TYRP1_HUMAN)
NWFVWTHYY

SEQ ID NO: 180016 - protein, 9 aa, Artificial Sequence
  Description of Artificial Sequence: Synthetic peptide
  Seed: RAQFPRQCA (TYRP1_HUMAN)
RPQFPRQCI

SEQ ID NO: 180017 - protein, 9 aa, Artificial Sequence
  Description of Artificial Sequence: Synthetic peptide
  Seed: FYSNSTNSF (TYRP1_HUMAN)
FTSNSTNSI

SEQ ID NO: 180018 - protein, 9 aa, Artificial Sequence
  Description of Artificial Sequence: Synthetic peptide
  Seed: TFPLENAPI (TYRP1_HUMAN)
TFPLENAPM

SEQ ID NO: 180019 - protein, 9 aa, Artificial Sequence
  Description of Artificial Sequence: Synthetic peptide
  Seed: RQYNMVPFW (TYRP1_HUMAN)
RYYNMVPFI

SEQ ID NO: 180020 - protein, 9 aa, Artificial Sequence
  Description of Artificial Sequence: Synthetic peptide
  Seed: YNYFVWTHY (TYRP1_HUMAN)
YIYFVWTHK

SEQ ID NO: 180021 - protein, 10 aa, Artificial Sequence
  Description of Artificial Sequence: Synthetic peptide
  Seed: MLQEPSFSLP (TYRP1_HUMAN)
MMQEPSFSLI

SEQ ID NO: 180022 - protein, 9 aa, Artificial Sequence
  Description of Artificial Sequence: Synthetic peptide
  Seed: KYDPAVRSL (TYRP1_HUMAN)
KSDPAVRSM

SEQ ID NO: 180023 - protein, 11 aa, Artificial Sequence
  Description of Artificial Sequence: Synthetic peptide
  Seed: IYNYFVWTHYY (TYRP1_HUMAN)
IYNYFVWTHYF

SEQ ID NO: 180024 - protein, 10 aa, Artificial Sequence
  Description of Artificial Sequence: Synthetic peptide
  Seed: RSMDEANQPL (TYRP1_HUMAN)
RVMDEANQPM

SEQ ID NO: 180025 - protein, 9 aa, Artificial Sequence
  Description of Artificial Sequence: Synthetic peptide
  Seed: YNYFVWTHY (TYRP1_HUMAN)
YLYFVWTHF

SEQ ID NO: 180026 - protein, 9 aa, Artificial Sequence
  Description of Artificial Sequence: Synthetic peptide
  Seed: GPDGNTPQF (TYRP1_HUMAN)
GLDGNTPQL

SEQ ID NO: 180027 - protein, 9 aa, Artificial Sequence
  Description of Artificial Sequence: Synthetic peptide
  Seed: GEVDFSHEG (TYRP1_HUMAN)
GEVDFSHEP

SEQ ID NO: 180028 - protein, 9 aa, Artificial Sequence
  Description of Artificial Sequence: Synthetic peptide
  Seed: YLIRARRSM (TYRP1_HUMAN)
YQIRARRSM

SEQ ID NO: 180029 - protein, 9 aa, Artificial Sequence
  Description of Artificial Sequence: Synthetic peptide
  Seed: AACDQRVLI (TYRP1_HUMAN)
ARCDQRVLY

SEQ ID NO: 180030 - protein, 9 aa, Artificial Sequence
  Description of Artificial Sequence: Synthetic peptide
  Seed: GPDGNTPQF (TYRP1_HUMAN)
GYDGNTPQF

SEQ ID NO: 180031 - protein, 9 aa, Artificial Sequence
  Description of Artificial Sequence: Synthetic peptide
  Seed: LHTFTDAVF (TYRP1_HUMAN)
LQTFTDAVI

SEQ ID NO: 180032 - protein, 10 aa, Artificial Sequence
  Description of Artificial Sequence: Synthetic peptide
  Seed: YTYEIQWPSR (TYRP1_HUMAN)
YVYEIQWPSK

SEQ ID NO: 180033 - protein, 9 aa, Artificial Sequence
  Description of Artificial Sequence: Synthetic peptide
  Seed: LGCIFFPLL (TYRP1_HUMAN)
LLCIFFPLM

SEQ ID NO: 180034 - protein, 9 aa, Artificial Sequence
  Description of Artificial Sequence: Synthetic peptide
  Seed: FPLENAPIG (TYRP1_HUMAN)
FSLENAPIY

SEQ ID NO: 180035 - protein, 9 aa, Artificial Sequence
  Description of Artificial Sequence: Synthetic peptide
  Seed: VGALLLVAL (TYRP1_HUMAN)
VIALLLVAV

SEQ ID NO: 180036 - protein, 9 aa, Artificial Sequence
  Description of Artificial Sequence: Synthetic peptide
  Seed: FSLPYWNFA (TYRP1_HUMAN)
FQLPYWNFM

SEQ ID NO: 180037 - protein, 10 aa, Artificial Sequence
  Description of Artificial Sequence: Synthetic peptide
  Seed: LSLGCIFFPL (TYRP1_HUMAN)
LTLGCIFFPI

SEQ ID NO: 180038 - protein, 9 aa, Artificial Sequence
  Description of Artificial Sequence: Synthetic peptide
  Seed: MAKRTTHPL (TYRP1_HUMAN)
MQKRTTHPF

SEQ ID NO: 180039 - protein, 9 aa, Artificial Sequence
  Description of Artificial Sequence: Synthetic peptide
  Seed: STNSFRNTV (TYRP1_HUMAN)
SLNSFRNTL

SEQ ID NO: 180040 - protein, 9 aa, Artificial Sequence
  Description of Artificial Sequence: Synthetic peptide
  Seed: WPPVTNTEM (TYRP1_HUMAN)
WPPVTNTEL

SEQ ID NO: 180041 - protein, 9 aa, Artificial Sequence
  Description of Artificial Sequence: Synthetic peptide
  Seed: LQNPNQSVV (TYRP1_HUMAN)
LQNPNQSVH

SEQ ID NO: 180042 - protein, 9 aa, Artificial Sequence
  Description of Artificial Sequence: Synthetic peptide
  Seed: GYSDPTGKY (TYRP1_HUMAN)
GTSDPTGKY

SEQ ID NO: 180043 - protein, 10 aa, Artificial Sequence
  Description of Artificial Sequence: Synthetic peptide
  Seed: WPPVTNTEMF (TYRP1_HUMAN)
WSPVTNTEMW

SEQ ID NO: 180044 - protein, 9 aa, Artificial Sequence
  Description of Artificial Sequence: Synthetic peptide
  Seed: APIGHNRQY (TYRP1_HUMAN)
AFIGHNRQF

SEQ ID NO: 180045 - protein, 9 aa, Artificial Sequence
  Description of Artificial Sequence: Synthetic peptide
  Seed: RRYNADIST (TYRP1_HUMAN)
RQYNADISM

SEQ ID NO: 180046 - protein, 10 aa, Artificial Sequence
  Description of Artificial Sequence: Synthetic peptide
  Seed: RRYNADISTF (TYRP1_HUMAN)
RMYNADISTF

SEQ ID NO: 180047 - protein, 9 aa, Artificial Sequence
  Description of Artificial Sequence: Synthetic peptide
  Seed: RVLIVRRNL (TYRP1_HUMAN)
RTLIVRRNA

SEQ ID NO: 180048 - protein, 10 aa, Artificial Sequence
  Description of Artificial Sequence: Synthetic peptide
  Seed: YNYFVWTHYY (TYRP1_HUMAN)
YIYFVWTHYK

SEQ ID NO: 180049 - protein, 9 aa, Artificial Sequence
  Description of Artificial Sequence: Synthetic peptide
  Seed: YTYEIQWPS (TYRP1_HUMAN)
YHYEIQWPV

SEQ ID NO: 180050 - protein, 9 aa, Artificial Sequence
  Description of Artificial Sequence: Synthetic peptide
  Seed: MAKRTTHPL (TYRP1_HUMAN)
MAKRTTHPK

SEQ ID NO: 180051 - protein, 9 aa, Artificial Sequence
  Description of Artificial Sequence: Synthetic peptide
  Seed: MLQEPSFSL (TYRP1_HUMAN)
MIQEPSFSI

SEQ ID NO: 180052 - protein, 9 aa, Artificial Sequence
  Description of Artificial Sequence: Synthetic peptide
  Seed: RSLHNLAHL (TYRP1_HUMAN)
RQLHNLAHH

SEQ ID NO: 180053 - protein, 9 aa, Artificial Sequence
  Description of Artificial Sequence: Synthetic peptide
  Seed: GLFDTPPFY (TYRP1_HUMAN)
GNFDTPPFK

SEQ ID NO: 180054 - protein, 9 aa, Artificial Sequence
  Description of Artificial Sequence: Synthetic peptide
  Seed: SREFSVPEI (TYRP1_HUMAN)
SREFSVPEL

SEQ ID NO: 180055 - protein, 10 aa, Artificial Sequence
  Description of Artificial Sequence: Synthetic peptide
  Seed: LGPDGNTPQF (TYRP1_HUMAN)
LRPDGNTPQY

SEQ ID NO: 180056 - protein, 10 aa, Artificial Sequence
  Description of Artificial Sequence: Synthetic peptide
  Seed: SHEGPAFLTW (TYRP1_HUMAN)
SQEGPAFLTW

SEQ ID NO: 180057 - protein, 9 aa, Artificial Sequence
  Description of Artificial Sequence: Synthetic peptide
  Seed: SLGCIFFPL (TYRP1_HUMAN)
SMGCIFFPV

SEQ ID NO: 180058 - protein, 10 aa, Artificial Sequence
  Description of Artificial Sequence: Synthetic peptide
  Seed: NISIYNYFVW (TYRP1_HUMAN)
NESIYNYFVW

SEQ ID NO: 180059 - protein, 10 aa, Artificial Sequence
  Description of Artificial Sequence: Synthetic peptide
  Seed: TDAVFDEWLR (TYRP1_HUMAN)
TLAVFDEWLK

SEQ ID NO: 180060 - protein, 9 aa, Artificial Sequence
  Description of Artificial Sequence: Synthetic peptide
  Seed: SLHNLAHLF (TYRP1_HUMAN)
SFHNLAHLF

SEQ ID NO: 180061 - protein, 9 aa, Artificial Sequence
  Description of Artificial Sequence: Synthetic peptide
  Seed: SGHNCGTCR (TYRP1_HUMAN)
SVHNCGTCK

SEQ ID NO: 180062 - protein, 10 aa, Artificial Sequence
  Description of Artificial Sequence: Synthetic peptide
  Seed: FGTASYLIRA (TYRP1_HUMAN)
FYTASYLIRI

SEQ ID NO: 180063 - protein, 9 aa, Artificial Sequence
  Description of Artificial Sequence: Synthetic peptide
  Seed: YNYFVWTHY (TYRP1_HUMAN)
YMYFVWTHR

SEQ ID NO: 180064 - protein, 9 aa, Artificial Sequence
  Description of Artificial Sequence: Synthetic peptide
  Seed: NADISTFPL (TYRP1_HUMAN)
NHDISTFPL

SEQ ID NO: 180065 - protein, 9 aa, Artificial Sequence
  Description of Artificial Sequence: Synthetic peptide
  Seed: AACDQRVLI (TYRP1_HUMAN)
AACDQRVLL

SEQ ID NO: 180066 - protein, 9 aa, Artificial Sequence
  Description of Artificial Sequence: Synthetic peptide
  Seed: AVVGALLLV (TYRP1_HUMAN)
AQVGALLLL

SEQ ID NO: 180067 - protein, 9 aa, Artificial Sequence
  Description of Artificial Sequence: Synthetic peptide
  Seed: NADISTFPL (TYRP1_HUMAN)
NSDISTFPV

SEQ ID NO: 180068 - protein, 9 aa, Artificial Sequence
  Description of Artificial Sequence: Synthetic peptide
  Seed: HYYSVKKTF (TYRP1_HUMAN)
HSYSVKKTL

SEQ ID NO: 180069 - protein, 9 aa, Artificial Sequence
  Description of Artificial Sequence: Synthetic peptide
  Seed: IAIAVVGAL (TYRP1_HUMAN)
ISIAVVGAF

SEQ ID NO: 180070 - protein, 10 aa, Artificial Sequence
  Description of Artificial Sequence: Synthetic peptide
  Seed: FYSNSTNSFR (TYRP1_HUMAN)
FCSNSTNSFR

SEQ ID NO: 180071 - protein, 10 aa, Artificial Sequence
  Description of Artificial Sequence: Synthetic peptide
  Seed: RYNADISTFP (TYRP1_HUMAN)
RYNADISTFV

SEQ ID NO: 180072 - protein, 9 aa, Artificial Sequence
  Description of Artificial Sequence: Synthetic peptide
  Seed: RFFNRTCHC (TYRP1_HUMAN)
RLFNRTCHA

SEQ ID NO: 180073 - protein, 9 aa, Artificial Sequence
  Description of Artificial Sequence: Synthetic peptide
  Seed: WHRYHLLRL (TYRP1_HUMAN)
WLRYHLLRY

SEQ ID NO: 180074 - protein, 9 aa, Artificial Sequence
  Description of Artificial Sequence: Synthetic peptide
  Seed: ALLLVALIF (TYRP1_HUMAN)
AALLVALIW

SEQ ID NO: 180075 - protein, 9 aa, Artificial Sequence
  Description of Artificial Sequence: Synthetic peptide
  Seed: FSVPEIIAI (TYRP1_HUMAN)
FSVPEIIAL

SEQ ID NO: 180076 - protein, 10 aa, Artificial Sequence
  Description of Artificial Sequence: Synthetic peptide
  Seed: EMLQEPSFSL (TYRP1_HUMAN)
EYLQEPSFSM

SEQ ID NO: 180077 - protein, 9 aa, Artificial Sequence
  Description of Artificial Sequence: Synthetic peptide
  Seed: FSLPYWNFA (TYRP1_HUMAN)
FVLPYWNFF

SEQ ID NO: 180078 - protein, 9 aa, Artificial Sequence
  Description of Artificial Sequence: Synthetic peptide
  Seed: ISIYNYFVW (TYRP1_HUMAN)
IYIYNYFVV

SEQ ID NO: 180079 - protein, 9 aa, Artificial Sequence
  Description of Artificial Sequence: Synthetic peptide
  Seed: LLVALIFGT (TYRP1_HUMAN)
LAVALIFGA

SEQ ID NO: 180080 - protein, 9 aa, Artificial Sequence
  Description of Artificial Sequence: Synthetic peptide
  Seed: HEGPAFLTW (TYRP1_HUMAN)
HEGPAFLTP

SEQ ID NO: 180081 - protein, 9 aa, Artificial Sequence
  Description of Artificial Sequence: Synthetic peptide
  Seed: NYFVWTHYY (TYRP1_HUMAN)
NFFVWTHYL

SEQ ID NO: 180082 - protein, 11 aa, Artificial Sequence
  Description of Artificial Sequence: Synthetic peptide
  Seed: FWPPVTNTEMF (TYRP1_HUMAN)
FFPPVTNTEMW

SEQ ID NO: 180083 - protein, 11 aa, Artificial Sequence
  Description of Artificial Sequence: Synthetic peptide
  Seed: VTAPDNLGYTY (TYRP1_HUMAN)
VAAPDNLGYTF

SEQ ID NO: 180084 - protein, 10 aa, Artificial Sequence
  Description of Artificial Sequence: Synthetic peptide
  Seed: RRYNADISTF (TYRP1_HUMAN)
RAYNADISTL

SEQ ID NO: 180085 - protein, 9 aa, Artificial Sequence
  Description of Artificial Sequence: Synthetic peptide
  Seed: TLISPNSVF (TYRP1_HUMAN)
TTISPNSVW

SEQ ID NO: 180086 - protein, 9 aa, Artificial Sequence
  Description of Artificial Sequence: Synthetic peptide
  Seed: FLTWHRYHL (TYRP1_HUMAN)
FTTWHRYHM

SEQ ID NO: 180087 - protein, 9 aa, Artificial Sequence
  Description of Artificial Sequence: Synthetic peptide
  Seed: ASYLIRARR (TYRP1_HUMAN)
ANYLIRARR

SEQ ID NO: 180088 - protein, 9 aa, Artificial Sequence
  Description of Artificial Sequence: Synthetic peptide
  Seed: VARPMVQRL (TYRP1_HUMAN)
VYRPMVQRY

SEQ ID NO: 180089 - protein, 10 aa, Artificial Sequence
  Description of Artificial Sequence: Synthetic peptide
  Seed: LLFQQARAQF (TYRP1_HUMAN)
LKFQQARAQM

SEQ ID NO: 180090 - protein, 10 aa, Artificial Sequence
  Description of Artificial Sequence: Synthetic peptide
  Seed: MVPFWPPVTN (TYRP1_HUMAN)
MSPFWPPVTY

SEQ ID NO: 180091 - protein, 10 aa, Artificial Sequence
  Description of Artificial Sequence: Synthetic peptide
  Seed: FWPPVTNTEM (TYRP1_HUMAN)
FFPPVTNTEI

SEQ ID NO: 180092 - protein, 9 aa, Artificial Sequence
  Description of Artificial Sequence: Synthetic peptide
  Seed: LFDTPPFYS (TYRP1_HUMAN)
LWDTPPFYM

SEQ ID NO: 180093 - protein, 9 aa, Artificial Sequence
  Description of Artificial Sequence: Synthetic peptide
  Seed: NYFVWTHYY (TYRP1_HUMAN)
NTFVWTHYL

SEQ ID NO: 180094 - protein, 9 aa, Artificial Sequence
  Description of Artificial Sequence: Synthetic peptide
  Seed: YTYEIQWPS (TYRP1_HUMAN)
YVYEIQWPI

SEQ ID NO: 180095 - protein, 9 aa, Artificial Sequence
  Description of Artificial Sequence: Synthetic peptide
  Seed: YTYEIQWPS (TYRP1_HUMAN)
YMYEIQWPT

SEQ ID NO: 180096 - protein, 9 aa, Artificial Sequence
  Description of Artificial Sequence: Synthetic peptide
  Seed: GLFDTPPFY (TYRP1_HUMAN)
GLFDTPPFT

SEQ ID NO: 180097 - protein, 9 aa, Artificial Sequence
  Description of Artificial Sequence: Synthetic peptide
  Seed: DQRVLIVRR (TYRP1_HUMAN)
DTRVLIVRR

SEQ ID NO: 180098 - protein, 10 aa, Artificial Sequence
  Description of Artificial Sequence: Synthetic peptide
  Seed: TDAVFDEWLR (TYRP1_HUMAN)
TTAVFDEWLR

SEQ ID NO: 180099 - protein, 9 aa, Artificial Sequence
  Description of Artificial Sequence: Synthetic peptide
  Seed: KYDPAVRSL (TYRP1_HUMAN)
KNDPAVRSV

SEQ ID NO: 180100 - protein, 10 aa, Artificial Sequence
  Description of Artificial Sequence: Synthetic peptide
  Seed: MAKRTTHPLF (TYRP1_HUMAN)
MVKRTTHPLF

SEQ ID NO: 180101 - protein, 9 aa, Artificial Sequence
  Description of Artificial Sequence: Synthetic peptide
  Seed: AFLTWHRYH (TYRP1_HUMAN)
ALLTWHRYK

SEQ ID NO: 180102 - protein, 10 aa, Artificial Sequence
  Description of Artificial Sequence: Synthetic peptide
  Seed: RSMDEANQPL (TYRP1_HUMAN)
RCMDEANQPV

SEQ ID NO: 180103 - protein, 9 aa, Artificial Sequence
  Description of Artificial Sequence: Synthetic peptide
  Seed: LLSLGCIFF (TYRP1_HUMAN)
LYSLGCIFF

SEQ ID NO: 180104 - protein, 10 aa, Artificial Sequence
  Description of Artificial Sequence: Synthetic peptide
  Seed: LSPNDPIFVL (TYRP1_HUMAN)
LVPNDPIFVW

SEQ ID NO: 180105 - protein, 9 aa, Artificial Sequence
  Description of Artificial Sequence: Synthetic peptide
  Seed: TFPLENAPI (TYRP1_HUMAN)
TYPLENAPI

SEQ ID NO: 180106 - protein, 9 aa, Artificial Sequence
  Description of Artificial Sequence: Synthetic peptide
  Seed: RARRSMDEA (TYRP1_HUMAN)
RTRRSMDEG

SEQ ID NO: 180107 - protein, 11 aa, Artificial Sequence
  Description of Artificial Sequence: Synthetic peptide
  Seed: ILGPDGNTPQF (TYRP1_HUMAN)
IMGPDGNTPQW

SEQ ID NO: 180108 - protein, 10 aa, Artificial Sequence
  Description of Artificial Sequence: Synthetic peptide
  Seed: EIIAIAVVGA (TYRP1_HUMAN)
EQIAIAVVGV

SEQ ID NO: 180109 - protein, 9 aa, Artificial Sequence
  Description of Artificial Sequence: Synthetic peptide
  Seed: AACDQRVLI (TYRP1_HUMAN)
AACDQRVLM

SEQ ID NO: 180110 - protein, 10 aa, Artificial Sequence
  Description of Artificial Sequence: Synthetic peptide
  Seed: STLISPNSVF (TYRP1_HUMAN)
SVLISPNSVW

SEQ ID NO: 180111 - protein, 9 aa, Artificial Sequence
  Description of Artificial Sequence: Synthetic peptide
  Seed: SVFSQWRVV (TYRP1_HUMAN)
SAFSQWRVM

SEQ ID NO: 180112 - protein, 10 aa, Artificial Sequence
  Description of Artificial Sequence: Synthetic peptide
  Seed: THYYSVKKTF (TYRP1_HUMAN)
TQYYSVKKTM

SEQ ID NO: 180113 - protein, 9 aa, Artificial Sequence
  Description of Artificial Sequence: Synthetic peptide
  Seed: VLLHTFTDA (TYRP1_HUMAN)
VLLHTFTDI

SEQ ID NO: 180114 - protein, 9 aa, Artificial Sequence
  Description of Artificial Sequence: Synthetic peptide
  Seed: NSVFSQWRV (TYRP1_HUMAN)
NVVFSQWRI

SEQ ID NO: 180115 - protein, 8 aa, Artificial Sequence
  Description of Artificial Sequence: Synthetic peptide
  Seed: HTFTDAVF (TYRP1_HUMAN)
HMFTDAVY

SEQ ID NO: 180116 - protein, 10 aa, Artificial Sequence
  Description of Artificial Sequence: Synthetic peptide
  Seed: ISPNSVFSQW (TYRP1_HUMAN)
ISPNSVFSQY

SEQ ID NO: 180117 - protein, 10 aa, Artificial Sequence
  Description of Artificial Sequence: Synthetic peptide
  Seed: YSNSTNSFRN (TYRP1_HUMAN)
YANSTNSFRK

SEQ ID NO: 180118 - protein, 9 aa, Artificial Sequence
  Description of Artificial Sequence: Synthetic peptide
  Seed: AFLTWHRYH (TYRP1_HUMAN)
AILTWHRYR

SEQ ID NO: 180119 - protein, 10 aa, Artificial Sequence
  Description of Artificial Sequence: Synthetic peptide
  Seed: REFSVPEIIA (TYRP1_HUMAN)
REFSVPEIIP

SEQ ID NO: 180120 - protein, 9 aa, Artificial Sequence
  Description of Artificial Sequence: Synthetic peptide
  Seed: LHNLAHLFL (TYRP1_HUMAN)
LQNLAHLFF

SEQ ID NO: 180121 - protein, 9 aa, Artificial Sequence
  Description of Artificial Sequence: Synthetic peptide
  Seed: RTTHPLFVI (TYRP1_HUMAN)
RITHPLFVF

SEQ ID NO: 180122 - protein, 10 aa, Artificial Sequence
  Description of Artificial Sequence: Synthetic peptide
  Seed: FGTASYLIRA (TYRP1_HUMAN)
FMTASYLIRA

SEQ ID NO: 180123 - protein, 9 aa, Artificial Sequence
  Description of Artificial Sequence: Synthetic peptide
  Seed: RSLHNLAHL (TYRP1_HUMAN)
RSLHNLAHV

SEQ ID NO: 180124 - protein, 10 aa, Artificial Sequence
  Description of Artificial Sequence: Synthetic peptide
  Seed: SMDEANQPLL (TYRP1_HUMAN)
SWDEANQPLF

SEQ ID NO: 180125 - protein, 9 aa, Artificial Sequence
  Description of Artificial Sequence: Synthetic peptide
  Seed: SLHNLAHLF (TYRP1_HUMAN)
SWHNLAHLW

SEQ ID NO: 180126 - protein, 10 aa, Artificial Sequence
  Description of Artificial Sequence: Synthetic peptide
  Seed: ATVEALRSGM (TYRP1_HUMAN)
AMVEALRSGI

SEQ ID NO: 180127 - protein, 10 aa, Artificial Sequence
  Description of Artificial Sequence: Synthetic peptide
  Seed: ISIYNYFVWT (TYRP1_HUMAN)
ITIYNYFVWW

SEQ ID NO: 180128 - protein, 10 aa, Artificial Sequence
  Description of Artificial Sequence: Synthetic peptide
  Seed: LLVALIFGTA (TYRP1_HUMAN)
LMVALIFGTA

SEQ ID NO: 180129 - protein, 10 aa, Artificial Sequence
  Description of Artificial Sequence: Synthetic peptide
  Seed: RSMDEANQPL (TYRP1_HUMAN)
RTMDEANQPW

SEQ ID NO: 180130 - protein, 9 aa, Artificial Sequence
  Description of Artificial Sequence: Synthetic peptide
  Seed: WHRYHLLRL (TYRP1_HUMAN)
WYRYHLLRY

SEQ ID NO: 180131 - protein, 9 aa, Artificial Sequence
  Description of Artificial Sequence: Synthetic peptide
  Seed: LGCIFFPLL (TYRP1_HUMAN)
LSCIFFPLW

SEQ ID NO: 180132 - protein, 9 aa, Artificial Sequence
  Description of Artificial Sequence: Synthetic peptide
  Seed: SFSLPYWNF (TYRP1_HUMAN)
SYSLPYWNF

SEQ ID NO: 180133 - protein, 9 aa, Artificial Sequence
  Description of Artificial Sequence: Synthetic peptide
  Seed: IAIAVVGAL (TYRP1_HUMAN)
IWIAVVGAM

SEQ ID NO: 180134 - protein, 9 aa, Artificial Sequence
  Description of Artificial Sequence: Synthetic peptide
  Seed: FVWTHYYSV (TYRP1_HUMAN)
FQWTHYYSC

SEQ ID NO: 180135 - protein, 9 aa, Artificial Sequence
  Description of Artificial Sequence: Synthetic peptide
  Seed: YSNSTNSFR (TYRP1_HUMAN)
YTNSTNSFL

SEQ ID NO: 180136 - protein, 9 aa, Artificial Sequence
  Description of Artificial Sequence: Synthetic peptide
  Seed: IAIAVVGAL (TYRP1_HUMAN)
IAIAVVGAW

SEQ ID NO: 180137 - protein, 9 aa, Artificial Sequence
  Description of Artificial Sequence: Synthetic peptide
  Seed: RSLHNLAHL (TYRP1_HUMAN)
RALHNLAHY

SEQ ID NO: 180138 - protein, 9 aa, Artificial Sequence
  Description of Artificial Sequence: Synthetic peptide
  Seed: PIFVLLHTF (TYRP1_HUMAN)
PYFVLLHTF

SEQ ID NO: 180139 - protein, 9 aa, Artificial Sequence
  Description of Artificial Sequence: Synthetic peptide
  Seed: CIFFPLLLF (TYRP1_HUMAN)
CWFFPLLLY

SEQ ID NO: 180140 - protein, 10 aa, Artificial Sequence
  Description of Artificial Sequence: Synthetic peptide
  Seed: YNYFVWTHYY (TYRP1_HUMAN)
YEYFVWTHYV

SEQ ID NO: 180141 - protein, 9 aa, Artificial Sequence
  Description of Artificial Sequence: Synthetic peptide
  Seed: LFQQARAQF (TYRP1_HUMAN)
LIQQARAQY

SEQ ID NO: 180142 - protein, 9 aa, Artificial Sequence
  Description of Artificial Sequence: Synthetic peptide
  Seed: CIFFPLLLF (TYRP1_HUMAN)
CVFFPLLLW

SEQ ID NO: 180143 - protein, 9 aa, Artificial Sequence
  Description of Artificial Sequence: Synthetic peptide
  Seed: RQCATVEAL (TYRP1_HUMAN)
RLCATVEAI

SEQ ID NO: 180144 - protein, 9 aa, Artificial Sequence
  Description of Artificial Sequence: Synthetic peptide
  Seed: YSNSTNSFR (TYRP1_HUMAN)
YANSTNSFI

SEQ ID NO: 180145 - protein, 9 aa, Artificial Sequence
  Description of Artificial Sequence: Synthetic peptide
  Seed: SPNSVFSQW (TYRP1_HUMAN)
SPNSVFSQM

SEQ ID NO: 180146 - protein, 10 aa, Artificial Sequence
  Description of Artificial Sequence: Synthetic peptide
  Seed: EGYSDPTGKY (TYRP1_HUMAN)
EIYSDPTGKY

SEQ ID NO: 180147 - protein, 9 aa, Artificial Sequence
  Description of Artificial Sequence: Synthetic peptide
  Seed: IAVVGALLL (TYRP1_HUMAN)
IMVVGALLV

SEQ ID NO: 180148 - protein, 10 aa, Artificial Sequence
  Description of Artificial Sequence: Synthetic peptide
  Seed: IIAIAVVGAL (TYRP1_HUMAN)
ILAIAVVGAL

SEQ ID NO: 180149 - protein, 9 aa, Artificial Sequence
  Description of Artificial Sequence: Synthetic peptide
  Seed: NYFVWTHYY (TYRP1_HUMAN)
NIFVWTHYR

SEQ ID NO: 180150 - protein, 10 aa, Artificial Sequence
  Description of Artificial Sequence: Synthetic peptide
  Seed: STFPLENAPI (TYRP1_HUMAN)
SMFPLENAPL

SEQ ID NO: 180151 - protein, 9 aa, Artificial Sequence
  Description of Artificial Sequence: Synthetic peptide
  Seed: ENISIYNYF (TYRP1_HUMAN)
EVISIYNYY

SEQ ID NO: 180152 - protein, 10 aa, Artificial Sequence
  Description of Artificial Sequence: Synthetic peptide
  Seed: LSLGCIFFPL (TYRP1_HUMAN)
LWLGCIFFPV

SEQ ID NO: 180153 - protein, 9 aa, Artificial Sequence
  Description of Artificial Sequence: Synthetic peptide
  Seed: KLLSLGCIF (TYRP1_HUMAN)
KSLSLGCIF

SEQ ID NO: 180154 - protein, 9 aa, Artificial Sequence
  Description of Artificial Sequence: Synthetic peptide
  Seed: LTWHRYHLL (TYRP1_HUMAN)
LFWHRYHLY

SEQ ID NO: 180155 - protein, 11 aa, Artificial Sequence
  Description of Artificial Sequence: Synthetic peptide
  Seed: HLSPNDPIFVL (TYRP1_HUMAN)
HSSPNDPIFVY

SEQ ID NO: 180156 - protein, 9 aa, Artificial Sequence
  Description of Artificial Sequence: Synthetic peptide
  Seed: FSVPEIIAI (TYRP1_HUMAN)
FLVPEIIAM

SEQ ID NO: 180157 - protein, 9 aa, Artificial Sequence
  Description of Artificial Sequence: Synthetic peptide
  Seed: EPSFSLPYW (TYRP1_HUMAN)
EASFSLPYW

SEQ ID NO: 180158 - protein, 9 aa, Artificial Sequence
  Description of Artificial Sequence: Synthetic peptide
  Seed: FYSNSTNSF (TYRP1_HUMAN)
FVSNSTNSI

SEQ ID NO: 180159 - protein, 10 aa, Artificial Sequence
  Description of Artificial Sequence: Synthetic peptide
  Seed: EGPAFLTWHR (TYRP1_HUMAN)
ETPAFLTWHR

SEQ ID NO: 180160 - protein, 9 aa, Artificial Sequence
  Description of Artificial Sequence: Synthetic peptide
  Seed: VARPMVQRL (TYRP1_HUMAN)
VLRPMVQRK

SEQ ID NO: 180161 - protein, 9 aa, Artificial Sequence
  Description of Artificial Sequence: Synthetic peptide
  Seed: ISIYNYFVW (TYRP1_HUMAN)
IVIYNYFVM

SEQ ID NO: 180162 - protein, 9 aa, Artificial Sequence
  Description of Artificial Sequence: Synthetic peptide
  Seed: IAVVGALLL (TYRP1_HUMAN)
IMVVGALLL

SEQ ID NO: 180163 - protein, 9 aa, Artificial Sequence
  Description of Artificial Sequence: Synthetic peptide
  Seed: AVVGALLLV (TYRP1_HUMAN)
ASVGALLLV

SEQ ID NO: 180164 - protein, 9 aa, Artificial Sequence
  Description of Artificial Sequence: Synthetic peptide
  Seed: IVRRNLLDL (TYRP1_HUMAN)
ISRRNLLDK

SEQ ID NO: 180165 - protein, 10 aa, Artificial Sequence
  Description of Artificial Sequence: Synthetic peptide
  Seed: RYNADISTFP (TYRP1_HUMAN)
RFNADISTFW

SEQ ID NO: 180166 - protein, 10 aa, Artificial Sequence
  Description of Artificial Sequence: Synthetic peptide
  Seed: ALIFGTASYL (TYRP1_HUMAN)
AIIFGTASYR

SEQ ID NO: 180167 - protein, 9 aa, Artificial Sequence
  Description of Artificial Sequence: Synthetic peptide
  Seed: RQYNMVPFW (TYRP1_HUMAN)
RQYNMVPFF

SEQ ID NO: 180168 - protein, 10 aa, Artificial Sequence
  Description of Artificial Sequence: Synthetic peptide
  Seed: RSMDEANQPL (TYRP1_HUMAN)
RWMDEANQPV

SEQ ID NO: 180169 - protein, 9 aa, Artificial Sequence
  Description of Artificial Sequence: Synthetic peptide
  Seed: SVKKTFLGV (TYRP1_HUMAN)
SVKKTFLGM

SEQ ID NO: 180170 - protein, 9 aa, Artificial Sequence
  Description of Artificial Sequence: Synthetic peptide
  Seed: APDNLGYTY (TYRP1_HUMAN)
ATDNLGYTM

SEQ ID NO: 180171 - protein, 9 aa, Artificial Sequence
  Description of Artificial Sequence: Synthetic peptide
  Seed: SMDEANQPL (TYRP1_HUMAN)
SEDEANQPM

SEQ ID NO: 180172 - protein, 10 aa, Artificial Sequence
  Description of Artificial Sequence: Synthetic peptide
  Seed: FVWTHYYSVK (TYRP1_HUMAN)
FLWTHYYSVT

SEQ ID NO: 180173 - protein, 9 aa, Artificial Sequence
  Description of Artificial Sequence: Synthetic peptide
  Seed: NFDSTLISP (TYRP1_HUMAN)
NFDSTLISI

SEQ ID NO: 180174 - protein, 9 aa, Artificial Sequence
  Description of Artificial Sequence: Synthetic peptide
  Seed: PNDPIFVLL (TYRP1_HUMAN)
PLDPIFVLL

SEQ ID NO: 180175 - protein, 11 aa, Artificial Sequence
  Description of Artificial Sequence: Synthetic peptide
  Seed: MLQEPSFSLPY (TYRP1_HUMAN)
MPQEPSFSLPY

SEQ ID NO: 180176 - protein, 9 aa, Artificial Sequence
  Description of Artificial Sequence: Synthetic peptide
  Seed: SLPYWNFAT (TYRP1_HUMAN)
SAPYWNFAV

SEQ ID NO: 180177 - protein, 9 aa, Artificial Sequence
  Description of Artificial Sequence: Synthetic peptide
  Seed: RVLIVRRNL (TYRP1_HUMAN)
RMLIVRRNY

SEQ ID NO: 180178 - protein, 11 aa, Artificial Sequence
  Description of Artificial Sequence: Synthetic peptide
  Seed: MFVTAPDNLGY (TYRP1_HUMAN)
MMVTAPDNLGF

SEQ ID NO: 180179 - protein, 9 aa, Artificial Sequence
  Description of Artificial Sequence: Synthetic peptide
  Seed: RTTHPLFVI (TYRP1_HUMAN)
RLTHPLFVL

SEQ ID NO: 180180 - protein, 10 aa, Artificial Sequence
  Description of Artificial Sequence: Synthetic peptide
  Seed: HSPQYPHDGR (TYRP1_HUMAN)
HTPQYPHDGR

SEQ ID NO: 180181 - protein, 11 aa, Artificial Sequence
  Description of Artificial Sequence: Synthetic peptide
  Seed: ALIFGTASYLI (TYRP1_HUMAN)
ALIFGTASYLV

SEQ ID NO: 180182 - protein, 10 aa, Artificial Sequence
  Description of Artificial Sequence: Synthetic peptide
  Seed: SPNDPIFVLL (TYRP1_HUMAN)
STNDPIFVLY

SEQ ID NO: 180183 - protein, 9 aa, Artificial Sequence
  Description of Artificial Sequence: Synthetic peptide
  Seed: VDFSHEGPA (TYRP1_HUMAN)
VEFSHEGPA

SEQ ID NO: 180184 - protein, 9 aa, Artificial Sequence
  Description of Artificial Sequence: Synthetic peptide
  Seed: SPNSVFSQW (TYRP1_HUMAN)
SANSVFSQW

SEQ ID NO: 180185 - protein, 9 aa, Artificial Sequence
  Description of Artificial Sequence: Synthetic peptide
  Seed: MSAPKLLSL (TYRP1_HUMAN)
MTAPKLLSF

SEQ ID NO: 180186 - protein, 9 aa, Artificial Sequence
  Description of Artificial Sequence: Synthetic peptide
  Seed: FVWTHYYSV (TYRP1_HUMAN)
FIWTHYYSS

SEQ ID NO: 180187 - protein, 9 aa, Artificial Sequence
  Description of Artificial Sequence: Synthetic peptide
  Seed: RTTHPLFVI (TYRP1_HUMAN)
RTTHPLFVW

SEQ ID NO: 180188 - protein, 10 aa, Artificial Sequence
  Description of Artificial Sequence: Synthetic peptide
  Seed: YFVWTHYYSV (TYRP1_HUMAN)
YTVWTHYYSA

SEQ ID NO: 180189 - protein, 11 aa, Artificial Sequence
  Description of Artificial Sequence: Synthetic peptide
  Seed: YNYFVWTHYYS (TYRP1_HUMAN)
YYYFVWTHYYL

SEQ ID NO: 180190 - protein, 9 aa, Artificial Sequence
  Description of Artificial Sequence: Synthetic peptide
  Seed: RQYNMVPFW (TYRP1_HUMAN)
REYNMVPFW

SEQ ID NO: 180191 - protein, 9 aa, Artificial Sequence
  Description of Artificial Sequence: Synthetic peptide
  Seed: STLISPNSV (TYRP1_HUMAN)
SILISPNSY

SEQ ID NO: 180192 - protein, 9 aa, Artificial Sequence
  Description of Artificial Sequence: Synthetic peptide
  Seed: NYFVWTHYY (TYRP1_HUMAN)
NSFVWTHYL

SEQ ID NO: 180193 - protein, 9 aa, Artificial Sequence
  Description of Artificial Sequence: Synthetic peptide
  Seed: DLMGSRSNF (TYRP1_HUMAN)
DMMGSRSNY

SEQ ID NO: 180194 - protein, 9 aa, Artificial Sequence
  Description of Artificial Sequence: Synthetic peptide
  Seed: LPEPQDVAQ (TYRP1_HUMAN)
LPEPQDVAM

SEQ ID NO: 180195 - protein, 11 aa, Artificial Sequence
  Description of Artificial Sequence: Synthetic peptide
  Seed: RSMDEANQPLL (TYRP1_HUMAN)
RQMDEANQPLY

SEQ ID NO: 180196 - protein, 10 aa, Artificial Sequence
  Description of Artificial Sequence: Synthetic peptide
  Seed: RPMVQRLPEP (TYRP1_HUMAN)
RPMVQRLPEV

SEQ ID NO: 180197 - protein, 10 aa, Artificial Sequence
  Description of Artificial Sequence: Synthetic peptide
  Seed: THPLFVIATR (TYRP1_HUMAN)
TAPLFVIATR

SEQ ID NO: 180198 - protein, 10 aa, Artificial Sequence
  Description of Artificial Sequence: Synthetic peptide
  Seed: IQWPSREFSV (TYRP1_HUMAN)
IMWPSREFSI

SEQ ID NO: 180199 - protein, 10 aa, Artificial Sequence
  Description of Artificial Sequence: Synthetic peptide
  Seed: YNYFVWTHYY (TYRP1_HUMAN)
YLYFVWTHYV

SEQ ID NO: 180200 - protein, 9 aa, Artificial Sequence
  Description of Artificial Sequence: Synthetic peptide
  Seed: IYNYFVWTH (TYRP1_HUMAN)
ISNYFVWTK

SEQ ID NO: 180201 - protein, 11 aa, Artificial Sequence
  Description of Artificial Sequence: Synthetic peptide
  Seed: ILGPDGNTPQF (TYRP1_HUMAN)
IAGPDGNTPQM

SEQ ID NO: 180202 - protein, 10 aa, Artificial Sequence
  Description of Artificial Sequence: Synthetic peptide
  Seed: EIIAIAVVGA (TYRP1_HUMAN)
EPIAIAVVGV

SEQ ID NO: 180203 - protein, 11 aa, Artificial Sequence
  Description of Artificial Sequence: Synthetic peptide
  Seed: VTAPDNLGYTY (TYRP1_HUMAN)
VVAPDNLGYTR

SEQ ID NO: 180204 - protein, 10 aa, Artificial Sequence
  Description of Artificial Sequence: Synthetic peptide
  Seed: ENISIYNYFV (TYRP1_HUMAN)
EVISIYNYFV

SEQ ID NO: 180205 - protein, 9 aa, Artificial Sequence
  Description of Artificial Sequence: Synthetic peptide
  Seed: GYSDPTGKY (TYRP1_HUMAN)
GVSDPTGKY

SEQ ID NO: 180206 - protein, 10 aa, Artificial Sequence
  Description of Artificial Sequence: Synthetic peptide
  Seed: AVVGALLLVA (TYRP1_HUMAN)
ALVGALLLVA

SEQ ID NO: 180207 - protein, 10 aa, Artificial Sequence
  Description of Artificial Sequence: Synthetic peptide
  Seed: EMLQEPSFSL (TYRP1_HUMAN)
EKLQEPSFSV

SEQ ID NO: 180208 - protein, 9 aa, Artificial Sequence
  Description of Artificial Sequence: Synthetic peptide
  Seed: RSLHNLAHL (TYRP1_HUMAN)
RILHNLAHA

SEQ ID NO: 180209 - protein, 10 aa, Artificial Sequence
  Description of Artificial Sequence: Synthetic peptide
  Seed: FSVPEIIAIA (TYRP1_HUMAN)
FKVPEIIAIV

SEQ ID NO: 180210 - protein, 9 aa, Artificial Sequence
  Description of Artificial Sequence: Synthetic peptide
  Seed: TLISPNSVF (TYRP1_HUMAN)
TSISPNSVM

SEQ ID NO: 180211 - protein, 9 aa, Artificial Sequence
  Description of Artificial Sequence: Synthetic peptide
  Seed: FSVPEIIAI (TYRP1_HUMAN)
FAVPEIIAW

SEQ ID NO: 180212 - protein, 9 aa, Artificial Sequence
  Description of Artificial Sequence: Synthetic peptide
  Seed: NYFVWTHYY (TYRP1_HUMAN)
NCFVWTHYR

SEQ ID NO: 180213 - protein, 9 aa, Artificial Sequence
  Description of Artificial Sequence: Synthetic peptide
  Seed: RARRSMDEA (TYRP1_HUMAN)
RTRRSMDER

SEQ ID NO: 180214 - protein, 9 aa, Artificial Sequence
  Description of Artificial Sequence: Synthetic peptide
  Seed: RARRSMDEA (TYRP1_HUMAN)
RWRRSMDEK

SEQ ID NO: 180215 - protein, 9 aa, Artificial Sequence
  Description of Artificial Sequence: Synthetic peptide
  Seed: YNYFVWTHY (TYRP1_HUMAN)
YTYFVWTHM

SEQ ID NO: 180216 - protein, 10 aa, Artificial Sequence
  Description of Artificial Sequence: Synthetic peptide
  Seed: FYSNSTNSFR (TYRP1_HUMAN)
FSSNSTNSFK

SEQ ID NO: 180217 - protein, 9 aa, Artificial Sequence
  Description of Artificial Sequence: Synthetic peptide
  Seed: MCCPDLSPV (TYRP1_HUMAN)
MTCPDLSPA

SEQ ID NO: 180218 - protein, 9 aa, Artificial Sequence
  Description of Artificial Sequence: Synthetic peptide
  Seed: NYFVWTHYY (TYRP1_HUMAN)
NTFVWTHYY

SEQ ID NO: 180219 - protein, 10 aa, Artificial Sequence
  Description of Artificial Sequence: Synthetic peptide
  Seed: MAKRTTHPLF (TYRP1_HUMAN)
MKKRTTHPLY

SEQ ID NO: 180220 - protein, 9 aa, Artificial Sequence
  Description of Artificial Sequence: Synthetic peptide
  Seed: NISIYNYFV (TYRP1_HUMAN)
NLSIYNYFV

SEQ ID NO: 180221 - protein, 10 aa, Artificial Sequence
  Description of Artificial Sequence: Synthetic peptide
  Seed: PAVRSLHNLA (TYRP1_HUMAN)
PRVRSLHNLV

SEQ ID NO: 180222 - protein, 9 aa, Artificial Sequence
  Description of Artificial Sequence: Synthetic peptide
  Seed: YNYFVWTHY (TYRP1_HUMAN)
YHYFVWTHM

SEQ ID NO: 180223 - protein, 9 aa, Artificial Sequence
  Description of Artificial Sequence: Synthetic peptide
  Seed: RFFNRTCHC (TYRP1_HUMAN)
RWFNRTCHY

SEQ ID NO: 180224 - protein, 9 aa, Artificial Sequence
  Description of Artificial Sequence: Synthetic peptide
  Seed: SMDEANQPL (TYRP1_HUMAN)
SGDEANQPV

SEQ ID NO: 180225 - protein, 9 aa, Artificial Sequence
  Description of Artificial Sequence: Synthetic peptide
  Seed: FTDAVFDEW (TYRP1_HUMAN)
FMDAVFDEV

SEQ ID NO: 180226 - protein, 10 aa, Artificial Sequence
  Description of Artificial Sequence: Synthetic peptide
  Seed: FGTASYLIRA (TYRP1_HUMAN)
FNTASYLIRV

SEQ ID NO: 180227 - protein, 8 aa, Artificial Sequence
  Description of Artificial Sequence: Synthetic peptide
  Seed: YSVKKTFL (TYRP1_HUMAN)
YAVKKTFM

SEQ ID NO: 180228 - protein, 9 aa, Artificial Sequence
  Description of Artificial Sequence: Synthetic peptide
  Seed: MFVTAPDNL (TYRP1_HUMAN)
MFVTAPDNF

SEQ ID NO: 180229 - protein, 10 aa, Artificial Sequence
  Description of Artificial Sequence: Synthetic peptide
  Seed: VDFSHEGPAF (TYRP1_HUMAN)
VQFSHEGPAM

SEQ ID NO: 180230 - protein, 9 aa, Artificial Sequence
  Description of Artificial Sequence: Synthetic peptide
  Seed: NYFVWTHYY (TYRP1_HUMAN)
NYFVWTHYV

SEQ ID NO: 180231 - protein, 9 aa, Artificial Sequence
  Description of Artificial Sequence: Synthetic peptide
  Seed: YTYEIQWPS (TYRP1_HUMAN)
YSYEIQWPV

SEQ ID NO: 180232 - protein, 9 aa, Artificial Sequence
  Description of Artificial Sequence: Synthetic peptide
  Seed: VFDEWLRRY (TYRP1_HUMAN)
VLDEWLRRM

SEQ ID NO: 180233 - protein, 9 aa, Artificial Sequence
  Description of Artificial Sequence: Synthetic peptide
  Seed: SVFSQWRVV (TYRP1_HUMAN)
SSFSQWRVV

SEQ ID NO: 180234 - protein, 11 aa, Artificial Sequence
  Description of Artificial Sequence: Synthetic peptide
  Seed: VTAPDNLGYTY (TYRP1_HUMAN)
VVAPDNLGYTK

SEQ ID NO: 180235 - protein, 9 aa, Artificial Sequence
  Description of Artificial Sequence: Synthetic peptide
  Seed: KLQNPNQSV (TYRP1_HUMAN)
KSQNPNQSK

SEQ ID NO: 180236 - protein, 10 aa, Artificial Sequence
  Description of Artificial Sequence: Synthetic peptide
  Seed: MSAPKLLSLG (TYRP1_HUMAN)
MCAPKLLSLW

SEQ ID NO: 180237 - protein, 9 aa, Artificial Sequence
  Description of Artificial Sequence: Synthetic peptide
  Seed: FENISIYNY (TYRP1_HUMAN)
FQNISIYNY

SEQ ID NO: 180238 - protein, 9 aa, Artificial Sequence
  Description of Artificial Sequence: Synthetic peptide
  Seed: DLMGSRSNF (TYRP1_HUMAN)
DLMGSRSNR

SEQ ID NO: 180239 - protein, 11 aa, Artificial Sequence
  Description of Artificial Sequence: Synthetic peptide
  Seed: FLNGTGGQTHL (TYRP1_HUMAN)
FMNGTGGQTHF

SEQ ID NO: 180240 - protein, 9 aa, Artificial Sequence
  Description of Artificial Sequence: Synthetic peptide
  Seed: YTYEIQWPS (TYRP1_HUMAN)
YRYEIQWPL

SEQ ID NO: 180241 - protein, 9 aa, Artificial Sequence
  Description of Artificial Sequence: Synthetic peptide
  Seed: TADSRPHSP (TYRP1_HUMAN)
TVDSRPHSL

SEQ ID NO: 180242 - protein, 9 aa, Artificial Sequence
  Description of Artificial Sequence: Synthetic peptide
  Seed: RSLHNLAHL (TYRP1_HUMAN)
RNLHNLAHK

SEQ ID NO: 180243 - protein, 9 aa, Artificial Sequence
  Description of Artificial Sequence: Synthetic peptide
  Seed: SMDEANQPL (TYRP1_HUMAN)
SHDEANQPF

SEQ ID NO: 180244 - protein, 8 aa, Artificial Sequence
  Description of Artificial Sequence: Synthetic peptide
  Seed: YSNSTNSF (TYRP1_HUMAN)
YYNSTNSV

SEQ ID NO: 180245 - protein, 9 aa, Artificial Sequence
  Description of Artificial Sequence: Synthetic peptide
  Seed: CYAEEYEKL (TYRP1_HUMAN)
CYAEEYEKM

SEQ ID NO: 180246 - protein, 9 aa, Artificial Sequence
  Description of Artificial Sequence: Synthetic peptide
  Seed: RTTHPLFVI (TYRP1_HUMAN)
RVTHPLFVF

SEQ ID NO: 180247 - protein, 9 aa, Artificial Sequence
  Description of Artificial Sequence: Synthetic peptide
  Seed: VARPMVQRL (TYRP1_HUMAN)
VQRPMVQRL

SEQ ID NO: 180248 - protein, 9 aa, Artificial Sequence
  Description of Artificial Sequence: Synthetic peptide
  Seed: MSAPKLLSL (TYRP1_HUMAN)
MVAPKLLSF

SEQ ID NO: 180249 - protein, 9 aa, Artificial Sequence
  Description of Artificial Sequence: Synthetic peptide
  Seed: QCYAEEYEK (TYRP1_HUMAN)
QTYAEEYEK

SEQ ID NO: 180250 - protein, 9 aa, Artificial Sequence
  Description of Artificial Sequence: Synthetic peptide
  Seed: YLIRARRSM (TYRP1_HUMAN)
YWIRARRSF

SEQ ID NO: 180251 - protein, 9 aa, Artificial Sequence
  Description of Artificial Sequence: Synthetic peptide
  Seed: EGYSDPTGK (TYRP1_HUMAN)
ELYSDPTGR

SEQ ID NO: 180252 - protein, 9 aa, Artificial Sequence
  Description of Artificial Sequence: Synthetic peptide
  Seed: VARPMVQRL (TYRP1_HUMAN)
VMRPMVQRY

SEQ ID NO: 180253 - protein, 9 aa, Artificial Sequence
  Description of Artificial Sequence: Synthetic peptide
  Seed: MAKRTTHPL (TYRP1_HUMAN)
MPKRTTHPY

SEQ ID NO: 180254 - protein, 9 aa, Artificial Sequence
  Description of Artificial Sequence: Synthetic peptide
  Seed: MLQEPSFSL (TYRP1_HUMAN)
MEQEPSFSF

SEQ ID NO: 180255 - protein, 9 aa, Artificial Sequence
  Description of Artificial Sequence: Synthetic peptide
  Seed: ACDQRVLIV (TYRP1_HUMAN)
AYDQRVLIM

SEQ ID NO: 180256 - protein, 9 aa, Artificial Sequence
  Description of Artificial Sequence: Synthetic peptide
  Seed: SLHNLAHLF (TYRP1_HUMAN)
SEHNLAHLY

SEQ ID NO: 180257 - protein, 9 aa, Artificial Sequence
  Description of Artificial Sequence: Synthetic peptide
  Seed: FLTWHRYHL (TYRP1_HUMAN)
FFTWHRYHL

SEQ ID NO: 180258 - protein, 9 aa, Artificial Sequence
  Description of Artificial Sequence: Synthetic peptide
  Seed: SPNDPIFVL (TYRP1_HUMAN)
STNDPIFVF

SEQ ID NO: 180259 - protein, 10 aa, Artificial Sequence
  Description of Artificial Sequence: Synthetic peptide
  Seed: FSLPYWNFAT (TYRP1_HUMAN)
FHLPYWNFAL

SEQ ID NO: 180260 - protein, 10 aa, Artificial Sequence
  Description of Artificial Sequence: Synthetic peptide
  Seed: FVTAPDNLGY (TYRP1_HUMAN)
FHTAPDNLGF

SEQ ID NO: 180261 - protein, 9 aa, Artificial Sequence
  Description of Artificial Sequence: Synthetic peptide
  Seed: NMVPFWPPV (TYRP1_HUMAN)
NTVPFWPPT

SEQ ID NO: 180262 - protein, 10 aa, Artificial Sequence
  Description of Artificial Sequence: Synthetic peptide
  Seed: RVVCDSLEDY (TYRP1_HUMAN)
RQVCDSLEDF

SEQ ID NO: 180263 - protein, 9 aa, Artificial Sequence
  Description of Artificial Sequence: Synthetic peptide
  Seed: STLISPNSV (TYRP1_HUMAN)
SALISPNSV

SEQ ID NO: 180264 - protein, 9 aa, Artificial Sequence
  Description of Artificial Sequence: Synthetic peptide
  Seed: RTTHPLFVI (TYRP1_HUMAN)
RWTHPLFVY

SEQ ID NO: 180265 - protein, 9 aa, Artificial Sequence
  Description of Artificial Sequence: Synthetic peptide
  Seed: MSAPKLLSL (TYRP1_HUMAN)
MNAPKLLSK

SEQ ID NO: 180266 - protein, 11 aa, Artificial Sequence
  Description of Artificial Sequence: Synthetic peptide
  Seed: FWPPVTNTEMF (TYRP1_HUMAN)
FHPPVTNTEMY

SEQ ID NO: 180267 - protein, 9 aa, Artificial Sequence
  Description of Artificial Sequence: Synthetic peptide
  Seed: SVKKTFLGV (TYRP1_HUMAN)
STKKTFLGL

SEQ ID NO: 180268 - protein, 9 aa, Artificial Sequence
  Description of Artificial Sequence: Synthetic peptide
  Seed: SLHNLAHLF (TYRP1_HUMAN)
SYHNLAHLV

SEQ ID NO: 180269 - protein, 9 aa, Artificial Sequence
  Description of Artificial Sequence: Synthetic peptide
  Seed: DSRPHSPQY (TYRP1_HUMAN)
DLRPHSPQY

SEQ ID NO: 180270 - protein, 9 aa, Artificial Sequence
  Description of Artificial Sequence: Synthetic peptide
  Seed: AVRSLHNLA (TYRP1_HUMAN)
ALRSLHNLK

SEQ ID NO: 180271 - protein, 10 aa, Artificial Sequence
  Description of Artificial Sequence: Synthetic peptide
  Seed: FSLPYWNFAT (TYRP1_HUMAN)
FMLPYWNFAM

SEQ ID NO: 180272 - protein, 11 aa, Artificial Sequence
  Description of Artificial Sequence: Synthetic peptide
  Seed: AIAVVGALLLV (TYRP1_HUMAN)
AQAVVGALLLV

SEQ ID NO: 180273 - protein, 10 aa, Artificial Sequence
  Description of Artificial Sequence: Synthetic peptide
  Seed: ISPNSVFSQW (TYRP1_HUMAN)
ITPNSVFSQW

SEQ ID NO: 180274 - protein, 10 aa, Artificial Sequence
  Description of Artificial Sequence: Synthetic peptide
  Seed: YNYFVWTHYY (TYRP1_HUMAN)
YMYFVWTHYF

SEQ ID NO: 180275 - protein, 9 aa, Artificial Sequence
  Description of Artificial Sequence: Synthetic peptide
  Seed: YTYEIQWPS (TYRP1_HUMAN)
YQYEIQWPG

SEQ ID NO: 180276 - protein, 10 aa, Artificial Sequence
  Description of Artificial Sequence: Synthetic peptide
  Seed: LGPDGNTPQF (TYRP1_HUMAN)
LMPDGNTPQM

SEQ ID NO: 180277 - protein, 9 aa, Artificial Sequence
  Description of Artificial Sequence: Synthetic peptide
  Seed: ACDQRVLIV (TYRP1_HUMAN)
AMDQRVLII

SEQ ID NO: 180278 - protein, 9 aa, Artificial Sequence
  Description of Artificial Sequence: Synthetic peptide
  Seed: NSVFSQWRV (TYRP1_HUMAN)
NTVFSQWRA

SEQ ID NO: 180279 - protein, 9 aa, Artificial Sequence
  Description of Artificial Sequence: Synthetic peptide
  Seed: HEGPAFLTW (TYRP1_HUMAN)
HKGPAFLTF

SEQ ID NO: 180280 - protein, 10 aa, Artificial Sequence
  Description of Artificial Sequence: Synthetic peptide
  Seed: YFVWTHYYSV (TYRP1_HUMAN)
YPVWTHYYSV

SEQ ID NO: 180281 - protein, 9 aa, Artificial Sequence
  Description of Artificial Sequence: Synthetic peptide
  Seed: ISIYNYFVW (TYRP1_HUMAN)
ILIYNYFVY

SEQ ID NO: 180282 - protein, 9 aa, Artificial Sequence
  Description of Artificial Sequence: Synthetic peptide
  Seed: AVVGALLLV (TYRP1_HUMAN)
AAVGALLLH

SEQ ID NO: 180283 - protein, 10 aa, Artificial Sequence
  Description of Artificial Sequence: Synthetic peptide
  Seed: FYSNSTNSFR (TYRP1_HUMAN)
FFSNSTNSFM

SEQ ID NO: 180284 - protein, 10 aa, Artificial Sequence
  Description of Artificial Sequence: Synthetic peptide
  Seed: YFVWTHYYSV (TYRP1_HUMAN)
YQVWTHYYSF

SEQ ID NO: 180285 - protein, 9 aa, Artificial Sequence
  Description of Artificial Sequence: Synthetic peptide
  Seed: TTHPLFVIA (TYRP1_HUMAN)
TAHPLFVIM

SEQ ID NO: 180286 - protein, 9 aa, Artificial Sequence
  Description of Artificial Sequence: Synthetic peptide
  Seed: GEVDFSHEG (TYRP1_HUMAN)
GEVDFSHEI

SEQ ID NO: 180287 - protein, 9 aa, Artificial Sequence
  Description of Artificial Sequence: Synthetic peptide
  Seed: NMVPFWPPV (TYRP1_HUMAN)
NIVPFWPPA

SEQ ID NO: 180288 - protein, 9 aa, Artificial Sequence
  Description of Artificial Sequence: Synthetic peptide
  Seed: FVWTHYYSV (TYRP1_HUMAN)
FLWTHYYSI

SEQ ID NO: 180289 - protein, 10 aa, Artificial Sequence
  Description of Artificial Sequence: Synthetic peptide
  Seed: TPQFENISIY (TYRP1_HUMAN)
TLQFENISIY

SEQ ID NO: 180290 - protein, 9 aa, Artificial Sequence
  Description of Artificial Sequence: Synthetic peptide
  Seed: NADISTFPL (TYRP1_HUMAN)
NLDISTFPV

SEQ ID NO: 180291 - protein, 10 aa, Artificial Sequence
  Description of Artificial Sequence: Synthetic peptide
  Seed: FSLPYWNFAT (TYRP1_HUMAN)
FCLPYWNFAV

SEQ ID NO: 180292 - protein, 10 aa, Artificial Sequence
  Description of Artificial Sequence: Synthetic peptide
  Seed: YNMVPFWPPV (TYRP1_HUMAN)
YMMVPFWPPL

SEQ ID NO: 180293 - protein, 11 aa, Artificial Sequence
  Description of Artificial Sequence: Synthetic peptide
  Seed: YNMVPFWPPVT (TYRP1_HUMAN)
YMMVPFWPPVW

SEQ ID NO: 180294 - protein, 10 aa, Artificial Sequence
  Description of Artificial Sequence: Synthetic peptide
  Seed: LSPNDPIFVL (TYRP1_HUMAN)
LNPNDPIFVF

SEQ ID NO: 180295 - protein, 9 aa, Artificial Sequence
  Description of Artificial Sequence: Synthetic peptide
  Seed: SFSLPYWNF (TYRP1_HUMAN)
SFSLPYWNL

SEQ ID NO: 180296 - protein, 10 aa, Artificial Sequence
  Description of Artificial Sequence: Synthetic peptide
  Seed: TAPDNLGYTY (TYRP1_HUMAN)
TSPDNLGYTF

SEQ ID NO: 180297 - protein, 8 aa, Artificial Sequence
  Description of Artificial Sequence: Synthetic peptide
  Seed: ACDQRVLI (TYRP1_HUMAN)
AADQRVLV

SEQ ID NO: 180298 - protein, 9 aa, Artificial Sequence
  Description of Artificial Sequence: Synthetic peptide
  Seed: AACDQRVLI (TYRP1_HUMAN)
AICDQRVLW

SEQ ID NO: 180299 - protein, 10 aa, Artificial Sequence
  Description of Artificial Sequence: Synthetic peptide
  Seed: RRNLLDLSKE (TYRP1_HUMAN)
RRNLLDLSKK

SEQ ID NO: 180300 - protein, 9 aa, Artificial Sequence
  Description of Artificial Sequence: Synthetic peptide
  Seed: REVWPLRFF (TYRP1_HUMAN)
REVWPLRFY

SEQ ID NO: 180301 - protein, 9 aa, Artificial Sequence
  Description of Artificial Sequence: Synthetic peptide
  Seed: LQNPNQSVV (TYRP1_HUMAN)
LTNPNQSVI

SEQ ID NO: 180302 - protein, 10 aa, Artificial Sequence
  Description of Artificial Sequence: Synthetic peptide
  Seed: KRTTHPLFVI (TYRP1_HUMAN)
KQTTHPLFVY

SEQ ID NO: 180303 - protein, 10 aa, Artificial Sequence
  Description of Artificial Sequence: Synthetic peptide
  Seed: LIFGTASYLI (TYRP1_HUMAN)
LLFGTASYLV

SEQ ID NO: 180304 - protein, 9 aa, Artificial Sequence
  Description of Artificial Sequence: Synthetic peptide
  Seed: NADISTFPL (TYRP1_HUMAN)
NPDISTFPL

SEQ ID NO: 180305 - protein, 9 aa, Artificial Sequence
  Description of Artificial Sequence: Synthetic peptide
  Seed: EPQDVAQCL (TYRP1_HUMAN)
EAQDVAQCY

SEQ ID NO: 180306 - protein, 10 aa, Artificial Sequence
  Description of Artificial Sequence: Synthetic peptide
  Seed: AVFDEWLRRY (TYRP1_HUMAN)
ATFDEWLRRR

SEQ ID NO: 180307 - protein, 9 aa, Artificial Sequence
  Description of Artificial Sequence: Synthetic peptide
  Seed: FVWTHYYSV (TYRP1_HUMAN)
FSWTHYYSF

SEQ ID NO: 180308 - protein, 11 aa, Artificial Sequence
  Description of Artificial Sequence: Synthetic peptide
  Seed: FPLLLFQQARA (TYRP1_HUMAN)
FMLLLFQQARV

SEQ ID NO: 180309 - protein, 9 aa, Artificial Sequence
  Description of Artificial Sequence: Synthetic peptide
  Seed: NISIYNYFV (TYRP1_HUMAN)
NTSIYNYFL

SEQ ID NO: 180310 - protein, 10 aa, Artificial Sequence
  Description of Artificial Sequence: Synthetic peptide
  Seed: RSMDEANQPL (TYRP1_HUMAN)
RSMDEANQPW

SEQ ID NO: 180311 - protein, 9 aa, Artificial Sequence
  Description of Artificial Sequence: Synthetic peptide
  Seed: SLGCIFFPL (TYRP1_HUMAN)
SVGCIFFPW

SEQ ID NO: 180312 - protein, 10 aa, Artificial Sequence
  Description of Artificial Sequence: Synthetic peptide
  Seed: ALIFGTASYL (TYRP1_HUMAN)
ALIFGTASYR

SEQ ID NO: 180313 - protein, 9 aa, Artificial Sequence
  Description of Artificial Sequence: Synthetic peptide
  Seed: EIQWPSREF (TYRP1_HUMAN)
ETQWPSRER

SEQ ID NO: 180314 - protein, 9 aa, Artificial Sequence
  Description of Artificial Sequence: Synthetic peptide
  Seed: HYYSVKKTF (TYRP1_HUMAN)
HTYSVKKTF

SEQ ID NO: 180315 - protein, 9 aa, Artificial Sequence
  Description of Artificial Sequence: Synthetic peptide
  Seed: IAIAVVGAL (TYRP1_HUMAN)
IIIAVVGAY

SEQ ID NO: 180316 - protein, 10 aa, Artificial Sequence
  Description of Artificial Sequence: Synthetic peptide
  Seed: FWPPVTNTEM (TYRP1_HUMAN)
FVPPVTNTEY

SEQ ID NO: 180317 - protein, 11 aa, Artificial Sequence
  Description of Artificial Sequence: Synthetic peptide
  Seed: REFSVPEIIAI (TYRP1_HUMAN)
REFSVPEIIAV

SEQ ID NO: 180318 - protein, 9 aa, Artificial Sequence
  Description of Artificial Sequence: Synthetic peptide
  Seed: YTYEIQWPS (TYRP1_HUMAN)
YNYEIQWPL

SEQ ID NO: 180319 - protein, 9 aa, Artificial Sequence
  Description of Artificial Sequence: Synthetic peptide
  Seed: MSAPKLLSL (TYRP1_HUMAN)
MYAPKLLSI

SEQ ID NO: 180320 - protein, 9 aa, Artificial Sequence
  Description of Artificial Sequence: Synthetic peptide
  Seed: STLISPNSV (TYRP1_HUMAN)
STLISPNSL

SEQ ID NO: 180321 - protein, 9 aa, Artificial Sequence
  Description of Artificial Sequence: Synthetic peptide
  Seed: LFQQARAQF (TYRP1_HUMAN)
LWQQARAQW

SEQ ID NO: 180322 - protein, 9 aa, Artificial Sequence
  Description of Artificial Sequence: Synthetic peptide
  Seed: DFSHEGPAF (TYRP1_HUMAN)
DLSHEGPAY

SEQ ID NO: 180323 - protein, 9 aa, Artificial Sequence
  Description of Artificial Sequence: Synthetic peptide
  Seed: REFSVPEII (TYRP1_HUMAN)
REFSVPEIG

SEQ ID NO: 180324 - protein, 9 aa, Artificial Sequence
  Description of Artificial Sequence: Synthetic peptide
  Seed: REFSVPEII (TYRP1_HUMAN)
RVFSVPEIF

SEQ ID NO: 180325 - protein, 11 aa, Artificial Sequence
  Description of Artificial Sequence: Synthetic peptide
  Seed: FLNGTGGQTHL (TYRP1_HUMAN)
FSNGTGGQTHF

SEQ ID NO: 180326 - protein, 9 aa, Artificial Sequence
  Description of Artificial Sequence: Synthetic peptide
  Seed: TADSRPHSP (TYRP1_HUMAN)
TSDSRPHSF

SEQ ID NO: 180327 - protein, 9 aa, Artificial Sequence
  Description of Artificial Sequence: Synthetic peptide
  Seed: RQYNMVPFW (TYRP1_HUMAN)
RYYNMVPFV

SEQ ID NO: 180328 - protein, 9 aa, Artificial Sequence
  Description of Artificial Sequence: Synthetic peptide
  Seed: GPDGNTPQF (TYRP1_HUMAN)
GSDGNTPQV

SEQ ID NO: 180329 - protein, 10 aa, Artificial Sequence
  Description of Artificial Sequence: Synthetic peptide
  Seed: ENISIYNYFV (TYRP1_HUMAN)
ECISIYNYFV

SEQ ID NO: 180330 - protein, 10 aa, Artificial Sequence
  Description of Artificial Sequence: Synthetic peptide
  Seed: FVLLHTFTDA (TYRP1_HUMAN)
FALLHTFTDL

SEQ ID NO: 180331 - protein, 9 aa, Artificial Sequence
  Description of Artificial Sequence: Synthetic peptide
  Seed: LQNPNQSVV (TYRP1_HUMAN)
LSNPNQSVL

SEQ ID NO: 180332 - protein, 9 aa, Artificial Sequence
  Description of Artificial Sequence: Synthetic peptide
  Seed: KYDPAVRSL (TYRP1_HUMAN)
KCDPAVRSL

SEQ ID NO: 180333 - protein, 10 aa, Artificial Sequence
  Description of Artificial Sequence: Synthetic peptide
  Seed: LSLGCIFFPL (TYRP1_HUMAN)
LMLGCIFFPV

SEQ ID NO: 180334 - protein, 9 aa, Artificial Sequence
  Description of Artificial Sequence: Synthetic peptide
  Seed: IATRRSEEI (TYRP1_HUMAN)
IATRRSEEY

SEQ ID NO: 180335 - protein, 9 aa, Artificial Sequence
  Description of Artificial Sequence: Synthetic peptide
  Seed: SLHNLAHLF (TYRP1_HUMAN)
SWHNLAHLL

SEQ ID NO: 180336 - protein, 9 aa, Artificial Sequence
  Description of Artificial Sequence: Synthetic peptide
  Seed: STEDGPIRR (TYRP1_HUMAN)
SSEDGPIRY

SEQ ID NO: 180337 - protein, 10 aa, Artificial Sequence
  Description of Artificial Sequence: Synthetic peptide
  Seed: MVPFWPPVTN (TYRP1_HUMAN)
MHPFWPPVTM

SEQ ID NO: 180338 - protein, 9 aa, Artificial Sequence
  Description of Artificial Sequence: Synthetic peptide
  Seed: PNDPIFVLL (TYRP1_HUMAN)
PFDPIFVLM

SEQ ID NO: 180339 - protein, 10 aa, Artificial Sequence
  Description of Artificial Sequence: Synthetic peptide
  Seed: YNYFVWTHYY (TYRP1_HUMAN)
YAYFVWTHYL

SEQ ID NO: 180340 - protein, 9 aa, Artificial Sequence
  Description of Artificial Sequence: Synthetic peptide
  Seed: LVALIFGTA (TYRP1_HUMAN)
LMALIFGTA

SEQ ID NO: 180341 - protein, 9 aa, Artificial Sequence
  Description of Artificial Sequence: Synthetic peptide
  Seed: LSKEEKNHF (TYRP1_HUMAN)
LQKEEKNHY

SEQ ID NO: 180342 - protein, 9 aa, Artificial Sequence
  Description of Artificial Sequence: Synthetic peptide
  Seed: FTDAVFDEW (TYRP1_HUMAN)
FMDAVFDEI

SEQ ID NO: 180343 - protein, 9 aa, Artificial Sequence
  Description of Artificial Sequence: Synthetic peptide
  Seed: STLISPNSV (TYRP1_HUMAN)
SSLISPNSF

SEQ ID NO: 180344 - protein, 9 aa, Artificial Sequence
  Description of Artificial Sequence: Synthetic peptide
  Seed: SVFSQWRVV (TYRP1_HUMAN)
SVFSQWRVK

SEQ ID NO: 180345 - protein, 9 aa, Artificial Sequence
  Description of Artificial Sequence: Synthetic peptide
  Seed: NFDSTLISP (TYRP1_HUMAN)
NWDSTLISM

SEQ ID NO: 180346 - protein, 10 aa, Artificial Sequence
  Description of Artificial Sequence: Synthetic peptide
  Seed: LSLGCIFFPL (TYRP1_HUMAN)
LHLGCIFFPV

SEQ ID NO: 180347 - protein, 10 aa, Artificial Sequence
  Description of Artificial Sequence: Synthetic peptide
  Seed: GMCCPDLSPV (TYRP1_HUMAN)
GLCCPDLSPV

SEQ ID NO: 180348 - protein, 10 aa, Artificial Sequence
  Description of Artificial Sequence: Synthetic peptide
  Seed: FSLPYWNFAT (TYRP1_HUMAN)
FFLPYWNFAL

SEQ ID NO: 180349 - protein, 10 aa, Artificial Sequence
  Description of Artificial Sequence: Synthetic peptide
  Seed: FSVPEIIAIA (TYRP1_HUMAN)
FCVPEIIAIV

SEQ ID NO: 180350 - protein, 9 aa, Artificial Sequence
  Description of Artificial Sequence: Synthetic peptide
  Seed: TASYLIRAR (TYRP1_HUMAN)
TISYLIRAK

SEQ ID NO: 180351 - protein, 11 aa, Artificial Sequence
  Description of Artificial Sequence: Synthetic peptide
  Seed: LISPNSVFSQW (TYRP1_HUMAN)
LASPNSVFSQL

SEQ ID NO: 180352 - protein, 9 aa, Artificial Sequence
  Description of Artificial Sequence: Synthetic peptide
  Seed: ALIFGTASY (TYRP1_HUMAN)
AKIFGTASF

SEQ ID NO: 180353 - protein, 9 aa, Artificial Sequence
  Description of Artificial Sequence: Synthetic peptide
  Seed: SEEILGPDG (TYRP1_HUMAN)
SEEILGPDV

SEQ ID NO: 180354 - protein, 9 aa, Artificial Sequence
  Description of Artificial Sequence: Synthetic peptide
  Seed: GPDGNTPQF (TYRP1_HUMAN)
GQDGNTPQY

SEQ ID NO: 180355 - protein, 11 aa, Artificial Sequence
  Description of Artificial Sequence: Synthetic peptide
  Seed: MFVTAPDNLGY (TYRP1_HUMAN)
MSVTAPDNLGW

SEQ ID NO: 180356 - protein, 10 aa, Artificial Sequence
  Description of Artificial Sequence: Synthetic peptide
  Seed: TAPDNLGYTY (TYRP1_HUMAN)
TYPDNLGYTY

SEQ ID NO: 180357 - protein, 10 aa, Artificial Sequence
  Description of Artificial Sequence: Synthetic peptide
  Seed: YNADISTFPL (TYRP1_HUMAN)
YFADISTFPL

SEQ ID NO: 180358 - protein, 9 aa, Artificial Sequence
  Description of Artificial Sequence: Synthetic peptide
  Seed: ALIFGTASY (TYRP1_HUMAN)
AVIFGTASW

SEQ ID NO: 180359 - protein, 10 aa, Artificial Sequence
  Description of Artificial Sequence: Synthetic peptide
  Seed: EMLQEPSFSL (TYRP1_HUMAN)
EFLQEPSFSI

SEQ ID NO: 180360 - protein, 10 aa, Artificial Sequence
  Description of Artificial Sequence: Synthetic peptide
  Seed: STFPLENAPI (TYRP1_HUMAN)
SAFPLENAPW

SEQ ID NO: 180361 - protein, 10 aa, Artificial Sequence
  Description of Artificial Sequence: Synthetic peptide
  Seed: THYYSVKKTF (TYRP1_HUMAN)
TPYYSVKKTF

SEQ ID NO: 180362 - protein, 11 aa, Artificial Sequence
  Description of Artificial Sequence: Synthetic peptide
  Seed: YNMVPFWPPVT (TYRP1_HUMAN)
YIMVPFWPPVI

SEQ ID NO: 180363 - protein, 8 aa, Artificial Sequence
  Description of Artificial Sequence: Synthetic peptide
  Seed: FSHEGPAF (TYRP1_HUMAN)
FPHEGPAF

SEQ ID NO: 180364 - protein, 9 aa, Artificial Sequence
  Description of Artificial Sequence: Synthetic peptide
  Seed: HPLFVIATR (TYRP1_HUMAN)
HMLFVIATK

SEQ ID NO: 180365 - protein, 9 aa, Artificial Sequence
  Description of Artificial Sequence: Synthetic peptide
  Seed: GYSDPTGKY (TYRP1_HUMAN)
GASDPTGKY

SEQ ID NO: 180366 - protein, 10 aa, Artificial Sequence
  Description of Artificial Sequence: Synthetic peptide
  Seed: HSPQYPHDGR (TYRP1_HUMAN)
HVPQYPHDGK

SEQ ID NO: 180367 - protein, 8 aa, Artificial Sequence
  Description of Artificial Sequence: Synthetic peptide
  Seed: YSDPTGKY (TYRP1_HUMAN)
YFDPTGKF

SEQ ID NO: 180368 - protein, 9 aa, Artificial Sequence
  Description of Artificial Sequence: Synthetic peptide
  Seed: MLQEPSFSL (TYRP1_HUMAN)
MFQEPSFSL

SEQ ID NO: 180369 - protein, 9 aa, Artificial Sequence
  Description of Artificial Sequence: Synthetic peptide
  Seed: NVARPMVQR (TYRP1_HUMAN)
NLARPMVQK

SEQ ID NO: 180370 - protein, 9 aa, Artificial Sequence
  Description of Artificial Sequence: Synthetic peptide
  Seed: FVWTHYYSV (TYRP1_HUMAN)
FNWTHYYSV

SEQ ID NO: 180371 - protein, 9 aa, Artificial Sequence
  Description of Artificial Sequence: Synthetic peptide
  Seed: KLQNPNQSV (TYRP1_HUMAN)
KIQNPNQSF

SEQ ID NO: 180372 - protein, 10 aa, Artificial Sequence
  Description of Artificial Sequence: Synthetic peptide
  Seed: TPQFENISIY (TYRP1_HUMAN)
TCQFENISIM

SEQ ID NO: 180373 - protein, 9 aa, Artificial Sequence
  Description of Artificial Sequence: Synthetic peptide
  Seed: FLNGTGGQT (TYRP1_HUMAN)
FLNGTGGQV

SEQ ID NO: 180374 - protein, 10 aa, Artificial Sequence
  Description of Artificial Sequence: Synthetic peptide
  Seed: STLISPNSVF (TYRP1_HUMAN)
SWLISPNSVF

SEQ ID NO: 180375 - protein, 9 aa, Artificial Sequence
  Description of Artificial Sequence: Synthetic peptide
  Seed: ISIYNYFVW (TYRP1_HUMAN)
ISIYNYFVF

SEQ ID NO: 180376 - protein, 10 aa, Artificial Sequence
  Description of Artificial Sequence: Synthetic peptide
  Seed: SREFSVPEII (TYRP1_HUMAN)
SIEFSVPEIL

SEQ ID NO: 180377 - protein, 9 aa, Artificial Sequence
  Description of Artificial Sequence: Synthetic peptide
  Seed: LGYTYEIQW (TYRP1_HUMAN)
LLYTYEIQW

SEQ ID NO: 180378 - protein, 9 aa, Artificial Sequence
  Description of Artificial Sequence: Synthetic peptide
  Seed: FLTWHRYHL (TYRP1_HUMAN)
FYTWHRYHY

SEQ ID NO: 180379 - protein, 10 aa, Artificial Sequence
  Description of Artificial Sequence: Synthetic peptide
  Seed: KRTTHPLFVI (TYRP1_HUMAN)
KSTTHPLFVM

SEQ ID NO: 180380 - protein, 9 aa, Artificial Sequence
  Description of Artificial Sequence: Synthetic peptide
  Seed: TFPLENAPI (TYRP1_HUMAN)
TIPLENAPL

SEQ ID NO: 180381 - protein, 9 aa, Artificial Sequence
  Description of Artificial Sequence: Synthetic peptide
  Seed: VGLFDTPPF (TYRP1_HUMAN)
VSLFDTPPY

SEQ ID NO: 180382 - protein, 10 aa, Artificial Sequence
  Description of Artificial Sequence: Synthetic peptide
  Seed: VGLFDTPPFY (TYRP1_HUMAN)
VELFDTPPFK

SEQ ID NO: 180383 - protein, 9 aa, Artificial Sequence
  Description of Artificial Sequence: Synthetic peptide
  Seed: RRYNADIST (TYRP1_HUMAN)
RRYNADISM

SEQ ID NO: 180384 - protein, 9 aa, Artificial Sequence
  Description of Artificial Sequence: Synthetic peptide
  Seed: PNDPIFVLL (TYRP1_HUMAN)
PYDPIFVLL

SEQ ID NO: 180385 - protein, 9 aa, Artificial Sequence
  Description of Artificial Sequence: Synthetic peptide
  Seed: STNSFRNTV (TYRP1_HUMAN)
SMNSFRNTL

SEQ ID NO: 180386 - protein, 10 aa, Artificial Sequence
  Description of Artificial Sequence: Synthetic peptide
  Seed: VGLFDTPPFY (TYRP1_HUMAN)
VNLFDTPPFY

SEQ ID NO: 180387 - protein, 11 aa, Artificial Sequence
  Description of Artificial Sequence: Synthetic peptide
  Seed: CNSTEDGPIRR (TYRP1_HUMAN)
CTSTEDGPIRR

SEQ ID NO: 180388 - protein, 10 aa, Artificial Sequence
  Description of Artificial Sequence: Synthetic peptide
  Seed: LTWHRYHLLR (TYRP1_HUMAN)
LAWHRYHLLR

SEQ ID NO: 180389 - protein, 10 aa, Artificial Sequence
  Description of Artificial Sequence: Synthetic peptide
  Seed: LQEPSFSLPY (TYRP1_HUMAN)
LQEPSFSLPM

SEQ ID NO: 180390 - protein, 9 aa, Artificial Sequence
  Description of Artificial Sequence: Synthetic peptide
  Seed: RYNADISTF (TYRP1_HUMAN)
RMNADISTI

SEQ ID NO: 180391 - protein, 10 aa, Artificial Sequence
  Description of Artificial Sequence: Synthetic peptide
  Seed: MQEMLQEPSF (TYRP1_HUMAN)
MKEMLQEPSF

SEQ ID NO: 180392 - protein, 9 aa, Artificial Sequence
  Description of Artificial Sequence: Synthetic peptide
  Seed: NADISTFPL (TYRP1_HUMAN)
NHDISTFPF

SEQ ID NO: 180393 - protein, 9 aa, Artificial Sequence
  Description of Artificial Sequence: Synthetic peptide
  Seed: VTAPDNLGY (TYRP1_HUMAN)
VAAPDNLGM

SEQ ID NO: 180394 - protein, 11 aa, Artificial Sequence
  Description of Artificial Sequence: Synthetic peptide
  Seed: DICTDDLMGSR (TYRP1_HUMAN)
DVCTDDLMGSK

SEQ ID NO: 180395 - protein, 11 aa, Artificial Sequence
  Description of Artificial Sequence: Synthetic peptide
  Seed: QEMLQEPSFSL (TYRP1_HUMAN)
QSMLQEPSFSL

SEQ ID NO: 180396 - protein, 9 aa, Artificial Sequence
  Description of Artificial Sequence: Synthetic peptide
  Seed: FLTWHRYHL (TYRP1_HUMAN)
FVTWHRYHM

SEQ ID NO: 180397 - protein, 10 aa, Artificial Sequence
  Description of Artificial Sequence: Synthetic peptide
  Seed: FGTASYLIRA (TYRP1_HUMAN)
FRTASYLIRV

SEQ ID NO: 180398 - protein, 9 aa, Artificial Sequence
  Description of Artificial Sequence: Synthetic peptide
  Seed: IFGTASYLI (TYRP1_HUMAN)
IYGTASYLY

SEQ ID NO: 180399 - protein, 9 aa, Artificial Sequence
  Description of Artificial Sequence: Synthetic peptide
  Seed: SLGCIFFPL (TYRP1_HUMAN)
SQGCIFFPT

SEQ ID NO: 180400 - protein, 10 aa, Artificial Sequence
  Description of Artificial Sequence: Synthetic peptide
  Seed: YNYFVWTHYY (TYRP1_HUMAN)
YWYFVWTHYR

SEQ ID NO: 180401 - protein, 10 aa, Artificial Sequence
  Description of Artificial Sequence: Synthetic peptide
  Seed: FSVPEIIAIA (TYRP1_HUMAN)
FQVPEIIAIL

SEQ ID NO: 180402 - protein, 9 aa, Artificial Sequence
  Description of Artificial Sequence: Synthetic peptide
  Seed: FYSNSTNSF (TYRP1_HUMAN)
FLSNSTNSM

SEQ ID NO: 180403 - protein, 10 aa, Artificial Sequence
  Description of Artificial Sequence: Synthetic peptide
  Seed: THLSPNDPIF (TYRP1_HUMAN)
THLSPNDPII

SEQ ID NO: 180404 - protein, 9 aa, Artificial Sequence
  Description of Artificial Sequence: Synthetic peptide
  Seed: NADISTFPL (TYRP1_HUMAN)
NRDISTFPL

SEQ ID NO: 180405 - protein, 9 aa, Artificial Sequence
  Description of Artificial Sequence: Synthetic peptide
  Seed: MAKRTTHPL (TYRP1_HUMAN)
MFKRTTHPV

SEQ ID NO: 180406 - protein, 10 aa, Artificial Sequence
  Description of Artificial Sequence: Synthetic peptide
  Seed: FLNGTGGQTH (TYRP1_HUMAN)
FMNGTGGQTF

SEQ ID NO: 180407 - protein, 9 aa, Artificial Sequence
  Description of Artificial Sequence: Synthetic peptide
  Seed: LTWHRYHLL (TYRP1_HUMAN)
LQWHRYHLI

SEQ ID NO: 180408 - protein, 11 aa, Artificial Sequence
  Description of Artificial Sequence: Synthetic peptide
  Seed: MLQEPSFSLPY (TYRP1_HUMAN)
MQQEPSFSLPF

SEQ ID NO: 180409 - protein, 10 aa, Artificial Sequence
  Description of Artificial Sequence: Synthetic peptide
  Seed: NYFVWTHYYS (TYRP1_HUMAN)
NPFVWTHYYY

SEQ ID NO: 180410 - protein, 9 aa, Artificial Sequence
  Description of Artificial Sequence: Synthetic peptide
  Seed: HYYSVKKTF (TYRP1_HUMAN)
HNYSVKKTF

SEQ ID NO: 180411 - protein, 10 aa, Artificial Sequence
  Description of Artificial Sequence: Synthetic peptide
  Seed: AVVGALLLVA (TYRP1_HUMAN)
AVVGALLLVV

SEQ ID NO: 180412 - protein, 9 aa, Artificial Sequence
  Description of Artificial Sequence: Synthetic peptide
  Seed: AKRTTHPLF (TYRP1_HUMAN)
AKRTTHPLY

SEQ ID NO: 180413 - protein, 9 aa, Artificial Sequence
  Description of Artificial Sequence: Synthetic peptide
  Seed: SVFSQWRVV (TYRP1_HUMAN)
SYFSQWRVK

SEQ ID NO: 180414 - protein, 10 aa, Artificial Sequence
  Description of Artificial Sequence: Synthetic peptide
  Seed: KLQNPNQSVV (TYRP1_HUMAN)
KLQNPNQSVW

SEQ ID NO: 180415 - protein, 9 aa, Artificial Sequence
  Description of Artificial Sequence: Synthetic peptide
  Seed: MAKRTTHPL (TYRP1_HUMAN)
MMKRTTHPH

SEQ ID NO: 180416 - protein, 10 aa, Artificial Sequence
  Description of Artificial Sequence: Synthetic peptide
  Seed: AQFPRQCATV (TYRP1_HUMAN)
ATFPRQCATV

SEQ ID NO: 180417 - protein, 9 aa, Artificial Sequence
  Description of Artificial Sequence: Synthetic peptide
  Seed: WTHYYSVKK (TYRP1_HUMAN)
WIHYYSVKR

SEQ ID NO: 180418 - protein, 9 aa, Artificial Sequence
  Description of Artificial Sequence: Synthetic peptide
  Seed: RTTHPLFVI (TYRP1_HUMAN)
RMTHPLFVF

SEQ ID NO: 180419 - protein, 9 aa, Artificial Sequence
  Description of Artificial Sequence: Synthetic peptide
  Seed: SPQYPHDGR (TYRP1_HUMAN)
SAQYPHDGR

SEQ ID NO: 180420 - protein, 10 aa, Artificial Sequence
  Description of Artificial Sequence: Synthetic peptide
  Seed: YNYFVWTHYY (TYRP1_HUMAN)
YLYFVWTHYK

SEQ ID NO: 180421 - protein, 9 aa, Artificial Sequence
  Description of Artificial Sequence: Synthetic peptide
  Seed: LTWHRYHLL (TYRP1_HUMAN)
LAWHRYHLM

SEQ ID NO: 180422 - protein, 9 aa, Artificial Sequence
  Description of Artificial Sequence: Synthetic peptide
  Seed: SVPEIIAIA (TYRP1_HUMAN)
SVPEIIAIY

SEQ ID NO: 180423 - protein, 9 aa, Artificial Sequence
  Description of Artificial Sequence: Synthetic peptide
  Seed: FTDAVFDEW (TYRP1_HUMAN)
FLDAVFDEM

SEQ ID NO: 180424 - protein, 9 aa, Artificial Sequence
  Description of Artificial Sequence: Synthetic peptide
  Seed: EIQWPSREF (TYRP1_HUMAN)
EIQWPSRER

SEQ ID NO: 180425 - protein, 8 aa, Artificial Sequence
  Description of Artificial Sequence: Synthetic peptide
  Seed: YAEEYEKL (TYRP1_HUMAN)
YYEEYEKL

SEQ ID NO: 180426 - protein, 9 aa, Artificial Sequence
  Description of Artificial Sequence: Synthetic peptide
  Seed: VCDICTDDL (TYRP1_HUMAN)
VWDICTDDM

SEQ ID NO: 180427 - protein, 9 aa, Artificial Sequence
  Description of Artificial Sequence: Synthetic peptide
  Seed: FSVPEIIAI (TYRP1_HUMAN)
FVVPEIIAY

SEQ ID NO: 180428 - protein, 11 aa, Artificial Sequence
  Description of Artificial Sequence: Synthetic peptide
  Seed: IAIAVVGALLL (TYRP1_HUMAN)
ISIAVVGALLW

SEQ ID NO: 180429 - protein, 10 aa, Artificial Sequence
  Description of Artificial Sequence: Synthetic peptide
  Seed: FTDAVFDEWL (TYRP1_HUMAN)
FVDAVFDEWV

SEQ ID NO: 180430 - protein, 8 aa, Artificial Sequence
  Description of Artificial Sequence: Synthetic peptide
  Seed: RQYNMVPF (TYRP1_HUMAN)
REYNMVPM

SEQ ID NO: 180431 - protein, 10 aa, Artificial Sequence
  Description of Artificial Sequence: Synthetic peptide
  Seed: GLFDTPPFYS (TYRP1_HUMAN)
GTFDTPPFYI

SEQ ID NO: 180432 - protein, 10 aa, Artificial Sequence
  Description of Artificial Sequence: Synthetic peptide
  Seed: MSAPKLLSLG (TYRP1_HUMAN)
MAAPKLLSLF

SEQ ID NO: 180433 - protein, 10 aa, Artificial Sequence
  Description of Artificial Sequence: Synthetic peptide
  Seed: RSLHNLAHLF (TYRP1_HUMAN)
RFLHNLAHLI

SEQ ID NO: 180434 - protein, 9 aa, Artificial Sequence
  Description of Artificial Sequence: Synthetic peptide
  Seed: REVWPLRFF (TYRP1_HUMAN)
RMVWPLRFM

SEQ ID NO: 180435 - protein, 10 aa, Artificial Sequence
  Description of Artificial Sequence: Synthetic peptide
  Seed: AFLTWHRYHL (TYRP1_HUMAN)
ALLTWHRYHL

SEQ ID NO: 180436 - protein, 9 aa, Artificial Sequence
  Description of Artificial Sequence: Synthetic peptide
  Seed: SPNDPIFVL (TYRP1_HUMAN)
SQNDPIFVY

SEQ ID NO: 180437 - protein, 9 aa, Artificial Sequence
  Description of Artificial Sequence: Synthetic peptide
  Seed: LFDTPPFYS (TYRP1_HUMAN)
LVDTPPFYL

SEQ ID NO: 180438 - protein, 9 aa, Artificial Sequence
  Description of Artificial Sequence: Synthetic peptide
  Seed: NMVPFWPPV (TYRP1_HUMAN)
NQVPFWPPA

SEQ ID NO: 180439 - protein, 11 aa, Artificial Sequence
  Description of Artificial Sequence: Synthetic peptide
  Seed: RLPEPQDVAQC (TYRP1_HUMAN)
RMPEPQDVAQF

SEQ ID NO: 180440 - protein, 10 aa, Artificial Sequence
  Description of Artificial Sequence: Synthetic peptide
  Seed: RVLIVRRNLL (TYRP1_HUMAN)
RTLIVRRNLV

SEQ ID NO: 180441 - protein, 9 aa, Artificial Sequence
  Description of Artificial Sequence: Synthetic peptide
  Seed: KYDPAVRSL (TYRP1_HUMAN)
KLDPAVRSM

SEQ ID NO: 180442 - protein, 9 aa, Artificial Sequence
  Description of Artificial Sequence: Synthetic peptide
  Seed: WHRYHLLRL (TYRP1_HUMAN)
WERYHLLRF

SEQ ID NO: 180443 - protein, 10 aa, Artificial Sequence
  Description of Artificial Sequence: Synthetic peptide
  Seed: TAPDNLGYTY (TYRP1_HUMAN)
TFPDNLGYTF

SEQ ID NO: 180444 - protein, 9 aa, Artificial Sequence
  Description of Artificial Sequence: Synthetic peptide
  Seed: FVWTHYYSV (TYRP1_HUMAN)
FLWTHYYSP

SEQ ID NO: 180445 - protein, 9 aa, Artificial Sequence
  Description of Artificial Sequence: Synthetic peptide
  Seed: NYFVWTHYY (TYRP1_HUMAN)
NYFVWTHYK

SEQ ID NO: 180446 - protein, 8 aa, Artificial Sequence
  Description of Artificial Sequence: Synthetic peptide
  Seed: YAEEYEKL (TYRP1_HUMAN)
YIEEYEKL

SEQ ID NO: 180447 - protein, 10 aa, Artificial Sequence
  Description of Artificial Sequence: Synthetic peptide
  Seed: RSLHNLAHLF (TYRP1_HUMAN)
RLLHNLAHLW

SEQ ID NO: 180448 - protein, 10 aa, Artificial Sequence
  Description of Artificial Sequence: Synthetic peptide
  Seed: YNMVPFWPPV (TYRP1_HUMAN)
YQMVPFWPPF

SEQ ID NO: 180449 - protein, 9 aa, Artificial Sequence
  Description of Artificial Sequence: Synthetic peptide
  Seed: IYNYFVWTH (TYRP1_HUMAN)
ILNYFVWTR

SEQ ID NO: 180450 - protein, 9 aa, Artificial Sequence
  Description of Artificial Sequence: Synthetic peptide
  Seed: IIAIAVVGA (TYRP1_HUMAN)
ITAIAVVGV

SEQ ID NO: 180451 - protein, 9 aa, Artificial Sequence
  Description of Artificial Sequence: Synthetic peptide
  Seed: ENISIYNYF (TYRP1_HUMAN)
ETISIYNYF

SEQ ID NO: 180452 - protein, 9 aa, Artificial Sequence
  Description of Artificial Sequence: Synthetic peptide
  Seed: LPYWNFATG (TYRP1_HUMAN)
LTYWNFATY

SEQ ID NO: 180453 - protein, 9 aa, Artificial Sequence
  Description of Artificial Sequence: Synthetic peptide
  Seed: APDNLGYTY (TYRP1_HUMAN)
ATDNLGYTL

SEQ ID NO: 180454 - protein, 10 aa, Artificial Sequence
  Description of Artificial Sequence: Synthetic peptide
  Seed: VALIFGTASY (TYRP1_HUMAN)
VPLIFGTASF

SEQ ID NO: 180455 - protein, 9 aa, Artificial Sequence
  Description of Artificial Sequence: Synthetic peptide
  Seed: STNSFRNTV (TYRP1_HUMAN)
SSNSFRNTA

SEQ ID NO: 180456 - protein, 9 aa, Artificial Sequence
  Description of Artificial Sequence: Synthetic peptide
  Seed: AVVGALLLV (TYRP1_HUMAN)
AIVGALLLR

SEQ ID NO: 180457 - protein, 10 aa, Artificial Sequence
  Description of Artificial Sequence: Synthetic peptide
  Seed: HFVRALDMAK (TYRP1_HUMAN)
HSVRALDMAR

SEQ ID NO: 180458 - protein, 9 aa, Artificial Sequence
  Description of Artificial Sequence: Synthetic peptide
  Seed: FSLPYWNFA (TYRP1_HUMAN)
FVLPYWNFI

SEQ ID NO: 180459 - protein, 10 aa, Artificial Sequence
  Description of Artificial Sequence: Synthetic peptide
  Seed: YSVKKTFLGV (TYRP1_HUMAN)
YQVKKTFLGA

SEQ ID NO: 180460 - protein, 9 aa, Artificial Sequence
  Description of Artificial Sequence: Synthetic peptide
  Seed: HEGPAFLTW (TYRP1_HUMAN)
HAGPAFLTM

SEQ ID NO: 180461 - protein, 9 aa, Artificial Sequence
  Description of Artificial Sequence: Synthetic peptide
  Seed: STLISPNSV (TYRP1_HUMAN)
SILISPNSV

SEQ ID NO: 180462 - protein, 9 aa, Artificial Sequence
  Description of Artificial Sequence: Synthetic peptide
  Seed: NMVPFWPPV (TYRP1_HUMAN)
NQVPFWPPM

SEQ ID NO: 180463 - protein, 8 aa, Artificial Sequence
  Description of Artificial Sequence: Synthetic peptide
  Seed: LIFGTASY (TYRP1_HUMAN)
LSFGTASF

SEQ ID NO: 180464 - protein, 10 aa, Artificial Sequence
  Description of Artificial Sequence: Synthetic peptide
  Seed: GPAFLTWHRY (TYRP1_HUMAN)
GYAFLTWHRY

SEQ ID NO: 180465 - protein, 9 aa, Artificial Sequence
  Description of Artificial Sequence: Synthetic peptide
  Seed: SPNDPIFVL (TYRP1_HUMAN)
SFNDPIFVM

SEQ ID NO: 180466 - protein, 9 aa, Artificial Sequence
  Description of Artificial Sequence: Synthetic peptide
  Seed: FPLENAPIG (TYRP1_HUMAN)
FILENAPIY

SEQ ID NO: 180467 - protein, 10 aa, Artificial Sequence
  Description of Artificial Sequence: Synthetic peptide
  Seed: SQWRVVCDSL (TYRP1_HUMAN)
SIWRVVCDSV

SEQ ID NO: 180468 - protein, 10 aa, Artificial Sequence
  Description of Artificial Sequence: Synthetic peptide
  Seed: SHEGPAFLTW (TYRP1_HUMAN)
SREGPAFLTW

SEQ ID NO: 180469 - protein, 9 aa, Artificial Sequence
  Description of Artificial Sequence: Synthetic peptide
  Seed: RYNADISTF (TYRP1_HUMAN)
RINADISTM

SEQ ID NO: 180470 - protein, 11 aa, Artificial Sequence
  Description of Artificial Sequence: Synthetic peptide
  Seed: ISPNSVFSQWR (TYRP1_HUMAN)
ISPNSVFSQWW

SEQ ID NO: 180471 - protein, 10 aa, Artificial Sequence
  Description of Artificial Sequence: Synthetic peptide
  Seed: RSMDEANQPL (TYRP1_HUMAN)
RKMDEANQPY

SEQ ID NO: 180472 - protein, 11 aa, Artificial Sequence
  Description of Artificial Sequence: Synthetic peptide
  Seed: LVALIFGTASY (TYRP1_HUMAN)
LKALIFGTASF

SEQ ID NO: 180473 - protein, 10 aa, Artificial Sequence
  Description of Artificial Sequence: Synthetic peptide
  Seed: FVLLHTFTDA (TYRP1_HUMAN)
FPLLHTFTDI

SEQ ID NO: 180474 - protein, 10 aa, Artificial Sequence
  Description of Artificial Sequence: Synthetic peptide
  Seed: YNMVPFWPPV (TYRP1_HUMAN)
YLMVPFWPPM

SEQ ID NO: 180475 - protein, 9 aa, Artificial Sequence
  Description of Artificial Sequence: Synthetic peptide
  Seed: DNLGYTYEI (TYRP1_HUMAN)
DSLGYTYEV

SEQ ID NO: 180476 - protein, 9 aa, Artificial Sequence
  Description of Artificial Sequence: Synthetic peptide
  Seed: IAVVGALLL (TYRP1_HUMAN)
IPVVGALLL

SEQ ID NO: 180477 - protein, 10 aa, Artificial Sequence
  Description of Artificial Sequence: Synthetic peptide
  Seed: HPLFVIATRR (TYRP1_HUMAN)
HTLFVIATRK

SEQ ID NO: 180478 - protein, 9 aa, Artificial Sequence
  Description of Artificial Sequence: Synthetic peptide
  Seed: IAIAVVGAL (TYRP1_HUMAN)
IIIAVVGAI

SEQ ID NO: 180479 - protein, 10 aa, Artificial Sequence
  Description of Artificial Sequence: Synthetic peptide
  Seed: RVVCDSLEDY (TYRP1_HUMAN)
RTVCDSLEDW

SEQ ID NO: 180480 - protein, 10 aa, Artificial Sequence
  Description of Artificial Sequence: Synthetic peptide
  Seed: YNADISTFPL (TYRP1_HUMAN)
YKADISTFPL

SEQ ID NO: 180481 - protein, 10 aa, Artificial Sequence
  Description of Artificial Sequence: Synthetic peptide
  Seed: FSLPYWNFAT (TYRP1_HUMAN)
FWLPYWNFAI

SEQ ID NO: 180482 - protein, 10 aa, Artificial Sequence
  Description of Artificial Sequence: Synthetic peptide
  Seed: LTWHRYHLLR (TYRP1_HUMAN)
LQWHRYHLLK

SEQ ID NO: 180483 - protein, 9 aa, Artificial Sequence
  Description of Artificial Sequence: Synthetic peptide
  Seed: REFSVPEII (TYRP1_HUMAN)
REFSVPEIF

SEQ ID NO: 180484 - protein, 9 aa, Artificial Sequence
  Description of Artificial Sequence: Synthetic peptide
  Seed: MLQEPSFSL (TYRP1_HUMAN)
MQQEPSFSY

SEQ ID NO: 180485 - protein, 9 aa, Artificial Sequence
  Description of Artificial Sequence: Synthetic peptide
  Seed: RPHSPQYPH (TYRP1_HUMAN)
RAHSPQYPL

SEQ ID NO: 180486 - protein, 9 aa, Artificial Sequence
  Description of Artificial Sequence: Synthetic peptide
  Seed: SMDEANQPL (TYRP1_HUMAN)
SMDEANQPM

SEQ ID NO: 180487 - protein, 10 aa, Artificial Sequence
  Description of Artificial Sequence: Synthetic peptide
  Seed: IQWPSREFSV (TYRP1_HUMAN)
ILWPSREFSV

SEQ ID NO: 180488 - protein, 9 aa, Artificial Sequence
  Description of Artificial Sequence: Synthetic peptide
  Seed: RLEKDMQEM (TYRP1_HUMAN)
RVEKDMQEL

SEQ ID NO: 180489 - protein, 9 aa, Artificial Sequence
  Description of Artificial Sequence: Synthetic peptide
  Seed: FSLPYWNFA (TYRP1_HUMAN)
FPLPYWNFC

SEQ ID NO: 180490 - protein, 11 aa, Artificial Sequence
  Description of Artificial Sequence: Synthetic peptide
  Seed: LISPNSVFSQW (TYRP1_HUMAN)
LTSPNSVFSQF

SEQ ID NO: 180491 - protein, 9 aa, Artificial Sequence
  Description of Artificial Sequence: Synthetic peptide
  Seed: AVRSLHNLA (TYRP1_HUMAN)
AIRSLHNLI

SEQ ID NO: 180492 - protein, 9 aa, Artificial Sequence
  Description of Artificial Sequence: Synthetic peptide
  Seed: RQYNMVPFW (TYRP1_HUMAN)
RAYNMVPFM

SEQ ID NO: 180493 - protein, 9 aa, Artificial Sequence
  Description of Artificial Sequence: Synthetic peptide
  Seed: NMVPFWPPV (TYRP1_HUMAN)
NTVPFWPPL

SEQ ID NO: 180494 - protein, 9 aa, Artificial Sequence
  Description of Artificial Sequence: Synthetic peptide
  Seed: GLFDTPPFY (TYRP1_HUMAN)
GQFDTPPFR

SEQ ID NO: 180495 - protein, 9 aa, Artificial Sequence
  Description of Artificial Sequence: Synthetic peptide
  Seed: WHRYHLLRL (TYRP1_HUMAN)
WSRYHLLRF

SEQ ID NO: 180496 - protein, 10 aa, Artificial Sequence
  Description of Artificial Sequence: Synthetic peptide
  Seed: YFVWTHYYSV (TYRP1_HUMAN)
YCVWTHYYSI

SEQ ID NO: 180497 - protein, 11 aa, Artificial Sequence
  Description of Artificial Sequence: Synthetic peptide
  Seed: RLPEPQDVAQC (TYRP1_HUMAN)
RQPEPQDVAQW

SEQ ID NO: 180498 - protein, 9 aa, Artificial Sequence
  Description of Artificial Sequence: Synthetic peptide
  Seed: YLIRARRSM (TYRP1_HUMAN)
YFIRARRSW

SEQ ID NO: 180499 - protein, 9 aa, Artificial Sequence
  Description of Artificial Sequence: Synthetic peptide
  Seed: NYFVWTHYY (TYRP1_HUMAN)
NRFVWTHYM

SEQ ID NO: 180500 - protein, 9 aa, Artificial Sequence
  Description of Artificial Sequence: Synthetic peptide
  Seed: FLNGTGGQT (TYRP1_HUMAN)
FINGTGGQV

SEQ ID NO: 180501 - protein, 9 aa, Artificial Sequence
  Description of Artificial Sequence: Synthetic peptide
  Seed: RYHLLRLEK (TYRP1_HUMAN)
RMHLLRLER

SEQ ID NO: 180502 - protein, 10 aa, Artificial Sequence
  Description of Artificial Sequence: Synthetic peptide
  Seed: ALIFGTASYL (TYRP1_HUMAN)
AQIFGTASYY

SEQ ID NO: 180503 - protein, 9 aa, Artificial Sequence
  Description of Artificial Sequence: Synthetic peptide
  Seed: RYHLLRLEK (TYRP1_HUMAN)
RSHLLRLEK

SEQ ID NO: 180504 - protein, 9 aa, Artificial Sequence
  Description of Artificial Sequence: Synthetic peptide
  Seed: IAIAVVGAL (TYRP1_HUMAN)
IAIAVVGAV

SEQ ID NO: 180505 - protein, 9 aa, Artificial Sequence
  Description of Artificial Sequence: Synthetic peptide
  Seed: ALIFGTASY (TYRP1_HUMAN)
AWIFGTASY

SEQ ID NO: 180506 - protein, 9 aa, Artificial Sequence
  Description of Artificial Sequence: Synthetic peptide
  Seed: MAKRTTHPL (TYRP1_HUMAN)
MTKRTTHPA

SEQ ID NO: 180507 - protein, 9 aa, Artificial Sequence
  Description of Artificial Sequence: Synthetic peptide
  Seed: SLHNLAHLF (TYRP1_HUMAN)
SAHNLAHLH

SEQ ID NO: 180508 - protein, 10 aa, Artificial Sequence
  Description of Artificial Sequence: Synthetic peptide
  Seed: MAKRTTHPLF (TYRP1_HUMAN)
MIKRTTHPLF

SEQ ID NO: 180509 - protein, 9 aa, Artificial Sequence
  Description of Artificial Sequence: Synthetic peptide
  Seed: APDNLGYTY (TYRP1_HUMAN)
AADNLGYTM

SEQ ID NO: 180510 - protein, 10 aa, Artificial Sequence
  Description of Artificial Sequence: Synthetic peptide
  Seed: YNADISTFPL (TYRP1_HUMAN)
YNADISTFPV

SEQ ID NO: 180511 - protein, 10 aa, Artificial Sequence
  Description of Artificial Sequence: Synthetic peptide
  Seed: ATVEALRSGM (TYRP1_HUMAN)
AIVEALRSGV

SEQ ID NO: 180512 - protein, 9 aa, Artificial Sequence
  Description of Artificial Sequence: Synthetic peptide
  Seed: AACDQRVLI (TYRP1_HUMAN)
ARCDQRVLF

SEQ ID NO: 180513 - protein, 10 aa, Artificial Sequence
  Description of Artificial Sequence: Synthetic peptide
  Seed: RSLHNLAHLF (TYRP1_HUMAN)
RCLHNLAHLW

SEQ ID NO: 180514 - protein, 9 aa, Artificial Sequence
  Description of Artificial Sequence: Synthetic peptide
  Seed: WHRYHLLRL (TYRP1_HUMAN)
WQRYHLLRY

SEQ ID NO: 180515 - protein, 9 aa, Artificial Sequence
  Description of Artificial Sequence: Synthetic peptide
  Seed: VFDEWLRRY (TYRP1_HUMAN)
VTDEWLRRL

SEQ ID NO: 180516 - protein, 10 aa, Artificial Sequence
  Description of Artificial Sequence: Synthetic peptide
  Seed: FVWTHYYSVK (TYRP1_HUMAN)
FIWTHYYSVM

SEQ ID NO: 180517 - protein, 9 aa, Artificial Sequence
  Description of Artificial Sequence: Synthetic peptide
  Seed: VVGALLLVA (TYRP1_HUMAN)
VLGALLLVL

SEQ ID NO: 180518 - protein, 9 aa, Artificial Sequence
  Description of Artificial Sequence: Synthetic peptide
  Seed: FPLLLFQQA (TYRP1_HUMAN)
FPLLLFQQI

SEQ ID NO: 180519 - protein, 9 aa, Artificial Sequence
  Description of Artificial Sequence: Synthetic peptide
  Seed: MAKRTTHPL (TYRP1_HUMAN)
MVKRTTHPL

SEQ ID NO: 180520 - protein, 9 aa, Artificial Sequence
  Description of Artificial Sequence: Synthetic peptide
  Seed: RFFNRTCHC (TYRP1_HUMAN)
RAFNRTCHV

SEQ ID NO: 180521 - protein, 10 aa, Artificial Sequence
  Description of Artificial Sequence: Synthetic peptide
  Seed: YNMVPFWPPV (TYRP1_HUMAN)
YKMVPFWPPI

SEQ ID NO: 180522 - protein, 10 aa, Artificial Sequence
  Description of Artificial Sequence: Synthetic peptide
  Seed: TPQFENISIY (TYRP1_HUMAN)
TGQFENISIM

SEQ ID NO: 180523 - protein, 10 aa, Artificial Sequence
  Description of Artificial Sequence: Synthetic peptide
  Seed: AVFDEWLRRY (TYRP1_HUMAN)
ALFDEWLRRR

SEQ ID NO: 180524 - protein, 10 aa, Artificial Sequence
  Description of Artificial Sequence: Synthetic peptide
  Seed: YNMVPFWPPV (TYRP1_HUMAN)
YPMVPFWPPL

SEQ ID NO: 180525 - protein, 9 aa, Artificial Sequence
  Description of Artificial Sequence: Synthetic peptide
  Seed: MAKRTTHPL (TYRP1_HUMAN)
MIKRTTHPK

SEQ ID NO: 180526 - protein, 9 aa, Artificial Sequence
  Description of Artificial Sequence: Synthetic peptide
  Seed: ISIYNYFVW (TYRP1_HUMAN)
IAIYNYFVI

SEQ ID NO: 180527 - protein, 9 aa, Artificial Sequence
  Description of Artificial Sequence: Synthetic peptide
  Seed: SMDEANQPL (TYRP1_HUMAN)
SSDEANQPL

SEQ ID NO: 180528 - protein, 9 aa, Artificial Sequence
  Description of Artificial Sequence: Synthetic peptide
  Seed: FSLPYWNFA (TYRP1_HUMAN)
FPLPYWNFA

SEQ ID NO: 180529 - protein, 10 aa, Artificial Sequence
  Description of Artificial Sequence: Synthetic peptide
  Seed: LQEPSFSLPY (TYRP1_HUMAN)
LAEPSFSLPF

SEQ ID NO: 180530 - protein, 9 aa, Artificial Sequence
  Description of Artificial Sequence: Synthetic peptide
  Seed: IGHNRQYNM (TYRP1_HUMAN)
IRHNRQYNM

SEQ ID NO: 180531 - protein, 10 aa, Artificial Sequence
  Description of Artificial Sequence: Synthetic peptide
  Seed: HPLFVIATRR (TYRP1_HUMAN)
HTLFVIATRR

SEQ ID NO: 180532 - protein, 9 aa, Artificial Sequence
  Description of Artificial Sequence: Synthetic peptide
  Seed: VARPMVQRL (TYRP1_HUMAN)
VSRPMVQRK

SEQ ID NO: 180533 - protein, 10 aa, Artificial Sequence
  Description of Artificial Sequence: Synthetic peptide
  Seed: TDAVFDEWLR (TYRP1_HUMAN)
TIAVFDEWLK

SEQ ID NO: 180534 - protein, 10 aa, Artificial Sequence
  Description of Artificial Sequence: Synthetic peptide
  Seed: FVWTHYYSVK (TYRP1_HUMAN)
FMWTHYYSVV

SEQ ID NO: 180535 - protein, 9 aa, Artificial Sequence
  Description of Artificial Sequence: Synthetic peptide
  Seed: MLQEPSFSL (TYRP1_HUMAN)
MSQEPSFSY

SEQ ID NO: 180536 - protein, 9 aa, Artificial Sequence
  Description of Artificial Sequence: Synthetic peptide
  Seed: LLVALIFGT (TYRP1_HUMAN)
LAVALIFGL

SEQ ID NO: 180537 - protein, 11 aa, Artificial Sequence
  Description of Artificial Sequence: Synthetic peptide
  Seed: RRYNADISTFP (TYRP1_HUMAN)
RWYNADISTFS

SEQ ID NO: 180538 - protein, 10 aa, Artificial Sequence
  Description of Artificial Sequence: Synthetic peptide
  Seed: NSFRNTVEGY (TYRP1_HUMAN)
NVFRNTVEGK

SEQ ID NO: 180539 - protein, 10 aa, Artificial Sequence
  Description of Artificial Sequence: Synthetic peptide
  Seed: ADSRPHSPQY (TYRP1_HUMAN)
AASRPHSPQW

SEQ ID NO: 180540 - protein, 9 aa, Artificial Sequence
  Description of Artificial Sequence: Synthetic peptide
  Seed: QQARAQFPR (TYRP1_HUMAN)
QFARAQFPK

SEQ ID NO: 180541 - protein, 10 aa, Artificial Sequence
  Description of Artificial Sequence: Synthetic peptide
  Seed: TPQFENISIY (TYRP1_HUMAN)
TEQFENISIF

SEQ ID NO: 180542 - protein, 9 aa, Artificial Sequence
  Description of Artificial Sequence: Synthetic peptide
  Seed: LGYTYEIQW (TYRP1_HUMAN)
LSYTYEIQM

SEQ ID NO: 180543 - protein, 10 aa, Artificial Sequence
  Description of Artificial Sequence: Synthetic peptide
  Seed: YNYFVWTHYY (TYRP1_HUMAN)
YPYFVWTHYM

SEQ ID NO: 180544 - protein, 9 aa, Artificial Sequence
  Description of Artificial Sequence: Synthetic peptide
  Seed: ISIYNYFVW (TYRP1_HUMAN)
ILIYNYFVM

SEQ ID NO: 180545 - protein, 11 aa, Artificial Sequence
  Description of Artificial Sequence: Synthetic peptide
  Seed: REVWPLRFFNR (TYRP1_HUMAN)
RAVWPLRFFNR

SEQ ID NO: 180546 - protein, 9 aa, Artificial Sequence
  Description of Artificial Sequence: Synthetic peptide
  Seed: FENISIYNY (TYRP1_HUMAN)
FNNISIYNY

SEQ ID NO: 180547 - protein, 9 aa, Artificial Sequence
  Description of Artificial Sequence: Synthetic peptide
  Seed: REFSVPEII (TYRP1_HUMAN)
RTFSVPEII

SEQ ID NO: 180548 - protein, 11 aa, Artificial Sequence
  Description of Artificial Sequence: Synthetic peptide
  Seed: YFVWTHYYSVK (TYRP1_HUMAN)
YLVWTHYYSVR

SEQ ID NO: 180549 - protein, 9 aa, Artificial Sequence
  Description of Artificial Sequence: Synthetic peptide
  Seed: SGRGRCEAV (TYRP1_HUMAN)
SPRGRCEAI

SEQ ID NO: 180550 - protein, 9 aa, Artificial Sequence
  Description of Artificial Sequence: Synthetic peptide
  Seed: ARAQFPRQC (TYRP1_HUMAN)
ARAQFPRQM

SEQ ID NO: 180551 - protein, 10 aa, Artificial Sequence
  Description of Artificial Sequence: Synthetic peptide
  Seed: FSLPYWNFAT (TYRP1_HUMAN)
FRLPYWNFAA

SEQ ID NO: 180552 - protein, 10 aa, Artificial Sequence
  Description of Artificial Sequence: Synthetic peptide
  Seed: LGPDGNTPQF (TYRP1_HUMAN)
LAPDGNTPQW

SEQ ID NO: 180553 - protein, 10 aa, Artificial Sequence
  Description of Artificial Sequence: Synthetic peptide
  Seed: FQQARAQFPR (TYRP1_HUMAN)
FYQARAQFPR

SEQ ID NO: 180554 - protein, 9 aa, Artificial Sequence
  Description of Artificial Sequence: Synthetic peptide
  Seed: VEGYSDPTG (TYRP1_HUMAN)
VEGYSDPTA

SEQ ID NO: 180555 - protein, 10 aa, Artificial Sequence
  Description of Artificial Sequence: Synthetic peptide
  Seed: ENISIYNYFV (TYRP1_HUMAN)
EMISIYNYFL

SEQ ID NO: 180556 - protein, 9 aa, Artificial Sequence
  Description of Artificial Sequence: Synthetic peptide
  Seed: AVFDEWLRR (TYRP1_HUMAN)
ASFDEWLRY

SEQ ID NO: 180557 - protein, 9 aa, Artificial Sequence
  Description of Artificial Sequence: Synthetic peptide
  Seed: NYFVWTHYY (TYRP1_HUMAN)
NMFVWTHYV

SEQ ID NO: 180558 - protein, 9 aa, Artificial Sequence
  Description of Artificial Sequence: Synthetic peptide
  Seed: VRSLHNLAH (TYRP1_HUMAN)
VRSLHNLAF

SEQ ID NO: 180559 - protein, 9 aa, Artificial Sequence
  Description of Artificial Sequence: Synthetic peptide
  Seed: DQRVLIVRR (TYRP1_HUMAN)
DYRVLIVRR

SEQ ID NO: 180560 - protein, 10 aa, Artificial Sequence
  Description of Artificial Sequence: Synthetic peptide
  Seed: SPNDPIFVLL (TYRP1_HUMAN)
SANDPIFVLL

SEQ ID NO: 180561 - protein, 10 aa, Artificial Sequence
  Description of Artificial Sequence: Synthetic peptide
  Seed: SQWRVVCDSL (TYRP1_HUMAN)
SKWRVVCDSY

SEQ ID NO: 180562 - protein, 9 aa, Artificial Sequence
  Description of Artificial Sequence: Synthetic peptide
  Seed: FYSNSTNSF (TYRP1_HUMAN)
FKSNSTNSY

SEQ ID NO: 180563 - protein, 9 aa, Artificial Sequence
  Description of Artificial Sequence: Synthetic peptide
  Seed: STNSFRNTV (TYRP1_HUMAN)
SINSFRNTK

SEQ ID NO: 180564 - protein, 9 aa, Artificial Sequence
  Description of Artificial Sequence: Synthetic peptide
  Seed: APIGHNRQY (TYRP1_HUMAN)
APIGHNRQA

SEQ ID NO: 180565 - protein, 10 aa, Artificial Sequence
  Description of Artificial Sequence: Synthetic peptide
  Seed: FLNGTGGQTH (TYRP1_HUMAN)
FSNGTGGQTM

SEQ ID NO: 180566 - protein, 10 aa, Artificial Sequence
  Description of Artificial Sequence: Synthetic peptide
  Seed: GKYDPAVRSL (TYRP1_HUMAN)
GQYDPAVRSL

SEQ ID NO: 180567 - protein, 10 aa, Artificial Sequence
  Description of Artificial Sequence: Synthetic peptide
  Seed: FSLPYWNFAT (TYRP1_HUMAN)
FDLPYWNFAA

SEQ ID NO: 180568 - protein, 9 aa, Artificial Sequence
  Description of Artificial Sequence: Synthetic peptide
  Seed: AVFDEWLRR (TYRP1_HUMAN)
AYFDEWLRR

SEQ ID NO: 180569 - protein, 9 aa, Artificial Sequence
  Description of Artificial Sequence: Synthetic peptide
  Seed: ISIYNYFVW (TYRP1_HUMAN)
ITIYNYFVF

SEQ ID NO: 180570 - protein, 10 aa, Artificial Sequence
  Description of Artificial Sequence: Synthetic peptide
  Seed: RRYNADISTF (TYRP1_HUMAN)
RYYNADISTV

SEQ ID NO: 180571 - protein, 10 aa, Artificial Sequence
  Description of Artificial Sequence: Synthetic peptide
  Seed: SVKKTFLGVG (TYRP1_HUMAN)
STKKTFLGVK

SEQ ID NO: 180572 - protein, 9 aa, Artificial Sequence
  Description of Artificial Sequence: Synthetic peptide
  Seed: RVLIVRRNL (TYRP1_HUMAN)
RVLIVRRNY

SEQ ID NO: 180573 - protein, 9 aa, Artificial Sequence
  Description of Artificial Sequence: Synthetic peptide
  Seed: KLQNPNQSV (TYRP1_HUMAN)
KLQNPNQSY

SEQ ID NO: 180574 - protein, 9 aa, Artificial Sequence
  Description of Artificial Sequence: Synthetic peptide
  Seed: AGNVARPMV (TYRP1_HUMAN)
AQNVARPMV

SEQ ID NO: 180575 - protein, 9 aa, Artificial Sequence
  Description of Artificial Sequence: Synthetic peptide
  Seed: NYFVWTHYY (TYRP1_HUMAN)
NSFVWTHYF

SEQ ID NO: 180576 - protein, 8 aa, Artificial Sequence
  Description of Artificial Sequence: Synthetic peptide
  Seed: YSDPTGKY (TYRP1_HUMAN)
YNDPTGKV

SEQ ID NO: 180577 - protein, 9 aa, Artificial Sequence
  Description of Artificial Sequence: Synthetic peptide
  Seed: FLTWHRYHL (TYRP1_HUMAN)
FTTWHRYHY

SEQ ID NO: 180578 - protein, 9 aa, Artificial Sequence
  Description of Artificial Sequence: Synthetic peptide
  Seed: HYYSVKKTF (TYRP1_HUMAN)
HLYSVKKTF

SEQ ID NO: 180579 - protein, 9 aa, Artificial Sequence
  Description of Artificial Sequence: Synthetic peptide
  Seed: ISIYNYFVW (TYRP1_HUMAN)
IQIYNYFVY

SEQ ID NO: 180580 - protein, 9 aa, Artificial Sequence
  Description of Artificial Sequence: Synthetic peptide
  Seed: YLIRARRSM (TYRP1_HUMAN)
YPIRARRSV

SEQ ID NO: 180581 - protein, 10 aa, Artificial Sequence
  Description of Artificial Sequence: Synthetic peptide
  Seed: TAPDNLGYTY (TYRP1_HUMAN)
TAPDNLGYTW

SEQ ID NO: 180582 - protein, 9 aa, Artificial Sequence
  Description of Artificial Sequence: Synthetic peptide
  Seed: IAVVGALLL (TYRP1_HUMAN)
IRVVGALLM

SEQ ID NO: 180583 - protein, 11 aa, Artificial Sequence
  Description of Artificial Sequence: Synthetic peptide
  Seed: RSLHNLAHLFL (TYRP1_HUMAN)
RALHNLAHLFY

SEQ ID NO: 180584 - protein, 9 aa, Artificial Sequence
  Description of Artificial Sequence: Synthetic peptide
  Seed: SMDEANQPL (TYRP1_HUMAN)
SWDEANQPF

SEQ ID NO: 180585 - protein, 9 aa, Artificial Sequence
  Description of Artificial Sequence: Synthetic peptide
  Seed: ALIFGTASY (TYRP1_HUMAN)
ATIFGTASR

SEQ ID NO: 180586 - protein, 9 aa, Artificial Sequence
  Description of Artificial Sequence: Synthetic peptide
  Seed: KLLSLGCIF (TYRP1_HUMAN)
KMLSLGCII

SEQ ID NO: 180587 - protein, 10 aa, Artificial Sequence
  Description of Artificial Sequence: Synthetic peptide
  Seed: STLISPNSVF (TYRP1_HUMAN)
SMLISPNSVM

SEQ ID NO: 180588 - protein, 9 aa, Artificial Sequence
  Description of Artificial Sequence: Synthetic peptide
  Seed: HLSPNDPIF (TYRP1_HUMAN)
HLSPNDPII

SEQ ID NO: 180589 - protein, 9 aa, Artificial Sequence
  Description of Artificial Sequence: Synthetic peptide
  Seed: HEGPAFLTW (TYRP1_HUMAN)
HTGPAFLTF

SEQ ID NO: 180590 - protein, 10 aa, Artificial Sequence
  Description of Artificial Sequence: Synthetic peptide
  Seed: ALIFGTASYL (TYRP1_HUMAN)
AQIFGTASYT

SEQ ID NO: 180591 - protein, 9 aa, Artificial Sequence
  Description of Artificial Sequence: Synthetic peptide
  Seed: HEGPAFLTW (TYRP1_HUMAN)
HCGPAFLTW

SEQ ID NO: 180592 - protein, 9 aa, Artificial Sequence
  Description of Artificial Sequence: Synthetic peptide
  Seed: HEGPAFLTW (TYRP1_HUMAN)
HKGPAFLTY

SEQ ID NO: 180593 - protein, 11 aa, Artificial Sequence
  Description of Artificial Sequence: Synthetic peptide
  Seed: FWPPVTNTEMF (TYRP1_HUMAN)
FCPPVTNTEMY

SEQ ID NO: 180594 - protein, 10 aa, Artificial Sequence
  Description of Artificial Sequence: Synthetic peptide
  Seed: TAPDNLGYTY (TYRP1_HUMAN)
TTPDNLGYTL

SEQ ID NO: 180595 - protein, 9 aa, Artificial Sequence
  Description of Artificial Sequence: Synthetic peptide
  Seed: RGRCEAVTA (TYRP1_HUMAN)
RMRCEAVTV

SEQ ID NO: 180596 - protein, 9 aa, Artificial Sequence
  Description of Artificial Sequence: Synthetic peptide
  Seed: IFGTASYLI (TYRP1_HUMAN)
IFGTASYLM

SEQ ID NO: 180597 - protein, 10 aa, Artificial Sequence
  Description of Artificial Sequence: Synthetic peptide
  Seed: FSLPYWNFAT (TYRP1_HUMAN)
FLLPYWNFAL

SEQ ID NO: 180598 - protein, 9 aa, Artificial Sequence
  Description of Artificial Sequence: Synthetic peptide
  Seed: MAKRTTHPL (TYRP1_HUMAN)
MSKRTTHPS

SEQ ID NO: 180599 - protein, 9 aa, Artificial Sequence
  Description of Artificial Sequence: Synthetic peptide
  Seed: ENISIYNYF (TYRP1_HUMAN)
ESISIYNYM

SEQ ID NO: 180600 - protein, 9 aa, Artificial Sequence
  Description of Artificial Sequence: Synthetic peptide
  Seed: LLVALIFGT (TYRP1_HUMAN)
LQVALIFGI

SEQ ID NO: 180601 - protein, 9 aa, Artificial Sequence
  Description of Artificial Sequence: Synthetic peptide
  Seed: FLNGTGGQT (TYRP1_HUMAN)
FLNGTGGQA

SEQ ID NO: 180602 - protein, 10 aa, Artificial Sequence
  Description of Artificial Sequence: Synthetic peptide
  Seed: VLLHTFTDAV (TYRP1_HUMAN)
VALHTFTDAV

SEQ ID NO: 180603 - protein, 9 aa, Artificial Sequence
  Description of Artificial Sequence: Synthetic peptide
  Seed: FYSNSTNSF (TYRP1_HUMAN)
FNSNSTNSY

SEQ ID NO: 180604 - protein, 11 aa, Artificial Sequence
  Description of Artificial Sequence: Synthetic peptide
  Seed: QEMLQEPSFSL (TYRP1_HUMAN)
QRMLQEPSFSV

SEQ ID NO: 180605 - protein, 9 aa, Artificial Sequence
  Description of Artificial Sequence: Synthetic peptide
  Seed: LTDQYQCYA (TYRP1_HUMAN)
LVDQYQCYV

SEQ ID NO: 180606 - protein, 9 aa, Artificial Sequence
  Description of Artificial Sequence: Synthetic peptide
  Seed: LVALIFGTA (TYRP1_HUMAN)
LTALIFGTA

SEQ ID NO: 180607 - protein, 10 aa, Artificial Sequence
  Description of Artificial Sequence: Synthetic peptide
  Seed: YNADISTFPL (TYRP1_HUMAN)
YYADISTFPL

SEQ ID NO: 180608 - protein, 9 aa, Artificial Sequence
  Description of Artificial Sequence: Synthetic peptide
  Seed: MLQEPSFSL (TYRP1_HUMAN)
MTQEPSFSK

SEQ ID NO: 180609 - protein, 8 aa, Artificial Sequence
  Description of Artificial Sequence: Synthetic peptide
  Seed: FQQARAQF (TYRP1_HUMAN)
FQQARAQY

SEQ ID NO: 180610 - protein, 10 aa, Artificial Sequence
  Description of Artificial Sequence: Synthetic peptide
  Seed: IAIAVVGALL (TYRP1_HUMAN)
ITIAVVGALV

SEQ ID NO: 180611 - protein, 10 aa, Artificial Sequence
  Description of Artificial Sequence: Synthetic peptide
  Seed: FGTASYLIRA (TYRP1_HUMAN)
FCTASYLIRV

SEQ ID NO: 180612 - protein, 9 aa, Artificial Sequence
  Description of Artificial Sequence: Synthetic peptide
  Seed: FTDAVFDEW (TYRP1_HUMAN)
FGDAVFDEL

SEQ ID NO: 180613 - protein, 10 aa, Artificial Sequence
  Description of Artificial Sequence: Synthetic peptide
  Seed: YNYFVWTHYY (TYRP1_HUMAN)
YHYFVWTHYR

SEQ ID NO: 180614 - protein, 9 aa, Artificial Sequence
  Description of Artificial Sequence: Synthetic peptide
  Seed: RSLHNLAHL (TYRP1_HUMAN)
RFLHNLAHK

SEQ ID NO: 180615 - protein, 11 aa, Artificial Sequence
  Description of Artificial Sequence: Synthetic peptide
  Seed: MFVTAPDNLGY (TYRP1_HUMAN)
MFVTAPDNLGF

SEQ ID NO: 180616 - protein, 9 aa, Artificial Sequence
  Description of Artificial Sequence: Synthetic peptide
  Seed: FTDAVFDEW (TYRP1_HUMAN)
FCDAVFDEF

SEQ ID NO: 180617 - protein, 10 aa, Artificial Sequence
  Description of Artificial Sequence: Synthetic peptide
  Seed: MVPFWPPVTN (TYRP1_HUMAN)
MFPFWPPVTY

SEQ ID NO: 180618 - protein, 9 aa, Artificial Sequence
  Description of Artificial Sequence: Synthetic peptide
  Seed: YTYEIQWPS (TYRP1_HUMAN)
YQYEIQWPE

SEQ ID NO: 180619 - protein, 9 aa, Artificial Sequence
  Description of Artificial Sequence: Synthetic peptide
  Seed: RTTHPLFVI (TYRP1_HUMAN)
RQTHPLFVL

SEQ ID NO: 180620 - protein, 10 aa, Artificial Sequence
  Description of Artificial Sequence: Synthetic peptide
  Seed: REFSVPEIIA (TYRP1_HUMAN)
RQFSVPEIII

SEQ ID NO: 180621 - protein, 10 aa, Artificial Sequence
  Description of Artificial Sequence: Synthetic peptide
  Seed: THYYSVKKTF (TYRP1_HUMAN)
TSYYSVKKTF

SEQ ID NO: 180622 - protein, 9 aa, Artificial Sequence
  Description of Artificial Sequence: Synthetic peptide
  Seed: LPYWNFATG (TYRP1_HUMAN)
LPYWNFATC

SEQ ID NO: 180623 - protein, 9 aa, Artificial Sequence
  Description of Artificial Sequence: Synthetic peptide
  Seed: RFFNRTCHC (TYRP1_HUMAN)
RTFNRTCHI

SEQ ID NO: 180624 - protein, 10 aa, Artificial Sequence
  Description of Artificial Sequence: Synthetic peptide
  Seed: MLQEPSFSLP (TYRP1_HUMAN)
MLQEPSFSLS

SEQ ID NO: 180625 - protein, 11 aa, Artificial Sequence
  Description of Artificial Sequence: Synthetic peptide
  Seed: FLNGTGGQTHL (TYRP1_HUMAN)
FINGTGGQTHY

SEQ ID NO: 180626 - protein, 9 aa, Artificial Sequence
  Description of Artificial Sequence: Synthetic peptide
  Seed: AQFPRQCAT (TYRP1_HUMAN)
AKFPRQCAF

SEQ ID NO: 180627 - protein, 10 aa, Artificial Sequence
  Description of Artificial Sequence: Synthetic peptide
  Seed: REFSVPEIIA (TYRP1_HUMAN)
REFSVPEIIW

SEQ ID NO: 180628 - protein, 9 aa, Artificial Sequence
  Description of Artificial Sequence: Synthetic peptide
  Seed: MSAPKLLSL (TYRP1_HUMAN)
MGAPKLLSL

SEQ ID NO: 180629 - protein, 9 aa, Artificial Sequence
  Description of Artificial Sequence: Synthetic peptide
  Seed: RAQFPRQCA (TYRP1_HUMAN)
RYQFPRQCK

SEQ ID NO: 180630 - protein, 10 aa, Artificial Sequence
  Description of Artificial Sequence: Synthetic peptide
  Seed: LSLGCIFFPL (TYRP1_HUMAN)
LTLGCIFFPW

SEQ ID NO: 180631 - protein, 9 aa, Artificial Sequence
  Description of Artificial Sequence: Synthetic peptide
  Seed: AIAVVGALL (TYRP1_HUMAN)
AVAVVGALI

SEQ ID NO: 180632 - protein, 10 aa, Artificial Sequence
  Description of Artificial Sequence: Synthetic peptide
  Seed: SPVSGPGTDR (TYRP1_HUMAN)
SPVSGPGTDV

SEQ ID NO: 180633 - protein, 11 aa, Artificial Sequence
  Description of Artificial Sequence: Synthetic peptide
  Seed: THLSPNDPIFV (TYRP1_HUMAN)
THLSPNDPIFM

SEQ ID NO: 180634 - protein, 9 aa, Artificial Sequence
  Description of Artificial Sequence: Synthetic peptide
  Seed: MCCPDLSPV (TYRP1_HUMAN)
MMCPDLSPT

SEQ ID NO: 180635 - protein, 9 aa, Artificial Sequence
  Description of Artificial Sequence: Synthetic peptide
  Seed: YTYEIQWPS (TYRP1_HUMAN)
YAYEIQWPF

SEQ ID NO: 180636 - protein, 10 aa, Artificial Sequence
  Description of Artificial Sequence: Synthetic peptide
  Seed: LIFGTASYLI (TYRP1_HUMAN)
LTFGTASYLF

SEQ ID NO: 180637 - protein, 10 aa, Artificial Sequence
  Description of Artificial Sequence: Synthetic peptide
  Seed: GKYDPAVRSL (TYRP1_HUMAN)
GRYDPAVRSF

SEQ ID NO: 180638 - protein, 9 aa, Artificial Sequence
  Description of Artificial Sequence: Synthetic peptide
  Seed: YNYFVWTHY (TYRP1_HUMAN)
YSYFVWTHR

SEQ ID NO: 180639 - protein, 10 aa, Artificial Sequence
  Description of Artificial Sequence: Synthetic peptide
  Seed: LIFGTASYLI (TYRP1_HUMAN)
LYFGTASYLI

SEQ ID NO: 180640 - protein, 11 aa, Artificial Sequence
  Description of Artificial Sequence: Synthetic peptide
  Seed: ILGPDGNTPQF (TYRP1_HUMAN)
IWGPDGNTPQF

SEQ ID NO: 180641 - protein, 9 aa, Artificial Sequence
  Description of Artificial Sequence: Synthetic peptide
  Seed: LTWHRYHLL (TYRP1_HUMAN)
LSWHRYHLM

SEQ ID NO: 180642 - protein, 10 aa, Artificial Sequence
  Description of Artificial Sequence: Synthetic peptide
  Seed: RSMDEANQPL (TYRP1_HUMAN)
RHMDEANQPV

SEQ ID NO: 180643 - protein, 10 aa, Artificial Sequence
  Description of Artificial Sequence: Synthetic peptide
  Seed: RSMDEANQPL (TYRP1_HUMAN)
RPMDEANQPI

SEQ ID NO: 180644 - protein, 9 aa, Artificial Sequence
  Description of Artificial Sequence: Synthetic peptide
  Seed: FENISIYNY (TYRP1_HUMAN)
FANISIYNF

SEQ ID NO: 180645 - protein, 11 aa, Artificial Sequence
  Description of Artificial Sequence: Synthetic peptide
  Seed: VTAPDNLGYTY (TYRP1_HUMAN)
VWAPDNLGYTY

SEQ ID NO: 180646 - protein, 9 aa, Artificial Sequence
  Description of Artificial Sequence: Synthetic peptide
  Seed: AACDQRVLI (TYRP1_HUMAN)
ASCDQRVLI

SEQ ID NO: 180647 - protein, 9 aa, Artificial Sequence
  Description of Artificial Sequence: Synthetic peptide
  Seed: LTWHRYHLL (TYRP1_HUMAN)
LTWHRYHLY

SEQ ID NO: 180648 - protein, 8 aa, Artificial Sequence
  Description of Artificial Sequence: Synthetic peptide
  Seed: YSDPTGKY (TYRP1_HUMAN)
YGDPTGKF

SEQ ID NO: 180649 - protein, 9 aa, Artificial Sequence
  Description of Artificial Sequence: Synthetic peptide
  Seed: NFDSTLISP (TYRP1_HUMAN)
NLDSTLISM

SEQ ID NO: 180650 - protein, 9 aa, Artificial Sequence
  Description of Artificial Sequence: Synthetic peptide
  Seed: HLSPNDPIF (TYRP1_HUMAN)
HISPNDPIL

SEQ ID NO: 180651 - protein, 10 aa, Artificial Sequence
  Description of Artificial Sequence: Synthetic peptide
  Seed: RSMDEANQPL (TYRP1_HUMAN)
RWMDEANQPL

SEQ ID NO: 180652 - protein, 10 aa, Artificial Sequence
  Description of Artificial Sequence: Synthetic peptide
  Seed: IAVVGALLLV (TYRP1_HUMAN)
ISVVGALLLV

SEQ ID NO: 180653 - protein, 9 aa, Artificial Sequence
  Description of Artificial Sequence: Synthetic peptide
  Seed: RPHSPQYPH (TYRP1_HUMAN)
RPHSPQYPF

SEQ ID NO: 180654 - protein, 9 aa, Artificial Sequence
  Description of Artificial Sequence: Synthetic peptide
  Seed: FSVPEIIAI (TYRP1_HUMAN)
FTVPEIIAL

SEQ ID NO: 180655 - protein, 10 aa, Artificial Sequence
  Description of Artificial Sequence: Synthetic peptide
  Seed: VLLHTFTDAV (TYRP1_HUMAN)
VGLHTFTDAV

SEQ ID NO: 180656 - protein, 10 aa, Artificial Sequence
  Description of Artificial Sequence: Synthetic peptide
  Seed: LLLVALIFGT (TYRP1_HUMAN)
LVLVALIFGL

SEQ ID NO: 180657 - protein, 11 aa, Artificial Sequence
  Description of Artificial Sequence: Synthetic peptide
  Seed: AACDQRVLIVR (TYRP1_HUMAN)
ATCDQRVLIVR

SEQ ID NO: 180658 - protein, 9 aa, Artificial Sequence
  Description of Artificial Sequence: Synthetic peptide
  Seed: SRSNFDSTL (TYRP1_HUMAN)
SVSNFDSTF

SEQ ID NO: 180659 - protein, 9 aa, Artificial Sequence
  Description of Artificial Sequence: Synthetic peptide
  Seed: FVRALDMAK (TYRP1_HUMAN)
FTRALDMAK

SEQ ID NO: 180660 - protein, 10 aa, Artificial Sequence
  Description of Artificial Sequence: Synthetic peptide
  Seed: SVPEIIAIAV (TYRP1_HUMAN)
SMPEIIAIAL

SEQ ID NO: 180661 - protein, 9 aa, Artificial Sequence
  Description of Artificial Sequence: Synthetic peptide
  Seed: LIFGTASYL (TYRP1_HUMAN)
LMFGTASYL

SEQ ID NO: 180662 - protein, 9 aa, Artificial Sequence
  Description of Artificial Sequence: Synthetic peptide
  Seed: LLTDQYQCY (TYRP1_HUMAN)
LYTDQYQCY

SEQ ID NO: 180663 - protein, 9 aa, Artificial Sequence
  Description of Artificial Sequence: Synthetic peptide
  Seed: IIAIAVVGA (TYRP1_HUMAN)
ILAIAVVGI

SEQ ID NO: 180664 - protein, 9 aa, Artificial Sequence
  Description of Artificial Sequence: Synthetic peptide
  Seed: STNSFRNTV (TYRP1_HUMAN)
SVNSFRNTF

SEQ ID NO: 180665 - protein, 10 aa, Artificial Sequence
  Description of Artificial Sequence: Synthetic peptide
  Seed: SQWRVVCDSL (TYRP1_HUMAN)
SQWRVVCDSF

SEQ ID NO: 180666 - protein, 10 aa, Artificial Sequence
  Description of Artificial Sequence: Synthetic peptide
  Seed: KRTTHPLFVI (TYRP1_HUMAN)
KPTTHPLFVW

SEQ ID NO: 180667 - protein, 9 aa, Artificial Sequence
  Description of Artificial Sequence: Synthetic peptide
  Seed: RTTHPLFVI (TYRP1_HUMAN)
RMTHPLFVI

SEQ ID NO: 180668 - protein, 10 aa, Artificial Sequence
  Description of Artificial Sequence: Synthetic peptide
  Seed: HLSPNDPIFV (TYRP1_HUMAN)
HASPNDPIFM

SEQ ID NO: 180669 - protein, 9 aa, Artificial Sequence
  Description of Artificial Sequence: Synthetic peptide
  Seed: RVLIVRRNL (TYRP1_HUMAN)
RPLIVRRNV

SEQ ID NO: 180670 - protein, 9 aa, Artificial Sequence
  Description of Artificial Sequence: Synthetic peptide
  Seed: ALLLVALIF (TYRP1_HUMAN)
ASLLVALIF

SEQ ID NO: 180671 - protein, 10 aa, Artificial Sequence
  Description of Artificial Sequence: Synthetic peptide
  Seed: SPNDPIFVLL (TYRP1_HUMAN)
STNDPIFVLF

SEQ ID NO: 180672 - protein, 10 aa, Artificial Sequence
  Description of Artificial Sequence: Synthetic peptide
  Seed: VALIFGTASY (TYRP1_HUMAN)
VVLIFGTASW

SEQ ID NO: 180673 - protein, 10 aa, Artificial Sequence
  Description of Artificial Sequence: Synthetic peptide
  Seed: LLLVALIFGT (TYRP1_HUMAN)
LFLVALIFGL

SEQ ID NO: 180674 - protein, 10 aa, Artificial Sequence
  Description of Artificial Sequence: Synthetic peptide
  Seed: GKYDPAVRSL (TYRP1_HUMAN)
GEYDPAVRSY

SEQ ID NO: 180675 - protein, 9 aa, Artificial Sequence
  Description of Artificial Sequence: Synthetic peptide
  Seed: IIAIAVVGA (TYRP1_HUMAN)
IMAIAVVGV

SEQ ID NO: 180676 - protein, 9 aa, Artificial Sequence
  Description of Artificial Sequence: Synthetic peptide
  Seed: SLHNLAHLF (TYRP1_HUMAN)
SYHNLAHLM

SEQ ID NO: 180677 - protein, 9 aa, Artificial Sequence
  Description of Artificial Sequence: Synthetic peptide
  Seed: NVARPMVQR (TYRP1_HUMAN)
NTARPMVQK

SEQ ID NO: 180678 - protein, 10 aa, Artificial Sequence
  Description of Artificial Sequence: Synthetic peptide
  Seed: FVWTHYYSVK (TYRP1_HUMAN)
FQWTHYYSVA

SEQ ID NO: 180679 - protein, 9 aa, Artificial Sequence
  Description of Artificial Sequence: Synthetic peptide
  Seed: VCDICTDDL (TYRP1_HUMAN)
VADICTDDL

SEQ ID NO: 180680 - protein, 9 aa, Artificial Sequence
  Description of Artificial Sequence: Synthetic peptide
  Seed: CIFFPLLLF (TYRP1_HUMAN)
CAFFPLLLY

SEQ ID NO: 180681 - protein, 10 aa, Artificial Sequence
  Description of Artificial Sequence: Synthetic peptide
  Seed: EMLQEPSFSL (TYRP1_HUMAN)
EMLQEPSFSI

SEQ ID NO: 180682 - protein, 8 aa, Artificial Sequence
  Description of Artificial Sequence: Synthetic peptide
  Seed: YSDPTGKY (TYRP1_HUMAN)
YIDPTGKL

SEQ ID NO: 180683 - protein, 10 aa, Artificial Sequence
  Description of Artificial Sequence: Synthetic peptide
  Seed: FSLPYWNFAT (TYRP1_HUMAN)
FVLPYWNFAI

SEQ ID NO: 180684 - protein, 11 aa, Artificial Sequence
  Description of Artificial Sequence: Synthetic peptide
  Seed: REFSVPEIIAI (TYRP1_HUMAN)
RFFSVPEIIAF

SEQ ID NO: 180685 - protein, 9 aa, Artificial Sequence
  Description of Artificial Sequence: Synthetic peptide
  Seed: TLISPNSVF (TYRP1_HUMAN)
TYISPNSVL

SEQ ID NO: 180686 - protein, 10 aa, Artificial Sequence
  Description of Artificial Sequence: Synthetic peptide
  Seed: NYFVWTHYYS (TYRP1_HUMAN)
NLFVWTHYYY

SEQ ID NO: 180687 - protein, 9 aa, Artificial Sequence
  Description of Artificial Sequence: Synthetic peptide
  Seed: NHFVRALDM (TYRP1_HUMAN)
NHFVRALDA

SEQ ID NO: 180688 - protein, 10 aa, Artificial Sequence
  Description of Artificial Sequence: Synthetic peptide
  Seed: GNVARPMVQR (TYRP1_HUMAN)
GCVARPMVQK

SEQ ID NO: 180689 - protein, 9 aa, Artificial Sequence
  Description of Artificial Sequence: Synthetic peptide
  Seed: SLPYWNFAT (TYRP1_HUMAN)
SMPYWNFAT

SEQ ID NO: 180690 - protein, 10 aa, Artificial Sequence
  Description of Artificial Sequence: Synthetic peptide
  Seed: FENISIYNYF (TYRP1_HUMAN)
FKNISIYNYF

SEQ ID NO: 180691 - protein, 10 aa, Artificial Sequence
  Description of Artificial Sequence: Synthetic peptide
  Seed: LSLGCIFFPL (TYRP1_HUMAN)
LCLGCIFFPV

SEQ ID NO: 180692 - protein, 9 aa, Artificial Sequence
  Description of Artificial Sequence: Synthetic peptide
  Seed: APDNLGYTY (TYRP1_HUMAN)
AMDNLGYTY

SEQ ID NO: 180693 - protein, 9 aa, Artificial Sequence
  Description of Artificial Sequence: Synthetic peptide
  Seed: AVRSLHNLA (TYRP1_HUMAN)
AVRSLHNLS

SEQ ID NO: 180694 - protein, 10 aa, Artificial Sequence
  Description of Artificial Sequence: Synthetic peptide
  Seed: FSLPYWNFAT (TYRP1_HUMAN)
FILPYWNFAT

SEQ ID NO: 180695 - protein, 9 aa, Artificial Sequence
  Description of Artificial Sequence: Synthetic peptide
  Seed: MSAPKLLSL (TYRP1_HUMAN)
MRAPKLLSY

SEQ ID NO: 180696 - protein, 9 aa, Artificial Sequence
  Description of Artificial Sequence: Synthetic peptide
  Seed: IAIAVVGAL (TYRP1_HUMAN)
IPIAVVGAT

SEQ ID NO: 180697 - protein, 9 aa, Artificial Sequence
  Description of Artificial Sequence: Synthetic peptide
  Seed: LSPNDPIFV (TYRP1_HUMAN)
LIPNDPIFV

SEQ ID NO: 180698 - protein, 9 aa, Artificial Sequence
  Description of Artificial Sequence: Synthetic peptide
  Seed: MLQEPSFSL (TYRP1_HUMAN)
MLQEPSFSC

SEQ ID NO: 180699 - protein, 9 aa, Artificial Sequence
  Description of Artificial Sequence: Synthetic peptide
  Seed: NRQYNMVPF (TYRP1_HUMAN)
NFQYNMVPL

SEQ ID NO: 180700 - protein, 10 aa, Artificial Sequence
  Description of Artificial Sequence: Synthetic peptide
  Seed: YNYFVWTHYY (TYRP1_HUMAN)
YFYFVWTHYL

SEQ ID NO: 180701 - protein, 9 aa, Artificial Sequence
  Description of Artificial Sequence: Synthetic peptide
  Seed: RYNADISTF (TYRP1_HUMAN)
RFNADISTW

SEQ ID NO: 180702 - protein, 9 aa, Artificial Sequence
  Description of Artificial Sequence: Synthetic peptide
  Seed: ASYLIRARR (TYRP1_HUMAN)
AMYLIRARK

SEQ ID NO: 180703 - protein, 9 aa, Artificial Sequence
  Description of Artificial Sequence: Synthetic peptide
  Seed: REFSVPEII (TYRP1_HUMAN)
RQFSVPEIV

SEQ ID NO: 180704 - protein, 9 aa, Artificial Sequence
  Description of Artificial Sequence: Synthetic peptide
  Seed: FSVPEIIAI (TYRP1_HUMAN)
FAVPEIIAH

SEQ ID NO: 180705 - protein, 9 aa, Artificial Sequence
  Description of Artificial Sequence: Synthetic peptide
  Seed: GLFDTPPFY (TYRP1_HUMAN)
GTFDTPPFR

SEQ ID NO: 180706 - protein, 10 aa, Artificial Sequence
  Description of Artificial Sequence: Synthetic peptide
  Seed: TPQFENISIY (TYRP1_HUMAN)
TSQFENISIM

SEQ ID NO: 180707 - protein, 9 aa, Artificial Sequence
  Description of Artificial Sequence: Synthetic peptide
  Seed: TLISPNSVF (TYRP1_HUMAN)
TAISPNSVW

SEQ ID NO: 180708 - protein, 10 aa, Artificial Sequence
  Description of Artificial Sequence: Synthetic peptide
  Seed: SMDEANQPLL (TYRP1_HUMAN)
SMDEANQPLV

SEQ ID NO: 180709 - protein, 9 aa, Artificial Sequence
  Description of Artificial Sequence: Synthetic peptide
  Seed: ISIYNYFVW (TYRP1_HUMAN)
IMIYNYFVM

SEQ ID NO: 180710 - protein, 9 aa, Artificial Sequence
  Description of Artificial Sequence: Synthetic peptide
  Seed: VLLHTFTDA (TYRP1_HUMAN)
VMLHTFTDV

SEQ ID NO: 180711 - protein, 9 aa, Artificial Sequence
  Description of Artificial Sequence: Synthetic peptide
  Seed: LLHTFTDAV (TYRP1_HUMAN)
LMHTFTDAL

SEQ ID NO: 180712 - protein, 9 aa, Artificial Sequence
  Description of Artificial Sequence: Synthetic peptide
  Seed: FSHEGPAFL (TYRP1_HUMAN)
FAHEGPAFA

SEQ ID NO: 180713 - protein, 9 aa, Artificial Sequence
  Description of Artificial Sequence: Synthetic peptide
  Seed: DQRVLIVRR (TYRP1_HUMAN)
DARVLIVRR

SEQ ID NO: 180714 - protein, 11 aa, Artificial Sequence
  Description of Artificial Sequence: Synthetic peptide
  Seed: YNYFVWTHYYS (TYRP1_HUMAN)
YMYFVWTHYYA

SEQ ID NO: 180715 - protein, 10 aa, Artificial Sequence
  Description of Artificial Sequence: Synthetic peptide
  Seed: VALIFGTASY (TYRP1_HUMAN)
VHLIFGTASY

SEQ ID NO: 180716 - protein, 9 aa, Artificial Sequence
  Description of Artificial Sequence: Synthetic peptide
  Seed: LLDLSKEEK (TYRP1_HUMAN)
LIDLSKEEY

SEQ ID NO: 180717 - protein, 9 aa, Artificial Sequence
  Description of Artificial Sequence: Synthetic peptide
  Seed: VLIVRRNLL (TYRP1_HUMAN)
VYIVRRNLY

SEQ ID NO: 180718 - protein, 10 aa, Artificial Sequence
  Description of Artificial Sequence: Synthetic peptide
  Seed: LIFGTASYLI (TYRP1_HUMAN)
LWFGTASYLI

SEQ ID NO: 180719 - protein, 11 aa, Artificial Sequence
  Description of Artificial Sequence: Synthetic peptide
  Seed: YNMVPFWPPVT (TYRP1_HUMAN)
YMMVPFWPPVC

SEQ ID NO: 180720 - protein, 10 aa, Artificial Sequence
  Description of Artificial Sequence: Synthetic peptide
  Seed: FSLPYWNFAT (TYRP1_HUMAN)
FALPYWNFAA

SEQ ID NO: 180721 - protein, 10 aa, Artificial Sequence
  Description of Artificial Sequence: Synthetic peptide
  Seed: FSLPYWNFAT (TYRP1_HUMAN)
FPLPYWNFAA

SEQ ID NO: 180722 - protein, 8 aa, Artificial Sequence
  Description of Artificial Sequence: Synthetic peptide
  Seed: LFDTPPFY (TYRP1_HUMAN)
LWDTPPFI

SEQ ID NO: 180723 - protein, 10 aa, Artificial Sequence
  Description of Artificial Sequence: Synthetic peptide
  Seed: EGYSDPTGKY (TYRP1_HUMAN)
EVYSDPTGKF

SEQ ID NO: 180724 - protein, 9 aa, Artificial Sequence
  Description of Artificial Sequence: Synthetic peptide
  Seed: GLFDTPPFY (TYRP1_HUMAN)
GTFDTPPFY

SEQ ID NO: 180725 - protein, 10 aa, Artificial Sequence
  Description of Artificial Sequence: Synthetic peptide
  Seed: LQEPSFSLPY (TYRP1_HUMAN)
LHEPSFSLPY

SEQ ID NO: 180726 - protein, 9 aa, Artificial Sequence
  Description of Artificial Sequence: Synthetic peptide
  Seed: FYSNSTNSF (TYRP1_HUMAN)
FPSNSTNSA

SEQ ID NO: 180727 - protein, 9 aa, Artificial Sequence
  Description of Artificial Sequence: Synthetic peptide
  Seed: MAKRTTHPL (TYRP1_HUMAN)
MGKRTTHPY

SEQ ID NO: 180728 - protein, 10 aa, Artificial Sequence
  Description of Artificial Sequence: Synthetic peptide
  Seed: TAPDNLGYTY (TYRP1_HUMAN)
TSPDNLGYTY

SEQ ID NO: 180729 - protein, 9 aa, Artificial Sequence
  Description of Artificial Sequence: Synthetic peptide
  Seed: RPGWRGAAC (TYRP1_HUMAN)
RTGWRGAAM

SEQ ID NO: 180730 - protein, 11 aa, Artificial Sequence
  Description of Artificial Sequence: Synthetic peptide
  Seed: YNMVPFWPPVT (TYRP1_HUMAN)
YFMVPFWPPVV

SEQ ID NO: 180731 - protein, 10 aa, Artificial Sequence
  Description of Artificial Sequence: Synthetic peptide
  Seed: KLLSLGCIFF (TYRP1_HUMAN)
KALSLGCIFW

SEQ ID NO: 180732 - protein, 10 aa, Artificial Sequence
  Description of Artificial Sequence: Synthetic peptide
  Seed: MAKRTTHPLF (TYRP1_HUMAN)
MPKRTTHPLM

SEQ ID NO: 180733 - protein, 9 aa, Artificial Sequence
  Description of Artificial Sequence: Synthetic peptide
  Seed: MLQEPSFSL (TYRP1_HUMAN)
MLQEPSFSR

SEQ ID NO: 180734 - protein, 9 aa, Artificial Sequence
  Description of Artificial Sequence: Synthetic peptide
  Seed: QEMLQEPSF (TYRP1_HUMAN)
QSMLQEPSY

SEQ ID NO: 180735 - protein, 9 aa, Artificial Sequence
  Description of Artificial Sequence: Synthetic peptide
  Seed: IAIAVVGAL (TYRP1_HUMAN)
ITIAVVGAR

SEQ ID NO: 180736 - protein, 9 aa, Artificial Sequence
  Description of Artificial Sequence: Synthetic peptide
  Seed: VFDEWLRRY (TYRP1_HUMAN)
VGDEWLRRL

SEQ ID NO: 180737 - protein, 10 aa, Artificial Sequence
  Description of Artificial Sequence: Synthetic peptide
  Seed: RRYNADISTF (TYRP1_HUMAN)
REYNADISTM

SEQ ID NO: 180738 - protein, 9 aa, Artificial Sequence
  Description of Artificial Sequence: Synthetic peptide
  Seed: DSRPHSPQY (TYRP1_HUMAN)
DARPHSPQF

SEQ ID NO: 180739 - protein, 9 aa, Artificial Sequence
  Description of Artificial Sequence: Synthetic peptide
  Seed: SMDEANQPL (TYRP1_HUMAN)
SIDEANQPY

SEQ ID NO: 180740 - protein, 10 aa, Artificial Sequence
  Description of Artificial Sequence: Synthetic peptide
  Seed: EIIAIAVVGA (TYRP1_HUMAN)
EIIAIAVVGV

SEQ ID NO: 180741 - protein, 9 aa, Artificial Sequence
  Description of Artificial Sequence: Synthetic peptide
  Seed: YLIRARRSM (TYRP1_HUMAN)
YMIRARRSM

SEQ ID NO: 180742 - protein, 9 aa, Artificial Sequence
  Description of Artificial Sequence: Synthetic peptide
  Seed: FSVPEIIAI (TYRP1_HUMAN)
FHVPEIIAY

SEQ ID NO: 180743 - protein, 9 aa, Artificial Sequence
  Description of Artificial Sequence: Synthetic peptide
  Seed: FLGVGQESF (TYRP1_HUMAN)
FAGVGQESY

SEQ ID NO: 180744 - protein, 9 aa, Artificial Sequence
  Description of Artificial Sequence: Synthetic peptide
  Seed: HPLFVIATR (TYRP1_HUMAN)
HFLFVIATR

SEQ ID NO: 180745 - protein, 11 aa, Artificial Sequence
  Description of Artificial Sequence: Synthetic peptide
  Seed: YNYFVWTHYYS (TYRP1_HUMAN)
YEYFVWTHYYY

SEQ ID NO: 180746 - protein, 11 aa, Artificial Sequence
  Description of Artificial Sequence: Synthetic peptide
  Seed: QEMLQEPSFSL (TYRP1_HUMAN)
QDMLQEPSFSV

SEQ ID NO: 180747 - protein, 9 aa, Artificial Sequence
  Description of Artificial Sequence: Synthetic peptide
  Seed: YTYEIQWPS (TYRP1_HUMAN)
YCYEIQWPV

SEQ ID NO: 180748 - protein, 9 aa, Artificial Sequence
  Description of Artificial Sequence: Synthetic peptide
  Seed: PIFVLLHTF (TYRP1_HUMAN)
PWFVLLHTF

SEQ ID NO: 180749 - protein, 9 aa, Artificial Sequence
  Description of Artificial Sequence: Synthetic peptide
  Seed: IAIAVVGAL (TYRP1_HUMAN)
IVIAVVGAF

SEQ ID NO: 180750 - protein, 8 aa, Artificial Sequence
  Description of Artificial Sequence: Synthetic peptide
  Seed: LFDTPPFY (TYRP1_HUMAN)
LFDTPPFI

SEQ ID NO: 180751 - protein, 11 aa, Artificial Sequence
  Description of Artificial Sequence: Synthetic peptide
  Seed: VRSLHNLAHLF (TYRP1_HUMAN)
VTSLHNLAHLW

SEQ ID NO: 180752 - protein, 9 aa, Artificial Sequence
  Description of Artificial Sequence: Synthetic peptide
  Seed: ISIYNYFVW (TYRP1_HUMAN)
IVIYNYFVY

SEQ ID NO: 180753 - protein, 10 aa, Artificial Sequence
  Description of Artificial Sequence: Synthetic peptide
  Seed: YSVKKTFLGV (TYRP1_HUMAN)
YQVKKTFLGL

SEQ ID NO: 180754 - protein, 9 aa, Artificial Sequence
  Description of Artificial Sequence: Synthetic peptide
  Seed: SPNSVFSQW (TYRP1_HUMAN)
STNSVFSQW

SEQ ID NO: 180755 - protein, 9 aa, Artificial Sequence
  Description of Artificial Sequence: Synthetic peptide
  Seed: REFSVPEII (TYRP1_HUMAN)
RNFSVPEIY

SEQ ID NO: 180756 - protein, 9 aa, Artificial Sequence
  Description of Artificial Sequence: Synthetic peptide
  Seed: SVKKTFLGV (TYRP1_HUMAN)
SSKKTFLGL

SEQ ID NO: 180757 - protein, 11 aa, Artificial Sequence
  Description of Artificial Sequence: Synthetic peptide
  Seed: RSMDEANQPLL (TYRP1_HUMAN)
RMMDEANQPLM

SEQ ID NO: 180758 - protein, 9 aa, Artificial Sequence
  Description of Artificial Sequence: Synthetic peptide
  Seed: AQFPRQCAT (TYRP1_HUMAN)
AGFPRQCAY

SEQ ID NO: 180759 - protein, 11 aa, Artificial Sequence
  Description of Artificial Sequence: Synthetic peptide
  Seed: QEMLQEPSFSL (TYRP1_HUMAN)
QHMLQEPSFSV

SEQ ID NO: 180760 - protein, 9 aa, Artificial Sequence
  Description of Artificial Sequence: Synthetic peptide
  Seed: SLHNLAHLF (TYRP1_HUMAN)
SLHNLAHLA

SEQ ID NO: 180761 - protein, 9 aa, Artificial Sequence
  Description of Artificial Sequence: Synthetic peptide
  Seed: MSAPKLLSL (TYRP1_HUMAN)
MVAPKLLSY

SEQ ID NO: 180762 - protein, 11 aa, Artificial Sequence
  Description of Artificial Sequence: Synthetic peptide
  Seed: FVLLHTFTDAV (TYRP1_HUMAN)
FWLLHTFTDAL

SEQ ID NO: 180763 - protein, 9 aa, Artificial Sequence
  Description of Artificial Sequence: Synthetic peptide
  Seed: RGRCEAVTA (TYRP1_HUMAN)
RMRCEAVTA

SEQ ID NO: 180764 - protein, 9 aa, Artificial Sequence
  Description of Artificial Sequence: Synthetic peptide
  Seed: TTHPLFVIA (TYRP1_HUMAN)
TSHPLFVIV

SEQ ID NO: 180765 - protein, 10 aa, Artificial Sequence
  Description of Artificial Sequence: Synthetic peptide
  Seed: FSVPEIIAIA (TYRP1_HUMAN)
FEVPEIIAIV

SEQ ID NO: 180766 - protein, 9 aa, Artificial Sequence
  Description of Artificial Sequence: Synthetic peptide
  Seed: RSNFDSTLI (TYRP1_HUMAN)
RVNFDSTLK

SEQ ID NO: 180767 - protein, 10 aa, Artificial Sequence
  Description of Artificial Sequence: Synthetic peptide
  Seed: VGLFDTPPFY (TYRP1_HUMAN)
VLLFDTPPFY

SEQ ID NO: 180768 - protein, 9 aa, Artificial Sequence
  Description of Artificial Sequence: Synthetic peptide
  Seed: LLHTFTDAV (TYRP1_HUMAN)
LIHTFTDAL

SEQ ID NO: 180769 - protein, 9 aa, Artificial Sequence
  Description of Artificial Sequence: Synthetic peptide
  Seed: RLPEPQDVA (TYRP1_HUMAN)
RLPEPQDVI

SEQ ID NO: 180770 - protein, 9 aa, Artificial Sequence
  Description of Artificial Sequence: Synthetic peptide
  Seed: SHEGPAFLT (TYRP1_HUMAN)
SHEGPAFLF

SEQ ID NO: 180771 - protein, 10 aa, Artificial Sequence
  Description of Artificial Sequence: Synthetic peptide
  Seed: SIYNYFVWTH (TYRP1_HUMAN)
SMYNYFVWTK

SEQ ID NO: 180772 - protein, 10 aa, Artificial Sequence
  Description of Artificial Sequence: Synthetic peptide
  Seed: FSLPYWNFAT (TYRP1_HUMAN)
FKLPYWNFAV

SEQ ID NO: 180773 - protein, 9 aa, Artificial Sequence
  Description of Artificial Sequence: Synthetic peptide
  Seed: TWHRYHLLR (TYRP1_HUMAN)
TTHRYHLLK

SEQ ID NO: 180774 - protein, 9 aa, Artificial Sequence
  Description of Artificial Sequence: Synthetic peptide
  Seed: RGRCEAVTA (TYRP1_HUMAN)
RMRCEAVTK

SEQ ID NO: 180775 - protein, 10 aa, Artificial Sequence
  Description of Artificial Sequence: Synthetic peptide
  Seed: YNYFVWTHYY (TYRP1_HUMAN)
YYYFVWTHYF

SEQ ID NO: 180776 - protein, 10 aa, Artificial Sequence
  Description of Artificial Sequence: Synthetic peptide
  Seed: YTYEIQWPSR (TYRP1_HUMAN)
YSYEIQWPSK

SEQ ID NO: 180777 - protein, 9 aa, Artificial Sequence
  Description of Artificial Sequence: Synthetic peptide
  Seed: GALLLVALI (TYRP1_HUMAN)
GQLLLVALI

SEQ ID NO: 180778 - protein, 9 aa, Artificial Sequence
  Description of Artificial Sequence: Synthetic peptide
  Seed: RYNADISTF (TYRP1_HUMAN)
RLNADISTF

SEQ ID NO: 180779 - protein, 9 aa, Artificial Sequence
  Description of Artificial Sequence: Synthetic peptide
  Seed: AVFDEWLRR (TYRP1_HUMAN)
AAFDEWLRY

SEQ ID NO: 180780 - protein, 10 aa, Artificial Sequence
  Description of Artificial Sequence: Synthetic peptide
  Seed: RYNADISTFP (TYRP1_HUMAN)
RWNADISTFF

SEQ ID NO: 180781 - protein, 9 aa, Artificial Sequence
  Description of Artificial Sequence: Synthetic peptide
  Seed: QEMLQEPSF (TYRP1_HUMAN)
QEMLQEPSL

SEQ ID NO: 180782 - protein, 9 aa, Artificial Sequence
  Description of Artificial Sequence: Synthetic peptide
  Seed: VTAPDNLGY (TYRP1_HUMAN)
VLAPDNLGY

SEQ ID NO: 180783 - protein, 10 aa, Artificial Sequence
  Description of Artificial Sequence: Synthetic peptide
  Seed: LSLGCIFFPL (TYRP1_HUMAN)
LGLGCIFFPV

SEQ ID NO: 180784 - protein, 9 aa, Artificial Sequence
  Description of Artificial Sequence: Synthetic peptide
  Seed: FPLLLFQQA (TYRP1_HUMAN)
FALLLFQQM

SEQ ID NO: 180785 - protein, 10 aa, Artificial Sequence
  Description of Artificial Sequence: Synthetic peptide
  Seed: YNADISTFPL (TYRP1_HUMAN)
YPADISTFPM

SEQ ID NO: 180786 - protein, 9 aa, Artificial Sequence
  Description of Artificial Sequence: Synthetic peptide
  Seed: NVARPMVQR (TYRP1_HUMAN)
NTARPMVQR

SEQ ID NO: 180787 - protein, 10 aa, Artificial Sequence
  Description of Artificial Sequence: Synthetic peptide
  Seed: VALIFGTASY (TYRP1_HUMAN)
VLLIFGTASF

SEQ ID NO: 180788 - protein, 9 aa, Artificial Sequence
  Description of Artificial Sequence: Synthetic peptide
  Seed: LSKEEKNHF (TYRP1_HUMAN)
LAKEEKNHM

SEQ ID NO: 180789 - protein, 10 aa, Artificial Sequence
  Description of Artificial Sequence: Synthetic peptide
  Seed: PFYSNSTNSF (TYRP1_HUMAN)
PYYSNSTNSF

SEQ ID NO: 180790 - protein, 9 aa, Artificial Sequence
  Description of Artificial Sequence: Synthetic peptide
  Seed: VFDEWLRRY (TYRP1_HUMAN)
VADEWLRRI

SEQ ID NO: 180791 - protein, 9 aa, Artificial Sequence
  Description of Artificial Sequence: Synthetic peptide
  Seed: FVRALDMAK (TYRP1_HUMAN)
FTRALDMAR

SEQ ID NO: 180792 - protein, 8 aa, Artificial Sequence
  Description of Artificial Sequence: Synthetic peptide
  Seed: LIFGTASY (TYRP1_HUMAN)
LMFGTASY

SEQ ID NO: 180793 - protein, 9 aa, Artificial Sequence
  Description of Artificial Sequence: Synthetic peptide
  Seed: REFSVPEII (TYRP1_HUMAN)
RKFSVPEIY

SEQ ID NO: 180794 - protein, 9 aa, Artificial Sequence
  Description of Artificial Sequence: Synthetic peptide
  Seed: RSNFDSTLI (TYRP1_HUMAN)
RMNFDSTLI

SEQ ID NO: 180795 - protein, 9 aa, Artificial Sequence
  Description of Artificial Sequence: Synthetic peptide
  Seed: REVWPLRFF (TYRP1_HUMAN)
RQVWPLRFY

SEQ ID NO: 180796 - protein, 9 aa, Artificial Sequence
  Description of Artificial Sequence: Synthetic peptide
  Seed: VGLFDTPPF (TYRP1_HUMAN)
VSLFDTPPM

SEQ ID NO: 180797 - protein, 10 aa, Artificial Sequence
  Description of Artificial Sequence: Synthetic peptide
  Seed: YFVWTHYYSV (TYRP1_HUMAN)
YYVWTHYYSW

SEQ ID NO: 180798 - protein, 9 aa, Artificial Sequence
  Description of Artificial Sequence: Synthetic peptide
  Seed: SLPYWNFAT (TYRP1_HUMAN)
SMPYWNFAC

SEQ ID NO: 180799 - protein, 10 aa, Artificial Sequence
  Description of Artificial Sequence: Synthetic peptide
  Seed: FSLPYWNFAT (TYRP1_HUMAN)
FRLPYWNFAI

SEQ ID NO: 180800 - protein, 10 aa, Artificial Sequence
  Description of Artificial Sequence: Synthetic peptide
  Seed: LSPNDPIFVL (TYRP1_HUMAN)
LIPNDPIFVW

SEQ ID NO: 180801 - protein, 11 aa, Artificial Sequence
  Description of Artificial Sequence: Synthetic peptide
  Seed: FWPPVTNTEMF (TYRP1_HUMAN)
FNPPVTNTEMW

SEQ ID NO: 180802 - protein, 10 aa, Artificial Sequence
  Description of Artificial Sequence: Synthetic peptide
  Seed: SFSLPYWNFA (TYRP1_HUMAN)
STSLPYWNFK

SEQ ID NO: 180803 - protein, 9 aa, Artificial Sequence
  Description of Artificial Sequence: Synthetic peptide
  Seed: FSHEGPAFL (TYRP1_HUMAN)
FVHEGPAFW

SEQ ID NO: 180804 - protein, 9 aa, Artificial Sequence
  Description of Artificial Sequence: Synthetic peptide
  Seed: RSLHNLAHL (TYRP1_HUMAN)
RLLHNLAHY

SEQ ID NO: 180805 - protein, 10 aa, Artificial Sequence
  Description of Artificial Sequence: Synthetic peptide
  Seed: EIIAIAVVGA (TYRP1_HUMAN)
EYIAIAVVGV

SEQ ID NO: 180806 - protein, 10 aa, Artificial Sequence
  Description of Artificial Sequence: Synthetic peptide
  Seed: FPRQCATVEA (TYRP1_HUMAN)
FPRQCATVEL

SEQ ID NO: 180807 - protein, 10 aa, Artificial Sequence
  Description of Artificial Sequence: Synthetic peptide
  Seed: GTCRPGWRGA (TYRP1_HUMAN)
GTCRPGWRGK

SEQ ID NO: 180808 - protein, 11 aa, Artificial Sequence
  Description of Artificial Sequence: Synthetic peptide
  Seed: KTFLGVGQESF (TYRP1_HUMAN)
KQFLGVGQESF

SEQ ID NO: 180809 - protein, 9 aa, Artificial Sequence
  Description of Artificial Sequence: Synthetic peptide
  Seed: SPNDPIFVL (TYRP1_HUMAN)
SGNDPIFVY

SEQ ID NO: 180810 - protein, 10 aa, Artificial Sequence
  Description of Artificial Sequence: Synthetic peptide
  Seed: AQFPRQCATV (TYRP1_HUMAN)
AKFPRQCATY

SEQ ID NO: 180811 - protein, 9 aa, Artificial Sequence
  Description of Artificial Sequence: Synthetic peptide
  Seed: MSAPKLLSL (TYRP1_HUMAN)
MMAPKLLSH

SEQ ID NO: 180812 - protein, 9 aa, Artificial Sequence
  Description of Artificial Sequence: Synthetic peptide
  Seed: LHNLAHLFL (TYRP1_HUMAN)
LKNLAHLFL

SEQ ID NO: 180813 - protein, 11 aa, Artificial Sequence
  Description of Artificial Sequence: Synthetic peptide
  Seed: REFSVPEIIAI (TYRP1_HUMAN)
RIFSVPEIIAW

SEQ ID NO: 180814 - protein, 11 aa, Artificial Sequence
  Description of Artificial Sequence: Synthetic peptide
  Seed: RYNADISTFPL (TYRP1_HUMAN)
RYNADISTFPW

SEQ ID NO: 180815 - protein, 9 aa, Artificial Sequence
  Description of Artificial Sequence: Synthetic peptide
  Seed: LLDLSKEEK (TYRP1_HUMAN)
LTDLSKEEY

SEQ ID NO: 180816 - protein, 9 aa, Artificial Sequence
  Description of Artificial Sequence: Synthetic peptide
  Seed: NYFVWTHYY (TYRP1_HUMAN)
NTFVWTHYK

SEQ ID NO: 180817 - protein, 9 aa, Artificial Sequence
  Description of Artificial Sequence: Synthetic peptide
  Seed: LIFGTASYL (TYRP1_HUMAN)
LAFGTASYA

SEQ ID NO: 180818 - protein, 9 aa, Artificial Sequence
  Description of Artificial Sequence: Synthetic peptide
  Seed: MLQEPSFSL (TYRP1_HUMAN)
MHQEPSFSV

SEQ ID NO: 180819 - protein, 8 aa, Artificial Sequence
  Description of Artificial Sequence: Synthetic peptide
  Seed: RQYNMVPF (TYRP1_HUMAN)
RRYNMVPI

SEQ ID NO: 180820 - protein, 9 aa, Artificial Sequence
  Description of Artificial Sequence: Synthetic peptide
  Seed: RSLHNLAHL (TYRP1_HUMAN)
RVLHNLAHA

SEQ ID NO: 180821 - protein, 11 aa, Artificial Sequence
  Description of Artificial Sequence: Synthetic peptide
  Seed: ILGPDGNTPQF (TYRP1_HUMAN)
IQGPDGNTPQY

SEQ ID NO: 180822 - protein, 9 aa, Artificial Sequence
  Description of Artificial Sequence: Synthetic peptide
  Seed: LTDQYQCYA (TYRP1_HUMAN)
LIDQYQCYI

SEQ ID NO: 180823 - protein, 9 aa, Artificial Sequence
  Description of Artificial Sequence: Synthetic peptide
  Seed: RQYNMVPFW (TYRP1_HUMAN)
RAYNMVPFL

SEQ ID NO: 180824 - protein, 10 aa, Artificial Sequence
  Description of Artificial Sequence: Synthetic peptide
  Seed: VDFSHEGPAF (TYRP1_HUMAN)
VMFSHEGPAF

SEQ ID NO: 180825 - protein, 9 aa, Artificial Sequence
  Description of Artificial Sequence: Synthetic peptide
  Seed: LQNPNQSVV (TYRP1_HUMAN)
LFNPNQSVL

SEQ ID NO: 180826 - protein, 9 aa, Artificial Sequence
  Description of Artificial Sequence: Synthetic peptide
  Seed: NADISTFPL (TYRP1_HUMAN)
NKDISTFPL

SEQ ID NO: 180827 - protein, 9 aa, Artificial Sequence
  Description of Artificial Sequence: Synthetic peptide
  Seed: GPDGNTPQF (TYRP1_HUMAN)
GLDGNTPQV

SEQ ID NO: 180828 - protein, 9 aa, Artificial Sequence
  Description of Artificial Sequence: Synthetic peptide
  Seed: RLEKDMQEM (TYRP1_HUMAN)
RMEKDMQEI

SEQ ID NO: 180829 - protein, 9 aa, Artificial Sequence
  Description of Artificial Sequence: Synthetic peptide
  Seed: LFDTPPFYS (TYRP1_HUMAN)
LGDTPPFYL

SEQ ID NO: 180830 - protein, 9 aa, Artificial Sequence
  Description of Artificial Sequence: Synthetic peptide
  Seed: RRNLLDLSK (TYRP1_HUMAN)
RRNLLDLSY

SEQ ID NO: 180831 - protein, 9 aa, Artificial Sequence
  Description of Artificial Sequence: Synthetic peptide
  Seed: SPNSVFSQW (TYRP1_HUMAN)
SSNSVFSQY

SEQ ID NO: 180832 - protein, 9 aa, Artificial Sequence
  Description of Artificial Sequence: Synthetic peptide
  Seed: MAKRTTHPL (TYRP1_HUMAN)
MFKRTTHPL

SEQ ID NO: 180833 - protein, 10 aa, Artificial Sequence
  Description of Artificial Sequence: Synthetic peptide
  Seed: AQFPRQCATV (TYRP1_HUMAN)
AVFPRQCATY

SEQ ID NO: 180834 - protein, 9 aa, Artificial Sequence
  Description of Artificial Sequence: Synthetic peptide
  Seed: FLGVGQESF (TYRP1_HUMAN)
FVGVGQESL

SEQ ID NO: 180835 - protein, 8 aa, Artificial Sequence
  Description of Artificial Sequence: Synthetic peptide
  Seed: REFSVPEI (TYRP1_HUMAN)
RDFSVPEA

SEQ ID NO: 180836 - protein, 9 aa, Artificial Sequence
  Description of Artificial Sequence: Synthetic peptide
  Seed: FSHEGPAFL (TYRP1_HUMAN)
FMHEGPAFF

SEQ ID NO: 180837 - protein, 9 aa, Artificial Sequence
  Description of Artificial Sequence: Synthetic peptide
  Seed: SRSNFDSTL (TYRP1_HUMAN)
SQSNFDSTI

SEQ ID NO: 180838 - protein, 9 aa, Artificial Sequence
  Description of Artificial Sequence: Synthetic peptide
  Seed: GPDGNTPQF (TYRP1_HUMAN)
GSDGNTPQM

SEQ ID NO: 180839 - protein, 11 aa, Artificial Sequence
  Description of Artificial Sequence: Synthetic peptide
  Seed: FWPPVTNTEMF (TYRP1_HUMAN)
FLPPVTNTEMW

SEQ ID NO: 180840 - protein, 9 aa, Artificial Sequence
  Description of Artificial Sequence: Synthetic peptide
  Seed: VFDEWLRRY (TYRP1_HUMAN)
VCDEWLRRM

SEQ ID NO: 180841 - protein, 9 aa, Artificial Sequence
  Description of Artificial Sequence: Synthetic peptide
  Seed: FSVPEIIAI (TYRP1_HUMAN)
FQVPEIIAM

SEQ ID NO: 180842 - protein, 10 aa, Artificial Sequence
  Description of Artificial Sequence: Synthetic peptide
  Seed: FTDAVFDEWL (TYRP1_HUMAN)
FTDAVFDEWV

SEQ ID NO: 180843 - protein, 9 aa, Artificial Sequence
  Description of Artificial Sequence: Synthetic peptide
  Seed: RQYNMVPFW (TYRP1_HUMAN)
RRYNMVPFR

SEQ ID NO: 180844 - protein, 10 aa, Artificial Sequence
  Description of Artificial Sequence: Synthetic peptide
  Seed: VALIFGTASY (TYRP1_HUMAN)
VILIFGTASF

SEQ ID NO: 180845 - protein, 9 aa, Artificial Sequence
  Description of Artificial Sequence: Synthetic peptide
  Seed: IAVVGALLL (TYRP1_HUMAN)
IMVVGALLF

SEQ ID NO: 180846 - protein, 9 aa, Artificial Sequence
  Description of Artificial Sequence: Synthetic peptide
  Seed: NFDSTLISP (TYRP1_HUMAN)
NWDSTLISV

SEQ ID NO: 180847 - protein, 11 aa, Artificial Sequence
  Description of Artificial Sequence: Synthetic peptide
  Seed: QEMLQEPSFSL (TYRP1_HUMAN)
QPMLQEPSFSV

SEQ ID NO: 180848 - protein, 9 aa, Artificial Sequence
  Description of Artificial Sequence: Synthetic peptide
  Seed: FLTWHRYHL (TYRP1_HUMAN)
FATWHRYHY

SEQ ID NO: 180849 - protein, 9 aa, Artificial Sequence
  Description of Artificial Sequence: Synthetic peptide
  Seed: GPAFLTWHR (TYRP1_HUMAN)
GTAFLTWHK

SEQ ID NO: 180850 - protein, 11 aa, Artificial Sequence
  Description of Artificial Sequence: Synthetic peptide
  Seed: NTPQFENISIY (TYRP1_HUMAN)
NMPQFENISIY

SEQ ID NO: 180851 - protein, 10 aa, Artificial Sequence
  Description of Artificial Sequence: Synthetic peptide
  Seed: GKYDPAVRSL (TYRP1_HUMAN)
GAYDPAVRSF

SEQ ID NO: 180852 - protein, 9 aa, Artificial Sequence
  Description of Artificial Sequence: Synthetic peptide
  Seed: AACDQRVLI (TYRP1_HUMAN)
AACDQRVLF

SEQ ID NO: 180853 - protein, 9 aa, Artificial Sequence
  Description of Artificial Sequence: Synthetic peptide
  Seed: MSAPKLLSL (TYRP1_HUMAN)
MIAPKLLSM

SEQ ID NO: 180854 - protein, 10 aa, Artificial Sequence
  Description of Artificial Sequence: Synthetic peptide
  Seed: SVKKTFLGVG (TYRP1_HUMAN)
SVKKTFLGVK

SEQ ID NO: 180855 - protein, 10 aa, Artificial Sequence
  Description of Artificial Sequence: Synthetic peptide
  Seed: QCYAEEYEKL (TYRP1_HUMAN)
QIYAEEYEKF

SEQ ID NO: 180856 - protein, 9 aa, Artificial Sequence
  Description of Artificial Sequence: Synthetic peptide
  Seed: LIFGTASYL (TYRP1_HUMAN)
LYFGTASYF

SEQ ID NO: 180857 - protein, 11 aa, Artificial Sequence
  Description of Artificial Sequence: Synthetic peptide
  Seed: KTFLGVGQESF (TYRP1_HUMAN)
KMFLGVGQESL

SEQ ID NO: 180858 - protein, 10 aa, Artificial Sequence
  Description of Artificial Sequence: Synthetic peptide
  Seed: FSLPYWNFAT (TYRP1_HUMAN)
FHLPYWNFAI

SEQ ID NO: 180859 - protein, 11 aa, Artificial Sequence
  Description of Artificial Sequence: Synthetic peptide
  Seed: LVALIFGTASY (TYRP1_HUMAN)
LAALIFGTASW

SEQ ID NO: 180860 - protein, 11 aa, Artificial Sequence
  Description of Artificial Sequence: Synthetic peptide
  Seed: MAKRTTHPLFV (TYRP1_HUMAN)
MAKRTTHPLFK

SEQ ID NO: 180861 - protein, 10 aa, Artificial Sequence
  Description of Artificial Sequence: Synthetic peptide
  Seed: AVFDEWLRRY (TYRP1_HUMAN)
ALFDEWLRRY

SEQ ID NO: 180862 - protein, 10 aa, Artificial Sequence
  Description of Artificial Sequence: Synthetic peptide
  Seed: LIFGTASYLI (TYRP1_HUMAN)
LEFGTASYLF

SEQ ID NO: 180863 - protein, 10 aa, Artificial Sequence
  Description of Artificial Sequence: Synthetic peptide
  Seed: YNADISTFPL (TYRP1_HUMAN)
YNADISTFPM

SEQ ID NO: 180864 - protein, 9 aa, Artificial Sequence
  Description of Artificial Sequence: Synthetic peptide
  Seed: TAPDNLGYT (TYRP1_HUMAN)
TFPDNLGYL

SEQ ID NO: 180865 - protein, 9 aa, Artificial Sequence
  Description of Artificial Sequence: Synthetic peptide
  Seed: YYSVKKTFL (TYRP1_HUMAN)
YSSVKKTFY

SEQ ID NO: 180866 - protein, 10 aa, Artificial Sequence
  Description of Artificial Sequence: Synthetic peptide
  Seed: FSLPYWNFAT (TYRP1_HUMAN)
FKLPYWNFAL

SEQ ID NO: 180867 - protein, 9 aa, Artificial Sequence
  Description of Artificial Sequence: Synthetic peptide
  Seed: IATRRSEEI (TYRP1_HUMAN)
ISTRRSEEY

SEQ ID NO: 180868 - protein, 9 aa, Artificial Sequence
  Description of Artificial Sequence: Synthetic peptide
  Seed: SVKKTFLGV (TYRP1_HUMAN)
SLKKTFLGV

SEQ ID NO: 180869 - protein, 10 aa, Artificial Sequence
  Description of Artificial Sequence: Synthetic peptide
  Seed: YFVWTHYYSV (TYRP1_HUMAN)
YMVWTHYYSA

SEQ ID NO: 180870 - protein, 9 aa, Artificial Sequence
  Description of Artificial Sequence: Synthetic peptide
  Seed: YLIRARRSM (TYRP1_HUMAN)
YWIRARRSY

SEQ ID NO: 180871 - protein, 9 aa, Artificial Sequence
  Description of Artificial Sequence: Synthetic peptide
  Seed: QEPSFSLPY (TYRP1_HUMAN)
QAPSFSLPF

SEQ ID NO: 180872 - protein, 11 aa, Artificial Sequence
  Description of Artificial Sequence: Synthetic peptide
  Seed: QEMLQEPSFSL (TYRP1_HUMAN)
QEMLQEPSFSA

SEQ ID NO: 180873 - protein, 9 aa, Artificial Sequence
  Description of Artificial Sequence: Synthetic peptide
  Seed: ACDQRVLIV (TYRP1_HUMAN)
AVDQRVLII

SEQ ID NO: 180874 - protein, 10 aa, Artificial Sequence
  Description of Artificial Sequence: Synthetic peptide
  Seed: SIYNYFVWTH (TYRP1_HUMAN)
SFYNYFVWTR

SEQ ID NO: 180875 - protein, 8 aa, Artificial Sequence
  Description of Artificial Sequence: Synthetic peptide
  Seed: KNHFVRAL (TYRP1_HUMAN)
KQHFVRAL

SEQ ID NO: 180876 - protein, 9 aa, Artificial Sequence
  Description of Artificial Sequence: Synthetic peptide
  Seed: REFSVPEII (TYRP1_HUMAN)
RDFSVPEIM

SEQ ID NO: 180877 - protein, 8 aa, Artificial Sequence
  Description of Artificial Sequence: Synthetic peptide
  Seed: YFVWTHYY (TYRP1_HUMAN)
YFVWTHYM

SEQ ID NO: 180878 - protein, 10 aa, Artificial Sequence
  Description of Artificial Sequence: Synthetic peptide
  Seed: YNYFVWTHYY (TYRP1_HUMAN)
YHYFVWTHYW

SEQ ID NO: 180879 - protein, 9 aa, Artificial Sequence
  Description of Artificial Sequence: Synthetic peptide
  Seed: RQYNMVPFW (TYRP1_HUMAN)
RRYNMVPFT

SEQ ID NO: 180880 - protein, 9 aa, Artificial Sequence
  Description of Artificial Sequence: Synthetic peptide
  Seed: VGLFDTPPF (TYRP1_HUMAN)
VALFDTPPM

SEQ ID NO: 180881 - protein, 9 aa, Artificial Sequence
  Description of Artificial Sequence: Synthetic peptide
  Seed: FSVPEIIAI (TYRP1_HUMAN)
FKVPEIIAY

SEQ ID NO: 180882 - protein, 10 aa, Artificial Sequence
  Description of Artificial Sequence: Synthetic peptide
  Seed: EIIAIAVVGA (TYRP1_HUMAN)
EQIAIAVVGI

SEQ ID NO: 180883 - protein, 9 aa, Artificial Sequence
  Description of Artificial Sequence: Synthetic peptide
  Seed: MAKRTTHPL (TYRP1_HUMAN)
MTKRTTHPW

SEQ ID NO: 180884 - protein, 10 aa, Artificial Sequence
  Description of Artificial Sequence: Synthetic peptide
  Seed: YFVWTHYYSV (TYRP1_HUMAN)
YVVWTHYYSA

SEQ ID NO: 180885 - protein, 9 aa, Artificial Sequence
  Description of Artificial Sequence: Synthetic peptide
  Seed: APDNLGYTY (TYRP1_HUMAN)
ATDNLGYTY

SEQ ID NO: 180886 - protein, 11 aa, Artificial Sequence
  Description of Artificial Sequence: Synthetic peptide
  Seed: SLPYWNFATGK (TYRP1_HUMAN)
SNPYWNFATGR

SEQ ID NO: 180887 - protein, 11 aa, Artificial Sequence
  Description of Artificial Sequence: Synthetic peptide
  Seed: VCDSLEDYDTL (TYRP1_HUMAN)
VLDSLEDYDTL

SEQ ID NO: 180888 - protein, 9 aa, Artificial Sequence
  Description of Artificial Sequence: Synthetic peptide
  Seed: RGRCEAVTA (TYRP1_HUMAN)
RVRCEAVTL

SEQ ID NO: 180889 - protein, 10 aa, Artificial Sequence
  Description of Artificial Sequence: Synthetic peptide
  Seed: NISIYNYFVW (TYRP1_HUMAN)
NCSIYNYFVW

SEQ ID NO: 180890 - protein, 10 aa, Artificial Sequence
  Description of Artificial Sequence: Synthetic peptide
  Seed: ADSRPHSPQY (TYRP1_HUMAN)
AFSRPHSPQA

SEQ ID NO: 180891 - protein, 11 aa, Artificial Sequence
  Description of Artificial Sequence: Synthetic peptide
  Seed: FLTWHRYHLLR (TYRP1_HUMAN)
FRTWHRYHLLR

SEQ ID NO: 180892 - protein, 9 aa, Artificial Sequence
  Description of Artificial Sequence: Synthetic peptide
  Seed: AVVGALLLV (TYRP1_HUMAN)
AIVGALLLA

SEQ ID NO: 180893 - protein, 9 aa, Artificial Sequence
  Description of Artificial Sequence: Synthetic peptide
  Seed: TLISPNSVF (TYRP1_HUMAN)
TYISPNSVY

SEQ ID NO: 180894 - protein, 10 aa, Artificial Sequence
  Description of Artificial Sequence: Synthetic peptide
  Seed: YNYFVWTHYY (TYRP1_HUMAN)
YFYFVWTHYC

SEQ ID NO: 180895 - protein, 10 aa, Artificial Sequence
  Description of Artificial Sequence: Synthetic peptide
  Seed: LENAPIGHNR (TYRP1_HUMAN)
LSNAPIGHNR

SEQ ID NO: 180896 - protein, 9 aa, Artificial Sequence
  Description of Artificial Sequence: Synthetic peptide
  Seed: FSVPEIIAI (TYRP1_HUMAN)
FPVPEIIAM

SEQ ID NO: 180897 - protein, 9 aa, Artificial Sequence
  Description of Artificial Sequence: Synthetic peptide
  Seed: WPPVTNTEM (TYRP1_HUMAN)
WTPVTNTEL

SEQ ID NO: 180898 - protein, 9 aa, Artificial Sequence
  Description of Artificial Sequence: Synthetic peptide
  Seed: IAIAVVGAL (TYRP1_HUMAN)
IMIAVVGAY

SEQ ID NO: 180899 - protein, 9 aa, Artificial Sequence
  Description of Artificial Sequence: Synthetic peptide
  Seed: RVLIVRRNL (TYRP1_HUMAN)
RTLIVRRNY

SEQ ID NO: 180900 - protein, 10 aa, Artificial Sequence
  Description of Artificial Sequence: Synthetic peptide
  Seed: TAPDNLGYTY (TYRP1_HUMAN)
TRPDNLGYTM

SEQ ID NO: 180901 - protein, 9 aa, Artificial Sequence
  Description of Artificial Sequence: Synthetic peptide
  Seed: FTDAVFDEW (TYRP1_HUMAN)
FEDAVFDEL

SEQ ID NO: 180902 - protein, 9 aa, Artificial Sequence
  Description of Artificial Sequence: Synthetic peptide
  Seed: MLQEPSFSL (TYRP1_HUMAN)
MKQEPSFSY

SEQ ID NO: 180903 - protein, 9 aa, Artificial Sequence
  Description of Artificial Sequence: Synthetic peptide
  Seed: NMVPFWPPV (TYRP1_HUMAN)
NIVPFWPPL

SEQ ID NO: 180904 - protein, 10 aa, Artificial Sequence
  Description of Artificial Sequence: Synthetic peptide
  Seed: LQEPSFSLPY (TYRP1_HUMAN)
LVEPSFSLPF

SEQ ID NO: 180905 - protein, 9 aa, Artificial Sequence
  Description of Artificial Sequence: Synthetic peptide
  Seed: SRSNFDSTL (TYRP1_HUMAN)
SKSNFDSTL

SEQ ID NO: 180906 - protein, 9 aa, Artificial Sequence
  Description of Artificial Sequence: Synthetic peptide
  Seed: RRYNADIST (TYRP1_HUMAN)
RQYNADISL

SEQ ID NO: 180907 - protein, 9 aa, Artificial Sequence
  Description of Artificial Sequence: Synthetic peptide
  Seed: FTDAVFDEW (TYRP1_HUMAN)
FVDAVFDEV

SEQ ID NO: 180908 - protein, 10 aa, Artificial Sequence
  Description of Artificial Sequence: Synthetic peptide
  Seed: YNYFVWTHYY (TYRP1_HUMAN)
YKYFVWTHYF

SEQ ID NO: 180909 - protein, 9 aa, Artificial Sequence
  Description of Artificial Sequence: Synthetic peptide
  Seed: ISIYNYFVW (TYRP1_HUMAN)
IIIYNYFVW

SEQ ID NO: 180910 - protein, 10 aa, Artificial Sequence
  Description of Artificial Sequence: Synthetic peptide
  Seed: FTDAVFDEWL (TYRP1_HUMAN)
FMDAVFDEWI

SEQ ID NO: 180911 - protein, 9 aa, Artificial Sequence
  Description of Artificial Sequence: Synthetic peptide
  Seed: LLVALIFGT (TYRP1_HUMAN)
LVVALIFGM

SEQ ID NO: 180912 - protein, 9 aa, Artificial Sequence
  Description of Artificial Sequence: Synthetic peptide
  Seed: SVPEIIAIA (TYRP1_HUMAN)
SMPEIIAIL

SEQ ID NO: 180913 - protein, 9 aa, Artificial Sequence
  Description of Artificial Sequence: Synthetic peptide
  Seed: ALIFGTASY (TYRP1_HUMAN)
AMIFGTASH

SEQ ID NO: 180914 - protein, 9 aa, Artificial Sequence
  Description of Artificial Sequence: Synthetic peptide
  Seed: RQCATVEAL (TYRP1_HUMAN)
RECATVEAY

SEQ ID NO: 180915 - protein, 9 aa, Artificial Sequence
  Description of Artificial Sequence: Synthetic peptide
  Seed: HLSPNDPIF (TYRP1_HUMAN)
HMSPNDPIY

SEQ ID NO: 180916 - protein, 9 aa, Artificial Sequence
  Description of Artificial Sequence: Synthetic peptide
  Seed: RGAACDQRV (TYRP1_HUMAN)
RVAACDQRV

SEQ ID NO: 180917 - protein, 9 aa, Artificial Sequence
  Description of Artificial Sequence: Synthetic peptide
  Seed: SMDEANQPL (TYRP1_HUMAN)
SIDEANQPL

SEQ ID NO: 180918 - protein, 9 aa, Artificial Sequence
  Description of Artificial Sequence: Synthetic peptide
  Seed: NRQYNMVPF (TYRP1_HUMAN)
NMQYNMVPY

SEQ ID NO: 180919 - protein, 9 aa, Artificial Sequence
  Description of Artificial Sequence: Synthetic peptide
  Seed: NRQYNMVPF (TYRP1_HUMAN)
NFQYNMVPY

SEQ ID NO: 180920 - protein, 9 aa, Artificial Sequence
  Description of Artificial Sequence: Synthetic peptide
  Seed: APDNLGYTY (TYRP1_HUMAN)
AADNLGYTL

SEQ ID NO: 180921 - protein, 9 aa, Artificial Sequence
  Description of Artificial Sequence: Synthetic peptide
  Seed: RPMVQRLPE (TYRP1_HUMAN)
RIMVQRLPL

SEQ ID NO: 180922 - protein, 9 aa, Artificial Sequence
  Description of Artificial Sequence: Synthetic peptide
  Seed: YTYEIQWPS (TYRP1_HUMAN)
YDYEIQWPR

SEQ ID NO: 180923 - protein, 9 aa, Artificial Sequence
  Description of Artificial Sequence: Synthetic peptide
  Seed: ALIFGTASY (TYRP1_HUMAN)
AMIFGTASM

SEQ ID NO: 180924 - protein, 8 aa, Artificial Sequence
  Description of Artificial Sequence: Synthetic peptide
  Seed: FPRQCATV (TYRP1_HUMAN)
FPRQCATM

SEQ ID NO: 180925 - protein, 10 aa, Artificial Sequence
  Description of Artificial Sequence: Synthetic peptide
  Seed: YNMVPFWPPV (TYRP1_HUMAN)
YVMVPFWPPM

SEQ ID NO: 180926 - protein, 9 aa, Artificial Sequence
  Description of Artificial Sequence: Synthetic peptide
  Seed: YLIRARRSM (TYRP1_HUMAN)
YRIRARRSF

SEQ ID NO: 180927 - protein, 10 aa, Artificial Sequence
  Description of Artificial Sequence: Synthetic peptide
  Seed: YFVWTHYYSV (TYRP1_HUMAN)
YVVWTHYYSI

SEQ ID NO: 180928 - protein, 9 aa, Artificial Sequence
  Description of Artificial Sequence: Synthetic peptide
  Seed: YTYEIQWPS (TYRP1_HUMAN)
YAYEIQWPK

SEQ ID NO: 180929 - protein, 10 aa, Artificial Sequence
  Description of Artificial Sequence: Synthetic peptide
  Seed: KLLSLGCIFF (TYRP1_HUMAN)
KQLSLGCIFL

SEQ ID NO: 180930 - protein, 9 aa, Artificial Sequence
  Description of Artificial Sequence: Synthetic peptide
  Seed: SIYNYFVWT (TYRP1_HUMAN)
SMYNYFVWL

SEQ ID NO: 180931 - protein, 11 aa, Artificial Sequence
  Description of Artificial Sequence: Synthetic peptide
  Seed: YNMVPFWPPVT (TYRP1_HUMAN)
YIMVPFWPPVC

SEQ ID NO: 180932 - protein, 9 aa, Artificial Sequence
  Description of Artificial Sequence: Synthetic peptide
  Seed: STNSFRNTV (TYRP1_HUMAN)
SGNSFRNTY

SEQ ID NO: 180933 - protein, 9 aa, Artificial Sequence
  Description of Artificial Sequence: Synthetic peptide
  Seed: VGLFDTPPF (TYRP1_HUMAN)
VKLFDTPPL

SEQ ID NO: 180934 - protein, 9 aa, Artificial Sequence
  Description of Artificial Sequence: Synthetic peptide
  Seed: AVRSLHNLA (TYRP1_HUMAN)
ASRSLHNLR

SEQ ID NO: 180935 - protein, 9 aa, Artificial Sequence
  Description of Artificial Sequence: Synthetic peptide
  Seed: DSRPHSPQY (TYRP1_HUMAN)
DQRPHSPQY

SEQ ID NO: 180936 - protein, 10 aa, Artificial Sequence
  Description of Artificial Sequence: Synthetic peptide
  Seed: LSPNDPIFVL (TYRP1_HUMAN)
LPPNDPIFVW

SEQ ID NO: 180937 - protein, 10 aa, Artificial Sequence
  Description of Artificial Sequence: Synthetic peptide
  Seed: MQEMLQEPSF (TYRP1_HUMAN)
MWEMLQEPSW

SEQ ID NO: 180938 - protein, 9 aa, Artificial Sequence
  Description of Artificial Sequence: Synthetic peptide
  Seed: MFVTAPDNL (TYRP1_HUMAN)
MYVTAPDNL

SEQ ID NO: 180939 - protein, 9 aa, Artificial Sequence
  Description of Artificial Sequence: Synthetic peptide
  Seed: MSAPKLLSL (TYRP1_HUMAN)
MGAPKLLSV

SEQ ID NO: 180940 - protein, 11 aa, Artificial Sequence
  Description of Artificial Sequence: Synthetic peptide
  Seed: MSAPKLLSLGC (TYRP1_HUMAN)
MVAPKLLSLGW

SEQ ID NO: 180941 - protein, 9 aa, Artificial Sequence
  Description of Artificial Sequence: Synthetic peptide
  Seed: NYFVWTHYY (TYRP1_HUMAN)
NIFVWTHYW

SEQ ID NO: 180942 - protein, 8 aa, Artificial Sequence
  Description of Artificial Sequence: Synthetic peptide
  Seed: LEKDMQEM (TYRP1_HUMAN)
LEKDMQEI

SEQ ID NO: 180943 - protein, 11 aa, Artificial Sequence
  Description of Artificial Sequence: Synthetic peptide
  Seed: TDAVFDEWLRR (TYRP1_HUMAN)
TTAVFDEWLRR

SEQ ID NO: 180944 - protein, 10 aa, Artificial Sequence
  Description of Artificial Sequence: Synthetic peptide
  Seed: KRTTHPLFVI (TYRP1_HUMAN)
KFTTHPLFVF

SEQ ID NO: 180945 - protein, 10 aa, Artificial Sequence
  Description of Artificial Sequence: Synthetic peptide
  Seed: ENISIYNYFV (TYRP1_HUMAN)
EVISIYNYFT

SEQ ID NO: 180946 - protein, 10 aa, Artificial Sequence
  Description of Artificial Sequence: Synthetic peptide
  Seed: HNRQYNMVPF (TYRP1_HUMAN)
HQRQYNMVPF

SEQ ID NO: 180947 - protein, 11 aa, Artificial Sequence
  Description of Artificial Sequence: Synthetic peptide
  Seed: REFSVPEIIAI (TYRP1_HUMAN)
RWFSVPEIIAF

SEQ ID NO: 180948 - protein, 10 aa, Artificial Sequence
  Description of Artificial Sequence: Synthetic peptide
  Seed: TPQFENISIY (TYRP1_HUMAN)
TYQFENISIF

SEQ ID NO: 180949 - protein, 11 aa, Artificial Sequence
  Description of Artificial Sequence: Synthetic peptide
  Seed: YNYFVWTHYYS (TYRP1_HUMAN)
YLYFVWTHYYY

SEQ ID NO: 180950 - protein, 9 aa, Artificial Sequence
  Description of Artificial Sequence: Synthetic peptide
  Seed: YSNSTNSFR (TYRP1_HUMAN)
YYNSTNSFK

SEQ ID NO: 180951 - protein, 9 aa, Artificial Sequence
  Description of Artificial Sequence: Synthetic peptide
  Seed: NYFVWTHYY (TYRP1_HUMAN)
NMFVWTHYR

SEQ ID NO: 180952 - protein, 9 aa, Artificial Sequence
  Description of Artificial Sequence: Synthetic peptide
  Seed: VTAPDNLGY (TYRP1_HUMAN)
VCAPDNLGW

SEQ ID NO: 180953 - protein, 9 aa, Artificial Sequence
  Description of Artificial Sequence: Synthetic peptide
  Seed: LQNPNQSVV (TYRP1_HUMAN)
LMNPNQSVY

SEQ ID NO: 180954 - protein, 8 aa, Artificial Sequence
  Description of Artificial Sequence: Synthetic peptide
  Seed: AGNVARPM (TYRP1_HUMAN)
AANVARPM

SEQ ID NO: 180955 - protein, 9 aa, Artificial Sequence
  Description of Artificial Sequence: Synthetic peptide
  Seed: SLGCIFFPL (TYRP1_HUMAN)
STGCIFFPW

SEQ ID NO: 180956 - protein, 9 aa, Artificial Sequence
  Description of Artificial Sequence: Synthetic peptide
  Seed: ISIYNYFVW (TYRP1_HUMAN)
IWIYNYFVF

SEQ ID NO: 180957 - protein, 9 aa, Artificial Sequence
  Description of Artificial Sequence: Synthetic peptide
  Seed: LQNPNQSVV (TYRP1_HUMAN)
LSNPNQSVF

SEQ ID NO: 180958 - protein, 10 aa, Artificial Sequence
  Description of Artificial Sequence: Synthetic peptide
  Seed: NYFVWTHYYS (TYRP1_HUMAN)
NFFVWTHYYL

SEQ ID NO: 180959 - protein, 10 aa, Artificial Sequence
  Description of Artificial Sequence: Synthetic peptide
  Seed: RRYNADISTF (TYRP1_HUMAN)
RIYNADISTI

SEQ ID NO: 180960 - protein, 9 aa, Artificial Sequence
  Description of Artificial Sequence: Synthetic peptide
  Seed: ALIFGTASY (TYRP1_HUMAN)
AVIFGTASF

SEQ ID NO: 180961 - protein, 10 aa, Artificial Sequence
  Description of Artificial Sequence: Synthetic peptide
  Seed: LGPDGNTPQF (TYRP1_HUMAN)
LRPDGNTPQW

SEQ ID NO: 180962 - protein, 9 aa, Artificial Sequence
  Description of Artificial Sequence: Synthetic peptide
  Seed: NVARPMVQR (TYRP1_HUMAN)
NYARPMVQR

SEQ ID NO: 180963 - protein, 9 aa, Artificial Sequence
  Description of Artificial Sequence: Synthetic peptide
  Seed: SGRGRCEAV (TYRP1_HUMAN)
SMRGRCEAV

SEQ ID NO: 180964 - protein, 9 aa, Artificial Sequence
  Description of Artificial Sequence: Synthetic peptide
  Seed: FLNGTGGQT (TYRP1_HUMAN)
FLNGTGGQM

SEQ ID NO: 180965 - protein, 10 aa, Artificial Sequence
  Description of Artificial Sequence: Synthetic peptide
  Seed: STLISPNSVF (TYRP1_HUMAN)
SMLISPNSVY

SEQ ID NO: 180966 - protein, 9 aa, Artificial Sequence
  Description of Artificial Sequence: Synthetic peptide
  Seed: MLQEPSFSL (TYRP1_HUMAN)
MRQEPSFSM

SEQ ID NO: 180967 - protein, 10 aa, Artificial Sequence
  Description of Artificial Sequence: Synthetic peptide
  Seed: YFVWTHYYSV (TYRP1_HUMAN)
YGVWTHYYSV

SEQ ID NO: 180968 - protein, 9 aa, Artificial Sequence
  Description of Artificial Sequence: Synthetic peptide
  Seed: GLFDTPPFY (TYRP1_HUMAN)
GMFDTPPFT

SEQ ID NO: 180969 - protein, 9 aa, Artificial Sequence
  Description of Artificial Sequence: Synthetic peptide
  Seed: ATRRSEEIL (TYRP1_HUMAN)
AVRRSEEIK

SEQ ID NO: 180970 - protein, 11 aa, Artificial Sequence
  Description of Artificial Sequence: Synthetic peptide
  Seed: KTFLGVGQESF (TYRP1_HUMAN)
KLFLGVGQESY

SEQ ID NO: 180971 - protein, 11 aa, Artificial Sequence
  Description of Artificial Sequence: Synthetic peptide
  Seed: SMDEANQPLLT (TYRP1_HUMAN)
SMDEANQPLLL

SEQ ID NO: 180972 - protein, 9 aa, Artificial Sequence
  Description of Artificial Sequence: Synthetic peptide
  Seed: ALIFGTASY (TYRP1_HUMAN)
AMIFGTASR

SEQ ID NO: 180973 - protein, 8 aa, Artificial Sequence
  Description of Artificial Sequence: Synthetic peptide
  Seed: REFSVPEI (TYRP1_HUMAN)
RDFSVPEI

SEQ ID NO: 180974 - protein, 9 aa, Artificial Sequence
  Description of Artificial Sequence: Synthetic peptide
  Seed: IFGTASYLI (TYRP1_HUMAN)
IYGTASYLI

SEQ ID NO: 180975 - protein, 10 aa, Artificial Sequence
  Description of Artificial Sequence: Synthetic peptide
  Seed: RRYNADISTF (TYRP1_HUMAN)
RLYNADISTL

SEQ ID NO: 180976 - protein, 10 aa, Artificial Sequence
  Description of Artificial Sequence: Synthetic peptide
  Seed: MVPFWPPVTN (TYRP1_HUMAN)
MTPFWPPVTF

SEQ ID NO: 180977 - protein, 10 aa, Artificial Sequence
  Description of Artificial Sequence: Synthetic peptide
  Seed: FSLPYWNFAT (TYRP1_HUMAN)
FLLPYWNFAA

SEQ ID NO: 180978 - protein, 9 aa, Artificial Sequence
  Description of Artificial Sequence: Synthetic peptide
  Seed: FSVPEIIAI (TYRP1_HUMAN)
FMVPEIIAA

SEQ ID NO: 180979 - protein, 9 aa, Artificial Sequence
  Description of Artificial Sequence: Synthetic peptide
  Seed: IAVVGALLL (TYRP1_HUMAN)
IKVVGALLM

SEQ ID NO: 180980 - protein, 10 aa, Artificial Sequence
  Description of Artificial Sequence: Synthetic peptide
  Seed: YFVWTHYYSV (TYRP1_HUMAN)
YGVWTHYYSI

SEQ ID NO: 180981 - protein, 9 aa, Artificial Sequence
  Description of Artificial Sequence: Synthetic peptide
  Seed: AIAVVGALL (TYRP1_HUMAN)
AAAVVGALH

SEQ ID NO: 180982 - protein, 9 aa, Artificial Sequence
  Description of Artificial Sequence: Synthetic peptide
  Seed: MSAPKLLSL (TYRP1_HUMAN)
MDAPKLLSI

SEQ ID NO: 180983 - protein, 10 aa, Artificial Sequence
  Description of Artificial Sequence: Synthetic peptide
  Seed: ADSRPHSPQY (TYRP1_HUMAN)
AVSRPHSPQW

SEQ ID NO: 180984 - protein, 9 aa, Artificial Sequence
  Description of Artificial Sequence: Synthetic peptide
  Seed: KYDPAVRSL (TYRP1_HUMAN)
KYDPAVRSM

SEQ ID NO: 180985 - protein, 9 aa, Artificial Sequence
  Description of Artificial Sequence: Synthetic peptide
  Seed: GPDGNTPQF (TYRP1_HUMAN)
GIDGNTPQM

SEQ ID NO: 180986 - protein, 10 aa, Artificial Sequence
  Description of Artificial Sequence: Synthetic peptide
  Seed: RTCHCNGNFS (TYRP1_HUMAN)
RTCHCNGNFK

SEQ ID NO: 180987 - protein, 9 aa, Artificial Sequence
  Description of Artificial Sequence: Synthetic peptide
  Seed: SLGCIFFPL (TYRP1_HUMAN)
SIGCIFFPI

SEQ ID NO: 180988 - protein, 10 aa, Artificial Sequence
  Description of Artificial Sequence: Synthetic peptide
  Seed: FSVPEIIAIA (TYRP1_HUMAN)
FMVPEIIAIV

SEQ ID NO: 180989 - protein, 10 aa, Artificial Sequence
  Description of Artificial Sequence: Synthetic peptide
  Seed: RSLHNLAHLF (TYRP1_HUMAN)
RDLHNLAHLY

SEQ ID NO: 180990 - protein, 9 aa, Artificial Sequence
  Description of Artificial Sequence: Synthetic peptide
  Seed: LTWHRYHLL (TYRP1_HUMAN)
LLWHRYHLK

SEQ ID NO: 180991 - protein, 11 aa, Artificial Sequence
  Description of Artificial Sequence: Synthetic peptide
  Seed: MAKRTTHPLFV (TYRP1_HUMAN)
MMKRTTHPLFK

SEQ ID NO: 180992 - protein, 10 aa, Artificial Sequence
  Description of Artificial Sequence: Synthetic peptide
  Seed: FVWTHYYSVK (TYRP1_HUMAN)
FIWTHYYSVP

SEQ ID NO: 180993 - protein, 10 aa, Artificial Sequence
  Description of Artificial Sequence: Synthetic peptide
  Seed: RTTHPLFVIA (TYRP1_HUMAN)
RKTHPLFVIK

SEQ ID NO: 180994 - protein, 9 aa, Artificial Sequence
  Description of Artificial Sequence: Synthetic peptide
  Seed: SLHNLAHLF (TYRP1_HUMAN)
SLHNLAHLK

SEQ ID NO: 180995 - protein, 9 aa, Artificial Sequence
  Description of Artificial Sequence: Synthetic peptide
  Seed: VTAPDNLGY (TYRP1_HUMAN)
VTAPDNLGL

SEQ ID NO: 180996 - protein, 10 aa, Artificial Sequence
  Description of Artificial Sequence: Synthetic peptide
  Seed: IAVVGALLLV (TYRP1_HUMAN)
ILVVGALLLA

SEQ ID NO: 180997 - protein, 9 aa, Artificial Sequence
  Description of Artificial Sequence: Synthetic peptide
  Seed: RARRSMDEA (TYRP1_HUMAN)
RVRRSMDEL

SEQ ID NO: 180998 - protein, 9 aa, Artificial Sequence
  Description of Artificial Sequence: Synthetic peptide
  Seed: FSVPEIIAI (TYRP1_HUMAN)
FGVPEIIAY

SEQ ID NO: 180999 - protein, 10 aa, Artificial Sequence
  Description of Artificial Sequence: Synthetic peptide
  Seed: FVLLHTFTDA (TYRP1_HUMAN)
FVLLHTFTDV

SEQ ID NO: 181000 - protein, 11 aa, Artificial Sequence
  Description of Artificial Sequence: Synthetic peptide
  Seed: KTFLGVGQESF (TYRP1_HUMAN)
KQFLGVGQESL

SEQ ID NO: 181001 - protein, 9 aa, Artificial Sequence
  Description of Artificial Sequence: Synthetic peptide
  Seed: FYSNSTNSF (TYRP1_HUMAN)
FWSNSTNSW

SEQ ID NO: 181002 - protein, 9 aa, Artificial Sequence
  Description of Artificial Sequence: Synthetic peptide
  Seed: MAKRTTHPL (TYRP1_HUMAN)
MSKRTTHPL

SEQ ID NO: 181003 - protein, 9 aa, Artificial Sequence
  Description of Artificial Sequence: Synthetic peptide
  Seed: SMDEANQPL (TYRP1_HUMAN)
STDEANQPL

SEQ ID NO: 181004 - protein, 10 aa, Artificial Sequence
  Description of Artificial Sequence: Synthetic peptide
  Seed: LLHTFTDAVF (TYRP1_HUMAN)
LRHTFTDAVY

SEQ ID NO: 181005 - protein, 10 aa, Artificial Sequence
  Description of Artificial Sequence: Synthetic peptide
  Seed: TFTDAVFDEW (TYRP1_HUMAN)
TYTDAVFDEI

SEQ ID NO: 181006 - protein, 10 aa, Artificial Sequence
  Description of Artificial Sequence: Synthetic peptide
  Seed: HLSPNDPIFV (TYRP1_HUMAN)
HQSPNDPIFW

SEQ ID NO: 181007 - protein, 10 aa, Artificial Sequence
  Description of Artificial Sequence: Synthetic peptide
  Seed: LLFQQARAQF (TYRP1_HUMAN)
LYFQQARAQM

SEQ ID NO: 181008 - protein, 9 aa, Artificial Sequence
  Description of Artificial Sequence: Synthetic peptide
  Seed: REFSVPEII (TYRP1_HUMAN)
REFSVPEIA

SEQ ID NO: 181009 - protein, 9 aa, Artificial Sequence
  Description of Artificial Sequence: Synthetic peptide
  Seed: YNYFVWTHY (TYRP1_HUMAN)
YAYFVWTHI

SEQ ID NO: 181010 - protein, 10 aa, Artificial Sequence
  Description of Artificial Sequence: Synthetic peptide
  Seed: LSLGCIFFPL (TYRP1_HUMAN)
LVLGCIFFPI

SEQ ID NO: 181011 - protein, 10 aa, Artificial Sequence
  Description of Artificial Sequence: Synthetic peptide
  Seed: GKYDPAVRSL (TYRP1_HUMAN)
GMYDPAVRSY

SEQ ID NO: 181012 - protein, 10 aa, Artificial Sequence
  Description of Artificial Sequence: Synthetic peptide
  Seed: LSLGCIFFPL (TYRP1_HUMAN)
LFLGCIFFPI

SEQ ID NO: 181013 - protein, 9 aa, Artificial Sequence
  Description of Artificial Sequence: Synthetic peptide
  Seed: RTTHPLFVI (TYRP1_HUMAN)
RATHPLFVI

SEQ ID NO: 181014 - protein, 9 aa, Artificial Sequence
  Description of Artificial Sequence: Synthetic peptide
  Seed: LQNPNQSVV (TYRP1_HUMAN)
LVNPNQSVY

SEQ ID NO: 181015 - protein, 9 aa, Artificial Sequence
  Description of Artificial Sequence: Synthetic peptide
  Seed: TAPDNLGYT (TYRP1_HUMAN)
TGPDNLGYM

SEQ ID NO: 181016 - protein, 10 aa, Artificial Sequence
  Description of Artificial Sequence: Synthetic peptide
  Seed: EGYSDPTGKY (TYRP1_HUMAN)
EMYSDPTGKR

SEQ ID NO: 181017 - protein, 9 aa, Artificial Sequence
  Description of Artificial Sequence: Synthetic peptide
  Seed: ACDQRVLIV (TYRP1_HUMAN)
ASDQRVLIF

SEQ ID NO: 181018 - protein, 9 aa, Artificial Sequence
  Description of Artificial Sequence: Synthetic peptide
  Seed: YNYFVWTHY (TYRP1_HUMAN)
YLYFVWTHR

SEQ ID NO: 181019 - protein, 10 aa, Artificial Sequence
  Description of Artificial Sequence: Synthetic peptide
  Seed: NISIYNYFVW (TYRP1_HUMAN)
NLSIYNYFVW

SEQ ID NO: 181020 - protein, 9 aa, Artificial Sequence
  Description of Artificial Sequence: Synthetic peptide
  Seed: DDREVWPLR (TYRP1_HUMAN)
DYREVWPLR

SEQ ID NO: 181021 - protein, 10 aa, Artificial Sequence
  Description of Artificial Sequence: Synthetic peptide
  Seed: FVLLHTFTDA (TYRP1_HUMAN)
FRLLHTFTDV

SEQ ID NO: 181022 - protein, 9 aa, Artificial Sequence
  Description of Artificial Sequence: Synthetic peptide
  Seed: RYHLLRLEK (TYRP1_HUMAN)
RVHLLRLEA

SEQ ID NO: 181023 - protein, 9 aa, Artificial Sequence
  Description of Artificial Sequence: Synthetic peptide
  Seed: ASYLIRARR (TYRP1_HUMAN)
AIYLIRARR

SEQ ID NO: 181024 - protein, 10 aa, Artificial Sequence
  Description of Artificial Sequence: Synthetic peptide
  Seed: VALIFGTASY (TYRP1_HUMAN)
VPLIFGTASY

SEQ ID NO: 181025 - protein, 9 aa, Artificial Sequence
  Description of Artificial Sequence: Synthetic peptide
  Seed: DDREVWPLR (TYRP1_HUMAN)
DTREVWPLK

SEQ ID NO: 181026 - protein, 9 aa, Artificial Sequence
  Description of Artificial Sequence: Synthetic peptide
  Seed: VPFWPPVTN (TYRP1_HUMAN)
VPFWPPVTG

SEQ ID NO: 181027 - protein, 9 aa, Artificial Sequence
  Description of Artificial Sequence: Synthetic peptide
  Seed: SMDEANQPL (TYRP1_HUMAN)
SLDEANQPI

SEQ ID NO: 181028 - protein, 9 aa, Artificial Sequence
  Description of Artificial Sequence: Synthetic peptide
  Seed: STEDGPIRR (TYRP1_HUMAN)
SLEDGPIRY

SEQ ID NO: 181029 - protein, 9 aa, Artificial Sequence
  Description of Artificial Sequence: Synthetic peptide
  Seed: VFDEWLRRY (TYRP1_HUMAN)
VMDEWLRRY

SEQ ID NO: 181030 - protein, 9 aa, Artificial Sequence
  Description of Artificial Sequence: Synthetic peptide
  Seed: RVLIVRRNL (TYRP1_HUMAN)
RPLIVRRNI

SEQ ID NO: 181031 - protein, 10 aa, Artificial Sequence
  Description of Artificial Sequence: Synthetic peptide
  Seed: SREFSVPEII (TYRP1_HUMAN)
SREFSVPEIL

SEQ ID NO: 181032 - protein, 9 aa, Artificial Sequence
  Description of Artificial Sequence: Synthetic peptide
  Seed: ENAPIGHNR (TYRP1_HUMAN)
EIAPIGHNR

SEQ ID NO: 181033 - protein, 10 aa, Artificial Sequence
  Description of Artificial Sequence: Synthetic peptide
  Seed: FLTWHRYHLL (TYRP1_HUMAN)
FNTWHRYHLV

SEQ ID NO: 181034 - protein, 9 aa, Artificial Sequence
  Description of Artificial Sequence: Synthetic peptide
  Seed: APIGHNRQY (TYRP1_HUMAN)
ASIGHNRQV

SEQ ID NO: 181035 - protein, 9 aa, Artificial Sequence
  Description of Artificial Sequence: Synthetic peptide
  Seed: STNSFRNTV (TYRP1_HUMAN)
SINSFRNTM

SEQ ID NO: 181036 - protein, 9 aa, Artificial Sequence
  Description of Artificial Sequence: Synthetic peptide
  Seed: GLFDTPPFY (TYRP1_HUMAN)
GQFDTPPFF

SEQ ID NO: 181037 - protein, 8 aa, Artificial Sequence
  Description of Artificial Sequence: Synthetic peptide
  Seed: SAPKLLSL (TYRP1_HUMAN)
SQPKLLSL

SEQ ID NO: 181038 - protein, 10 aa, Artificial Sequence
  Description of Artificial Sequence: Synthetic peptide
  Seed: FLNGTGGQTH (TYRP1_HUMAN)
FGNGTGGQTY

SEQ ID NO: 181039 - protein, 10 aa, Artificial Sequence
  Description of Artificial Sequence: Synthetic peptide
  Seed: IAVVGALLLV (TYRP1_HUMAN)
IKVVGALLLV

SEQ ID NO: 181040 - protein, 9 aa, Artificial Sequence
  Description of Artificial Sequence: Synthetic peptide
  Seed: RDDREVWPL (TYRP1_HUMAN)
REDREVWPI

SEQ ID NO: 181041 - protein, 10 aa, Artificial Sequence
  Description of Artificial Sequence: Synthetic peptide
  Seed: FVLLHTFTDA (TYRP1_HUMAN)
FWLLHTFTDI

SEQ ID NO: 181042 - protein, 9 aa, Artificial Sequence
  Description of Artificial Sequence: Synthetic peptide
  Seed: LLTDQYQCY (TYRP1_HUMAN)
LMTDQYQCY

SEQ ID NO: 181043 - protein, 9 aa, Artificial Sequence
  Description of Artificial Sequence: Synthetic peptide
  Seed: LIFGTASYL (TYRP1_HUMAN)
LSFGTASYW

SEQ ID NO: 181044 - protein, 10 aa, Artificial Sequence
  Description of Artificial Sequence: Synthetic peptide
  Seed: SQWRVVCDSL (TYRP1_HUMAN)
SLWRVVCDSL

SEQ ID NO: 181045 - protein, 11 aa, Artificial Sequence
  Description of Artificial Sequence: Synthetic peptide
  Seed: GTDRCGSSSGR (TYRP1_HUMAN)
GTDRCGSSSGY

SEQ ID NO: 181046 - protein, 9 aa, Artificial Sequence
  Description of Artificial Sequence: Synthetic peptide
  Seed: LVALIFGTA (TYRP1_HUMAN)
LPALIFGTC

SEQ ID NO: 181047 - protein, 8 aa, Artificial Sequence
  Description of Artificial Sequence: Synthetic peptide
  Seed: YFVWTHYY (TYRP1_HUMAN)
YIVWTHYY

SEQ ID NO: 181048 - protein, 9 aa, Artificial Sequence
  Description of Artificial Sequence: Synthetic peptide
  Seed: RARRSMDEA (TYRP1_HUMAN)
RIRRSMDEV

SEQ ID NO: 181049 - protein, 9 aa, Artificial Sequence
  Description of Artificial Sequence: Synthetic peptide
  Seed: MAKRTTHPL (TYRP1_HUMAN)
MWKRTTHPF

SEQ ID NO: 181050 - protein, 10 aa, Artificial Sequence
  Description of Artificial Sequence: Synthetic peptide
  Seed: RSMDEANQPL (TYRP1_HUMAN)
RPMDEANQPL

SEQ ID NO: 181051 - protein, 9 aa, Artificial Sequence
  Description of Artificial Sequence: Synthetic peptide
  Seed: LHTFTDAVF (TYRP1_HUMAN)
LSTFTDAVY

SEQ ID NO: 181052 - protein, 9 aa, Artificial Sequence
  Description of Artificial Sequence: Synthetic peptide
  Seed: LTWHRYHLL (TYRP1_HUMAN)
LMWHRYHLF

SEQ ID NO: 181053 - protein, 9 aa, Artificial Sequence
  Description of Artificial Sequence: Synthetic peptide
  Seed: RSLHNLAHL (TYRP1_HUMAN)
RALHNLAHM

SEQ ID NO: 181054 - protein, 9 aa, Artificial Sequence
  Description of Artificial Sequence: Synthetic peptide
  Seed: GPDGNTPQF (TYRP1_HUMAN)
GQDGNTPQM

SEQ ID NO: 181055 - protein, 9 aa, Artificial Sequence
  Description of Artificial Sequence: Synthetic peptide
  Seed: KLQNPNQSV (TYRP1_HUMAN)
KTQNPNQSL

SEQ ID NO: 181056 - protein, 10 aa, Artificial Sequence
  Description of Artificial Sequence: Synthetic peptide
  Seed: YFVWTHYYSV (TYRP1_HUMAN)
YFVWTHYYSI

SEQ ID NO: 181057 - protein, 9 aa, Artificial Sequence
  Description of Artificial Sequence: Synthetic peptide
  Seed: SLGCIFFPL (TYRP1_HUMAN)
STGCIFFPV

SEQ ID NO: 181058 - protein, 10 aa, Artificial Sequence
  Description of Artificial Sequence: Synthetic peptide
  Seed: YNADISTFPL (TYRP1_HUMAN)
YAADISTFPA

SEQ ID NO: 181059 - protein, 11 aa, Artificial Sequence
  Description of Artificial Sequence: Synthetic peptide
  Seed: YNMVPFWPPVT (TYRP1_HUMAN)
YQMVPFWPPVH

SEQ ID NO: 181060 - protein, 9 aa, Artificial Sequence
  Description of Artificial Sequence: Synthetic peptide
  Seed: TADSRPHSP (TYRP1_HUMAN)
TADSRPHSM

SEQ ID NO: 181061 - protein, 10 aa, Artificial Sequence
  Description of Artificial Sequence: Synthetic peptide
  Seed: RTTHPLFVIA (TYRP1_HUMAN)
RKTHPLFVIA

SEQ ID NO: 181062 - protein, 10 aa, Artificial Sequence
  Description of Artificial Sequence: Synthetic peptide
  Seed: STFPLENAPI (TYRP1_HUMAN)
SMFPLENAPI

SEQ ID NO: 181063 - protein, 10 aa, Artificial Sequence
  Description of Artificial Sequence: Synthetic peptide
  Seed: NYFVWTHYYS (TYRP1_HUMAN)
NTFVWTHYYY

SEQ ID NO: 181064 - protein, 9 aa, Artificial Sequence
  Description of Artificial Sequence: Synthetic peptide
  Seed: GPDGNTPQF (TYRP1_HUMAN)
GMDGNTPQI

SEQ ID NO: 181065 - protein, 11 aa, Artificial Sequence
  Description of Artificial Sequence: Synthetic peptide
  Seed: SLPYWNFATGK (TYRP1_HUMAN)
SRPYWNFATGR

SEQ ID NO: 181066 - protein, 10 aa, Artificial Sequence
  Description of Artificial Sequence: Synthetic peptide
  Seed: MLQEPSFSLP (TYRP1_HUMAN)
MMQEPSFSLG

SEQ ID NO: 181067 - protein, 9 aa, Artificial Sequence
  Description of Artificial Sequence: Synthetic peptide
  Seed: HEGPAFLTW (TYRP1_HUMAN)
HMGPAFLTY

SEQ ID NO: 181068 - protein, 9 aa, Artificial Sequence
  Description of Artificial Sequence: Synthetic peptide
  Seed: VFDEWLRRY (TYRP1_HUMAN)
VLDEWLRRI

SEQ ID NO: 181069 - protein, 10 aa, Artificial Sequence
  Description of Artificial Sequence: Synthetic peptide
  Seed: MVPFWPPVTN (TYRP1_HUMAN)
MLPFWPPVTY

SEQ ID NO: 181070 - protein, 9 aa, Artificial Sequence
  Description of Artificial Sequence: Synthetic peptide
  Seed: HEGPAFLTW (TYRP1_HUMAN)
HRGPAFLTY

SEQ ID NO: 181071 - protein, 11 aa, Artificial Sequence
  Description of Artificial Sequence: Synthetic peptide
  Seed: FENISIYNYFV (TYRP1_HUMAN)
FLNISIYNYFA

SEQ ID NO: 181072 - protein, 10 aa, Artificial Sequence
  Description of Artificial Sequence: Synthetic peptide
  Seed: FSVPEIIAIA (TYRP1_HUMAN)
FMVPEIIAIT

SEQ ID NO: 181073 - protein, 10 aa, Artificial Sequence
  Description of Artificial Sequence: Synthetic peptide
  Seed: YNYFVWTHYY (TYRP1_HUMAN)
YAYFVWTHYM

SEQ ID NO: 181074 - protein, 9 aa, Artificial Sequence
  Description of Artificial Sequence: Synthetic peptide
  Seed: NVARPMVQR (TYRP1_HUMAN)
NIARPMVQK

SEQ ID NO: 181075 - protein, 9 aa, Artificial Sequence
  Description of Artificial Sequence: Synthetic peptide
  Seed: YTYEIQWPS (TYRP1_HUMAN)
YLYEIQWPG

SEQ ID NO: 181076 - protein, 11 aa, Artificial Sequence
  Description of Artificial Sequence: Synthetic peptide
  Seed: YSDPTGKYDPA (TYRP1_HUMAN)
YIDPTGKYDPM

SEQ ID NO: 181077 - protein, 10 aa, Artificial Sequence
  Description of Artificial Sequence: Synthetic peptide
  Seed: YSVKKTFLGV (TYRP1_HUMAN)
YQVKKTFLGI

SEQ ID NO: 181078 - protein, 9 aa, Artificial Sequence
  Description of Artificial Sequence: Synthetic peptide
  Seed: LHTFTDAVF (TYRP1_HUMAN)
LQTFTDAVL

SEQ ID NO: 181079 - protein, 9 aa, Artificial Sequence
  Description of Artificial Sequence: Synthetic peptide
  Seed: RNPAGNVAR (TYRP1_HUMAN)
RLPAGNVAR

SEQ ID NO: 181080 - protein, 10 aa, Artificial Sequence
  Description of Artificial Sequence: Synthetic peptide
  Seed: LTWHRYHLLR (TYRP1_HUMAN)
LFWHRYHLLR

SEQ ID NO: 181081 - protein, 9 aa, Artificial Sequence
  Description of Artificial Sequence: Synthetic peptide
  Seed: LQNPNQSVV (TYRP1_HUMAN)
LANPNQSVV

SEQ ID NO: 181082 - protein, 9 aa, Artificial Sequence
  Description of Artificial Sequence: Synthetic peptide
  Seed: RFFNRTCHC (TYRP1_HUMAN)
RIFNRTCHV

SEQ ID NO: 181083 - protein, 10 aa, Artificial Sequence
  Description of Artificial Sequence: Synthetic peptide
  Seed: FVWTHYYSVK (TYRP1_HUMAN)
FMWTHYYSVL

SEQ ID NO: 181084 - protein, 11 aa, Artificial Sequence
  Description of Artificial Sequence: Synthetic peptide
  Seed: FLNGTGGQTHL (TYRP1_HUMAN)
FANGTGGQTHF

SEQ ID NO: 181085 - protein, 9 aa, Artificial Sequence
  Description of Artificial Sequence: Synthetic peptide
  Seed: HYYSVKKTF (TYRP1_HUMAN)
HLYSVKKTM

SEQ ID NO: 181086 - protein, 9 aa, Artificial Sequence
  Description of Artificial Sequence: Synthetic peptide
  Seed: FSHEGPAFL (TYRP1_HUMAN)
FSHEGPAFV

SEQ ID NO: 181087 - protein, 11 aa, Artificial Sequence
  Description of Artificial Sequence: Synthetic peptide
  Seed: VCDSLEDYDTL (TYRP1_HUMAN)
VADSLEDYDTL

SEQ ID NO: 181088 - protein, 9 aa, Artificial Sequence
  Description of Artificial Sequence: Synthetic peptide
  Seed: MLQEPSFSL (TYRP1_HUMAN)
MMQEPSFSY

SEQ ID NO: 181089 - protein, 10 aa, Artificial Sequence
  Description of Artificial Sequence: Synthetic peptide
  Seed: RRYNADISTF (TYRP1_HUMAN)
RKYNADISTM

SEQ ID NO: 181090 - protein, 10 aa, Artificial Sequence
  Description of Artificial Sequence: Synthetic peptide
  Seed: NISIYNYFVW (TYRP1_HUMAN)
NNSIYNYFVW

SEQ ID NO: 181091 - protein, 11 aa, Artificial Sequence
  Description of Artificial Sequence: Synthetic peptide
  Seed: RRSMDEANQPL (TYRP1_HUMAN)
RCSMDEANQPV

SEQ ID NO: 181092 - protein, 9 aa, Artificial Sequence
  Description of Artificial Sequence: Synthetic peptide
  Seed: LLDLSKEEK (TYRP1_HUMAN)
LADLSKEEY

SEQ ID NO: 181093 - protein, 9 aa, Artificial Sequence
  Description of Artificial Sequence: Synthetic peptide
  Seed: RFFNRTCHC (TYRP1_HUMAN)
RMFNRTCHR

SEQ ID NO: 181094 - protein, 9 aa, Artificial Sequence
  Description of Artificial Sequence: Synthetic peptide
  Seed: QEMLQEPSF (TYRP1_HUMAN)
QEMLQEPSC

SEQ ID NO: 181095 - protein, 9 aa, Artificial Sequence
  Description of Artificial Sequence: Synthetic peptide
  Seed: RPGWRGAAC (TYRP1_HUMAN)
RPGWRGAAV

SEQ ID NO: 181096 - protein, 10 aa, Artificial Sequence
  Description of Artificial Sequence: Synthetic peptide
  Seed: PFYSNSTNSF (TYRP1_HUMAN)
PFYSNSTNSM

SEQ ID NO: 181097 - protein, 9 aa, Artificial Sequence
  Description of Artificial Sequence: Synthetic peptide
  Seed: VGLFDTPPF (TYRP1_HUMAN)
VALFDTPPF

SEQ ID NO: 181098 - protein, 10 aa, Artificial Sequence
  Description of Artificial Sequence: Synthetic peptide
  Seed: RSMDEANQPL (TYRP1_HUMAN)
RLMDEANQPW

SEQ ID NO: 181099 - protein, 9 aa, Artificial Sequence
  Description of Artificial Sequence: Synthetic peptide
  Seed: GPDGNTPQF (TYRP1_HUMAN)
GFDGNTPQM

SEQ ID NO: 181100 - protein, 9 aa, Artificial Sequence
  Description of Artificial Sequence: Synthetic peptide
  Seed: THLSPNDPI (TYRP1_HUMAN)
TRLSPNDPL

SEQ ID NO: 181101 - protein, 10 aa, Artificial Sequence
  Description of Artificial Sequence: Synthetic peptide
  Seed: FYSNSTNSFR (TYRP1_HUMAN)
FLSNSTNSFK

SEQ ID NO: 181102 - protein, 11 aa, Artificial Sequence
  Description of Artificial Sequence: Synthetic peptide
  Seed: FVLLHTFTDAV (TYRP1_HUMAN)
FRLLHTFTDAV

SEQ ID NO: 181103 - protein, 9 aa, Artificial Sequence
  Description of Artificial Sequence: Synthetic peptide
  Seed: REFSVPEII (TYRP1_HUMAN)
RMFSVPEIF

SEQ ID NO: 181104 - protein, 9 aa, Artificial Sequence
  Description of Artificial Sequence: Synthetic peptide
  Seed: GEVDFSHEG (TYRP1_HUMAN)
GEVDFSHEA

SEQ ID NO: 181105 - protein, 10 aa, Homo sapiens
  Native (TYRP1_HUMAN)
SMDEANQPLL

SEQ ID NO: 181106 - protein, 10 aa, Homo sapiens
  Native (TYRP1_HUMAN)
CDQRVLIVRR

SEQ ID NO: 181107 - protein, 11 aa, Homo sapiens
  Native (TYRP1_HUMAN)
TVEGYSDPTGK

SEQ ID NO: 181108 - protein, 9 aa, Homo sapiens
  Native (TYRP1_HUMAN)
EEKNHFVRA

SEQ ID NO: 181109 - protein, 9 aa, Homo sapiens
  Native (TYRP1_HUMAN)
WPPVTNTEM

SEQ ID NO: 181110 - protein, 9 aa, Homo sapiens
  Native (TYRP1_HUMAN)
TFPLENAPI

SEQ ID NO: 181111 - protein, 10 aa, Homo sapiens
  Native (TYRP1_HUMAN)
KEEKNHFVRA

SEQ ID NO: 181112 - protein, 10 aa, Homo sapiens
  Native (TYRP1_HUMAN)
CRPGWRGAAC

SEQ ID NO: 181113 - protein, 10 aa, Homo sapiens
  Native (TYRP1_HUMAN)
IYNYFVWTHY

SEQ ID NO: 181114 - protein, 8 aa, Homo sapiens
  Native (TYRP1_HUMAN)
TEDGPIRR

SEQ ID NO: 181115 - protein, 9 aa, Homo sapiens
  Native (TYRP1_HUMAN)
AQCLEVGLF

SEQ ID NO: 181116 - protein, 9 aa, Homo sapiens
  Native (TYRP1_HUMAN)
FPLLLFQQA

SEQ ID NO: 181117 - protein, 8 aa, Homo sapiens
  Native (TYRP1_HUMAN)
HTFTDAVF

SEQ ID NO: 181118 - protein, 9 aa, Homo sapiens
  Native (TYRP1_HUMAN)
PVSGPGTDR

SEQ ID NO: 181119 - protein, 11 aa, Homo sapiens
  Native (TYRP1_HUMAN)
MAKRTTHPLFV

SEQ ID NO: 181120 - protein, 9 aa, Homo sapiens
  Native (TYRP1_HUMAN)
AHLFLNGTG

SEQ ID NO: 181121 - protein, 8 aa, Homo sapiens
  Native (TYRP1_HUMAN)
KRTTHPLF

SEQ ID NO: 181122 - protein, 11 aa, Homo sapiens
  Native (TYRP1_HUMAN)
VEALRSGMCCP

SEQ ID NO: 181123 - protein, 8 aa, Homo sapiens
  Native (TYRP1_HUMAN)
AGNVARPM

SEQ ID NO: 181124 - protein, 9 aa, Homo sapiens
  Native (TYRP1_HUMAN)
VFDEWLRRY

SEQ ID NO: 181125 - protein, 11 aa, Homo sapiens
  Native (TYRP1_HUMAN)
LISPNSVFSQW

SEQ ID NO: 181126 - protein, 10 aa, Homo sapiens
  Native (TYRP1_HUMAN)
STFPLENAPI

SEQ ID NO: 181127 - protein, 9 aa, Homo sapiens
  Native (TYRP1_HUMAN)
QEPSFSLPY

SEQ ID NO: 181128 - protein, 10 aa, Homo sapiens
  Native (TYRP1_HUMAN)
TFTDAVFDEW

SEQ ID NO: 181129 - protein, 8 aa, Homo sapiens
  Native (TYRP1_HUMAN)
HNLAHLFL

SEQ ID NO: 181130 - protein, 9 aa, Homo sapiens
  Native (TYRP1_HUMAN)
TADSRPHSP

SEQ ID NO: 181131 - protein, 8 aa, Homo sapiens
  Native (TYRP1_HUMAN)
GALLLVAL

SEQ ID NO: 181132 - protein, 9 aa, Homo sapiens
  Native (TYRP1_HUMAN)
GPDGNTPQF

SEQ ID NO: 181133 - protein, 8 aa, Homo sapiens
  Native (TYRP1_HUMAN)
LEKDMQEM

SEQ ID NO: 181134 - protein, 8 aa, Homo sapiens
  Native (TYRP1_HUMAN)
HRYHLLRL

SEQ ID NO: 181135 - protein, 8 aa, Homo sapiens
  Native (TYRP1_HUMAN)
LISPNSVF

SEQ ID NO: 181136 - protein, 11 aa, Homo sapiens
  Native (TYRP1_HUMAN)
GEVDFSHEGPA

SEQ ID NO: 181137 - protein, 10 aa, Homo sapiens
  Native (TYRP1_HUMAN)
NTVEGYSDPT

SEQ ID NO: 181138 - protein, 11 aa, Homo sapiens
  Native (TYRP1_HUMAN)
PFWPPVTNTEM

SEQ ID NO: 181139 - protein, 11 aa, Homo sapiens
  Native (TYRP1_HUMAN)
SLEDYDTLGTL

SEQ ID NO: 181140 - protein, 10 aa, Homo sapiens
  Native (TYRP1_HUMAN)
ARRSMDEANQ

SEQ ID NO: 181141 - protein, 8 aa, Homo sapiens
  Native (TYRP1_HUMAN)
IFGTASYL

SEQ ID NO: 181142 - protein, 10 aa, Homo sapiens
  Native (TYRP1_HUMAN)
GMCCPDLSPV

SEQ ID NO: 181143 - protein, 11 aa, Homo sapiens
  Native (TYRP1_HUMAN)
HEGPAFLTWHR

SEQ ID NO: 181144 - protein, 10 aa, Homo sapiens
  Native (TYRP1_HUMAN)
PKLLSLGCIF

SEQ ID NO: 181145 - protein, 9 aa, Homo sapiens
  Native (TYRP1_HUMAN)
RVLIVRRNL

SEQ ID NO: 181146 - protein, 9 aa, Homo sapiens
  Native (TYRP1_HUMAN)
RSGMCCPDL

SEQ ID NO: 181147 - protein, 9 aa, Homo sapiens
  Native (TYRP1_HUMAN)
VGQESFGEV

SEQ ID NO: 181148 - protein, 9 aa, Homo sapiens
  Native (TYRP1_HUMAN)
WLRRYNADI

SEQ ID NO: 181149 - protein, 10 aa, Homo sapiens
  Native (TYRP1_HUMAN)
LLLVALIFGT

SEQ ID NO: 181150 - protein, 8 aa, Homo sapiens
  Native (TYRP1_HUMAN)
LQNPNQSV

SEQ ID NO: 181151 - protein, 10 aa, Homo sapiens
  Native (TYRP1_HUMAN)
LIVRRNLLDL

SEQ ID NO: 181152 - protein, 10 aa, Homo sapiens
  Native (TYRP1_HUMAN)
VCDICTDDLM

SEQ ID NO: 181153 - protein, 10 aa, Homo sapiens
  Native (TYRP1_HUMAN)
ARAQFPRQCA

SEQ ID NO: 181154 - protein, 9 aa, Homo sapiens
  Native (TYRP1_HUMAN)
CPDLSPVSG

SEQ ID NO: 181155 - protein, 8 aa, Homo sapiens
  Native (TYRP1_HUMAN)
SLHNLAHL

SEQ ID NO: 181156 - protein, 11 aa, Homo sapiens
  Native (TYRP1_HUMAN)
VGQESFGEVDF

SEQ ID NO: 181157 - protein, 10 aa, Homo sapiens
  Native (TYRP1_HUMAN)
VGLFDTPPFY

SEQ ID NO: 181158 - protein, 10 aa, Homo sapiens
  Native (TYRP1_HUMAN)
RPMVQRLPEP

SEQ ID NO: 181159 - protein, 9 aa, Homo sapiens
  Native (TYRP1_HUMAN)
LFDTPPFYS

SEQ ID NO: 181160 - protein, 10 aa, Homo sapiens
  Native (TYRP1_HUMAN)
EVWPLRFFNR

SEQ ID NO: 181161 - protein, 10 aa, Homo sapiens
  Native (TYRP1_HUMAN)
NLAHLFLNGT

SEQ ID NO: 181162 - protein, 11 aa, Homo sapiens
  Native (TYRP1_HUMAN)
WHRYHLLRLEK

SEQ ID NO: 181163 - protein, 9 aa, Homo sapiens
  Native (TYRP1_HUMAN)
VEGYSDPTG

SEQ ID NO: 181164 - protein, 8 aa, Homo sapiens
  Native (TYRP1_HUMAN)
YSDPTGKY

SEQ ID NO: 181165 - protein, 8 aa, Homo sapiens
  Native (TYRP1_HUMAN)
NSVFSQWR

SEQ ID NO: 181166 - protein, 9 aa, Homo sapiens
  Native (TYRP1_HUMAN)
QESFGEVDF

SEQ ID NO: 181167 - protein, 9 aa, Homo sapiens
  Native (TYRP1_HUMAN)
GSRSNFDST

SEQ ID NO: 181168 - protein, 8 aa, Homo sapiens
  Native (TYRP1_HUMAN)
PEIIAIAV

SEQ ID NO: 181169 - protein, 11 aa, Homo sapiens
  Native (TYRP1_HUMAN)
VDFSHEGPAFL

SEQ ID NO: 181170 - protein, 8 aa, Homo sapiens
  Native (TYRP1_HUMAN)
FQQARAQF

SEQ ID NO: 181171 - protein, 10 aa, Homo sapiens
  Native (TYRP1_HUMAN)
NMVPFWPPVT

SEQ ID NO: 181172 - protein, 11 aa, Homo sapiens
  Native (TYRP1_HUMAN)
KRTTHPLFVIA

SEQ ID NO: 181173 - protein, 10 aa, Homo sapiens
  Native (TYRP1_HUMAN)
FLTWHRYHLL

SEQ ID NO: 181174 - protein, 9 aa, Homo sapiens
  Native (TYRP1_HUMAN)
TPQFENISI

SEQ ID NO: 181175 - protein, 11 aa, Homo sapiens
  Native (TYRP1_HUMAN)
TEDGPIRRNPA

SEQ ID NO: 181176 - protein, 11 aa, Homo sapiens
  Native (TYRP1_HUMAN)
AACDQRVLIVR

SEQ ID NO: 181177 - protein, 10 aa, Homo sapiens
  Native (TYRP1_HUMAN)
VLLHTFTDAV

SEQ ID NO: 181178 - protein, 10 aa, Homo sapiens
  Native (TYRP1_HUMAN)
TDAVFDEWLR

SEQ ID NO: 181179 - protein, 11 aa, Homo sapiens
  Native (TYRP1_HUMAN)
AFLTWHRYHLL

SEQ ID NO: 181180 - protein, 10 aa, Homo sapiens
  Native (TYRP1_HUMAN)
IAVVGALLLV

SEQ ID NO: 181181 - protein, 9 aa, Homo sapiens
  Native (TYRP1_HUMAN)
SKEEKNHFV

SEQ ID NO: 181182 - protein, 11 aa, Homo sapiens
  Native (TYRP1_HUMAN)
EILGPDGNTPQ

SEQ ID NO: 181183 - protein, 9 aa, Homo sapiens
  Native (TYRP1_HUMAN)
GEVDFSHEG

SEQ ID NO: 181184 - protein, 10 aa, Homo sapiens
  Native (TYRP1_HUMAN)
CEAVTADSRP

SEQ ID NO: 181185 - protein, 9 aa, Homo sapiens
  Native (TYRP1_HUMAN)
LIFGTASYL

SEQ ID NO: 181186 - protein, 9 aa, Homo sapiens
  Native (TYRP1_HUMAN)
QYQCYAEEY

SEQ ID NO: 181187 - protein, 11 aa, Homo sapiens
  Native (TYRP1_HUMAN)
SIYNYFVWTHY

SEQ ID NO: 181188 - protein, 8 aa, Homo sapiens
  Native (TYRP1_HUMAN)
YDPAVRSL

SEQ ID NO: 181189 - protein, 10 aa, Homo sapiens
  Native (TYRP1_HUMAN)
DAVFDEWLRR

SEQ ID NO: 181190 - protein, 10 aa, Homo sapiens
  Native (TYRP1_HUMAN)
FSLPYWNFAT

SEQ ID NO: 181191 - protein, 10 aa, Homo sapiens
  Native (TYRP1_HUMAN)
SPNDPIFVLL

SEQ ID NO: 181192 - protein, 10 aa, Homo sapiens
  Native (TYRP1_HUMAN)
NISIYNYFVW

SEQ ID NO: 181193 - protein, 10 aa, Homo sapiens
  Native (TYRP1_HUMAN)
HDGRDDREVW

SEQ ID NO: 181194 - protein, 8 aa, Homo sapiens
  Native (TYRP1_HUMAN)
SPNDPIFV

SEQ ID NO: 181195 - protein, 9 aa, Homo sapiens
  Native (TYRP1_HUMAN)
VCDICTDDL

SEQ ID NO: 181196 - protein, 10 aa, Homo sapiens
  Native (TYRP1_HUMAN)
AQFPRQCATV

SEQ ID NO: 181197 - protein, 8 aa, Homo sapiens
  Native (TYRP1_HUMAN)
DYDTLGTL

SEQ ID NO: 181198 - protein, 9 aa, Homo sapiens
  Native (TYRP1_HUMAN)
DEWLRRYNA

SEQ ID NO: 181199 - protein, 10 aa, Homo sapiens
  Native (TYRP1_HUMAN)
NSFRNTVEGY

SEQ ID NO: 181200 - protein, 9 aa, Homo sapiens
  Native (TYRP1_HUMAN)
DGRDDREVW

SEQ ID NO: 181201 - protein, 11 aa, Homo sapiens
  Native (TYRP1_HUMAN)
FLNGTGGQTHL

SEQ ID NO: 181202 - protein, 11 aa, Homo sapiens
  Native (TYRP1_HUMAN)
RYNADISTFPL

SEQ ID NO: 181203 - protein, 9 aa, Homo sapiens
  Native (TYRP1_HUMAN)
RGAACDQRV

SEQ ID NO: 181204 - protein, 8 aa, Homo sapiens
  Native (TYRP1_HUMAN)
TWHRYHLL

SEQ ID NO: 181205 - protein, 11 aa, Homo sapiens
  Native (TYRP1_HUMAN)
KEEKNHFVRAL

SEQ ID NO: 181206 - protein, 9 aa, Homo sapiens
  Native (TYRP1_HUMAN)
DDREVWPLR

SEQ ID NO: 181207 - protein, 9 aa, Homo sapiens
  Native (TYRP1_HUMAN)
DFSHEGPAF

SEQ ID NO: 181208 - protein, 8 aa, Homo sapiens
  Native (TYRP1_HUMAN)
NYFVWTHY

SEQ ID NO: 181209 - protein, 9 aa, Homo sapiens
  Native (TYRP1_HUMAN)
PAFLTWHRY

SEQ ID NO: 181210 - protein, 9 aa, Homo sapiens
  Native (TYRP1_HUMAN)
CRPGWRGAA

SEQ ID NO: 181211 - protein, 10 aa, Homo sapiens
  Native (TYRP1_HUMAN)
TPQFENISIY

SEQ ID NO: 181212 - protein, 9 aa, Homo sapiens
  Native (TYRP1_HUMAN)
VVCDSLEDY

SEQ ID NO: 181213 - protein, 11 aa, Homo sapiens
  Native (TYRP1_HUMAN)
LSPNDPIFVLL

SEQ ID NO: 181214 - protein, 10 aa, Homo sapiens
  Native (TYRP1_HUMAN)
VWTHYYSVKK

SEQ ID NO: 181215 - protein, 10 aa, Homo sapiens
  Native (TYRP1_HUMAN)
YEIQWPSREF

SEQ ID NO: 181216 - protein, 9 aa, Homo sapiens
  Native (TYRP1_HUMAN)
SGHNCGTCR

SEQ ID NO: 181217 - protein, 9 aa, Homo sapiens
  Native (TYRP1_HUMAN)
STEDGPIRR

SEQ ID NO: 181218 - protein, 10 aa, Homo sapiens
  Native (TYRP1_HUMAN)
IIAIAVVGAL

SEQ ID NO: 181219 - protein, 10 aa, Homo sapiens
  Native (TYRP1_HUMAN)
IQWPSREFSV

SEQ ID NO: 181220 - protein, 9 aa, Homo sapiens
  Native (TYRP1_HUMAN)
AGNVARPMV

SEQ ID NO: 181221 - protein, 9 aa, Homo sapiens
  Native (TYRP1_HUMAN)
WPLRFFNRT

SEQ ID NO: 181222 - protein, 10 aa, Homo sapiens
  Native (TYRP1_HUMAN)
YNMVPFWPPV

SEQ ID NO: 181223 - protein, 11 aa, Homo sapiens
  Native (TYRP1_HUMAN)
QYQCYAEEYEK

SEQ ID NO: 181224 - protein, 10 aa, Homo sapiens
  Native (TYRP1_HUMAN)
GWRGAACDQR

SEQ ID NO: 181225 - protein, 8 aa, Homo sapiens
  Native (TYRP1_HUMAN)
AVVGALLL

SEQ ID NO: 181226 - protein, 8 aa, Homo sapiens
  Native (TYRP1_HUMAN)
PNDPIFVL

SEQ ID NO: 181227 - protein, 10 aa, Homo sapiens
  Native (TYRP1_HUMAN)
NHFVRALDMA

SEQ ID NO: 181228 - protein, 9 aa, Homo sapiens
  Native (TYRP1_HUMAN)
LGCIFFPLL

SEQ ID NO: 181229 - protein, 11 aa, Homo sapiens
  Native (TYRP1_HUMAN)
PQFENISIYNY

SEQ ID NO: 181230 - protein, 9 aa, Homo sapiens
  Native (TYRP1_HUMAN)
RAQFPRQCA

SEQ ID NO: 181231 - protein, 9 aa, Homo sapiens
  Native (TYRP1_HUMAN)
VARPMVQRL

SEQ ID NO: 181232 - protein, 9 aa, Homo sapiens
  Native (TYRP1_HUMAN)
APKLLSLGC

SEQ ID NO: 181233 - protein, 10 aa, Homo sapiens
  Native (TYRP1_HUMAN)
RQCATVEALR

SEQ ID NO: 181234 - protein, 10 aa, Homo sapiens
  Native (TYRP1_HUMAN)
LIFGTASYLI

SEQ ID NO: 181235 - protein, 9 aa, Homo sapiens
  Native (TYRP1_HUMAN)
SREFSVPEI

SEQ ID NO: 181236 - protein, 9 aa, Homo sapiens
  Native (TYRP1_HUMAN)
LLTDQYQCY

SEQ ID NO: 181237 - protein, 9 aa, Homo sapiens
  Native (TYRP1_HUMAN)
RRYNADIST

SEQ ID NO: 181238 - protein, 9 aa, Homo sapiens
  Native (TYRP1_HUMAN)
RYHLLRLEK

SEQ ID NO: 181239 - protein, 11 aa, Homo sapiens
  Native (TYRP1_HUMAN)
YSDPTGKYDPA

SEQ ID NO: 181240 - protein, 9 aa, Homo sapiens
  Native (TYRP1_HUMAN)
ACDQRVLIV

SEQ ID NO: 181241 - protein, 9 aa, Homo sapiens
  Native (TYRP1_HUMAN)
IVRRNLLDL

SEQ ID NO: 181242 - protein, 8 aa, Homo sapiens
  Native (TYRP1_HUMAN)
LFDTPPFY

SEQ ID NO: 181243 - protein, 8 aa, Homo sapiens
  Native (TYRP1_HUMAN)
AQFPRQCA

SEQ ID NO: 181244 - protein, 9 aa, Homo sapiens
  Native (TYRP1_HUMAN)
VDFSHEGPA

SEQ ID NO: 181245 - protein, 11 aa, Homo sapiens
  Native (TYRP1_HUMAN)
RRSMDEANQPL

SEQ ID NO: 181246 - protein, 11 aa, Homo sapiens
  Native (TYRP1_HUMAN)
GTASYLIRARR

SEQ ID NO: 181247 - protein, 10 aa, Homo sapiens
  Native (TYRP1_HUMAN)
DPAVRSLHNL

SEQ ID NO: 181248 - protein, 9 aa, Homo sapiens
  Native (TYRP1_HUMAN)
SEEILGPDG

SEQ ID NO: 181249 - protein, 8 aa, Homo sapiens
  Native (TYRP1_HUMAN)
QYNMVPFW

SEQ ID NO: 181250 - protein, 9 aa, Homo sapiens
  Native (TYRP1_HUMAN)
TNTEMFVTA

SEQ ID NO: 181251 - protein, 9 aa, Homo sapiens
  Native (TYRP1_HUMAN)
RPMVQRLPE

SEQ ID NO: 181252 - protein, 10 aa, Homo sapiens
  Native (TYRP1_HUMAN)
YNADISTFPL

SEQ ID NO: 181253 - protein, 9 aa, Homo sapiens
  Native (TYRP1_HUMAN)
PLLLFQQAR

SEQ ID NO: 181254 - protein, 9 aa, Homo sapiens
  Native (TYRP1_HUMAN)
VVGALLLVA

SEQ ID NO: 181255 - protein, 8 aa, Homo sapiens
  Native (TYRP1_HUMAN)
PSFSLPYW

SEQ ID NO: 181256 - protein, 9 aa, Homo sapiens
  Native (TYRP1_HUMAN)
FPRQCATVE

SEQ ID NO: 181257 - protein, 8 aa, Homo sapiens
  Native (TYRP1_HUMAN)
LHTFTDAV

SEQ ID NO: 181258 - protein, 9 aa, Homo sapiens
  Native (TYRP1_HUMAN)
VGALLLVAL

SEQ ID NO: 181259 - protein, 9 aa, Homo sapiens
  Native (TYRP1_HUMAN)
FSLPYWNFA

SEQ ID NO: 181260 - protein, 11 aa, Homo sapiens
  Native (TYRP1_HUMAN)
MSAPKLLSLGC

SEQ ID NO: 181261 - protein, 8 aa, Homo sapiens
  Native (TYRP1_HUMAN)
FSLPYWNF

SEQ ID NO: 181262 - protein, 9 aa, Homo sapiens
  Native (TYRP1_HUMAN)
PLFVIATRR

SEQ ID NO: 181263 - protein, 10 aa, Homo sapiens
  Native (TYRP1_HUMAN)
RTCHCNGNFS

SEQ ID NO: 181264 - protein, 11 aa, Homo sapiens
  Native (TYRP1_HUMAN)
EANQPLLTDQY

SEQ ID NO: 181265 - protein, 10 aa, Homo sapiens
  Native (TYRP1_HUMAN)
DQYQCYAEEY

SEQ ID NO: 181266 - protein, 11 aa, Homo sapiens
  Native (TYRP1_HUMAN)
LRLEKDMQEML

SEQ ID NO: 181267 - protein, 11 aa, Homo sapiens
  Native (TYRP1_HUMAN)
QRLPEPQDVAQ

SEQ ID NO: 181268 - protein, 10 aa, Homo sapiens
  Native (TYRP1_HUMAN)
LSPNDPIFVL

SEQ ID NO: 181269 - protein, 8 aa, Homo sapiens
  Native (TYRP1_HUMAN)
FSHEGPAF

SEQ ID NO: 181270 - protein, 9 aa, Homo sapiens
  Native (TYRP1_HUMAN)
VWTHYYSVK

SEQ ID NO: 181271 - protein, 11 aa, Homo sapiens
  Native (TYRP1_HUMAN)
EVGLFDTPPFY

SEQ ID NO: 181272 - protein, 8 aa, Homo sapiens
  Native (TYRP1_HUMAN)
KNHFVRAL

SEQ ID NO: 181273 - protein, 11 aa, Homo sapiens
  Native (TYRP1_HUMAN)
RSLHNLAHLFL

SEQ ID NO: 181274 - protein, 8 aa, Homo sapiens
  Native (TYRP1_HUMAN)
VPEIIAIA

SEQ ID NO: 181275 - protein, 8 aa, Homo sapiens
  Native (TYRP1_HUMAN)
TAPDNLGY

SEQ ID NO: 181276 - protein, 9 aa, Homo sapiens
  Native (TYRP1_HUMAN)
RFFNRTCHC

SEQ ID NO: 181277 - protein, 10 aa, Homo sapiens
  Native (TYRP1_HUMAN)
SLGCIFFPLL

SEQ ID NO: 181278 - protein, 9 aa, Homo sapiens
  Native (TYRP1_HUMAN)
RLEKDMQEM

SEQ ID NO: 181279 - protein, 10 aa, Homo sapiens
  Native (TYRP1_HUMAN)
ATVEALRSGM

SEQ ID NO: 181280 - protein, 9 aa, Homo sapiens
  Native (TYRP1_HUMAN)
TGKYDPAVR

SEQ ID NO: 181281 - protein, 8 aa, Homo sapiens
  Native (TYRP1_HUMAN)
REVWPLRF

SEQ ID NO: 181282 - protein, 8 aa, Homo sapiens
  Native (TYRP1_HUMAN)
PQDVAQCL

SEQ ID NO: 181283 - protein, 9 aa, Homo sapiens
  Native (TYRP1_HUMAN)
NFDSTLISP

SEQ ID NO: 181284 - protein, 9 aa, Homo sapiens
  Native (TYRP1_HUMAN)
WPSREFSVP

SEQ ID NO: 181285 - protein, 8 aa, Homo sapiens
  Native (TYRP1_HUMAN)
SAPKLLSL

SEQ ID NO: 181286 - protein, 9 aa, Homo sapiens
  Native (TYRP1_HUMAN)
LRFFNRTCH

SEQ ID NO: 181287 - protein, 9 aa, Homo sapiens
  Native (TYRP1_HUMAN)
DAVFDEWLR

SEQ ID NO: 181288 - protein, 9 aa, Homo sapiens
  Native (TYRP1_HUMAN)
RLPEPQDVA

SEQ ID NO: 181289 - protein, 8 aa, Homo sapiens
  Native (TYRP1_HUMAN)
SHEGPAFL

SEQ ID NO: 181290 - protein, 10 aa, Homo sapiens
  Native (TYRP1_HUMAN)
PAVRSLHNLA

SEQ ID NO: 181291 - protein, 11 aa, Homo sapiens
  Native (TYRP1_HUMAN)
FENISIYNYFV

SEQ ID NO: 181292 - protein, 8 aa, Homo sapiens
  Native (TYRP1_HUMAN)
WRVVCDSL

SEQ ID NO: 181293 - protein, 11 aa, Homo sapiens
  Native (TYRP1_HUMAN)
IVRRNLLDLSK

SEQ ID NO: 181294 - protein, 9 aa, Homo sapiens
  Native (TYRP1_HUMAN)
NISIYNYFV

SEQ ID NO: 181295 - protein, 8 aa, Homo sapiens
  Native (TYRP1_HUMAN)
YNADISTF

SEQ ID NO: 181296 - protein, 11 aa, Homo sapiens
  Native (TYRP1_HUMAN)
FSVPEIIAIAV

SEQ ID NO: 181297 - protein, 9 aa, Homo sapiens
  Native (TYRP1_HUMAN)
AVRSLHNLA

SEQ ID NO: 181298 - protein, 9 aa, Homo sapiens
  Native (TYRP1_HUMAN)
TTHPLFVIA

SEQ ID NO: 181299 - protein, 10 aa, Homo sapiens
  Native (TYRP1_HUMAN)
EFSVPEIIAI

SEQ ID NO: 181300 - protein, 10 aa, Homo sapiens
  Native (TYRP1_HUMAN)
NSTNSFRNTV

SEQ ID NO: 181301 - protein, 11 aa, Homo sapiens
  Native (TYRP1_HUMAN)
GPIRRNPAGNV

SEQ ID NO: 181302 - protein, 8 aa, Homo sapiens
  Native (TYRP1_HUMAN)
DEANQPLL

SEQ ID NO: 181303 - protein, 9 aa, Homo sapiens
  Native (TYRP1_HUMAN)
SVFSQWRVV

SEQ ID NO: 181304 - protein, 9 aa, Homo sapiens
  Native (TYRP1_HUMAN)
STLISPNSV

SEQ ID NO: 181305 - protein, 10 aa, Homo sapiens
  Native (TYRP1_HUMAN)
VRRNLLDLSK

SEQ ID NO: 181306 - protein, 8 aa, Homo sapiens
  Native (TYRP1_HUMAN)
VEALRSGM

SEQ ID NO: 181307 - protein, 11 aa, Homo sapiens
  Native (TYRP1_HUMAN)
LFQQARAQFPR

SEQ ID NO: 181308 - protein, 8 aa, Homo sapiens
  Native (TYRP1_HUMAN)
LIFGTASY

SEQ ID NO: 181309 - protein, 10 aa, Homo sapiens
  Native (TYRP1_HUMAN)
YSVKKTFLGV

SEQ ID NO: 181310 - protein, 11 aa, Homo sapiens
  Native (TYRP1_HUMAN)
YYSVKKTFLGV

SEQ ID NO: 181311 - protein, 9 aa, Homo sapiens
  Native (TYRP1_HUMAN)
NADISTFPL

SEQ ID NO: 181312 - protein, 9 aa, Homo sapiens
  Native (TYRP1_HUMAN)
CIFFPLLLF

SEQ ID NO: 181313 - protein, 8 aa, Homo sapiens
  Native (TYRP1_HUMAN)
LLSLGCIF

SEQ ID NO: 181314 - protein, 10 aa, Homo sapiens
  Native (TYRP1_HUMAN)
IAIAVVGALL

SEQ ID NO: 181315 - protein, 9 aa, Homo sapiens
  Native (TYRP1_HUMAN)
CGSSSGRGR

SEQ ID NO: 181316 - protein, 11 aa, Homo sapiens
  Native (TYRP1_HUMAN)
RALDMAKRTTH

SEQ ID NO: 181317 - protein, 8 aa, Homo sapiens
  Native (TYRP1_HUMAN)
RSNFDSTL

SEQ ID NO: 181318 - protein, 9 aa, Homo sapiens
  Native (TYRP1_HUMAN)
LTWHRYHLL

SEQ ID NO: 181319 - protein, 11 aa, Homo sapiens
  Native (TYRP1_HUMAN)
YFVWTHYYSVK

SEQ ID NO: 181320 - protein, 9 aa, Homo sapiens
  Native (TYRP1_HUMAN)
ATRRSEEIL

SEQ ID NO: 181321 - protein, 11 aa, Homo sapiens
  Native (TYRP1_HUMAN)
LEDYDTLGTLC

SEQ ID NO: 181322 - protein, 11 aa, Homo sapiens
  Native (TYRP1_HUMAN)
AGNVARPMVQR

SEQ ID NO: 181323 - protein, 10 aa, Homo sapiens
  Native (TYRP1_HUMAN)
LLTDQYQCYA

SEQ ID NO: 181324 - protein, 10 aa, Homo sapiens
  Native (TYRP1_HUMAN)
ASYLIRARRS

SEQ ID NO: 181325 - protein, 10 aa, Homo sapiens
  Native (TYRP1_HUMAN)
VDFSHEGPAF

SEQ ID NO: 181326 - protein, 11 aa, Homo sapiens
  Native (TYRP1_HUMAN)
THLSPNDPIFV

SEQ ID NO: 181327 - protein, 9 aa, Homo sapiens
  Native (TYRP1_HUMAN)
SHEGPAFLT

SEQ ID NO: 181328 - protein, 11 aa, Homo sapiens
  Native (TYRP1_HUMAN)
FTDAVFDEWLR

SEQ ID NO: 181329 - protein, 9 aa, Homo sapiens
  Native (TYRP1_HUMAN)
PAGNVARPM

SEQ ID NO: 181330 - protein, 10 aa, Homo sapiens
  Native (TYRP1_HUMAN)
ADSRPHSPQY

SEQ ID NO: 181331 - protein, 10 aa, Homo sapiens
  Native (TYRP1_HUMAN)
GKYDPAVRSL

SEQ ID NO: 181332 - protein, 10 aa, Homo sapiens
  Native (TYRP1_HUMAN)
TEDGPIRRNP

SEQ ID NO: 181333 - protein, 9 aa, Homo sapiens
  Native (TYRP1_HUMAN)
VTAPDNLGY

SEQ ID NO: 181334 - protein, 8 aa, Homo sapiens
  Native (TYRP1_HUMAN)
ASYLIRAR

SEQ ID NO: 181335 - protein, 9 aa, Homo sapiens
  Native (TYRP1_HUMAN)
EKNHFVRAL

SEQ ID NO: 181336 - protein, 10 aa, Homo sapiens
  Native (TYRP1_HUMAN)
DISTFPLENA

SEQ ID NO: 181337 - protein, 9 aa, Homo sapiens
  Native (TYRP1_HUMAN)
GPAFLTWHR

SEQ ID NO: 181338 - protein, 11 aa, Homo sapiens
  Native (TYRP1_HUMAN)
DRCGSSSGRGR

SEQ ID NO: 181339 - protein, 9 aa, Homo sapiens
  Native (TYRP1_HUMAN)
NYFVWTHYY

SEQ ID NO: 181340 - protein, 11 aa, Homo sapiens
  Native (TYRP1_HUMAN)
PPFYSNSTNSF

SEQ ID NO: 181341 - protein, 10 aa, Homo sapiens
  Native (TYRP1_HUMAN)
SLHNLAHLFL

SEQ ID NO: 181342 - protein, 9 aa, Homo sapiens
  Native (TYRP1_HUMAN)
RSNFDSTLI

SEQ ID NO: 181343 - protein, 10 aa, Homo sapiens
  Native (TYRP1_HUMAN)
NTPQFENISI

SEQ ID NO: 181344 - protein, 9 aa, Homo sapiens
  Native (TYRP1_HUMAN)
DREVWPLRF

SEQ ID NO: 181345 - protein, 10 aa, Homo sapiens
  Native (TYRP1_HUMAN)
GRGRCEAVTA

SEQ ID NO: 181346 - protein, 11 aa, Homo sapiens
  Native (TYRP1_HUMAN)
TTHPLFVIATR

SEQ ID NO: 181347 - protein, 11 aa, Homo sapiens
  Native (TYRP1_HUMAN)
FSHEGPAFLTW

SEQ ID NO: 181348 - protein, 10 aa, Homo sapiens
  Native (TYRP1_HUMAN)
THPLFVIATR

SEQ ID NO: 181349 - protein, 8 aa, Homo sapiens
  Native (TYRP1_HUMAN)
SVPEIIAI

SEQ ID NO: 181350 - protein, 10 aa, Homo sapiens
  Native (TYRP1_HUMAN)
FLNGTGGQTH

SEQ ID NO: 181351 - protein, 10 aa, Homo sapiens
  Native (TYRP1_HUMAN)
QEMLQEPSFS

SEQ ID NO: 181352 - protein, 9 aa, Homo sapiens
  Native (TYRP1_HUMAN)
LSKEEKNHF

SEQ ID NO: 181353 - protein, 8 aa, Homo sapiens
  Native (TYRP1_HUMAN)
MDEANQPL

SEQ ID NO: 181354 - protein, 11 aa, Homo sapiens
  Native (TYRP1_HUMAN)
APDNLGYTYEI

SEQ ID NO: 181355 - protein, 11 aa, Homo sapiens
  Native (TYRP1_HUMAN)
TYEIQWPSREF

SEQ ID NO: 181356 - protein, 11 aa, Homo sapiens
  Native (TYRP1_HUMAN)
LVALIFGTASY

SEQ ID NO: 181357 - protein, 10 aa, Homo sapiens
  Native (TYRP1_HUMAN)
EMLQEPSFSL

SEQ ID NO: 181358 - protein, 10 aa, Homo sapiens
  Native (TYRP1_HUMAN)
NVARPMVQRL

SEQ ID NO: 181359 - protein, 8 aa, Homo sapiens
  Native (TYRP1_HUMAN)
IAVVGALL

SEQ ID NO: 181360 - protein, 10 aa, Homo sapiens
  Native (TYRP1_HUMAN)
YSNSTNSFRN

SEQ ID NO: 181361 - protein, 8 aa, Homo sapiens
  Native (TYRP1_HUMAN)
NLGYTYEI

SEQ ID NO: 181362 - protein, 9 aa, Homo sapiens
  Native (TYRP1_HUMAN)
PEIIAIAVV

SEQ ID NO: 181363 - protein, 9 aa, Homo sapiens
  Native (TYRP1_HUMAN)
RGRCEAVTA

SEQ ID NO: 181364 - protein, 10 aa, Homo sapiens
  Native (TYRP1_HUMAN)
HFVRALDMAK

SEQ ID NO: 181365 - protein, 9 aa, Homo sapiens
  Native (TYRP1_HUMAN)
KLLSLGCIF

SEQ ID NO: 181366 - protein, 10 aa, Homo sapiens
  Native (TYRP1_HUMAN)
FYSNSTNSFR

SEQ ID NO: 181367 - protein, 9 aa, Homo sapiens
  Native (TYRP1_HUMAN)
FLNGTGGQT

SEQ ID NO: 181368 - protein, 8 aa, Homo sapiens
  Native (TYRP1_HUMAN)
GPIRRNPA

SEQ ID NO: 181369 - protein, 9 aa, Homo sapiens
  Native (TYRP1_HUMAN)
LLHTFTDAV

SEQ ID NO: 181370 - protein, 10 aa, Homo sapiens
  Native (TYRP1_HUMAN)
LRLEKDMQEM

SEQ ID NO: 181371 - protein, 11 aa, Homo sapiens
  Native (TYRP1_HUMAN)
TADSRPHSPQY

SEQ ID NO: 181372 - protein, 9 aa, Homo sapiens
  Native (TYRP1_HUMAN)
ATGKNVCDI

SEQ ID NO: 181373 - protein, 8 aa, Homo sapiens
  Native (TYRP1_HUMAN)
TLISPNSV

SEQ ID NO: 181374 - protein, 10 aa, Homo sapiens
  Native (TYRP1_HUMAN)
FVWTHYYSVK

SEQ ID NO: 181375 - protein, 8 aa, Homo sapiens
  Native (TYRP1_HUMAN)
SYLIRARR

SEQ ID NO: 181376 - protein, 9 aa, Homo sapiens
  Native (TYRP1_HUMAN)
CTDDLMGSR

SEQ ID NO: 181377 - protein, 9 aa, Homo sapiens
  Native (TYRP1_HUMAN)
NHFVRALDM

SEQ ID NO: 181378 - protein, 8 aa, Homo sapiens
  Native (TYRP1_HUMAN)
QARAQFPR

SEQ ID NO: 181379 - protein, 9 aa, Homo sapiens
  Native (TYRP1_HUMAN)
IGHNRQYNM

SEQ ID NO: 181380 - protein, 11 aa, Homo sapiens
  Native (TYRP1_HUMAN)
LTWHRYHLLRL

SEQ ID NO: 181381 - protein, 11 aa, Homo sapiens
  Native (TYRP1_HUMAN)
VCDSLEDYDTL

SEQ ID NO: 181382 - protein, 10 aa, Homo sapiens
  Native (TYRP1_HUMAN)
VEALRSGMCC

SEQ ID NO: 181383 - protein, 8 aa, Homo sapiens
  Native (TYRP1_HUMAN)
DDREVWPL

SEQ ID NO: 181384 - protein, 11 aa, Homo sapiens
  Native (TYRP1_HUMAN)
SLPYWNFATGK

SEQ ID NO: 181385 - protein, 9 aa, Homo sapiens
  Native (TYRP1_HUMAN)
PPVTNTEMF

SEQ ID NO: 181386 - protein, 10 aa, Homo sapiens
  Native (TYRP1_HUMAN)
DMAKRTTHPL

SEQ ID NO: 181387 - protein, 10 aa, Homo sapiens
  Native (TYRP1_HUMAN)
NLLDLSKEEK

SEQ ID NO: 181388 - protein, 10 aa, Homo sapiens
  Native (TYRP1_HUMAN)
AIAVVGALLL

SEQ ID NO: 181389 - protein, 11 aa, Homo sapiens
  Native (TYRP1_HUMAN)
NFSGHNCGTCR

SEQ ID NO: 181390 - protein, 9 aa, Homo sapiens
  Native (TYRP1_HUMAN)
DNLGYTYEI

SEQ ID NO: 181391 - protein, 9 aa, Homo sapiens
  Native (TYRP1_HUMAN)
AVTADSRPH

SEQ ID NO: 181392 - protein, 11 aa, Homo sapiens
  Native (TYRP1_HUMAN)
GYTYEIQWPSR

SEQ ID NO: 181393 - protein, 11 aa, Homo sapiens
  Native (TYRP1_HUMAN)
HLSPNDPIFVL

SEQ ID NO: 181394 - protein, 11 aa, Homo sapiens
  Native (TYRP1_HUMAN)
LEVGLFDTPPF

SEQ ID NO: 181395 - protein, 10 aa, Homo sapiens
  Native (TYRP1_HUMAN)
EEKNHFVRAL

SEQ ID NO: 181396 - protein, 10 aa, Homo sapiens
  Native (TYRP1_HUMAN)
SQWRVVCDSL

SEQ ID NO: 181397 - protein, 9 aa, Homo sapiens
  Native (TYRP1_HUMAN)
IYNYFVWTH

SEQ ID NO: 181398 - protein, 9 aa, Homo sapiens
  Native (TYRP1_HUMAN)
DLMGSRSNF

SEQ ID NO: 181399 - protein, 9 aa, Homo sapiens
  Native (TYRP1_HUMAN)
EPQDVAQCL

SEQ ID NO: 181400 - protein, 9 aa, Homo sapiens
  Native (TYRP1_HUMAN)
TYEIQWPSR

SEQ ID NO: 181401 - protein, 9 aa, Homo sapiens
  Native (TYRP1_HUMAN)
YSNSTNSFR

SEQ ID NO: 181402 - protein, 8 aa, Homo sapiens
  Native (TYRP1_HUMAN)
NAPIGHNR

SEQ ID NO: 181403 - protein, 10 aa, Homo sapiens
  Native (TYRP1_HUMAN)
LPEPQDVAQC

SEQ ID NO: 181404 - protein, 10 aa, Homo sapiens
  Native (TYRP1_HUMAN)
QTHLSPNDPI

SEQ ID NO: 181405 - protein, 8 aa, Homo sapiens
  Native (TYRP1_HUMAN)
IQWPSREF

SEQ ID NO: 181406 - protein, 9 aa, Homo sapiens
  Native (TYRP1_HUMAN)
LPYWNFATG

SEQ ID NO: 181407 - protein, 10 aa, Homo sapiens
  Native (TYRP1_HUMAN)
GEVDFSHEGP

SEQ ID NO: 181408 - protein, 11 aa, Homo sapiens
  Native (TYRP1_HUMAN)
LRRYNADISTF

SEQ ID NO: 181409 - protein, 10 aa, Homo sapiens
  Native (TYRP1_HUMAN)
DLSKEEKNHF

SEQ ID NO: 181410 - protein, 11 aa, Homo sapiens
  Native (TYRP1_HUMAN)
THPLFVIATRR

SEQ ID NO: 181411 - protein, 10 aa, Homo sapiens
  Native (TYRP1_HUMAN)
GQESFGEVDF

SEQ ID NO: 181412 - protein, 9 aa, Homo sapiens
  Native (TYRP1_HUMAN)
QQARAQFPR

SEQ ID NO: 181413 - protein, 10 aa, Homo sapiens
  Native (TYRP1_HUMAN)
SPVSGPGTDR

SEQ ID NO: 181414 - protein, 8 aa, Homo sapiens
  Native (TYRP1_HUMAN)
QFENISIY

SEQ ID NO: 181415 - protein, 10 aa, Homo sapiens
  Native (TYRP1_HUMAN)
RRNLLDLSKE

SEQ ID NO: 181416 - protein, 10 aa, Homo sapiens
  Native (TYRP1_HUMAN)
QRVLIVRRNL

SEQ ID NO: 181417 - protein, 11 aa, Homo sapiens
  Native (TYRP1_HUMAN)
SPVSGPGTDRC

SEQ ID NO: 181418 - protein, 11 aa, Homo sapiens
  Native (TYRP1_HUMAN)
LQEPSFSLPYW

SEQ ID NO: 181419 - protein, 11 aa, Homo sapiens
  Native (TYRP1_HUMAN)
TGKYDPAVRSL

SEQ ID NO: 181420 - protein, 11 aa, Homo sapiens
  Native (TYRP1_HUMAN)
AVVGALLLVAL

SEQ ID NO: 181421 - protein, 10 aa, Homo sapiens
  Native (TYRP1_HUMAN)
VRSLHNLAHL

SEQ ID NO: 181422 - protein, 11 aa, Homo sapiens
  Native (TYRP1_HUMAN)
VEGYSDPTGKY

SEQ ID NO: 181423 - protein, 9 aa, Homo sapiens
  Native (TYRP1_HUMAN)
YLIRARRSM

SEQ ID NO: 181424 - protein, 10 aa, Homo sapiens
  Native (TYRP1_HUMAN)
ENISIYNYFV

SEQ ID NO: 181425 - protein, 11 aa, Homo sapiens
  Native (TYRP1_HUMAN)
EPQDVAQCLEV

SEQ ID NO: 181426 - protein, 11 aa, Homo sapiens
  Native (TYRP1_HUMAN)
LLSLGCIFFPL

SEQ ID NO: 181427 - protein, 8 aa, Homo sapiens
  Native (TYRP1_HUMAN)
FPRQCATV

SEQ ID NO: 181428 - protein, 9 aa, Homo sapiens
  Native (TYRP1_HUMAN)
LLLFQQARA

SEQ ID NO: 181429 - protein, 8 aa, Homo sapiens
  Native (TYRP1_HUMAN)
QPLLTDQY

SEQ ID NO: 181430 - protein, 10 aa, Homo sapiens
  Native (TYRP1_HUMAN)
FENISIYNYF

SEQ ID NO: 181431 - protein, 9 aa, Homo sapiens
  Native (TYRP1_HUMAN)
MCCPDLSPV

SEQ ID NO: 181432 - protein, 9 aa, Homo sapiens
  Native (TYRP1_HUMAN)
APDNLGYTY

SEQ ID NO: 181433 - protein, 8 aa, Homo sapiens
  Native (TYRP1_HUMAN)
LIVRRNLL

SEQ ID NO: 181434 - protein, 11 aa, Homo sapiens
  Native (TYRP1_HUMAN)
HTFTDAVFDEW

SEQ ID NO: 181435 - protein, 9 aa, Homo sapiens
  Native (TYRP1_HUMAN)
DEANQPLLT

SEQ ID NO: 181436 - protein, 8 aa, Homo sapiens
  Native (TYRP1_HUMAN)
ARPMVQRL

SEQ ID NO: 181437 - protein, 10 aa, Homo sapiens
  Native (TYRP1_HUMAN)
GSRSNFDSTL

SEQ ID NO: 181438 - protein, 11 aa, Homo sapiens
  Native (TYRP1_HUMAN)
EEILGPDGNTP

SEQ ID NO: 181439 - protein, 11 aa, Homo sapiens
  Native (TYRP1_HUMAN)
ISPNSVFSQWR

SEQ ID NO: 181440 - protein, 11 aa, Homo sapiens
  Native (TYRP1_HUMAN)
NPAGNVARPMV

SEQ ID NO: 181441 - protein, 8 aa, Homo sapiens
  Native (TYRP1_HUMAN)
ACDQRVLI

SEQ ID NO: 181442 - protein, 9 aa, Homo sapiens
  Native (TYRP1_HUMAN)
QFPRQCATV

SEQ ID NO: 181443 - protein, 8 aa, Homo sapiens
  Native (TYRP1_HUMAN)
AACDQRVL

SEQ ID NO: 181444 - protein, 8 aa, Homo sapiens
  Native (TYRP1_HUMAN)
SLEDYDTL

SEQ ID NO: 181445 - protein, 9 aa, Homo sapiens
  Native (TYRP1_HUMAN)
LEKDMQEML

SEQ ID NO: 181446 - protein, 11 aa, Homo sapiens
  Native (TYRP1_HUMAN)
YNYFVWTHYYS

SEQ ID NO: 181447 - protein, 9 aa, Homo sapiens
  Native (TYRP1_HUMAN)
LEVGLFDTP

SEQ ID NO: 181448 - protein, 11 aa, Homo sapiens
  Native (TYRP1_HUMAN)
TEMFVTAPDNL

SEQ ID NO: 181449 - protein, 10 aa, Homo sapiens
  Native (TYRP1_HUMAN)
NSTEDGPIRR

SEQ ID NO: 181450 - protein, 9 aa, Homo sapiens
  Native (TYRP1_HUMAN)
TPPFYSNST

SEQ ID NO: 181451 - protein, 11 aa, Homo sapiens
  Native (TYRP1_HUMAN)
IYNYFVWTHYY

SEQ ID NO: 181452 - protein, 11 aa, Homo sapiens
  Native (TYRP1_HUMAN)
QEMLQEPSFSL

SEQ ID NO: 181453 - protein, 9 aa, Homo sapiens
  Native (TYRP1_HUMAN)
VGLFDTPPF

SEQ ID NO: 181454 - protein, 9 aa, Homo sapiens
  Native (TYRP1_HUMAN)
LHTFTDAVF

SEQ ID NO: 181455 - protein, 9 aa, Homo sapiens
  Native (TYRP1_HUMAN)
IRRNPAGNV

SEQ ID NO: 181456 - protein, 11 aa, Homo sapiens
  Native (TYRP1_HUMAN)
FGTASYLIRAR

SEQ ID NO: 181457 - protein, 11 aa, Homo sapiens
  Native (TYRP1_HUMAN)
QYNMVPFWPPV

SEQ ID NO: 181458 - protein, 8 aa, Homo sapiens
  Native (TYRP1_HUMAN)
EPSFSLPY

SEQ ID NO: 181459 - protein, 11 aa, Homo sapiens
  Native (TYRP1_HUMAN)
LSKEEKNHFVR

SEQ ID NO: 181460 - protein, 10 aa, Homo sapiens
  Native (TYRP1_HUMAN)
STLISPNSVF

SEQ ID NO: 181461 - protein, 10 aa, Homo sapiens
  Native (TYRP1_HUMAN)
IFGTASYLIR

SEQ ID NO: 181462 - protein, 11 aa, Homo sapiens
  Native (TYRP1_HUMAN)
VALIFGTASYL

SEQ ID NO: 181463 - protein, 10 aa, Homo sapiens
  Native (TYRP1_HUMAN)
FDEWLRRYNA

SEQ ID NO: 181464 - protein, 10 aa, Homo sapiens
  Native (TYRP1_HUMAN)
FGTASYLIRA

SEQ ID NO: 181465 - protein, 9 aa, Homo sapiens
  Native (TYRP1_HUMAN)
LFQQARAQF

SEQ ID NO: 181466 - protein, 9 aa, Homo sapiens
  Native (TYRP1_HUMAN)
RRSEEILGP

SEQ ID NO: 181467 - protein, 8 aa, Homo sapiens
  Native (TYRP1_HUMAN)
RPGWRGAA

SEQ ID NO: 181468 - protein, 9 aa, Homo sapiens
  Native (TYRP1_HUMAN)
SVKKTFLGV

SEQ ID NO: 181469 - protein, 10 aa, Homo sapiens
  Native (TYRP1_HUMAN)
RYNADISTFP

SEQ ID NO: 181470 - protein, 9 aa, Homo sapiens
  Native (TYRP1_HUMAN)
SLHNLAHLF

SEQ ID NO: 181471 - protein, 11 aa, Homo sapiens
  Native (TYRP1_HUMAN)
LIFGTASYLIR

SEQ ID NO: 181472 - protein, 10 aa, Homo sapiens
  Native (TYRP1_HUMAN)
AVVGALLLVA

SEQ ID NO: 181473 - protein, 9 aa, Homo sapiens
  Native (TYRP1_HUMAN)
LLSLGCIFF

SEQ ID NO: 181474 - protein, 8 aa, Homo sapiens
  Native (TYRP1_HUMAN)
KEEKNHFV

SEQ ID NO: 181475 - protein, 8 aa, Homo sapiens
  Native (TYRP1_HUMAN)
LHNLAHLF

SEQ ID NO: 181476 - protein, 8 aa, Homo sapiens
  Native (TYRP1_HUMAN)
MVPFWPPV

SEQ ID NO: 181477 - protein, 8 aa, Homo sapiens
  Native (TYRP1_HUMAN)
LTWHRYHL

SEQ ID NO: 181478 - protein, 11 aa, Homo sapiens
  Native (TYRP1_HUMAN)
ASYLIRARRSM

SEQ ID NO: 181479 - protein, 9 aa, Homo sapiens
  Native (TYRP1_HUMAN)
CYAEEYEKL

SEQ ID NO: 181480 - protein, 9 aa, Homo sapiens
  Native (TYRP1_HUMAN)
SFSLPYWNF

SEQ ID NO: 181481 - protein, 9 aa, Homo sapiens
  Native (TYRP1_HUMAN)
VRALDMAKR

SEQ ID NO: 181482 - protein, 9 aa, Homo sapiens
  Native (TYRP1_HUMAN)
HLSPNDPIF

SEQ ID NO: 181483 - protein, 9 aa, Homo sapiens
  Native (TYRP1_HUMAN)
PIFVLLHTF

SEQ ID NO: 181484 - protein, 10 aa, Homo sapiens
  Native (TYRP1_HUMAN)
RSLHNLAHLF

SEQ ID NO: 181485 - protein, 11 aa, Homo sapiens
  Native (TYRP1_HUMAN)
GRCEAVTADSR

SEQ ID NO: 181486 - protein, 10 aa, Homo sapiens
  Native (TYRP1_HUMAN)
FQQARAQFPR

SEQ ID NO: 181487 - protein, 9 aa, Homo sapiens
  Native (TYRP1_HUMAN)
GHNRQYNMV

SEQ ID NO: 181488 - protein, 11 aa, Homo sapiens
  Native (TYRP1_HUMAN)
WRGAACDQRVL

SEQ ID NO: 181489 - protein, 10 aa, Homo sapiens
  Native (TYRP1_HUMAN)
RVVCDSLEDY

SEQ ID NO: 181490 - protein, 10 aa, Homo sapiens
  Native (TYRP1_HUMAN)
FSGHNCGTCR

SEQ ID NO: 181491 - protein, 11 aa, Homo sapiens
  Native (TYRP1_HUMAN)
PRQCATVEALR

SEQ ID NO: 181492 - protein, 10 aa, Homo sapiens
  Native (TYRP1_HUMAN)
FFPLLLFQQA

SEQ ID NO: 181493 - protein, 9 aa, Homo sapiens
  Native (TYRP1_HUMAN)
VLLHTFTDA

SEQ ID NO: 181494 - protein, 9 aa, Homo sapiens
  Native (TYRP1_HUMAN)
TAPDNLGYT

SEQ ID NO: 181495 - protein, 11 aa, Homo sapiens
  Native (TYRP1_HUMAN)
EVWPLRFFNRT

SEQ ID NO: 181496 - protein, 9 aa, Homo sapiens
  Native (TYRP1_HUMAN)
RDDREVWPL

SEQ ID NO: 181497 - protein, 9 aa, Homo sapiens
  Native (TYRP1_HUMAN)
GAACDQRVL

SEQ ID NO: 181498 - protein, 10 aa, Homo sapiens
  Native (TYRP1_HUMAN)
AFLTWHRYHL

SEQ ID NO: 181499 - protein, 10 aa, Homo sapiens
  Native (TYRP1_HUMAN)
LGPDGNTPQF

SEQ ID NO: 181500 - protein, 9 aa, Homo sapiens
  Native (TYRP1_HUMAN)
TEMFVTAPD

SEQ ID NO: 181501 - protein, 8 aa, Homo sapiens
  Native (TYRP1_HUMAN)
EAVTADSR

SEQ ID NO: 181502 - protein, 8 aa, Homo sapiens
  Native (TYRP1_HUMAN)
IFFPLLLF

SEQ ID NO: 181503 - protein, 10 aa, Homo sapiens
  Native (TYRP1_HUMAN)
LSLGCIFFPL

SEQ ID NO: 181504 - protein, 8 aa, Homo sapiens
  Native (TYRP1_HUMAN)
YSVKKTFL

SEQ ID NO: 181505 - protein, 9 aa, Homo sapiens
  Native (TYRP1_HUMAN)
VRSLHNLAH

SEQ ID NO: 181506 - protein, 11 aa, Homo sapiens
  Native (TYRP1_HUMAN)
EVDFSHEGPAF

SEQ ID NO: 181507 - protein, 8 aa, Homo sapiens
  Native (TYRP1_HUMAN)
VLIVRRNL

SEQ ID NO: 181508 - protein, 11 aa, Homo sapiens
  Native (TYRP1_HUMAN)
AIAVVGALLLV

SEQ ID NO: 181509 - protein, 9 aa, Homo sapiens
  Native (TYRP1_HUMAN)
CGTCRPGWR

SEQ ID NO: 181510 - protein, 9 aa, Homo sapiens
  Native (TYRP1_HUMAN)
RTCHCNGNF

SEQ ID NO: 181511 - protein, 10 aa, Homo sapiens
  Native (TYRP1_HUMAN)
SIYNYFVWTH

SEQ ID NO: 181512 - protein, 11 aa, Homo sapiens
  Native (TYRP1_HUMAN)
SGPGTDRCGSS

SEQ ID NO: 181513 - protein, 10 aa, Homo sapiens
  Native (TYRP1_HUMAN)
TAPDNLGYTY

SEQ ID NO: 181514 - protein, 10 aa, Homo sapiens
  Native (TYRP1_HUMAN)
AVFDEWLRRY

SEQ ID NO: 181515 - protein, 9 aa, Homo sapiens
  Native (TYRP1_HUMAN)
REVWPLRFF

SEQ ID NO: 181516 - protein, 8 aa, Homo sapiens
  Native (TYRP1_HUMAN)
HFVRALDM

SEQ ID NO: 181517 - protein, 11 aa, Homo sapiens
  Native (TYRP1_HUMAN)
REVWPLRFFNR

SEQ ID NO: 181518 - protein, 10 aa, Homo sapiens
  Native (TYRP1_HUMAN)
EMFVTAPDNL

SEQ ID NO: 181519 - protein, 9 aa, Homo sapiens
  Native (TYRP1_HUMAN)
NSTEDGPIR

SEQ ID NO: 181520 - protein, 10 aa, Homo sapiens
  Native (TYRP1_HUMAN)
VVGALLLVAL

SEQ ID NO: 181521 - protein, 9 aa, Homo sapiens
  Native (TYRP1_HUMAN)
KLQNPNQSV

SEQ ID NO: 181522 - protein, 9 aa, Homo sapiens
  Native (TYRP1_HUMAN)
IAVVGALLL

SEQ ID NO: 181523 - protein, 11 aa, Homo sapiens
  Native (TYRP1_HUMAN)
ALIFGTASYLI

SEQ ID NO: 181524 - protein, 11 aa, Homo sapiens
  Native (TYRP1_HUMAN)
YTYEIQWPSRE

SEQ ID NO: 181525 - protein, 11 aa, Homo sapiens
  Native (TYRP1_HUMAN)
PFYSNSTNSFR

SEQ ID NO: 181526 - protein, 9 aa, Homo sapiens
  Native (TYRP1_HUMAN)
ALLLVALIF

SEQ ID NO: 181527 - protein, 9 aa, Homo sapiens
  Native (TYRP1_HUMAN)
NPAGNVARP

SEQ ID NO: 181528 - protein, 11 aa, Homo sapiens
  Native (TYRP1_HUMAN)
IRRNPAGNVAR

SEQ ID NO: 181529 - protein, 10 aa, Homo sapiens
  Native (TYRP1_HUMAN)
WPLRFFNRTC

SEQ ID NO: 181530 - protein, 10 aa, Homo sapiens
  Native (TYRP1_HUMAN)
GNVARPMVQR

SEQ ID NO: 181531 - protein, 10 aa, Homo sapiens
  Native (TYRP1_HUMAN)
NAPIGHNRQY

SEQ ID NO: 181532 - protein, 9 aa, Homo sapiens
  Native (TYRP1_HUMAN)
STNSFRNTV

SEQ ID NO: 181533 - protein, 9 aa, Homo sapiens
  Native (TYRP1_HUMAN)
WHRYHLLRL

SEQ ID NO: 181534 - protein, 9 aa, Homo sapiens
  Native (TYRP1_HUMAN)
QDVAQCLEV

SEQ ID NO: 181535 - protein, 9 aa, Homo sapiens
  Native (TYRP1_HUMAN)
SLGCIFFPL

SEQ ID NO: 181536 - protein, 9 aa, Homo sapiens
  Native (TYRP1_HUMAN)
ENISIYNYF

SEQ ID NO: 181537 - protein, 10 aa, Homo sapiens
  Native (TYRP1_HUMAN)
KYDPAVRSLH

SEQ ID NO: 181538 - protein, 10 aa, Homo sapiens
  Native (TYRP1_HUMAN)
QFENISIYNY

SEQ ID NO: 181539 - protein, 11 aa, Homo sapiens
  Native (TYRP1_HUMAN)
FVWTHYYSVKK

SEQ ID NO: 181540 - protein, 9 aa, Homo sapiens
  Native (TYRP1_HUMAN)
QCATVEALR

SEQ ID NO: 181541 - protein, 9 aa, Homo sapiens
  Native (TYRP1_HUMAN)
NGTGGQTHL

SEQ ID NO: 181542 - protein, 10 aa, Homo sapiens
  Native (TYRP1_HUMAN)
GTCRPGWRGA

SEQ ID NO: 181543 - protein, 11 aa, Homo sapiens
  Native (TYRP1_HUMAN)
RDDREVWPLRF

SEQ ID NO: 181544 - protein, 10 aa, Homo sapiens
  Native (TYRP1_HUMAN)
DVAQCLEVGL

SEQ ID NO: 181545 - protein, 9 aa, Homo sapiens
  Native (TYRP1_HUMAN)
RPGWRGAAC

SEQ ID NO: 181546 - protein, 10 aa, Homo sapiens
  Native (TYRP1_HUMAN)
HRYHLLRLEK

SEQ ID NO: 181547 - protein, 10 aa, Homo sapiens
  Native (TYRP1_HUMAN)
AACDQRVLIV

SEQ ID NO: 181548 - protein, 9 aa, Homo sapiens
  Native (TYRP1_HUMAN)
IATRRSEEI

SEQ ID NO: 181549 - protein, 10 aa, Homo sapiens
  Native (TYRP1_HUMAN)
LEVGLFDTPP

SEQ ID NO: 181550 - protein, 9 aa, Homo sapiens
  Native (TYRP1_HUMAN)
LLVALIFGT

SEQ ID NO: 181551 - protein, 9 aa, Homo sapiens
  Native (TYRP1_HUMAN)
EGYSDPTGK

SEQ ID NO: 181552 - protein, 8 aa, Homo sapiens
  Native (TYRP1_HUMAN)
FVTAPDNL

SEQ ID NO: 181553 - protein, 9 aa, Homo sapiens
  Native (TYRP1_HUMAN)
QRLPEPQDV

SEQ ID NO: 181554 - protein, 11 aa, Homo sapiens
  Native (TYRP1_HUMAN)
LSPVSGPGTDR

SEQ ID NO: 181555 - protein, 11 aa, Homo sapiens
  Native (TYRP1_HUMAN)
QTHLSPNDPIF

SEQ ID NO: 181556 - protein, 11 aa, Homo sapiens
  Native (TYRP1_HUMAN)
TDDLMGSRSNF

SEQ ID NO: 181557 - protein, 10 aa, Homo sapiens
  Native (TYRP1_HUMAN)
SRSNFDSTLI

SEQ ID NO: 181558 - protein, 11 aa, Homo sapiens
  Native (TYRP1_HUMAN)
IAIAVVGALLL

SEQ ID NO: 181559 - protein, 9 aa, Homo sapiens
  Native (TYRP1_HUMAN)
DQRVLIVRR

SEQ ID NO: 181560 - protein, 9 aa, Homo sapiens
  Native (TYRP1_HUMAN)
EPSFSLPYW

SEQ ID NO: 181561 - protein, 9 aa, Homo sapiens
  Native (TYRP1_HUMAN)
GYSDPTGKY

SEQ ID NO: 181562 - protein, 10 aa, Homo sapiens
  Native (TYRP1_HUMAN)
LPYWNFATGK

SEQ ID NO: 181563 - protein, 10 aa, Homo sapiens
  Native (TYRP1_HUMAN)
LRSGMCCPDL

SEQ ID NO: 181564 - protein, 10 aa, Homo sapiens
  Native (TYRP1_HUMAN)
IRRNPAGNVA

SEQ ID NO: 181565 - protein, 8 aa, Homo sapiens
  Native (TYRP1_HUMAN)
VSGPGTDR

SEQ ID NO: 181566 - protein, 8 aa, Homo sapiens
  Native (TYRP1_HUMAN)
YQCYAEEY

SEQ ID NO: 181567 - protein, 8 aa, Homo sapiens
  Native (TYRP1_HUMAN)
YSNSTNSF

SEQ ID NO: 181568 - protein, 10 aa, Homo sapiens
  Native (TYRP1_HUMAN)
LLHTFTDAVF

SEQ ID NO: 181569 - protein, 8 aa, Homo sapiens
  Native (TYRP1_HUMAN)
LIRARRSM

SEQ ID NO: 181570 - protein, 11 aa, Homo sapiens
  Native (TYRP1_HUMAN)
QRVLIVRRNLL

SEQ ID NO: 181571 - protein, 11 aa, Homo sapiens
  Native (TYRP1_HUMAN)
QFENISIYNYF

SEQ ID NO: 181572 - protein, 10 aa, Homo sapiens
  Native (TYRP1_HUMAN)
LLFQQARAQF

SEQ ID NO: 181573 - protein, 11 aa, Homo sapiens
  Native (TYRP1_HUMAN)
VLLHTFTDAVF

SEQ ID NO: 181574 - protein, 10 aa, Homo sapiens
  Native (TYRP1_HUMAN)
SPNSVFSQWR

SEQ ID NO: 181575 - protein, 10 aa, Homo sapiens
  Native (TYRP1_HUMAN)
YEKLQNPNQS

SEQ ID NO: 181576 - protein, 8 aa, Homo sapiens
  Native (TYRP1_HUMAN)
YFVWTHYY

SEQ ID NO: 181577 - protein, 8 aa, Homo sapiens
  Native (TYRP1_HUMAN)
LQEPSFSL

SEQ ID NO: 181578 - protein, 11 aa, Homo sapiens
  Native (TYRP1_HUMAN)
FPRQCATVEAL

SEQ ID NO: 181579 - protein, 11 aa, Homo sapiens
  Native (TYRP1_HUMAN)
SVPEIIAIAVV

SEQ ID NO: 181580 - protein, 10 aa, Homo sapiens
  Native (TYRP1_HUMAN)
APKLLSLGCI

SEQ ID NO: 181581 - protein, 8 aa, Homo sapiens
  Native (TYRP1_HUMAN)
FPLENAPI

SEQ ID NO: 181582 - protein, 10 aa, Homo sapiens
  Native (TYRP1_HUMAN)
SREFSVPEII

SEQ ID NO: 181583 - protein, 10 aa, Homo sapiens
  Native (TYRP1_HUMAN)
LQEPSFSLPY

SEQ ID NO: 181584 - protein, 10 aa, Homo sapiens
  Native (TYRP1_HUMAN)
FTDAVFDEWL

SEQ ID NO: 181585 - protein, 9 aa, Homo sapiens
  Native (TYRP1_HUMAN)
IIAIAVVGA

SEQ ID NO: 181586 - protein, 9 aa, Homo sapiens
  Native (TYRP1_HUMAN)
LQNPNQSVV

SEQ ID NO: 181587 - protein, 9 aa, Homo sapiens
  Native (TYRP1_HUMAN)
THYYSVKKT

SEQ ID NO: 181588 - protein, 8 aa, Homo sapiens
  Native (TYRP1_HUMAN)
HEGPAFLT

SEQ ID NO: 181589 - protein, 8 aa, Homo sapiens
  Native (TYRP1_HUMAN)
SPVSGPGT

SEQ ID NO: 181590 - protein, 10 aa, Homo sapiens
  Native (TYRP1_HUMAN)
VQRLPEPQDV

SEQ ID NO: 181591 - protein, 9 aa, Homo sapiens
  Native (TYRP1_HUMAN)
VEALRSGMC

SEQ ID NO: 181592 - protein, 10 aa, Homo sapiens
  Native (TYRP1_HUMAN)
MSAPKLLSLG

SEQ ID NO: 181593 - protein, 10 aa, Homo sapiens
  Native (TYRP1_HUMAN)
HYYSVKKTFL

SEQ ID NO: 181594 - protein, 10 aa, Homo sapiens
  Native (TYRP1_HUMAN)
FVLLHTFTDA

SEQ ID NO: 181595 - protein, 9 aa, Homo sapiens
  Native (TYRP1_HUMAN)
FGTASYLIR

SEQ ID NO: 181596 - protein, 10 aa, Homo sapiens
  Native (TYRP1_HUMAN)
RSMDEANQPL

SEQ ID NO: 181597 - protein, 8 aa, Homo sapiens
  Native (TYRP1_HUMAN)
NDPIFVLL

SEQ ID NO: 181598 - protein, 10 aa, Homo sapiens
  Native (TYRP1_HUMAN)
MVPFWPPVTN

SEQ ID NO: 181599 - protein, 9 aa, Homo sapiens
  Native (TYRP1_HUMAN)
HRYHLLRLE

SEQ ID NO: 181600 - protein, 9 aa, Homo sapiens
  Native (TYRP1_HUMAN)
DYDTLGTLC

SEQ ID NO: 181601 - protein, 11 aa, Homo sapiens
  Native (TYRP1_HUMAN)
GTDRCGSSSGR

SEQ ID NO: 181602 - protein, 9 aa, Homo sapiens
  Native (TYRP1_HUMAN)
LTDQYQCYA

SEQ ID NO: 181603 - protein, 10 aa, Homo sapiens
  Native (TYRP1_HUMAN)
DSTLISPNSV

SEQ ID NO: 181604 - protein, 11 aa, Homo sapiens
  Native (TYRP1_HUMAN)
APIGHNRQYNM

SEQ ID NO: 181605 - protein, 10 aa, Homo sapiens
  Native (TYRP1_HUMAN)
TTHPLFVIAT

SEQ ID NO: 181606 - protein, 8 aa, Homo sapiens
  Native (TYRP1_HUMAN)
SRPHSPQY

SEQ ID NO: 181607 - protein, 9 aa, Homo sapiens
  Native (TYRP1_HUMAN)
PNDPIFVLL

SEQ ID NO: 181608 - protein, 9 aa, Homo sapiens
  Native (TYRP1_HUMAN)
HEGPAFLTW

SEQ ID NO: 181609 - protein, 11 aa, Homo sapiens
  Native (TYRP1_HUMAN)
RPHSPQYPHDG

SEQ ID NO: 181610 - protein, 8 aa, Homo sapiens
  Native (TYRP1_HUMAN)
AFLTWHRY

SEQ ID NO: 181611 - protein, 11 aa, Homo sapiens
  Native (TYRP1_HUMAN)
ENISIYNYFVW

SEQ ID NO: 181612 - protein, 9 aa, Homo sapiens
  Native (TYRP1_HUMAN)
RNPAGNVAR

SEQ ID NO: 181613 - protein, 9 aa, Homo sapiens
  Native (TYRP1_HUMAN)
GALLLVALI

SEQ ID NO: 181614 - protein, 10 aa, Homo sapiens
  Native (TYRP1_HUMAN)
GRDDREVWPL

SEQ ID NO: 181615 - protein, 9 aa, Homo sapiens
  Native (TYRP1_HUMAN)
LGYTYEIQW

SEQ ID NO: 181616 - protein, 9 aa, Homo sapiens
  Native (TYRP1_HUMAN)
VPFWPPVTN

SEQ ID NO: 181617 - protein, 9 aa, Homo sapiens
  Native (TYRP1_HUMAN)
AQFPRQCAT

SEQ ID NO: 181618 - protein, 9 aa, Homo sapiens
  Native (TYRP1_HUMAN)
VPEIIAIAV

SEQ ID NO: 181619 - protein, 10 aa, Homo sapiens
  Native (TYRP1_HUMAN)
YFVWTHYYSV

SEQ ID NO: 181620 - protein, 11 aa, Homo sapiens
  Native (TYRP1_HUMAN)
MLQEPSFSLPY

SEQ ID NO: 181621 - protein, 11 aa, Homo sapiens
  Native (TYRP1_HUMAN)
FWPPVTNTEMF

SEQ ID NO: 181622 - protein, 11 aa, Homo sapiens
  Native (TYRP1_HUMAN)
FPLLLFQQARA

SEQ ID NO: 181623 - protein, 9 aa, Homo sapiens
  Native (TYRP1_HUMAN)
FLGVGQESF

SEQ ID NO: 181624 - protein, 9 aa, Homo sapiens
  Native (TYRP1_HUMAN)
FVRALDMAK

SEQ ID NO: 181625 - protein, 11 aa, Homo sapiens
  Native (TYRP1_HUMAN)
NYFVWTHYYSV

SEQ ID NO: 181626 - protein, 8 aa, Homo sapiens
  Native (TYRP1_HUMAN)
VRRNLLDL

SEQ ID NO: 181627 - protein, 8 aa, Homo sapiens
  Native (TYRP1_HUMAN)
RPMVQRLP

SEQ ID NO: 181628 - protein, 10 aa, Homo sapiens
  Native (TYRP1_HUMAN)
KLQNPNQSVV

SEQ ID NO: 181629 - protein, 10 aa, Homo sapiens
  Native (TYRP1_HUMAN)
GPAFLTWHRY

SEQ ID NO: 181630 - protein, 9 aa, Homo sapiens
  Native (TYRP1_HUMAN)
FLTWHRYHL

SEQ ID NO: 181631 - protein, 8 aa, Homo sapiens
  Native (TYRP1_HUMAN)
RTTHPLFV

SEQ ID NO: 181632 - protein, 8 aa, Homo sapiens
  Native (TYRP1_HUMAN)
RRNPAGNV

SEQ ID NO: 181633 - protein, 11 aa, Homo sapiens
  Native (TYRP1_HUMAN)
SLGCIFFPLLL

SEQ ID NO: 181634 - protein, 8 aa, Homo sapiens
  Native (TYRP1_HUMAN)
WPSREFSV

SEQ ID NO: 181635 - protein, 9 aa, Homo sapiens
  Native (TYRP1_HUMAN)
LEDYDTLGT

SEQ ID NO: 181636 - protein, 10 aa, Homo sapiens
  Native (TYRP1_HUMAN)
THYYSVKKTF

SEQ ID NO: 181637 - protein, 11 aa, Homo sapiens
  Native (TYRP1_HUMAN)
YQCYAEEYEKL

SEQ ID NO: 181638 - protein, 10 aa, Homo sapiens
  Native (TYRP1_HUMAN)
NRQYNMVPFW

SEQ ID NO: 181639 - protein, 10 aa, Homo sapiens
  Native (TYRP1_HUMAN)
SHEGPAFLTW

SEQ ID NO: 181640 - protein, 11 aa, Homo sapiens
  Native (TYRP1_HUMAN)
YEKLQNPNQSV

SEQ ID NO: 181641 - protein, 11 aa, Homo sapiens
  Native (TYRP1_HUMAN)
WPSREFSVPEI

SEQ ID NO: 181642 - protein, 9 aa, Homo sapiens
  Native (TYRP1_HUMAN)
RRSMDEANQ

SEQ ID NO: 181643 - protein, 9 aa, Homo sapiens
  Native (TYRP1_HUMAN)
AFLTWHRYH

SEQ ID NO: 181644 - protein, 9 aa, Homo sapiens
  Native (TYRP1_HUMAN)
VAQCLEVGL

SEQ ID NO: 181645 - protein, 9 aa, Homo sapiens
  Native (TYRP1_HUMAN)
DPTGKYDPA

SEQ ID NO: 181646 - protein, 10 aa, Homo sapiens
  Native (TYRP1_HUMAN)
SFSLPYWNFA

SEQ ID NO: 181647 - protein, 10 aa, Homo sapiens
  Native (TYRP1_HUMAN)
HPLFVIATRR

SEQ ID NO: 181648 - protein, 10 aa, Homo sapiens
  Native (TYRP1_HUMAN)
DPIFVLLHTF

SEQ ID NO: 181649 - protein, 10 aa, Homo sapiens
  Native (TYRP1_HUMAN)
PSFSLPYWNF

SEQ ID NO: 181650 - protein, 9 aa, Homo sapiens
  Native (TYRP1_HUMAN)
ASYLIRARR

SEQ ID NO: 181651 - protein, 9 aa, Homo sapiens
  Native (TYRP1_HUMAN)
GTASYLIRA

SEQ ID NO: 181652 - protein, 8 aa, Homo sapiens
  Native (TYRP1_HUMAN)
TTHPLFVI

SEQ ID NO: 181653 - protein, 10 aa, Homo sapiens
  Native (TYRP1_HUMAN)
HSPQYPHDGR

SEQ ID NO: 181654 - protein, 9 aa, Homo sapiens
  Native (TYRP1_HUMAN)
NCGTCRPGW

SEQ ID NO: 181655 - protein, 10 aa, Homo sapiens
  Native (TYRP1_HUMAN)
FWPPVTNTEM

SEQ ID NO: 181656 - protein, 11 aa, Homo sapiens
  Native (TYRP1_HUMAN)
SMDEANQPLLT

SEQ ID NO: 181657 - protein, 11 aa, Homo sapiens
  Native (TYRP1_HUMAN)
MFVTAPDNLGY

SEQ ID NO: 181658 - protein, 10 aa, Homo sapiens
  Native (TYRP1_HUMAN)
VAQCLEVGLF

SEQ ID NO: 181659 - protein, 9 aa, Homo sapiens
  Native (TYRP1_HUMAN)
AIAVVGALL

SEQ ID NO: 181660 - protein, 10 aa, Homo sapiens
  Native (TYRP1_HUMAN)
ANQPLLTDQY

SEQ ID NO: 181661 - protein, 10 aa, Homo sapiens
  Native (TYRP1_HUMAN)
AVRSLHNLAH

SEQ ID NO: 181662 - protein, 9 aa, Homo sapiens
  Native (TYRP1_HUMAN)
FPLENAPIG

SEQ ID NO: 181663 - protein, 9 aa, Homo sapiens
  Native (TYRP1_HUMAN)
CDQRVLIVR

SEQ ID NO: 181664 - protein, 9 aa, Homo sapiens
  Native (TYRP1_HUMAN)
SPQYPHDGR

SEQ ID NO: 181665 - protein, 8 aa, Homo sapiens
  Native (TYRP1_HUMAN)
PPVTNTEM

SEQ ID NO: 181666 - protein, 9 aa, Homo sapiens
  Native (TYRP1_HUMAN)
PQFENISIY

SEQ ID NO: 181667 - protein, 9 aa, Homo sapiens
  Native (TYRP1_HUMAN)
TASYLIRAR

SEQ ID NO: 181668 - protein, 10 aa, Homo sapiens
  Native (TYRP1_HUMAN)
RLEKDMQEML

SEQ ID NO: 181669 - protein, 9 aa, Homo sapiens
  Native (TYRP1_HUMAN)
EDYDTLGTL

SEQ ID NO: 181670 - protein, 11 aa, Homo sapiens
  Native (TYRP1_HUMAN)
FFPLLLFQQAR

SEQ ID NO: 181671 - protein, 9 aa, Homo sapiens
  Native (TYRP1_HUMAN)
RRNPAGNVA

SEQ ID NO: 181672 - protein, 9 aa, Homo sapiens
  Native (TYRP1_HUMAN)
EIQWPSREF

SEQ ID NO: 181673 - protein, 11 aa, Homo sapiens
  Native (TYRP1_HUMAN)
APKLLSLGCIF

SEQ ID NO: 181674 - protein, 8 aa, Homo sapiens
  Native (TYRP1_HUMAN)
IFVLLHTF

SEQ ID NO: 181675 - protein, 9 aa, Homo sapiens
  Native (TYRP1_HUMAN)
MLQEPSFSL

SEQ ID NO: 181676 - protein, 11 aa, Homo sapiens
  Native (TYRP1_HUMAN)
HRYHLLRLEKD

SEQ ID NO: 181677 - protein, 11 aa, Homo sapiens
  Native (TYRP1_HUMAN)
ILGPDGNTPQF

SEQ ID NO: 181678 - protein, 11 aa, Homo sapiens
  Native (TYRP1_HUMAN)
DVAQCLEVGLF

SEQ ID NO: 181679 - protein, 10 aa, Homo sapiens
  Native (TYRP1_HUMAN)
HNCGTCRPGW

SEQ ID NO: 181680 - protein, 8 aa, Homo sapiens
  Native (TYRP1_HUMAN)
VPFWPPVT

SEQ ID NO: 181681 - protein, 9 aa, Homo sapiens
  Native (TYRP1_HUMAN)
NQPLLTDQY

SEQ ID NO: 181682 - protein, 11 aa, Homo sapiens
  Native (TYRP1_HUMAN)
CNSTEDGPIRR

SEQ ID NO: 181683 - protein, 8 aa, Homo sapiens
  Native (TYRP1_HUMAN)
ADISTFPL

SEQ ID NO: 181684 - protein, 9 aa, Homo sapiens
  Native (TYRP1_HUMAN)
LVALIFGTA

SEQ ID NO: 181685 - protein, 8 aa, Homo sapiens
  Native (TYRP1_HUMAN)
RQYNMVPF

SEQ ID NO: 181686 - protein, 9 aa, Homo sapiens
  Native (TYRP1_HUMAN)
QWRVVCDSL

SEQ ID NO: 181687 - protein, 8 aa, Homo sapiens
  Native (TYRP1_HUMAN)
RPHSPQYP

SEQ ID NO: 181688 - protein, 10 aa, Homo sapiens
  Native (TYRP1_HUMAN)
FPLENAPIGH

SEQ ID NO: 181689 - protein, 10 aa, Homo sapiens
  Native (TYRP1_HUMAN)
LLVALIFGTA

SEQ ID NO: 181690 - protein, 10 aa, Homo sapiens
  Native (TYRP1_HUMAN)
SYLIRARRSM

SEQ ID NO: 181691 - protein, 10 aa, Homo sapiens
  Native (TYRP1_HUMAN)
RVLIVRRNLL

SEQ ID NO: 181692 - protein, 11 aa, Homo sapiens
  Native (TYRP1_HUMAN)
MGSRSNFDSTL

SEQ ID NO: 181693 - protein, 8 aa, Homo sapiens
  Native (TYRP1_HUMAN)
AVFDEWLR

SEQ ID NO: 181694 - protein, 10 aa, Homo sapiens
  Native (TYRP1_HUMAN)
VPEIIAIAVV

SEQ ID NO: 181695 - protein, 10 aa, Homo sapiens
  Native (TYRP1_HUMAN)
FPLLLFQQAR

SEQ ID NO: 181696 - protein, 11 aa, Homo sapiens
  Native (TYRP1_HUMAN)
ENAPIGHNRQY

SEQ ID NO: 181697 - protein, 11 aa, Homo sapiens
  Native (TYRP1_HUMAN)
WTHYYSVKKTF

SEQ ID NO: 181698 - protein, 9 aa, Homo sapiens
  Native (TYRP1_HUMAN)
LLDLSKEEK

SEQ ID NO: 181699 - protein, 9 aa, Homo sapiens
  Native (TYRP1_HUMAN)
RTTHPLFVI

SEQ ID NO: 181700 - protein, 10 aa, Homo sapiens
  Native (TYRP1_HUMAN)
EEILGPDGNT

SEQ ID NO: 181701 - protein, 8 aa, Homo sapiens
  Native (TYRP1_HUMAN)
VARPMVQR

SEQ ID NO: 181702 - protein, 10 aa, Homo sapiens
  Native (TYRP1_HUMAN)
TASYLIRARR

SEQ ID NO: 181703 - protein, 10 aa, Homo sapiens
  Native (TYRP1_HUMAN)
LENAPIGHNR

SEQ ID NO: 181704 - protein, 10 aa, Homo sapiens
  Native (TYRP1_HUMAN)
ISIYNYFVWT

SEQ ID NO: 181705 - protein, 9 aa, Homo sapiens
  Native (TYRP1_HUMAN)
SGRGRCEAV

SEQ ID NO: 181706 - protein, 10 aa, Homo sapiens
  Native (TYRP1_HUMAN)
TWHRYHLLRL

SEQ ID NO: 181707 - protein, 11 aa, Homo sapiens
  Native (TYRP1_HUMAN)
REFSVPEIIAI

SEQ ID NO: 181708 - protein, 11 aa, Homo sapiens
  Native (TYRP1_HUMAN)
YNMVPFWPPVT

SEQ ID NO: 181709 - protein, 9 aa, Homo sapiens
  Native (TYRP1_HUMAN)
ARAQFPRQC

SEQ ID NO: 181710 - protein, 10 aa, Homo sapiens
  Native (TYRP1_HUMAN)
EIIAIAVVGA

SEQ ID NO: 181711 - protein, 10 aa, Homo sapiens
  Native (TYRP1_HUMAN)
FVTAPDNLGY

SEQ ID NO: 181712 - protein, 10 aa, Homo sapiens
  Native (TYRP1_HUMAN)
LEDYDTLGTL

SEQ ID NO: 181713 - protein, 10 aa, Homo sapiens
  Native (TYRP1_HUMAN)
NPAGNVARPM

SEQ ID NO: 181714 - protein, 9 aa, Homo sapiens
  Native (TYRP1_HUMAN)
SLPYWNFAT

SEQ ID NO: 181715 - protein, 10 aa, Homo sapiens
  Native (TYRP1_HUMAN)
KRTTHPLFVI

SEQ ID NO: 181716 - protein, 9 aa, Homo sapiens
  Native (TYRP1_HUMAN)
QCYAEEYEK

SEQ ID NO: 181717 - protein, 8 aa, Homo sapiens
  Native (TYRP1_HUMAN)
LSLGCIFF

SEQ ID NO: 181718 - protein, 9 aa, Homo sapiens
  Native (TYRP1_HUMAN)
RSLHNLAHL

SEQ ID NO: 181719 - protein, 10 aa, Homo sapiens
  Native (TYRP1_HUMAN)
FSVPEIIAIA

SEQ ID NO: 181720 - protein, 9 aa, Homo sapiens
  Native (TYRP1_HUMAN)
LHNLAHLFL

SEQ ID NO: 181721 - protein, 9 aa, Homo sapiens
  Native (TYRP1_HUMAN)
EEYEKLQNP

SEQ ID NO: 181722 - protein, 8 aa, Homo sapiens
  Native (TYRP1_HUMAN)
AQCLEVGL

SEQ ID NO: 181723 - protein, 9 aa, Homo sapiens
  Native (TYRP1_HUMAN)
SFRNTVEGY

SEQ ID NO: 181724 - protein, 9 aa, Homo sapiens
  Native (TYRP1_HUMAN)
TWHRYHLLR

SEQ ID NO: 181725 - protein, 10 aa, Homo sapiens
  Native (TYRP1_HUMAN)
WPPVTNTEMF

SEQ ID NO: 181726 - protein, 9 aa, Homo sapiens
  Native (TYRP1_HUMAN)
NRQYNMVPF

SEQ ID NO: 181727 - protein, 11 aa, Homo sapiens
  Native (TYRP1_HUMAN)
LLLFQQARAQF

SEQ ID NO: 181728 - protein, 10 aa, Homo sapiens
  Native (TYRP1_HUMAN)
PFYSNSTNSF

SEQ ID NO: 181729 - protein, 10 aa, Homo sapiens
  Native (TYRP1_HUMAN)
CNSTEDGPIR

SEQ ID NO: 181730 - protein, 10 aa, Homo sapiens
  Native (TYRP1_HUMAN)
MLQEPSFSLP

SEQ ID NO: 181731 - protein, 10 aa, Homo sapiens
  Native (TYRP1_HUMAN)
EGPAFLTWHR

SEQ ID NO: 181732 - protein, 10 aa, Homo sapiens
  Native (TYRP1_HUMAN)
GTASYLIRAR

SEQ ID NO: 181733 - protein, 9 aa, Homo sapiens
  Native (TYRP1_HUMAN)
QWPSREFSV

SEQ ID NO: 181734 - protein, 11 aa, Homo sapiens
  Native (TYRP1_HUMAN)
FLTWHRYHLLR

SEQ ID NO: 181735 - protein, 9 aa, Homo sapiens
  Native (TYRP1_HUMAN)
HPLFVIATR

SEQ ID NO: 181736 - protein, 10 aa, Homo sapiens
  Native (TYRP1_HUMAN)
SVPEIIAIAV

SEQ ID NO: 181737 - protein, 9 aa, Homo sapiens
  Native (TYRP1_HUMAN)
NSVFSQWRV

SEQ ID NO: 181738 - protein, 11 aa, Homo sapiens
  Native (TYRP1_HUMAN)
TDAVFDEWLRR

SEQ ID NO: 181739 - protein, 9 aa, Homo sapiens
  Native (TYRP1_HUMAN)
VWPLRFFNR

SEQ ID NO: 181740 - protein, 11 aa, Homo sapiens
  Native (TYRP1_HUMAN)
YPHDGRDDREV

SEQ ID NO: 181741 - protein, 10 aa, Homo sapiens
  Native (TYRP1_HUMAN)
ALIFGTASYL

SEQ ID NO: 181742 - protein, 11 aa, Homo sapiens
  Native (TYRP1_HUMAN)
DICTDDLMGSR

SEQ ID NO: 181743 - protein, 10 aa, Homo sapiens
  Native (TYRP1_HUMAN)
QRLPEPQDVA

SEQ ID NO: 181744 - protein, 11 aa, Homo sapiens
  Native (TYRP1_HUMAN)
LPEPQDVAQCL

SEQ ID NO: 181745 - protein, 10 aa, Homo sapiens
  Native (TYRP1_HUMAN)
EDYDTLGTLC

SEQ ID NO: 181746 - protein, 11 aa, Homo sapiens
  Native (TYRP1_HUMAN)
RRNPAGNVARP

SEQ ID NO: 181747 - protein, 11 aa, Homo sapiens
  Native (TYRP1_HUMAN)
FVLLHTFTDAV

SEQ ID NO: 181748 - protein, 10 aa, Homo sapiens
  Native (TYRP1_HUMAN)
VEGYSDPTGK

SEQ ID NO: 181749 - protein, 9 aa, Homo sapiens
  Native (TYRP1_HUMAN)
TDAVFDEWL

SEQ ID NO: 181750 - protein, 9 aa, Homo sapiens
  Native (TYRP1_HUMAN)
THPLFVIAT

SEQ ID NO: 181751 - protein, 11 aa, Homo sapiens
  Native (TYRP1_HUMAN)
SPNSVFSQWRV

SEQ ID NO: 181752 - protein, 11 aa, Homo sapiens
  Native (TYRP1_HUMAN)
SEEILGPDGNT

SEQ ID NO: 181753 - protein, 11 aa, Homo sapiens
  Native (TYRP1_HUMAN)
LSLGCIFFPLL

SEQ ID NO: 181754 - protein, 8 aa, Homo sapiens
  Native (TYRP1_HUMAN)
FRNTVEGY

SEQ ID NO: 181755 - protein, 9 aa, Homo sapiens
  Native (TYRP1_HUMAN)
MDEANQPLL

SEQ ID NO: 181756 - protein, 9 aa, Homo sapiens
  Native (TYRP1_HUMAN)
FTDAVFDEW

SEQ ID NO: 181757 - protein, 10 aa, Homo sapiens
  Native (TYRP1_HUMAN)
GVGQESFGEV

SEQ ID NO: 181758 - protein, 11 aa, Homo sapiens
  Native (TYRP1_HUMAN)
QPLLTDQYQCY

SEQ ID NO: 181759 - protein, 11 aa, Homo sapiens
  Native (TYRP1_HUMAN)
NTPQFENISIY

SEQ ID NO: 181760 - protein, 9 aa, Homo sapiens
  Native (TYRP1_HUMAN)
PYWNFATGK

SEQ ID NO: 181761 - protein, 11 aa, Homo sapiens
  Native (TYRP1_HUMAN)
QFPRQCATVEA

SEQ ID NO: 181762 - protein, 8 aa, Homo sapiens
  Native (TYRP1_HUMAN)
GLFDTPPF

SEQ ID NO: 181763 - protein, 10 aa, Homo sapiens
  Native (TYRP1_HUMAN)
NYFVWTHYYS

SEQ ID NO: 181764 - protein, 10 aa, Homo sapiens
  Native (TYRP1_HUMAN)
AEEYEKLQNP

SEQ ID NO: 181765 - protein, 10 aa, Homo sapiens
  Native (TYRP1_HUMAN)
HNRQYNMVPF

SEQ ID NO: 181766 - protein, 11 aa, Homo sapiens
  Native (TYRP1_HUMAN)
HFVRALDMAKR

SEQ ID NO: 181767 - protein, 10 aa, Homo sapiens
  Native (TYRP1_HUMAN)
LTWHRYHLLR

SEQ ID NO: 181768 - protein, 8 aa, Homo sapiens
  Native (TYRP1_HUMAN)
SNFDSTLI

SEQ ID NO: 181769 - protein, 8 aa, Homo sapiens
  Native (TYRP1_HUMAN)
REFSVPEI

SEQ ID NO: 181770 - protein, 10 aa, Homo sapiens
  Native (TYRP1_HUMAN)
RRNPAGNVAR

SEQ ID NO: 181771 - protein, 9 aa, Homo sapiens
  Native (TYRP1_HUMAN)
DSLEDYDTL

SEQ ID NO: 181772 - protein, 8 aa, Homo sapiens
  Native (TYRP1_HUMAN)
PQFENISI

SEQ ID NO: 181773 - protein, 9 aa, Homo sapiens
  Native (TYRP1_HUMAN)
THLSPNDPI

SEQ ID NO: 181774 - protein, 11 aa, Homo sapiens
  Native (TYRP1_HUMAN)
RLPEPQDVAQC

SEQ ID NO: 181775 - protein, 9 aa, Homo sapiens
  Native (TYRP1_HUMAN)
GPIRRNPAG

SEQ ID NO: 181776 - protein, 10 aa, Homo sapiens
  Native (TYRP1_HUMAN)
QCYAEEYEKL

SEQ ID NO: 181777 - protein, 9 aa, Homo sapiens
  Native (TYRP1_HUMAN)
GCIFFPLLL

SEQ ID NO: 181778 - protein, 10 aa, Homo sapiens
  Native (TYRP1_HUMAN)
TFLGVGQESF

SEQ ID NO: 181779 - protein, 11 aa, Homo sapiens
  Native (TYRP1_HUMAN)
VRSLHNLAHLF

SEQ ID NO: 181780 - protein, 10 aa, Homo sapiens
  Native (TYRP1_HUMAN)
GLFDTPPFYS

SEQ ID NO: 181781 - protein, 9 aa, Homo sapiens
  Native (TYRP1_HUMAN)
MFVTAPDNL

SEQ ID NO: 181782 - protein, 8 aa, Homo sapiens
  Native (TYRP1_HUMAN)
TEMFVTAP

SEQ ID NO: 181783 - protein, 8 aa, Homo sapiens
  Native (TYRP1_HUMAN)
HPLFVIAT

SEQ ID NO: 181784 - protein, 10 aa, Homo sapiens
  Native (TYRP1_HUMAN)
SVKKTFLGVG

SEQ ID NO: 181785 - protein, 8 aa, Homo sapiens
  Native (TYRP1_HUMAN)
FDEWLRRY

SEQ ID NO: 181786 - protein, 8 aa, Homo sapiens
  Native (TYRP1_HUMAN)
SIYNYFVW

SEQ ID NO: 181787 - protein, 8 aa, Homo sapiens
  Native (TYRP1_HUMAN)
ALLLVALI

SEQ ID NO: 181788 - protein, 10 aa, Homo sapiens
  Native (TYRP1_HUMAN)
MAKRTTHPLF

SEQ ID NO: 181789 - protein, 9 aa, Homo sapiens
  Native (TYRP1_HUMAN)
KEEKNHFVR

SEQ ID NO: 181790 - protein, 11 aa, Homo sapiens
  Native (TYRP1_HUMAN)
RSMDEANQPLL

SEQ ID NO: 181791 - protein, 9 aa, Homo sapiens
  Native (TYRP1_HUMAN)
YTYEIQWPS

SEQ ID NO: 181792 - protein, 8 aa, Homo sapiens
  Native (TYRP1_HUMAN)
LPYWNFAT

SEQ ID NO: 181793 - protein, 9 aa, Homo sapiens
  Native (TYRP1_HUMAN)
LSPNDPIFV

SEQ ID NO: 181794 - protein, 9 aa, Homo sapiens
  Native (TYRP1_HUMAN)
LPEPQDVAQ

SEQ ID NO: 181795 - protein, 9 aa, Homo sapiens
  Native (TYRP1_HUMAN)
SPVSGPGTD

SEQ ID NO: 181796 - protein, 9 aa, Homo sapiens
  Native (TYRP1_HUMAN)
YYSVKKTFL

SEQ ID NO: 181797 - protein, 10 aa, Homo sapiens
  Native (TYRP1_HUMAN)
MQEMLQEPSF

SEQ ID NO: 181798 - protein, 11 aa, Homo sapiens
  Native (TYRP1_HUMAN)
GRDDREVWPLR

SEQ ID NO: 181799 - protein, 8 aa, Homo sapiens
  Native (TYRP1_HUMAN)
TDAVFDEW

SEQ ID NO: 181800 - protein, 9 aa, Homo sapiens
  Native (TYRP1_HUMAN)
YNYFVWTHY

SEQ ID NO: 181801 - protein, 8 aa, Homo sapiens
  Native (TYRP1_HUMAN)
YYSVKKTF

SEQ ID NO: 181802 - protein, 9 aa, Homo sapiens
  Native (TYRP1_HUMAN)
SIYNYFVWT

SEQ ID NO: 181803 - protein, 9 aa, Homo sapiens
  Native (TYRP1_HUMAN)
RPHSPQYPH

SEQ ID NO: 181804 - protein, 10 aa, Homo sapiens
  Native (TYRP1_HUMAN)
VPFWPPVTNT

SEQ ID NO: 181805 - protein, 11 aa, Homo sapiens
  Native (TYRP1_HUMAN)
RRYNADISTFP

SEQ ID NO: 181806 - protein, 10 aa, Homo sapiens
  Native (TYRP1_HUMAN)
REFSVPEIIA

SEQ ID NO: 181807 - protein, 10 aa, Homo sapiens
  Native (TYRP1_HUMAN)
EGYSDPTGKY

SEQ ID NO: 181808 - protein, 10 aa, Homo sapiens
  Native (TYRP1_HUMAN)
HLSPNDPIFV

SEQ ID NO: 181809 - protein, 9 aa, Homo sapiens
  Native (TYRP1_HUMAN)
AKRTTHPLF

SEQ ID NO: 181810 - protein, 10 aa, Homo sapiens
  Native (TYRP1_HUMAN)
FVRALDMAKR

SEQ ID NO: 181811 - protein, 10 aa, Homo sapiens
  Native (TYRP1_HUMAN)
NSVFSQWRVV

SEQ ID NO: 181812 - protein, 8 aa, Homo sapiens
  Native (TYRP1_HUMAN)
THPLFVIA

SEQ ID NO: 181813 - protein, 9 aa, Homo sapiens
  Native (TYRP1_HUMAN)
AACDQRVLI

SEQ ID NO: 181814 - protein, 8 aa, Artificial Sequence
  Description of Artificial Sequence: Synthetic peptide
  Seed: AACDQRVL (TYRP1_HUMAN)
  misc_feature (2)..(2): Xaa can be Ala, Ser, Thr, Ile, Val, Gln, Arg, Glu, or Gly
  misc_feature (8)..(8): Xaa can be Leu, Tyr, Phe, Met, Ile, Lys, Val, or His
AXCDQRVX

SEQ ID NO: 181815 - protein, 9 aa, Artificial Sequence
  Description of Artificial Sequence: Synthetic peptide
  Seed: AACDQRVLI (TYRP1_HUMAN)
  misc_feature (2)..(2): Xaa can be Arg, Gln, Ser, Ala, Thr, Leu, Val, Met, Ile, Gly, Lys, Asn, Glu, Phe, Tyr, His, Pro, Cys, Asp, or Trp
  misc_feature (9)..(9): Xaa can be Met, Trp, Tyr, Phe, Leu, Val, Ile, Lys, Arg, His, Ala, Cys, Thr, Asn, or Gln
AXCDQRVLX

SEQ ID NO: 181816 - protein, 10 aa, Artificial Sequence
  Description of Artificial Sequence: Synthetic peptide
  Seed: AACDQRVLIV (TYRP1_HUMAN)
  misc_feature (2)..(2): Xaa can be Gln, Val, Ile, Ala, Leu, Thr, Ser, Met, Glu, Arg, Gly, Tyr, Asn, Phe, Lys, Pro, Cys, His, Trp, or Asp
  misc_feature (10)..(10): Xaa can be Leu, Met, Tyr, Phe, Val, Lys, Ile, Trp, Arg, Ala, His, Cys, or Thr
AXCDQRVLIX

SEQ ID NO: 181817 - protein, 11 aa, Artificial Sequence
  Description of Artificial Sequence: Synthetic peptide
  Seed: AACDQRVLIVR (TYRP1_HUMAN)
  misc_feature (2)..(2): Xaa can be Ala, Ser, Thr, Val, Ile, Gly, Met, Tyr, Leu, Gln, Asn, Phe, Trp, Glu, or Asp
  misc_feature (11)..(11): Xaa can be Lys, Arg, Phe, Tyr, Leu, Met, Trp, Val, or Ile
AXCDQRVLIVX

SEQ ID NO: 181818 - protein, 8 aa, Artificial Sequence
  Description of Artificial Sequence: Synthetic peptide
  Seed: ACDQRVLI (TYRP1_HUMAN)
  misc_feature (2)..(2): Xaa can be Ala, Phe, Tyr, Ser, Val, Ile, Thr, Trp, Asn, Cys, Met, Asp, Leu, Gln, Gly, His, Pro, Glu, or Arg
  misc_feature (8)..(8): Xaa can be Leu, Met, Ile, Phe, Val, Tyr, Cys, Trp, Ala, or Thr
AXDQRVLX

SEQ ID NO: 181819 - protein, 9 aa, Artificial Sequence
  Description of Artificial Sequence: Synthetic peptide
  Seed: ACDQRVLIV (TYRP1_HUMAN)
  misc_feature (2)..(2): Xaa can be Ala, Tyr, Phe, Ser, Thr, Val, Ile, Leu, Trp, Met, Gly, Gln, Arg, Asn, Glu, Pro, Cys, Asp, His, or Lys
  misc_feature (9)..(9): Xaa can be Leu, Met, Val, Ile, Phe, Tyr, Ala, Cys, Lys, Arg, Trp, Thr, Ser, Pro, His, Gly, Gln, or Gl u
AXDQRVLIX

SEQ ID NO: 181820 - protein, 8 aa, Artificial Sequence
  Description of Artificial Sequence: Synthetic peptide
  Seed: ADISTFPL (TYRP1_HUMAN)
  misc_feature (2)..(2): Xaa can be Glu, Asp, or Gln
  misc_feature (8)..(8): Xaa can be Leu, Met, Phe, Val, Ala, Ile, Ser, Cys, Thr, Gly, or Pro
AXISTFPX

SEQ ID NO: 181821 - protein, 10 aa, Artificial Sequence
  Description of Artificial Sequence: Synthetic peptide
  Seed: ADSRPHSPQY (TYRP1_HUMAN)
  misc_feature (2)..(2): Xaa can be Thr, Tyr, Arg, Val, Phe, Met, Lys, Gln, Glu, His, Asn, Trp, Ile, Asp, Leu, Ser, Gly, Cys, Pro, or Ala
  misc_feature (10)..(10): Xaa can be Thr, Ala, Ile, Lys, Val, Trp, Leu, Gly, Tyr, Pro, Cys, Phe, Met, Arg, Ser, Gln, His, Glu, or Asn
AXSRPHSPQX

SEQ ID NO: 181822 - protein, 10 aa, Artificial Sequence
  Description of Artificial Sequence: Synthetic peptide
  Seed: AEEYEKLQNP (TYRP1_HUMAN)
  misc_feature (2)..(2): Xaa can be Glu, Asp, or Gln
  misc_feature (10)..(10): Xaa can be Ala, Cys, Val, Leu, Pro, Met, Thr, Trp, Tyr, Ser, Ile, Gly, or Phe
AXEYEKLQNX

SEQ ID NO: 181823 - protein, 8 aa, Artificial Sequence
  Description of Artificial Sequence: Synthetic peptide
  Seed: AFLTWHRY (TYRP1_HUMAN)
  misc_feature (2)..(2): Xaa can be Tyr, Phe, Gln, Met, Val, Thr, Ile, Trp, Leu, or Ser
  misc_feature (8)..(8): Xaa can be Tyr, Phe, Leu, Met, or Ile
AXLTWHRX

SEQ ID NO: 181824 - protein, 9 aa, Artificial Sequence
  Description of Artificial Sequence: Synthetic peptide
  Seed: AFLTWHRYH (TYRP1_HUMAN)
  misc_feature (2)..(2): Xaa can be Met, Thr, Leu, Trp, Ser, Tyr, Val, Phe, Glu, Gln, Ala, Cys, His, Ile, Asn, Gly, Lys, Asp, Arg, or Pro
  misc_feature (9)..(9): Xaa can be Arg, Lys, His, or Tyr
AXLTWHRYX

SEQ ID NO: 181825 - protein, 10 aa, Artificial Sequence
  Description of Artificial Sequence: Synthetic peptide
  Seed: AFLTWHRYHL (TYRP1_HUMAN)
  misc_feature (2)..(2): Xaa can be Met, Leu, Tyr, Phe, Trp, Ile, Gln, Thr, Val, His, Cys, Pro, Asp, Arg, Gly, Glu, Asn, Lys, Ala, or Ser
  misc_feature (10)..(10): Xaa can be Leu, Val, Ile, Phe, Met, Trp, Ala, Thr, or Tyr
AXLTWHRYHX

SEQ ID NO: 181826 - protein, 11 aa, Artificial Sequence
  Description of Artificial Sequence: Synthetic peptide
  Seed: AFLTWHRYHLL (TYRP1_HUMAN)
  misc_feature (2)..(2): Xaa can be Met, Leu, Tyr, Phe, Gln, Thr, Trp, Ile, Arg, Val, Ala, Ser, or Lys
  misc_feature (11)..(11): Xaa can be Val, Ile, Leu, Ala, or Met
AXLTWHRYHLX

SEQ ID NO: 181827 - protein, 8 aa, Artificial Sequence
  Description of Artificial Sequence: Synthetic peptide
  Seed: AGNVARPM (TYRP1_HUMAN)
  misc_feature (2)..(2): Xaa can be Ala, Thr, Ser, Val, Ile, Gly, or Met
  misc_feature (8)..(8): Xaa can be Leu, Tyr, Met, Phe, Ile, Val, or Trp
AXNVARPX

SEQ ID NO: 181828 - protein, 9 aa, Artificial Sequence
  Description of Artificial Sequence: Synthetic peptide
  Seed: AGNVARPMV (TYRP1_HUMAN)
  misc_feature (2)..(2): Xaa can be Gln, Thr, Ala, Ser, Ile, Val, Gly, Leu, Met, Asn, Glu, or Asp
  misc_feature (9)..(9): Xaa can be Val, Ile, Leu, Met, Phe, Cys, or Ala
AXNVARPMX

SEQ ID NO: 181829 - protein, 11 aa, Artificial Sequence
  Description of Artificial Sequence: Synthetic peptide
  Seed: AGNVARPMVQR (TYRP1_HUMAN)
  misc_feature (2)..(2): Xaa can be Ala, Ile, Asn, Val, Glu, Pro, Arg, Phe, Met, Lys, Ser, Leu, Thr, Gly, Asp, Tyr, Cys, His, Gln, or Trp
  misc_feature (11)..(11): Xaa can be Lys, or Arg
AXNVARPMVQX

SEQ ID NO: 181830 - protein, 9 aa, Artificial Sequence
  Description of Artificial Sequence: Synthetic peptide
  Seed: AHLFLNGTG (TYRP1_HUMAN)
  misc_feature (2)..(2): Xaa can be His, Arg, or Gln
  misc_feature (9)..(9): Xaa can be Ala, Val, Ile, Leu, Cys, Pro, Thr, Ser, Met, or Gly
AXLFLNGTX

SEQ ID NO: 181831 - protein, 9 aa, Artificial Sequence
  Description of Artificial Sequence: Synthetic peptide
  Seed: AIAVVGALL (TYRP1_HUMAN)
  misc_feature (2)..(2): Xaa can be Ala, Met, Leu, Gln, Val, Ser, Thr, Ile, Gly, Asn, Glu, Pro, Arg, Asp, His, Cys, Phe, Lys, Tyr, or Trp
  misc_feature (9)..(9): Xaa can be Tyr, Phe, Leu, Met, Lys, Val, Arg, Trp, Ile, Ala, His, Thr, Cys, Ser, Pro, Gly, or Gln
AXAVVGALX

SEQ ID NO: 181832 - protein, 10 aa, Artificial Sequence
  Description of Artificial Sequence: Synthetic peptide
  Seed: AIAVVGALLL (TYRP1_HUMAN)
  misc_feature (2)..(2): Xaa can be Leu, Met, Ala, Ile, Val, Thr, Ser, or Gln
  misc_feature (10)..(10): Xaa can be Leu, Val, Met, Ile, Ala, Phe, Ser, His, Cys, Thr, Asp, Arg, Lys, Pro, Tyr, Asn, Gln, Glu, Trp, or Gly
AXAVVGALLX

SEQ ID NO: 181833 - protein, 11 aa, Artificial Sequence
  Description of Artificial Sequence: Synthetic peptide
  Seed: AIAVVGALLLV (TYRP1_HUMAN)
  misc_feature (2)..(2): Xaa can be Met, Gln, Leu, Ile, Ala, Pro, Val, Tyr, Phe, Ser, His, Cys, Glu, Asp, Thr, Gly, Lys, Arg, Trp, or Asn
  misc_feature (11)..(11): Xaa can be Val, Leu, Ala, Met, or Ile
AXAVVGALLLX

SEQ ID NO: 181834 - protein, 9 aa, Artificial Sequence
  Description of Artificial Sequence: Synthetic peptide
  Seed: AKRTTHPLF (TYRP1_HUMAN)
  misc_feature (2)..(2): Xaa can be Arg, Gln, Met, Glu, Leu, Ser, Val, Ile, Ala, Lys, His, Phe, Tyr, Thr, Gly, Trp, Pro, Cys, Asn, or Asp
  misc_feature (9)..(9): Xaa can be Tyr, Phe, Met, Leu, Trp, Ile, His, Val, Lys, Arg, or Ala
AXRTTHPLX

SEQ ID NO: 181835 - protein, 9 aa, Artificial Sequence
  Description of Artificial Sequence: Synthetic peptide
  Seed: ALIFGTASY (TYRP1_HUMAN)
  misc_feature (2)..(2): Xaa can be Ala, Gln, Tyr, Met, Ser, Phe, Thr, Val, Pro, Ile, Gly, Leu, Trp, Glu, Lys, His, Cys, Arg, Asn, or Asp
  misc_feature (9)..(9): Xaa can be Phe, Met, Tyr, His, Trp, Leu, Arg, Lys, Val, Ile, Ala, Cys, Thr, Gly, Ser, Asn, Gln, or Pr o
AXIFGTASX

SEQ ID NO: 181836 - protein, 10 aa, Artificial Sequence
  Description of Artificial Sequence: Synthetic peptide
  Seed: ALIFGTASYL (TYRP1_HUMAN)
  misc_feature (2)..(2): Xaa can be Gln, Thr, Ile, Ser, Ala, Leu, Val, Met, Phe, Tyr, Trp, Glu, Gly, Asn, Cys, Asp, Arg, Pro, His, or Lys
  misc_feature (10)..(10): Xaa can be Met, Tyr, Val, Phe, Leu, Ala, Ile, Arg, Lys, Trp, Ser, Asn, Pro, Cys, His, Gln, Asp, Gly, Thr, or Glu
AXIFGTASYX

SEQ ID NO: 181837 - protein, 11 aa, Artificial Sequence
  Description of Artificial Sequence: Synthetic peptide
  Seed: ALIFGTASYLI (TYRP1_HUMAN)
  misc_feature (2)..(2): Xaa can be Met, Leu, Phe, Gln, Tyr, Ile, Trp, Thr, Lys, Ala, Ser, Val, or Arg
  misc_feature (11)..(11): Xaa can be Val, Ile, Leu, Ala, Thr, Asp, Lys, Trp, His, Gln, Pro, Met, Ser, Asn, Glu, Gly, Phe, Arg, Cys, or Tyr
AXIFGTASYLX

SEQ ID NO: 181838 - protein, 8 aa, Artificial Sequence
  Description of Artificial Sequence: Synthetic peptide
  Seed: ALLLVALI (TYRP1_HUMAN)
  misc_feature (2)..(2): Xaa can be Gln, Ser, Asp, Ala, Gly, His, Glu, Asn, Met, Val, Lys, Thr, Leu, Pro, or Ile
  misc_feature (8)..(8): Xaa can be Ile, Val, Leu, Met, Cys, Phe, or Ala
AXLLVALX

SEQ ID NO: 181839 - protein, 9 aa, Artificial Sequence
  Description of Artificial Sequence: Synthetic peptide
  Seed: ALLLVALIF (TYRP1_HUMAN)
  misc_feature (2)..(2): Xaa can be Gln, Thr, Ser, Met, Leu, Ala, Glu, Ile, Val, Lys, Arg, Pro, His, Gly, Asp, Cys, Asn, Phe, or Tyr
  misc_feature (9)..(9): Xaa can be Tyr, Phe, Trp, Met, Leu, Ile, Val, His, or Ala
AXLLVALIX

SEQ ID NO: 181840 - protein, 10 aa, Artificial Sequence
  Description of Artificial Sequence: Synthetic peptide
  Seed: ANQPLLTDQY (TYRP1_HUMAN)
  misc_feature (2)..(2): Xaa can be Thr, Ser, Val, Met, Ile, Leu, Tyr, Gly, Phe, Ala, Cys, Trp, Gln, Asp, Asn, or Glu
  misc_feature (10)..(10): Xaa can be Tyr, Lys, Phe, Arg, or His
AXQPLLTDQX

SEQ ID NO: 181841 - protein, 9 aa, Artificial Sequence
  Description of Artificial Sequence: Synthetic peptide
  Seed: APDNLGYTY (TYRP1_HUMAN)
  misc_feature (2)..(2): Xaa can be Tyr, Thr, Pro, Ala, Phe, Val, Ser, Ile, Arg, Met, Leu, Gly, Gln, Cys, Trp, His, Glu, Asn, Lys, or Asp
  misc_feature (9)..(9): Xaa can be Phe, Tyr, Met, Leu, Lys, Trp, Arg, Ile, Val, His, Ala, Gln, Cys, Thr, or Pro
AXDNLGYTX

SEQ ID NO: 181842 - protein, 11 aa, Artificial Sequence
  Description of Artificial Sequence: Synthetic peptide
  Seed: APDNLGYTYEI (TYRP1_HUMAN)
  misc_feature (2)..(2): Xaa can be , or Pro
  misc_feature (11)..(11): Xaa can be Leu, Met, Ala, Ile, Phe, Cys, or Val
AXDNLGYTYEX

SEQ ID NO: 181843 - protein, 9 aa, Artificial Sequence
  Description of Artificial Sequence: Synthetic peptide
  Seed: APIGHNRQY (TYRP1_HUMAN)
  misc_feature (2)..(2): Xaa can be Ala, Pro, Arg, Thr, Gln, Val, Ser, Ile, Tyr, Gly, Leu, Glu, His, Asn, Met, Lys, Phe, Cys, Trp, or Asp
  misc_feature (9)..(9): Xaa can be Tyr, Leu, Met, Phe, Ile, Val, Trp, His, Lys, Arg, Ala, Cys, Thr, Ser, Gln, Pro, or Gly
AXIGHNRQX

SEQ ID NO: 181844 - protein, 11 aa, Artificial Sequence
  Description of Artificial Sequence: Synthetic peptide
  Seed: APIGHNRQYNM (TYRP1_HUMAN)
  misc_feature (2)..(2): Xaa can be , or Pro
  misc_feature (11)..(11): Xaa can be Ile, Val, Leu, Phe, Ala, Met, or Cys
AXIGHNRQYNX

SEQ ID NO: 181845 - protein, 9 aa, Artificial Sequence
  Description of Artificial Sequence: Synthetic peptide
  Seed: APKLLSLGC (TYRP1_HUMAN)
  misc_feature (2)..(2): Xaa can be Pro, Ala, or Val
  misc_feature (9)..(9): Xaa can be Leu, Ala, Met, Phe, Ile, Thr, Ser, Val, His, Pro, Trp, Tyr, Cys, or Gly
AXKLLSLGX

SEQ ID NO: 181846 - protein, 10 aa, Artificial Sequence
  Description of Artificial Sequence: Synthetic peptide
  Seed: APKLLSLGCI (TYRP1_HUMAN)
  misc_feature (2)..(2): Xaa can be , or Pro
  misc_feature (10)..(10): Xaa can be Met, Thr, Ala, Phe, Cys, Val, Pro, Ser, Ile, or Leu
AXKLLSLGCX

SEQ ID NO: 181847 - protein, 11 aa, Artificial Sequence
  Description of Artificial Sequence: Synthetic peptide
  Seed: APKLLSLGCIF (TYRP1_HUMAN)
  misc_feature (2)..(2): Xaa can be , or Pro
  misc_feature (11)..(11): Xaa can be Val, Ile, Thr, Leu, Ala, Phe, Gly, Cys, Pro, Met, or Ser
AXKLLSLGCIX

SEQ ID NO: 181848 - protein, 8 aa, Artificial Sequence
  Description of Artificial Sequence: Synthetic peptide
  Seed: AQCLEVGL (TYRP1_HUMAN)
  misc_feature (2)..(2): Xaa can be , or Gln
  misc_feature (8)..(8): Xaa can be Val, Leu, or Ile
AXCLEVGX

SEQ ID NO: 181849 - protein, 9 aa, Artificial Sequence
  Description of Artificial Sequence: Synthetic peptide
  Seed: AQCLEVGLF (TYRP1_HUMAN)
  misc_feature (2)..(2): Xaa can be Glu, Gln, His, Met, Leu, Asp, Val, Ala, Ile, Ser, Lys, Gly, Thr, Pro, Arg, Phe, Tyr, or As n
  misc_feature (9)..(9): Xaa can be Tyr, Phe, Trp, Met, Leu, Val, Ile, Lys, Arg, Ala, Cys, or His
AXCLEVGLX

SEQ ID NO: 181850 - protein, 8 aa, Artificial Sequence
  Description of Artificial Sequence: Synthetic peptide
  Seed: AQFPRQCA (TYRP1_HUMAN)
  misc_feature (2)..(2): Xaa can be His, Gln, Ala, Ser, Glu, Gly, Met, Asp, or Leu
  misc_feature (8)..(8): Xaa can be Ile, Val, Leu, Met, Ala, Thr, Phe, or Cys
AXFPRQCX

SEQ ID NO: 181851 - protein, 9 aa, Artificial Sequence
  Description of Artificial Sequence: Synthetic peptide
  Seed: AQFPRQCAT (TYRP1_HUMAN)
  misc_feature (2)..(2): Xaa can be Glu, Gln, His, Met, Arg, Asp, Ala, Leu, Pro, Lys, Ser, Gly, Thr, Ile, Val, Asn, Tyr, Phe, Trp, or Cys
  misc_feature (9)..(9): Xaa can be Ile, Met, Tyr, Phe, Leu, Val, Ala, His, Trp, Cys, Pro, Thr, Gly, Ser, Asn, Lys, Arg, Gln, Asp, or Glu
AXFPRQCAX

SEQ ID NO: 181852 - protein, 10 aa, Artificial Sequence
  Description of Artificial Sequence: Synthetic peptide
  Seed: AQFPRQCATV (TYRP1_HUMAN)
  misc_feature (2)..(2): Xaa can be Glu, His, Met, Gln, Leu, Arg, Ala, Val, Thr, Ile, Ser, Pro, Lys, Gly, Asp, Tyr, Asn, Phe, Cys, or Trp
  misc_feature (10)..(10): Xaa can be Tyr, Phe, Leu, Met, Val, Ile, Ala, Trp, Cys, Thr, Ser, Pro, Gly, or His
AXFPRQCATX

SEQ ID NO: 181853 - protein, 9 aa, Artificial Sequence
  Description of Artificial Sequence: Synthetic peptide
  Seed: ARAQFPRQC (TYRP1_HUMAN)
  misc_feature (2)..(2): Xaa can be Arg, His, Gln, Ala, Tyr, Trp, Ser, Lys, Met, Ile, Phe, Glu, Val, Gly, Leu, Asn, Thr, Asp, Pro, or Cys
  misc_feature (9)..(9): Xaa can be Leu, Phe, Met, Ile, Val, Tyr, Cys, Ala, Pro, Lys, Thr, Arg, Trp, His, Glu, Ser, Gly, Asn, or Gln
AXAQFPRQX

SEQ ID NO: 181854 - protein, 10 aa, Artificial Sequence
  Description of Artificial Sequence: Synthetic peptide
  Seed: ARAQFPRQCA (TYRP1_HUMAN)
  misc_feature (2)..(2): Xaa can be Arg, His, or Gln
  misc_feature (10)..(10): Xaa can be Ala, Leu, Ile, Val, Cys, Met, Tyr, Phe, Thr, Pro, or Trp
AXAQFPRQCX

SEQ ID NO: 181855 - protein, 8 aa, Artificial Sequence
  Description of Artificial Sequence: Synthetic peptide
  Seed: ARPMVQRL (TYRP1_HUMAN)
  misc_feature (2)..(2): Xaa can be Arg, Tyr, Gln, His, Phe, Ala, Ser, Asp, Gly, Thr, Glu, or Asn
  misc_feature (8)..(8): Xaa can be Leu, Met, Phe, Tyr, Val, or Ile
AXPMVQRX

SEQ ID NO: 181856 - protein, 10 aa, Artificial Sequence
  Description of Artificial Sequence: Synthetic peptide
  Seed: ARRSMDEANQ (TYRP1_HUMAN)
  misc_feature (2)..(2): Xaa can be Arg, Gln, or Gly
  misc_feature (10)..(10): Xaa can be Phe, Leu, Lys, Arg, Tyr, His, Gln, Ala, Ile, Met, Trp, or Val
AXRSMDEANX

SEQ ID NO: 181857 - protein, 8 aa, Artificial Sequence
  Description of Artificial Sequence: Synthetic peptide
  Seed: ASYLIRAR (TYRP1_HUMAN)
  misc_feature (2)..(2): Xaa can be Met, Phe, Gln, Ser, Leu, Thr, Tyr, Ala, Trp, Ile, or Val
  misc_feature (8)..(8): Xaa can be Arg, or Lys
AXYLIRAX

SEQ ID NO: 181858 - protein, 9 aa, Artificial Sequence
  Description of Artificial Sequence: Synthetic peptide
  Seed: ASYLIRARR (TYRP1_HUMAN)
  misc_feature (2)..(2): Xaa can be Thr, Ser, Met, Val, Leu, Ala, Ile, Tyr, Gln, Phe, Trp, Cys, Asn, Asp, Gly, Pro, Glu, or Hi s
  misc_feature (9)..(9): Xaa can be Arg, Lys, Tyr, His, Ala, Leu, Val, Ile, Met, Ser, Gly, Phe, or Thr
AXYLIRARX

SEQ ID NO: 181859 - protein, 10 aa, Artificial Sequence
  Description of Artificial Sequence: Synthetic peptide
  Seed: ASYLIRARRS (TYRP1_HUMAN)
  misc_feature (2)..(2): Xaa can be Ile, Thr, Val, Tyr, Phe, Met, Ser, Leu, Trp, Gly, Ala, Gln, Asn, Arg, Glu, Lys, His, Cys, Asp, or Pro
  misc_feature (10)..(10): Xaa can be Arg, Lys, Val, Glu, Ser, Pro, Tyr, Ala, His, Asn, Gly, Met, Asp, Phe, Cys, Gln, Trp, Ile, Thr, or Leu
AXYLIRARRX

SEQ ID NO: 181860 - protein, 11 aa, Artificial Sequence
  Description of Artificial Sequence: Synthetic peptide
  Seed: ASYLIRARRSM (TYRP1_HUMAN)
  misc_feature (2)..(2): Xaa can be Ser, Thr, Ala, or Val
  misc_feature (11)..(11): Xaa can be Trp, Tyr, Met, or Phe
AXYLIRARRSX

SEQ ID NO: 181861 - protein, 9 aa, Artificial Sequence
  Description of Artificial Sequence: Synthetic peptide
  Seed: ATGKNVCDI (TYRP1_HUMAN)
  misc_feature (2)..(2): Xaa can be Ala, Thr, Ser, or Val
  misc_feature (9)..(9): Xaa can be Leu, Met, Val, or Ile
AXGKNVCDX

SEQ ID NO: 181862 - protein, 9 aa, Artificial Sequence
  Description of Artificial Sequence: Synthetic peptide
  Seed: ATRRSEEIL (TYRP1_HUMAN)
  misc_feature (2)..(2): Xaa can be Thr, Arg, Val, Ser, Ala, Ile, Gln, Met, Leu, Gly, Asn, Tyr, Trp, Pro, Asp, Phe, Glu, or Cy s
  misc_feature (9)..(9): Xaa can be Trp, Lys, Tyr, Leu, Phe, Ala, Met, Val, Ile, Arg, His, or Ser
AXRRSEEIX

SEQ ID NO: 181863 - protein, 10 aa, Artificial Sequence
  Description of Artificial Sequence: Synthetic peptide
  Seed: ATVEALRSGM (TYRP1_HUMAN)
  misc_feature (2)..(2): Xaa can be Met, Val, Thr, Ser, Gln, Ile, Ala, Leu, Gly, Glu, Cys, Asn, Asp, or Pro
  misc_feature (10)..(10): Xaa can be Arg, Tyr, Phe, Met, Leu, Lys, Ile, Val, Trp, Ala, His, or Thr
AXVEALRSGX

SEQ ID NO: 181864 - protein, 8 aa, Artificial Sequence
  Description of Artificial Sequence: Synthetic peptide
  Seed: AVFDEWLR (TYRP1_HUMAN)
  misc_feature (2)..(2): Xaa can be Met, Leu, Ile, Gln, Tyr, Ser, Thr, Val, Phe, or Trp
  misc_feature (8)..(8): Xaa can be Arg, or Lys
AXFDEWLX

SEQ ID NO: 181865 - protein, 9 aa, Artificial Sequence
  Description of Artificial Sequence: Synthetic peptide
  Seed: AVFDEWLRR (TYRP1_HUMAN)
  misc_feature (2)..(2): Xaa can be Thr, Ala, Leu, Met, Val, Ser, Tyr, Ile, Gln, Gly, Phe, Asn, Cys, Trp, Glu, Asp, Pro, Lys, Arg, or His
  misc_feature (9)..(9): Xaa can be Arg, Tyr, Lys, Phe, Met, Leu, Trp, Val, Ile, His, Ala, or Gln
AXFDEWLRX

SEQ ID NO: 181866 - protein, 10 aa, Artificial Sequence
  Description of Artificial Sequence: Synthetic peptide
  Seed: AVFDEWLRRY (TYRP1_HUMAN)
  misc_feature (2)..(2): Xaa can be Phe, Met, Thr, Leu, Val, Ser, Ile, Gln, Ala, Tyr, Arg, Glu, Gly, Asn, Trp, Lys, Cys, Pro, Asp, or His
  misc_feature (10)..(10): Xaa can be Tyr, Trp, Arg, Phe, Lys, Leu, Met, Ile, His, Val, Ala, Gln, Cys, Thr, Asn, Asp, Glu, Pro, Ser, or Gly
AXFDEWLRRX

SEQ ID NO: 181867 - protein, 9 aa, Artificial Sequence
  Description of Artificial Sequence: Synthetic peptide
  Seed: AVRSLHNLA (TYRP1_HUMAN)
  misc_feature (2)..(2): Xaa can be Thr, Ile, Ala, Tyr, Met, Val, Ser, Leu, Phe, Gln, Pro, Trp, Gly, Asn, Cys, His, Lys, or Ar g
  misc_feature (9)..(9): Xaa can be Lys, Val, Ala, Leu, Ile, Met, Thr, Gly, Ser, Arg, Tyr, Gln, Pro, Cys, Asn, Phe, His, Glu, Trp, or Asp
AXRSLHNLX

SEQ ID NO: 181868 - protein, 10 aa, Artificial Sequence
  Description of Artificial Sequence: Synthetic peptide
  Seed: AVRSLHNLAH (TYRP1_HUMAN)
  misc_feature (2)..(2): Xaa can be Ser, Thr, Val, Tyr, Ala, Met, Phe, Ile, Gln, Leu, Gly, Trp, Asn, Cys, His, Lys, Arg, or Gl u
  misc_feature (10)..(10): Xaa can be Lys, Tyr, Ala, Val, Ile, Met, Leu, Phe, Arg, Ser, Gly, Pro, Thr, His, Cys, Glu, Gln, Asn, Asp, or Trp
AXRSLHNLAX

SEQ ID NO: 181869 - protein, 9 aa, Artificial Sequence
  Description of Artificial Sequence: Synthetic peptide
  Seed: AVTADSRPH (TYRP1_HUMAN)
  misc_feature (2)..(2): Xaa can be Ala, Ser, Val, Thr, Ile, Gln, Gly, Met, Leu, Glu, Cys, or Asn
  misc_feature (9)..(9): Xaa can be Tyr, Phe, Met, His, Leu, Ile, Val, or Ala
AXTADSRPX

SEQ ID NO: 181870 - protein, 8 aa, Artificial Sequence
  Description of Artificial Sequence: Synthetic peptide
  Seed: AVVGALLL (TYRP1_HUMAN)
  misc_feature (2)..(2): Xaa can be Ala, Val, Ile, Thr, or Ser
  misc_feature (8)..(8): Xaa can be Leu, Met, or Ile
AXVGALLX

SEQ ID NO: 181871 - protein, 9 aa, Artificial Sequence
  Description of Artificial Sequence: Synthetic peptide
  Seed: AVVGALLLV (TYRP1_HUMAN)
  misc_feature (2)..(2): Xaa can be Met, Leu, Gln, Ala, Ser, Val, Thr, Ile, Glu, Gly, Asn, Pro, Cys, Asp, Phe, Tyr, His, Lys, Arg, or Trp
  misc_feature (9)..(9): Xaa can be Val, Arg, Phe, Ile, Tyr, Lys, Leu, Trp, Met, His, Ala, Thr, Cys, Ser, Pro, Gly, or Gln
AXVGALLLX

SEQ ID NO: 181872 - protein, 10 aa, Artificial Sequence
  Description of Artificial Sequence: Synthetic peptide
  Seed: AVVGALLLVA (TYRP1_HUMAN)
  misc_feature (2)..(2): Xaa can be Gln, Ile, Met, Val, Leu, Thr, Ala, Ser, Lys, Trp, Cys, His, Phe, Glu, Tyr, Gly, Pro, Asn, Arg, or Asp
  misc_feature (10)..(10): Xaa can be Val, Leu, Ile, Ala, Met, Phe, His, Gly, Ser, Cys, Pro, Asn, Tyr, Thr, Glu, Arg, Trp, Gln, Lys, or Asp
AXVGALLLVX

SEQ ID NO: 181873 - protein, 11 aa, Artificial Sequence
  Description of Artificial Sequence: Synthetic peptide
  Seed: AVVGALLLVAL (TYRP1_HUMAN)
  misc_feature (2)..(2): Xaa can be Gln, Leu, Val, Met, Thr, Ile, Ser, or Ala
  misc_feature (11)..(11): Xaa can be Val, Ile, Leu, Ala, or Met
AXVGALLLVAX

SEQ ID NO: 181874 - protein, 9 aa, Artificial Sequence
  Description of Artificial Sequence: Synthetic peptide
  Seed: CDQRVLIVR (TYRP1_HUMAN)
  misc_feature (2)..(2): Xaa can be Tyr, Gln, Ala, Ser, Val, Asp, Ile, Met, Gly, Asn, Leu, Phe, Trp, Pro, or Thr
  misc_feature (9)..(9): Xaa can be Arg, or Lys
CXQRVLIVX

SEQ ID NO: 181875 - protein, 10 aa, Artificial Sequence
  Description of Artificial Sequence: Synthetic peptide
  Seed: CDQRVLIVRR (TYRP1_HUMAN)
  misc_feature (2)..(2): Xaa can be Met, Gln, Phe, Tyr, Thr, Ser, Ile, Val, Trp, Leu, Asp, Cys, Gly, Asn, Ala, Arg, Glu, His, Lys, or Pro
  misc_feature (10)..(10): Xaa can be Arg, Lys, Asp, Gln, Gly, Phe, Ile, Ser, Cys, Ala, Thr, Val, Leu, Tyr, Pro, Met, Trp, Glu, Asn, or His
CXQRVLIVRX

SEQ ID NO: 181876 - protein, 10 aa, Artificial Sequence
  Description of Artificial Sequence: Synthetic peptide
  Seed: CEAVTADSRP (TYRP1_HUMAN)
  misc_feature (2)..(2): Xaa can be , or Glu
  misc_feature (10)..(10): Xaa can be Pro, Val, Thr, Cys, Ile, Leu, Met, or Ala
CXAVTADSRX

SEQ ID NO: 181877 - protein, 9 aa, Artificial Sequence
  Description of Artificial Sequence: Synthetic peptide
  Seed: CGSSSGRGR (TYRP1_HUMAN)
  misc_feature (2)..(2): Xaa can be Ile, Thr, Met, Val, Ala, Tyr, Leu, Ser, Gly, Phe, Gln, Pro, or Trp
  misc_feature (9)..(9): Xaa can be Arg, or Lys
CXSSSGRGX

SEQ ID NO: 181878 - protein, 9 aa, Artificial Sequence
  Description of Artificial Sequence: Synthetic peptide
  Seed: CGTCRPGWR (TYRP1_HUMAN)
  misc_feature (2)..(2): Xaa can be Thr, Trp, Ile, Ser, Met, Val, Gln, Asn, Ala, Gly, Tyr, Leu, or Phe
  misc_feature (9)..(9): Xaa can be , or Arg
CXTCRPGWX

SEQ ID NO: 181879 - protein, 9 aa, Artificial Sequence
  Description of Artificial Sequence: Synthetic peptide
  Seed: CIFFPLLLF (TYRP1_HUMAN)
  misc_feature (2)..(2): Xaa can be Ala, Gln, Ser, Thr, Met, Val, Gly, Leu, Asn, Ile, Phe, Cys, Arg, Lys, His, Tyr, Glu, Trp, Pro, or Asp
  misc_feature (9)..(9): Xaa can be Tyr, Trp, Phe, Met, Leu, Ile, His, Val, Ala, or Cys
CXFFPLLLX

SEQ ID NO: 181880 - protein, 10 aa, Artificial Sequence
  Description of Artificial Sequence: Synthetic peptide
  Seed: CNSTEDGPIR (TYRP1_HUMAN)
  misc_feature (2)..(2): Xaa can be Ala, Ile, Gln, Ser, Thr, Gly, Met, Leu, Val, Asn, Tyr, Glu, Phe, or Asp
  misc_feature (10)..(10): Xaa can be Lys, Arg, Leu, Phe, or Met
CXSTEDGPIX

SEQ ID NO: 181881 - protein, 11 aa, Artificial Sequence
  Description of Artificial Sequence: Synthetic peptide
  Seed: CNSTEDGPIRR (TYRP1_HUMAN)
  misc_feature (2)..(2): Xaa can be Ala, Thr, Ser, Val, Gly, Asp, Cys, Leu, Met, Phe, Trp, Asn, Glu, Ile, Gln, Tyr, Pro, or Hi s
  misc_feature (11)..(11): Xaa can be Arg, Lys, Tyr, Phe, Trp, His, Leu, or Met
CXSTEDGPIRX

SEQ ID NO: 181882 - protein, 9 aa, Artificial Sequence
  Description of Artificial Sequence: Synthetic peptide
  Seed: CPDLSPVSG (TYRP1_HUMAN)
  misc_feature (2)..(2): Xaa can be Pro, or Ala
  misc_feature (9)..(9): Xaa can be Ala, Thr, Phe, Cys, Ile, Gly, Leu, Pro, Met, Ser, Val, or Tyr
CXDLSPVSX

SEQ ID NO: 181883 - protein, 9 aa, Artificial Sequence
  Description of Artificial Sequence: Synthetic peptide
  Seed: CRPGWRGAA (TYRP1_HUMAN)
  misc_feature (2)..(2): Xaa can be His, Arg, or Gln
  misc_feature (9)..(9): Xaa can be Ala, Val, Ile, or Leu
CXPGWRGAX

SEQ ID NO: 181884 - protein, 10 aa, Artificial Sequence
  Description of Artificial Sequence: Synthetic peptide
  Seed: CRPGWRGAAC (TYRP1_HUMAN)
  misc_feature (2)..(2): Xaa can be His, Arg, Gln, or Glu
  misc_feature (10)..(10): Xaa can be Ala, Ile, Val, Leu, Cys, Pro, Met, or Thr
CXPGWRGAAX

SEQ ID NO: 181885 - protein, 9 aa, Artificial Sequence
  Description of Artificial Sequence: Synthetic peptide
  Seed: CTDDLMGSR (TYRP1_HUMAN)
  misc_feature (2)..(2): Xaa can be Ala, Thr, Ser, Val, Ile, Phe, Tyr, Leu, Met, Gly, Trp, Gln, Cys, Glu, Asn, Pro, Asp, Lys, or His
  misc_feature (9)..(9): Xaa can be Lys, Tyr, Arg, Phe, Leu, Met, Trp, His, Ile, or Val
CXDDLMGSX

SEQ ID NO: 181886 - protein, 9 aa, Artificial Sequence
  Description of Artificial Sequence: Synthetic peptide
  Seed: CYAEEYEKL (TYRP1_HUMAN)
  misc_feature (2)..(2): Xaa can be Tyr, Phe, Arg, Ala, Trp, Gln, Met, His, Ile, Val, Leu, Ser, Thr, Glu, Lys, Gly, Asn, or As p
  misc_feature (9)..(9): Xaa can be Leu, Met, Phe, Tyr, Ile, Trp, Val, or Cys
CXAEEYEKX

SEQ ID NO: 181887 - protein, 9 aa, Artificial Sequence
  Description of Artificial Sequence: Synthetic peptide
  Seed: DAVFDEWLR (TYRP1_HUMAN)
  misc_feature (2)..(2): Xaa can be Thr, Tyr, Met, Gln, Asn, Leu, Ala, Ser, Trp, Gly, Ile, Phe, Cys, Val, Arg, or Pro
  misc_feature (9)..(9): Xaa can be Arg, Lys, His, or Tyr
DXVFDEWLX

SEQ ID NO: 181888 - protein, 10 aa, Artificial Sequence
  Description of Artificial Sequence: Synthetic peptide
  Seed: DAVFDEWLRR (TYRP1_HUMAN)
  misc_feature (2)..(2): Xaa can be Val, Thr, Gly, Gln, Tyr, Ala, Lys, Ser, Glu, Pro, Cys, Leu, Phe, Asp, Ile, Arg, Asn, Trp, Met, or His
  misc_feature (10)..(10): Xaa can be Lys, Arg, or Tyr
DXVFDEWLRX

SEQ ID NO: 181889 - protein, 8 aa, Artificial Sequence
  Description of Artificial Sequence: Synthetic peptide
  Seed: DDREVWPL (TYRP1_HUMAN)
  misc_feature (2)..(2): Xaa can be Glu, or Asp
  misc_feature (8)..(8): Xaa can be Leu, Ile, Phe, Val, or Met
DXREVWPX

SEQ ID NO: 181890 - protein, 9 aa, Artificial Sequence
  Description of Artificial Sequence: Synthetic peptide
  Seed: DDREVWPLR (TYRP1_HUMAN)
  misc_feature (2)..(2): Xaa can be Val, Thr, Ile, Ala, Ser, Leu, Met, Tyr, Phe, His, Trp, Pro, Glu, Cys, Gly, Gln, Asp, Asn, Arg, or Lys
  misc_feature (9)..(9): Xaa can be Arg, Lys, His, Met, Tyr, Leu, Phe, Val, Ile, or Gln
DXREVWPLX

SEQ ID NO: 181891 - protein, 8 aa, Artificial Sequence
  Description of Artificial Sequence: Synthetic peptide
  Seed: DEANQPLL (TYRP1_HUMAN)
  misc_feature (2)..(2): Xaa can be Glu, Asp, or Gln
  misc_feature (8)..(8): Xaa can be Leu, Tyr, Cys, Phe, Met, Thr, His, Ile, Ala, Trp, or Val
DXANQPLX

SEQ ID NO: 181892 - protein, 9 aa, Artificial Sequence
  Description of Artificial Sequence: Synthetic peptide
  Seed: DEANQPLLT (TYRP1_HUMAN)
  misc_feature (2)..(2): Xaa can be Glu, Gln, or Asp
  misc_feature (9)..(9): Xaa can be Val, Leu, Met, Ala, Ile, Phe, Pro, Gly, Thr, Cys, or Ser
DXANQPLLX

SEQ ID NO: 181893 - protein, 9 aa, Artificial Sequence
  Description of Artificial Sequence: Synthetic peptide
  Seed: DEWLRRYNA (TYRP1_HUMAN)
  misc_feature (2)..(2): Xaa can be Glu, His, Gln, Asp, Arg, Asn, Met, or Lys
  misc_feature (9)..(9): Xaa can be Phe, Tyr, Ile, Val, Leu, Met, Ala, Cys, Pro, Thr, Trp, Lys, Glu, Gly, Ser, Asn, Gln, or Hi s
DXWLRRYNX

SEQ ID NO: 181894 - protein, 9 aa, Artificial Sequence
  Description of Artificial Sequence: Synthetic peptide
  Seed: DFSHEGPAF (TYRP1_HUMAN)
  misc_feature (2)..(2): Xaa can be Tyr, Leu, Met, Gln, Ile, Ala, Arg, Trp, Val, Phe, Ser, Glu, Pro, Asn, Thr, Gly, Lys, Cys, or His
  misc_feature (9)..(9): Xaa can be Tyr, Phe, Met, Leu, Trp, or Ile
DXSHEGPAX

SEQ ID NO: 181895 - protein, 9 aa, Artificial Sequence
  Description of Artificial Sequence: Synthetic peptide
  Seed: DGRDDREVW (TYRP1_HUMAN)
  misc_feature (2)..(2): Xaa can be Ala, Pro, Thr, Ser, Val, Leu, Gly, Ile, Met, Asn, Cys, or Gln
  misc_feature (9)..(9): Xaa can be Trp, Phe, Tyr, Met, or Leu
DXRDDREVX

SEQ ID NO: 181896 - protein, 11 aa, Artificial Sequence
  Description of Artificial Sequence: Synthetic peptide
  Seed: DICTDDLMGSR (TYRP1_HUMAN)
  misc_feature (2)..(2): Xaa can be Val, Ala, Thr, Ile, Gly, Leu, Cys, Gln, Glu, Asp, Tyr, Met, Asn, Trp, Ser, Phe, His, or Ly s
  misc_feature (11)..(11): Xaa can be Lys, Arg, Tyr, His, Phe, Gln, or Met
DXCTDDLMGSX

SEQ ID NO: 181897 - protein, 10 aa, Artificial Sequence
  Description of Artificial Sequence: Synthetic peptide
  Seed: DISTFPLENA (TYRP1_HUMAN)
  misc_feature (2)..(2): Xaa can be Thr, Val, Ile, Ala, Met, Ser, or Leu
  misc_feature (10)..(10): Xaa can be Ile, Val, Leu, Ala, or Met
DXSTFPLENX

SEQ ID NO: 181898 - protein, 9 aa, Artificial Sequence
  Description of Artificial Sequence: Synthetic peptide
  Seed: DLMGSRSNF (TYRP1_HUMAN)
  misc_feature (2)..(2): Xaa can be Ile, Thr, Val, Ala, Ser, Gln, Leu, Met, Gly, Phe, Glu, Asn, Cys, Pro, Lys, Arg, His, Tyr, or Asp
  misc_feature (9)..(9): Xaa can be Tyr, Arg, Phe, Lys, Trp, Met, Leu, Ile, His, or Val
DXMGSRSNX

SEQ ID NO: 181899 - protein, 10 aa, Artificial Sequence
  Description of Artificial Sequence: Synthetic peptide
  Seed: DLSKEEKNHF (TYRP1_HUMAN)
  misc_feature (2)..(2): Xaa can be Gln, Leu, Met, or Ile
  misc_feature (10)..(10): Xaa can be Tyr, or Phe
DXSKEEKNHX

SEQ ID NO: 181900 - protein, 10 aa, Artificial Sequence
  Description of Artificial Sequence: Synthetic peptide
  Seed: DMAKRTTHPL (TYRP1_HUMAN)
  misc_feature (2)..(2): Xaa can be Met, Leu, Tyr, Phe, Pro, Val, Gln, Ile, Trp, or Ala
  misc_feature (10)..(10): Xaa can be Leu, Phe, Met, Ile, or Val
DXAKRTTHPX

SEQ ID NO: 181901 - protein, 9 aa, Artificial Sequence
  Description of Artificial Sequence: Synthetic peptide
  Seed: DNLGYTYEI (TYRP1_HUMAN)
  misc_feature (2)..(2): Xaa can be Thr, Val, Met, Ser, Ala, Ile, Leu, Gln, Gly, Glu, Asn, Cys, or Pro
  misc_feature (9)..(9): Xaa can be Val, Leu, Ile, Ala, Met, Thr, Cys, Phe, or Ser
DXLGYTYEX

SEQ ID NO: 181902 - protein, 10 aa, Artificial Sequence
  Description of Artificial Sequence: Synthetic peptide
  Seed: DPAVRSLHNL (TYRP1_HUMAN)
  misc_feature (2)..(2): Xaa can be , or Pro
  misc_feature (10)..(10): Xaa can be , or Leu
DXAVRSLHNX

SEQ ID NO: 181903 - protein, 10 aa, Artificial Sequence
  Description of Artificial Sequence: Synthetic peptide
  Seed: DPIFVLLHTF (TYRP1_HUMAN)
  misc_feature (2)..(2): Xaa can be Pro, Ala, Ser, or Thr
  misc_feature (10)..(10): Xaa can be Trp, Tyr, Met, or Phe
DXIFVLLHTX

SEQ ID NO: 181904 - protein, 9 aa, Artificial Sequence
  Description of Artificial Sequence: Synthetic peptide
  Seed: DPTGKYDPA (TYRP1_HUMAN)
  misc_feature (2)..(2): Xaa can be Pro, or Ala
  misc_feature (9)..(9): Xaa can be Ala, or Val
DXTGKYDPX

SEQ ID NO: 181905 - protein, 9 aa, Artificial Sequence
  Description of Artificial Sequence: Synthetic peptide
  Seed: DQRVLIVRR (TYRP1_HUMAN)
  misc_feature (2)..(2): Xaa can be Thr, Val, Ile, Ser, Ala, Pro, Met, Gln, Gly, Tyr, His, Trp, Leu, Asn, Asp, Phe, Cys, Glu, Lys, or Arg
  misc_feature (9)..(9): Xaa can be Arg, Lys, Tyr, Met, Leu, His, Phe, or Val
DXRVLIVRX

SEQ ID NO: 181906 - protein, 10 aa, Artificial Sequence
  Description of Artificial Sequence: Synthetic peptide
  Seed: DQYQCYAEEY (TYRP1_HUMAN)
  misc_feature (2)..(2): Xaa can be Glu, Gln, His, Ala, Met, Ile, Arg, Leu, Val, Ser, Tyr, Pro, Trp, Gly, Thr, or Phe
  misc_feature (10)..(10): Xaa can be Tyr, Phe, Trp, Met, Ala, His, or Leu
DXYQCYAEEX

SEQ ID NO: 181907 - protein, 11 aa, Artificial Sequence
  Description of Artificial Sequence: Synthetic peptide
  Seed: DRCGSSSGRGR (TYRP1_HUMAN)
  misc_feature (2)..(2): Xaa can be Ala, Gly, Asn, Tyr, Trp, Gln, Val, Ile, Cys, Thr, Ser, Leu, Met, His, Phe, Arg, Asp, Lys, Glu, or Pro
  misc_feature (11)..(11): Xaa can be Arg, or Lys
DXCGSSSGRGX

SEQ ID NO: 181908 - protein, 9 aa, Artificial Sequence
  Description of Artificial Sequence: Synthetic peptide
  Seed: DREVWPLRF (TYRP1_HUMAN)
  misc_feature (2)..(2): Xaa can be Arg, His, Gln, Tyr, or Phe
  misc_feature (9)..(9): Xaa can be Phe, Leu, Tyr, Met, Ile, Trp, Val, or Lys
DXEVWPLRX

SEQ ID NO: 181909 - protein, 9 aa, Artificial Sequence
  Description of Artificial Sequence: Synthetic peptide
  Seed: DSLEDYDTL (TYRP1_HUMAN)
  misc_feature (2)..(2): Xaa can be Ala, Thr, Ile, Val, Ser, Pro, Leu, Met, Gln, Gly, Glu, or Cys
  misc_feature (9)..(9): Xaa can be Val, Ile, Leu, Met, Phe, Trp, Tyr, Ala, Thr, or Cys
DXLEDYDTX

SEQ ID NO: 181910 - protein, 9 aa, Artificial Sequence
  Description of Artificial Sequence: Synthetic peptide
  Seed: DSRPHSPQY (TYRP1_HUMAN)
  misc_feature (2)..(2): Xaa can be Thr, Val, Ile, Ala, Ser, Pro, Gln, Met, His, Leu, Gly, Arg, Glu, Tyr, Phe, Asn, Cys, Asp, Trp, or Lys
  misc_feature (9)..(9): Xaa can be Tyr, Phe, Arg, Met, Lys, Leu, Trp, Ile, His, Val, Gln, or Ala
DXRPHSPQX

SEQ ID NO: 181911 - protein, 10 aa, Artificial Sequence
  Description of Artificial Sequence: Synthetic peptide
  Seed: DSTLISPNSV (TYRP1_HUMAN)
  misc_feature (2)..(2): Xaa can be Thr, Ala, Val, Ser, Ile, or Met
  misc_feature (10)..(10): Xaa can be Val, Ile, or Leu
DXTLISPNSX

SEQ ID NO: 181912 - protein, 10 aa, Artificial Sequence
  Description of Artificial Sequence: Synthetic peptide
  Seed: DVAQCLEVGL (TYRP1_HUMAN)
  misc_feature (2)..(2): Xaa can be Val, Thr, Ile, Ala, Ser, Met, Leu, Asn, Gln, Phe, Glu, Tyr, Gly, or Cys
  misc_feature (10)..(10): Xaa can be Arg, Lys, Val, Leu, Ile, Tyr, Met, Ala, or His
DXAQCLEVGX

SEQ ID NO: 181913 - protein, 11 aa, Artificial Sequence
  Description of Artificial Sequence: Synthetic peptide
  Seed: DVAQCLEVGLF (TYRP1_HUMAN)
  misc_feature (2)..(2): Xaa can be Thr, Val, Ile, Ala, Met, Ser, or Leu
  misc_feature (11)..(11): Xaa can be Trp, Phe, or Tyr
DXAQCLEVGLX

SEQ ID NO: 181914 - protein, 8 aa, Artificial Sequence
  Description of Artificial Sequence: Synthetic peptide
  Seed: DYDTLGTL (TYRP1_HUMAN)
  misc_feature (2)..(2): Xaa can be Tyr, Phe, Ser, Trp, Ala, Thr, Leu, Val, Ile, Met, Asn, Gln, Arg, Gly, His, or Cys
  misc_feature (8)..(8): Xaa can be Leu, Ile, Met, Phe, Val, or Tyr
DXDTLGTX

SEQ ID NO: 181915 - protein, 9 aa, Artificial Sequence
  Description of Artificial Sequence: Synthetic peptide
  Seed: DYDTLGTLC (TYRP1_HUMAN)
  misc_feature (2)..(2): Xaa can be Tyr, Phe, Trp, Met, Leu, Thr, Ala, Ile, Ser, Gly, Cys, Val, Gln, Arg, His, Pro, Asn, Glu, Asp, or Lys
  misc_feature (9)..(9): Xaa can be Leu, Met, Phe, Ile, Val, Tyr, Cys, Trp, Ala, or Thr
DXDTLGTLX

SEQ ID NO: 181916 - protein, 11 aa, Artificial Sequence
  Description of Artificial Sequence: Synthetic peptide
  Seed: EANQPLLTDQY (TYRP1_HUMAN)
  misc_feature (2)..(2): Xaa can be Ala, Thr, Val, Gln, Ile, Ser, Met, Gly, Leu, Asp, Phe, Asn, or Tyr
  misc_feature (11)..(11): Xaa can be Tyr, Lys, or Phe
EXNQPLLTDQX

SEQ ID NO: 181917 - protein, 8 aa, Artificial Sequence
  Description of Artificial Sequence: Synthetic peptide
  Seed: EAVTADSR (TYRP1_HUMAN)
  misc_feature (2)..(2): Xaa can be Val, Ile, Ala, or Thr
  misc_feature (8)..(8): Xaa can be Arg, or Lys
EXVTADSX

SEQ ID NO: 181918 - protein, 9 aa, Artificial Sequence
  Description of Artificial Sequence: Synthetic peptide
  Seed: EDYDTLGTL (TYRP1_HUMAN)
  misc_feature (2)..(2): Xaa can be Glu, Gln, Asp, Ala, Arg, His, Leu, Ser, Tyr, Phe, Met, Val, Ile, Lys, Gly, Asn, Pro, Thr, Cys, or Trp
  misc_feature (9)..(9): Xaa can be Val, Leu, Ile, Met, Tyr, Phe, Cys, Ala, Trp, Pro, Thr, His, Ser, Gly, Gln, Lys, Glu, Arg, Asn, or Asp
EXYDTLGTX

SEQ ID NO: 181919 - protein, 10 aa, Artificial Sequence
  Description of Artificial Sequence: Synthetic peptide
  Seed: EDYDTLGTLC (TYRP1_HUMAN)
  misc_feature (2)..(2): Xaa can be Glu, Asp, or Gln
  misc_feature (10)..(10): Xaa can be Ala, Cys, Val, Ile, Leu, Met, Tyr, Asn, Pro, Lys, Phe, Trp, Glu, Ser, Thr, Gln, Asp, Arg, or Gly
EXYDTLGTLX

SEQ ID NO: 181920 - protein, 10 aa, Artificial Sequence
  Description of Artificial Sequence: Synthetic peptide
  Seed: EEILGPDGNT (TYRP1_HUMAN)
  misc_feature (2)..(2): Xaa can be , or Glu
  misc_feature (10)..(10): Xaa can be Ser, Pro, Phe, Ile, Ala, Val, Leu, Thr, Met, or Cys
EXILGPDGNX

SEQ ID NO: 181921 - protein, 11 aa, Artificial Sequence
  Description of Artificial Sequence: Synthetic peptide
  Seed: EEILGPDGNTP (TYRP1_HUMAN)
  misc_feature (2)..(2): Xaa can be Glu, Gln, or Asp
  misc_feature (11)..(11): Xaa can be Phe, Val, Leu, Ile, Met, Ala, Cys, Thr, Trp, Gly, Tyr, Ser, Pro, or Lys
EXILGPDGNTX

SEQ ID NO: 181922 - protein, 9 aa, Artificial Sequence
  Description of Artificial Sequence: Synthetic peptide
  Seed: EEKNHFVRA (TYRP1_HUMAN)
  misc_feature (2)..(2): Xaa can be Glu, Asp, Gln, Asn, Lys, Ser, or Ala
  misc_feature (9)..(9): Xaa can be Trp, Ile, Val, Ala, Cys, Tyr, Met, Leu, Phe, Thr, Pro, Asp, Arg, His, Lys, Gly, or Ser
EXKNHFVRX

SEQ ID NO: 181923 - protein, 10 aa, Artificial Sequence
  Description of Artificial Sequence: Synthetic peptide
  Seed: EEKNHFVRAL (TYRP1_HUMAN)
  misc_feature (2)..(2): Xaa can be Glu, Gln, or Asp
  misc_feature (10)..(10): Xaa can be Trp, Phe, Tyr, Ile, Met, Val, Cys, Leu, or Ala
EXKNHFVRAX

SEQ ID NO: 181924 - protein, 9 aa, Artificial Sequence
  Description of Artificial Sequence: Synthetic peptide
  Seed: EEYEKLQNP (TYRP1_HUMAN)
  misc_feature (2)..(2): Xaa can be Glu, Asp, Gln, Ala, Ser, Asn, Val, Thr, Lys, Gly, Pro, Ile, Met, His, or Leu
  misc_feature (9)..(9): Xaa can be Leu, Phe, Tyr, Ile, Met, Trp, Val, Cys, Thr, Ala, Pro, Ser, His, Arg, Glu, Asp, Gly, Lys, Asn, or Gln
EXYEKLQNX

SEQ ID NO: 181925 - protein, 10 aa, Artificial Sequence
  Description of Artificial Sequence: Synthetic peptide
  Seed: EFSVPEIIAI (TYRP1_HUMAN)
  misc_feature (2)..(2): Xaa can be Thr, Val, Ala, Ser, Ile, Leu, Gly, Asp, Met, Arg, Cys, Lys, His, Pro, Trp, Phe, Gln, Asn, Tyr, or Glu
  misc_feature (10)..(10): Xaa can be Val, Ala, Ile, Leu, Met, or Thr
EXSVPEIIAX

SEQ ID NO: 181926 - protein, 10 aa, Artificial Sequence
  Description of Artificial Sequence: Synthetic peptide
  Seed: EGPAFLTWHR (TYRP1_HUMAN)
  misc_feature (2)..(2): Xaa can be Val, Thr, Ala, Met, Ile, Ser, Phe, Trp, Gln, His, Lys, Leu, Glu, Tyr, Pro, Gly, Asp, Arg, Cys, or Asn
  misc_feature (10)..(10): Xaa can be Lys, Arg, Tyr, His, Met, Leu, Gln, or Phe
EXPAFLTWHX

SEQ ID NO: 181927 - protein, 9 aa, Artificial Sequence
  Description of Artificial Sequence: Synthetic peptide
  Seed: EGYSDPTGK (TYRP1_HUMAN)
  misc_feature (2)..(2): Xaa can be Val, Thr, Ala, Ile, Ser, Met, Arg, Leu, Gln, Tyr, Gly, Cys, Glu, Asn, Phe, Lys, Pro, Trp, Asp, or His
  misc_feature (9)..(9): Xaa can be Arg, Lys, Tyr, Phe, Leu, Met, His, Val, Ile, Gln, Ala, Asn, Trp, or Glu
EXYSDPTGX

SEQ ID NO: 181928 - protein, 10 aa, Artificial Sequence
  Description of Artificial Sequence: Synthetic peptide
  Seed: EGYSDPTGKY (TYRP1_HUMAN)
  misc_feature (2)..(2): Xaa can be Thr, Val, Ile, Met, Ala, Ser, Leu, Gln, Glu, Phe, Gly, Pro, Tyr, Trp, Asn, Asp, Cys, His, Lys, or Arg
  misc_feature (10)..(10): Xaa can be Tyr, Lys, Arg, Phe, Trp, Met, His, Leu, Gln, Ile, or Val
EXYSDPTGKX

SEQ ID NO: 181929 - protein, 10 aa, Artificial Sequence
  Description of Artificial Sequence: Synthetic peptide
  Seed: EIIAIAVVGA (TYRP1_HUMAN)
  misc_feature (2)..(2): Xaa can be Thr, Ala, Val, Ser, Ile, Met, Leu, Asn, Gln, Gly, Cys, Lys, Asp, Glu, His, Arg, Pro, Tyr, Trp, or Phe
  misc_feature (10)..(10): Xaa can be Ile, Ala, Val, Leu, Met, Thr, Ser, Phe, or Cys
EXIAIAVVGX

SEQ ID NO: 181930 - protein, 11 aa, Artificial Sequence
  Description of Artificial Sequence: Synthetic peptide
  Seed: EILGPDGNTPQ (TYRP1_HUMAN)
  misc_feature (2)..(2): Xaa can be Val, Thr, Ala, Ile, Ser, Met, Leu, Gly, Cys, His, Pro, Phe, Asp, Lys, Glu, Asn, Trp, Tyr, Gln, or Arg
  misc_feature (11)..(11): Xaa can be Lys, Arg, Met, Leu, His, Gln, Tyr, Phe, Asn, Glu, Trp, Ile, Ala, Val, Thr, or Ser
EXLGPDGNTPX

SEQ ID NO: 181931 - protein, 9 aa, Artificial Sequence
  Description of Artificial Sequence: Synthetic peptide
  Seed: EIQWPSREF (TYRP1_HUMAN)
  misc_feature (2)..(2): Xaa can be Val, Thr, Ala, Ile, Gln, Ser, Met, Leu, Gly, Pro, Asn, Glu, Asp, Phe, Tyr, Cys, His, Arg, Trp, or Lys
  misc_feature (9)..(9): Xaa can be Tyr, Arg, Phe, Lys, Met, Trp, Leu, His, Ile, Val, or Gln
EXQWPSREX

SEQ ID NO: 181932 - protein, 9 aa, Artificial Sequence
  Description of Artificial Sequence: Synthetic peptide
  Seed: EKNHFVRAL (TYRP1_HUMAN)
  misc_feature (2)..(2): Xaa can be Arg, His, Gln, Gly, Lys, Ala, Asn, Glu, or Pro
  misc_feature (9)..(9): Xaa can be Leu, Phe, Met, Ile, Val, Ala, or Cys
EXNHFVRAX

SEQ ID NO: 181933 - protein, 10 aa, Artificial Sequence
  Description of Artificial Sequence: Synthetic peptide
  Seed: EMFVTAPDNL (TYRP1_HUMAN)
  misc_feature (2)..(2): Xaa can be Leu, Met, or Val
  misc_feature (10)..(10): Xaa can be Val, or Leu
EXFVTAPDNX

SEQ ID NO: 181934 - protein, 10 aa, Artificial Sequence
  Description of Artificial Sequence: Synthetic peptide
  Seed: EMLQEPSFSL (TYRP1_HUMAN)
  misc_feature (2)..(2): Xaa can be Leu, Met, Phe, Gln, Tyr, Thr, Ser, Arg, Ile, Ala, Trp, Lys, Val, His, Asn, Gly, Cys, Pro, Glu, or Asp
  misc_feature (10)..(10): Xaa can be Val, Leu, Ile, Met, Ala, Phe, Thr, Trp, or Cys
EXLQEPSFSX

SEQ ID NO: 181935 - protein, 9 aa, Artificial Sequence
  Description of Artificial Sequence: Synthetic peptide
  Seed: ENAPIGHNR (TYRP1_HUMAN)
  misc_feature (2)..(2): Xaa can be Val, Thr, Ile, Ala, Ser, Leu, Met, Gln, Tyr, Arg, Phe, Gly, Cys, Asn, Glu, Lys, Asp, Pro, Trp, or His
  misc_feature (9)..(9): Xaa can be Lys, Arg, Tyr, Phe, Met, Leu, His, Ile, Val, Ala, Trp, Gln, Asn, Thr, Glu, Gly, Ser, Cys, or Pro
EXAPIGHNX

SEQ ID NO: 181936 - protein, 11 aa, Artificial Sequence
  Description of Artificial Sequence: Synthetic peptide
  Seed: ENAPIGHNRQY (TYRP1_HUMAN)
  misc_feature (2)..(2): Xaa can be Met, Val, Thr, Ile, Ser, Tyr, Leu, Asp, Phe, Trp, Gly, Ala, Glu, Asn, Cys, or Gln
  misc_feature (11)..(11): Xaa can be Tyr, Lys, Phe, or Trp
EXAPIGHNRQX

SEQ ID NO: 181937 - protein, 9 aa, Artificial Sequence
  Description of Artificial Sequence: Synthetic peptide
  Seed: ENISIYNYF (TYRP1_HUMAN)
  misc_feature (2)..(2): Xaa can be Thr, Val, Ile, Ser, Ala, Met, Leu, Gln, Asn, Gly, Pro, Asp, Cys, Glu, Phe, Tyr, His, Arg, or Lys
  misc_feature (9)..(9): Xaa can be Tyr, Phe, Trp, Met, Leu, Val, Ile, Ala, His, Thr, Arg, or Ser
EXISIYNYX

SEQ ID NO: 181938 - protein, 10 aa, Artificial Sequence
  Description of Artificial Sequence: Synthetic peptide
  Seed: ENISIYNYFV (TYRP1_HUMAN)
  misc_feature (2)..(2): Xaa can be Thr, Val, Ser, Ile, Ala, Leu, Met, Phe, Pro, Asp, Gly, Arg, Lys, Glu, Tyr, Trp, His, Gln, Cys, or Asn
  misc_feature (10)..(10): Xaa can be Ile, Ala, Leu, Val, Thr, Met, Ser, Cys, Phe, Gly, or Pro
EXISIYNYFX

SEQ ID NO: 181939 - protein, 11 aa, Artificial Sequence
  Description of Artificial Sequence: Synthetic peptide
  Seed: ENISIYNYFVW (TYRP1_HUMAN)
  misc_feature (2)..(2): Xaa can be Thr, Ala, Phe, Asp, Tyr, Gly, His, Arg, Met, Val, Cys, Ser, Lys, Trp, Leu, Ile, Asn, Glu, Pro, or Gln
  misc_feature (11)..(11): Xaa can be , or Trp
EXISIYNYFVX

SEQ ID NO: 181940 - protein, 9 aa, Artificial Sequence
  Description of Artificial Sequence: Synthetic peptide
  Seed: EPQDVAQCL (TYRP1_HUMAN)
  misc_feature (2)..(2): Xaa can be Pro, Ala, Ser, Val, Gly, Ile, Thr, Leu, Met, Gln, Cys, Glu, Phe, or Asn
  misc_feature (9)..(9): Xaa can be Trp, Tyr, Phe, Ile, Val, Leu, Met, Ala, His, Pro, or Thr
EXQDVAQCX

SEQ ID NO: 181941 - protein, 11 aa, Artificial Sequence
  Description of Artificial Sequence: Synthetic peptide
  Seed: EPQDVAQCLEV (TYRP1_HUMAN)
  misc_feature (2)..(2): Xaa can be , or Pro
  misc_feature (11)..(11): Xaa can be Met, Ile, Ala, Val, or Leu
EXQDVAQCLEX

SEQ ID NO: 181942 - protein, 8 aa, Artificial Sequence
  Description of Artificial Sequence: Synthetic peptide
  Seed: EPSFSLPY (TYRP1_HUMAN)
  misc_feature (2)..(2): Xaa can be Pro, or Ala
  misc_feature (8)..(8): Xaa can be Tyr, Met, or Phe
EXSFSLPX

SEQ ID NO: 181943 - protein, 9 aa, Artificial Sequence
  Description of Artificial Sequence: Synthetic peptide
  Seed: EPSFSLPYW (TYRP1_HUMAN)
  misc_feature (2)..(2): Xaa can be Pro, Ser, Thr, Ala, Trp, Asn, Val, Asp, Gln, Met, Leu, Gly, Tyr, Cys, Glu, Ile, or Phe
  misc_feature (9)..(9): Xaa can be Trp, Phe, Ile, Met, Tyr, or Leu
EXSFSLPYX

SEQ ID NO: 181944 - protein, 11 aa, Artificial Sequence
  Description of Artificial Sequence: Synthetic peptide
  Seed: EVDFSHEGPAF (TYRP1_HUMAN)
  misc_feature (2)..(2): Xaa can be Ala, Ile, Thr, Val, Leu, Met, Ser, Cys, Gly, Gln, Phe, or Pro
  misc_feature (11)..(11): Xaa can be Phe, Leu, Met, Tyr, Ile, Trp, or Val
EXDFSHEGPAX

SEQ ID NO: 181945 - protein, 11 aa, Artificial Sequence
  Description of Artificial Sequence: Synthetic peptide
  Seed: EVGLFDTPPFY (TYRP1_HUMAN)
  misc_feature (2)..(2): Xaa can be Val, or Thr
  misc_feature (11)..(11): Xaa can be , or Tyr
EXGLFDTPPFX

SEQ ID NO: 181946 - protein, 10 aa, Artificial Sequence
  Description of Artificial Sequence: Synthetic peptide
  Seed: EVWPLRFFNR (TYRP1_HUMAN)
  misc_feature (2)..(2): Xaa can be Thr, Val, Phe, Tyr, Ile, Met, Ala, Trp, Ser, His, Cys, Glu, Gly, Lys, Asn, Arg, Asp, Leu, Gln, or Pro
  misc_feature (10)..(10): Xaa can be Arg, Lys, Tyr, His, Gln, Met, Leu, or Phe
EXWPLRFFNX

SEQ ID NO: 181947 - protein, 11 aa, Artificial Sequence
  Description of Artificial Sequence: Synthetic peptide
  Seed: EVWPLRFFNRT (TYRP1_HUMAN)
  misc_feature (2)..(2): Xaa can be Thr, Val, Met, Phe, Tyr, Ser, Ile, Ala, Trp, Leu, Asn, Cys, Gly, His, or Gln
  misc_feature (11)..(11): Xaa can be Arg, Lys, His, Leu, Met, Tyr, Ile, Val, Phe, Gln, Ala, Trp, Cys, Thr, Asp, Ser, Gly, Pro, Glu, or Asn
EXWPLRFFNRX

SEQ ID NO: 181948 - protein, 8 aa, Artificial Sequence
  Description of Artificial Sequence: Synthetic peptide
  Seed: FDEWLRRY (TYRP1_HUMAN)
  misc_feature (2)..(2): Xaa can be Val, Leu, Thr, Asn, Met, Asp, Ala, Ser, or Ile
  misc_feature (8)..(8): Xaa can be , or Tyr
FXEWLRRX

SEQ ID NO: 181949 - protein, 10 aa, Artificial Sequence
  Description of Artificial Sequence: Synthetic peptide
  Seed: FDEWLRRYNA (TYRP1_HUMAN)
  misc_feature (2)..(2): Xaa can be Lys, Met, Gln, Arg, Glu, Tyr, Asn, Thr, Trp, Val, Ile, Ser, His, Phe, Pro, Asp, Leu, Gly, Ala, or Cys
  misc_feature (10)..(10): Xaa can be Met, Ala, Phe, Leu, Val, or Ile
FXEWLRRYNX

SEQ ID NO: 181950 - protein, 9 aa, Artificial Sequence
  Description of Artificial Sequence: Synthetic peptide
  Seed: FENISIYNY (TYRP1_HUMAN)
  misc_feature (2)..(2): Xaa can be Glu, Ala, Gln, Asp, Ser, Met, Thr, Gly, His, Val, Ile, Leu, Lys, Phe, Pro, Tyr, Asn, Arg, Trp, or Cys
  misc_feature (9)..(9): Xaa can be Tyr, Phe, Met, Leu, Lys, Trp, Ile, His, Val, Ala, Arg, Cys, Gly, Pro, Ser, or Thr
FXNISIYNX

SEQ ID NO: 181951 - protein, 10 aa, Artificial Sequence
  Description of Artificial Sequence: Synthetic peptide
  Seed: FENISIYNYF (TYRP1_HUMAN)
  misc_feature (2)..(2): Xaa can be Glu, Gln, Met, Lys, His, Ser, Pro, Thr, Ala, Ile, Arg, Leu, Val, or Asp
  misc_feature (10)..(10): Xaa can be Phe, Tyr, Met, Leu, Trp, Ile, Val, His, Ala, or Cys
FXNISIYNYX

SEQ ID NO: 181952 - protein, 11 aa, Artificial Sequence
  Description of Artificial Sequence: Synthetic peptide
  Seed: FENISIYNYFV (TYRP1_HUMAN)
  misc_feature (2)..(2): Xaa can be Met, Leu, Gln, Cys, Ala, Tyr, Glu, Asn, Gly, Val, His, Asp, Lys, Ile, Thr, Pro, Trp, Arg, Phe, or Ser
  misc_feature (11)..(11): Xaa can be Ile, Val, Leu, Met, Thr, or Ala
FXNISIYNYFX

SEQ ID NO: 181953 - protein, 10 aa, Artificial Sequence
  Description of Artificial Sequence: Synthetic peptide
  Seed: FFPLLLFQQA (TYRP1_HUMAN)
  misc_feature (2)..(2): Xaa can be Arg, Trp, Met, Ser, Tyr, Asn, His, Gln, Ala, Leu, Asp, Val, Ile, Phe, Gly, Pro, Glu, Cys, Lys, or Thr
  misc_feature (10)..(10): Xaa can be Ser, Val, Ile, Thr, Pro, or Ala
FXPLLLFQQX

SEQ ID NO: 181954 - protein, 11 aa, Artificial Sequence
  Description of Artificial Sequence: Synthetic peptide
  Seed: FFPLLLFQQAR (TYRP1_HUMAN)
  misc_feature (2)..(2): Xaa can be Tyr, Thr, Phe, Arg, or Met
  misc_feature (11)..(11): Xaa can be , or Arg
FXPLLLFQQAX

SEQ ID NO: 181955 - protein, 9 aa, Artificial Sequence
  Description of Artificial Sequence: Synthetic peptide
  Seed: FGTASYLIR (TYRP1_HUMAN)
  misc_feature (2)..(2): Xaa can be Thr, Val, Ala, Ser, Pro, Ile, Phe, Asp, Leu, Met, Gln, Tyr, Asn, Gly, His, Cys, or Trp
  misc_feature (9)..(9): Xaa can be Arg, Lys, His, or Tyr
FXTASYLIX

SEQ ID NO: 181956 - protein, 10 aa, Artificial Sequence
  Description of Artificial Sequence: Synthetic peptide
  Seed: FGTASYLIRA (TYRP1_HUMAN)
  misc_feature (2)..(2): Xaa can be Leu, Met, Gln, Ile, Val, Pro, Lys, Glu, Ser, Ala, Arg, Trp, His, Cys, Tyr, Asn, Asp, Gly, Phe, or Thr
  misc_feature (10)..(10): Xaa can be Leu, Val, Ile, Met, Ala, Thr, Ser, Cys, Phe, Gly, or Pro
FXTASYLIRX

SEQ ID NO: 181957 - protein, 11 aa, Artificial Sequence
  Description of Artificial Sequence: Synthetic peptide
  Seed: FGTASYLIRAR (TYRP1_HUMAN)
  misc_feature (2)..(2): Xaa can be Glu, Val, Met, Thr, Phe, Lys, Ile, Cys, Asn, Tyr, Leu, Ser, Gln, Pro, Asp, Gly, Arg, Trp, Ala, or His
  misc_feature (11)..(11): Xaa can be Arg, or Lys
FXTASYLIRAX

SEQ ID NO: 181958 - protein, 9 aa, Artificial Sequence
  Description of Artificial Sequence: Synthetic peptide
  Seed: FLGVGQESF (TYRP1_HUMAN)
  misc_feature (2)..(2): Xaa can be Ala, Met, Pro, Arg, Leu, Ser, Tyr, Val, Thr, Phe, Ile, Gly, Gln, Glu, Asn, Trp, His, Cys, Asp, or Lys
  misc_feature (9)..(9): Xaa can be Met, Tyr, Phe, Leu, Lys, Ile, Val, Trp, Arg, His, Ala, Thr, Cys, or Gln
FXGVGQESX

SEQ ID NO: 181959 - protein, 9 aa, Artificial Sequence
  Description of Artificial Sequence: Synthetic peptide
  Seed: FLNGTGGQT (TYRP1_HUMAN)
  misc_feature (2)..(2): Xaa can be Met, Leu, Gln, Val, Ile, Thr, Ser, or Ala
  misc_feature (9)..(9): Xaa can be Leu, Ile, Val, Ala, Met, or Thr
FXNGTGGQX

SEQ ID NO: 181960 - protein, 10 aa, Artificial Sequence
  Description of Artificial Sequence: Synthetic peptide
  Seed: FLNGTGGQTH (TYRP1_HUMAN)
  misc_feature (2)..(2): Xaa can be Ala, Val, Thr, Ser, Ile, Met, Gly, Gln, Leu, Asn, Pro, Glu, Phe, Cys, Asp, Tyr, Lys, Arg, Trp, or His
  misc_feature (10)..(10): Xaa can be Tyr, Phe, Met, Leu, Trp, His, Lys, Arg, Ile, Cys, Val, Ala, Gln, Thr, Ser, Gly, Pro, Glu, or Asn
FXNGTGGQTX

SEQ ID NO: 181961 - protein, 11 aa, Artificial Sequence
  Description of Artificial Sequence: Synthetic peptide
  Seed: FLNGTGGQTHL (TYRP1_HUMAN)
  misc_feature (2)..(2): Xaa can be Ala, Ser, Tyr, Val, Leu, Thr, Arg, Met, Gln, Ile, Phe, Gly, Trp, Asn, Glu, Cys, Pro, His, Asp, or Lys
  misc_feature (11)..(11): Xaa can be Tyr, Met, Phe, Leu, Ile, Lys, Trp, Val, His, Arg, Ala, Cys, Gln, Ser, Gly, Asn, or Thr
FXNGTGGQTHX

SEQ ID NO: 181962 - protein, 9 aa, Artificial Sequence
  Description of Artificial Sequence: Synthetic peptide
  Seed: FLTWHRYHL (TYRP1_HUMAN)
  misc_feature (2)..(2): Xaa can be Leu, Met, Pro, Ala, Ser, Thr, Tyr, Phe, Ile, Gln, Val, Gly, Asn, Arg, Trp, Glu, Lys, His, Cys, or Asp
  misc_feature (9)..(9): Xaa can be Met, Leu, Phe, Tyr, Val, Ile, Ala, Lys, Arg, Trp, Thr, His, Ser, Pro, Cys, or Gly
FXTWHRYHX

SEQ ID NO: 181963 - protein, 10 aa, Artificial Sequence
  Description of Artificial Sequence: Synthetic peptide
  Seed: FLTWHRYHLL (TYRP1_HUMAN)
  misc_feature (2)..(2): Xaa can be Leu, Met, Pro, Ile, Thr, Gln, Val, Ala, Glu, Asp, Phe, His, Trp, Lys, Asn, Ser, Arg, Tyr, Gly, or Cys
  misc_feature (10)..(10): Xaa can be Leu, Ile, Val, Ala, Met, Phe, Cys, Gln, Lys, Tyr, Trp, His, Asp, Glu, Pro, Ser, Arg, Thr, Gly, or Asn
FXTWHRYHLX

SEQ ID NO: 181964 - protein, 11 aa, Artificial Sequence
  Description of Artificial Sequence: Synthetic peptide
  Seed: FLTWHRYHLLR (TYRP1_HUMAN)
  misc_feature (2)..(2): Xaa can be Met, Leu, Ile, Tyr, Phe, Val, Thr, Ala, His, Ser, Cys, Gly, Arg, Asn, Trp, Gln, Lys, Pro, Asp, or Glu
  misc_feature (11)..(11): Xaa can be Arg, Lys, Val, Asn, Cys, Phe, Thr, Ala, Ile, Tyr, Asp, Ser, Leu, Pro, Met, Gly, Gln, His, Trp, or Glu
FXTWHRYHLLX

SEQ ID NO: 181965 - protein, 8 aa, Artificial Sequence
  Description of Artificial Sequence: Synthetic peptide
  Seed: FPLENAPI (TYRP1_HUMAN)
  misc_feature (2)..(2): Xaa can be Pro, or Ala
  misc_feature (8)..(8): Xaa can be Ile, Val, Ser, Pro, Met, Leu, Phe, Ala, Thr, or Cys
FXLENAPX

SEQ ID NO: 181966 - protein, 9 aa, Artificial Sequence
  Description of Artificial Sequence: Synthetic peptide
  Seed: FPLENAPIG (TYRP1_HUMAN)
  misc_feature (2)..(2): Xaa can be Pro, Ala, Val, Ser, Thr, Ile, Gly, Met, Cys, Phe, Gln, Glu, Leu, Tyr, Trp, His, Lys, Asn, or Asp
  misc_feature (9)..(9): Xaa can be Tyr, Phe, Met, Leu, Val, Ile, Ala, His, Trp, Cys, Thr, Asn, Glu, Ser, Gln, Pro, Arg, Gly, Asp, or Lys
FXLENAPIX

SEQ ID NO: 181967 - protein, 10 aa, Artificial Sequence
  Description of Artificial Sequence: Synthetic peptide
  Seed: FPLENAPIGH (TYRP1_HUMAN)
  misc_feature (2)..(2): Xaa can be Pro, Ala, Val, Met, Ile, Thr, Leu, or Ser
  misc_feature (10)..(10): Xaa can be Tyr, Phe, Met, Ala, Val, His, Ile, Trp, Cys, or Leu
FXLENAPIGX

SEQ ID NO: 181968 - protein, 9 aa, Artificial Sequence
  Description of Artificial Sequence: Synthetic peptide
  Seed: FPLLLFQQA (TYRP1_HUMAN)
  misc_feature (2)..(2): Xaa can be Pro, His, Arg, Ala, Gln, Ser, Gly, Glu, Val, Lys, Thr, Met, or Ile
  misc_feature (9)..(9): Xaa can be Tyr, Val, Ala, Ile, Met, Phe, Leu, Cys, Thr, Pro, Ser, Gly, Arg, Trp, Lys, or His
FXLLLFQQX

SEQ ID NO: 181969 - protein, 10 aa, Artificial Sequence
  Description of Artificial Sequence: Synthetic peptide
  Seed: FPLLLFQQAR (TYRP1_HUMAN)
  misc_feature (2)..(2): Xaa can be Pro, Ala, Trp, Tyr, Phe, Met, His, Cys, Lys, Asn, Ser, Arg, Ile, Asp, Glu, Thr, Leu, Gly, Gln, or Val
  misc_feature (10)..(10): Xaa can be Arg, Lys, Ala, Pro, Gly, Val, Ile, Asp, Met, Thr, Glu, Gln, Ser, His, Asn, Phe, Tyr, Leu, Cys, or Trp
FXLLLFQQAX

SEQ ID NO: 181970 - protein, 11 aa, Artificial Sequence
  Description of Artificial Sequence: Synthetic peptide
  Seed: FPLLLFQQARA (TYRP1_HUMAN)
  misc_feature (2)..(2): Xaa can be Leu, Met, His, Ala, Arg, Ser, Phe, Val, Pro, Gln, Lys, Thr, Trp, Asp, Cys, Asn, Ile, Glu, Gly, or Tyr
  misc_feature (11)..(11): Xaa can be Leu, Val, Ile, Ala, or Met
FXLLLFQQARX

SEQ ID NO: 181971 - protein, 8 aa, Artificial Sequence
  Description of Artificial Sequence: Synthetic peptide
  Seed: FPRQCATV (TYRP1_HUMAN)
  misc_feature (2)..(2): Xaa can be Pro, or Ala
  misc_feature (8)..(8): Xaa can be Ile, Val, Leu, Ala, Ser, Thr, Cys, Met, Phe, or Pro
FXRQCATX

SEQ ID NO: 181972 - protein, 9 aa, Artificial Sequence
  Description of Artificial Sequence: Synthetic peptide
  Seed: FPRQCATVE (TYRP1_HUMAN)
  misc_feature (2)..(2): Xaa can be Pro, Ala, Val, Ile, Met, Leu, Ser, Thr, Cys, Gly, Gln, Phe, or Asp
  misc_feature (9)..(9): Xaa can be Tyr, Leu, Met, Ala, Phe, Ile, Val, Cys, Pro, Trp, Thr, Ser, Asp, Asn, Glu, Arg, His, Gln, Lys, or Gly
FXRQCATVX

SEQ ID NO: 181973 - protein, 10 aa, Artificial Sequence
  Description of Artificial Sequence: Synthetic peptide
  Seed: FPRQCATVEA (TYRP1_HUMAN)
  misc_feature (2)..(2): Xaa can be Pro, Val, Ile, Ala, Met, Leu, Thr, Ser, His, Arg, Asn, Lys, Trp, Gly, Tyr, Asp, Glu, Gln, Cys, or Phe
  misc_feature (10)..(10): Xaa can be Ala, Tyr, Leu, Met, Phe, Val, Ile, Thr, Gly, Lys, His, Cys, Ser, Arg, Pro, Gln, Trp, or Gl u
FXRQCATVEX

SEQ ID NO: 181974 - protein, 11 aa, Artificial Sequence
  Description of Artificial Sequence: Synthetic peptide
  Seed: FPRQCATVEAL (TYRP1_HUMAN)
  misc_feature (2)..(2): Xaa can be Pro, or Ala
  misc_feature (11)..(11): Xaa can be Leu, Phe, Tyr, Trp, Ala, Gly, Asp, Ser, Ile, Pro, Arg, Met, Lys, His, Gln, Glu, Cys, Thr, Val, or Asn
FXRQCATVEAX

SEQ ID NO: 181975 - protein, 8 aa, Artificial Sequence
  Description of Artificial Sequence: Synthetic peptide
  Seed: FQQARAQF (TYRP1_HUMAN)
  misc_feature (2)..(2): Xaa can be Gln, Glu, Ala, Tyr, Ser, Arg, Phe, His, Met, Asp, Lys, Asn, Val, Leu, Ile, Thr, Gly, Pro, or Trp
  misc_feature (8)..(8): Xaa can be Leu, Tyr, Phe, Met, or Ile
FXQARAQX

SEQ ID NO: 181976 - protein, 10 aa, Artificial Sequence
  Description of Artificial Sequence: Synthetic peptide
  Seed: FQQARAQFPR (TYRP1_HUMAN)
  misc_feature (2)..(2): Xaa can be Val, Thr, Ile, Asn, Glu, Gly, Cys, Leu, Ser, Gln, Ala, Tyr, Phe, Arg, Trp, His, Met, Lys, Asp, or Pro
  misc_feature (10)..(10): Xaa can be Lys, Arg, or Tyr
FXQARAQFPX

SEQ ID NO: 181977 - protein, 8 aa, Artificial Sequence
  Description of Artificial Sequence: Synthetic peptide
  Seed: FRNTVEGY (TYRP1_HUMAN)
  misc_feature (2)..(2): Xaa can be Tyr, Phe, Arg, His, Gln, Trp, or Lys
  misc_feature (8)..(8): Xaa can be Phe, Tyr, Leu, Met, or Ile
FXNTVEGX

SEQ ID NO: 181978 - protein, 10 aa, Artificial Sequence
  Description of Artificial Sequence: Synthetic peptide
  Seed: FSGHNCGTCR (TYRP1_HUMAN)
  misc_feature (2)..(2): Xaa can be Ala, Thr, Ser, Val, Ile, Leu, Met, Gly, Phe, Gln, Asn, Asp, Tyr, Cys, Glu, or Trp
  misc_feature (10)..(10): Xaa can be Lys, Tyr, Arg, Leu, Met, Phe, Val, or Ile
FXGHNCGTCX

SEQ ID NO: 181979 - protein, 8 aa, Artificial Sequence
  Description of Artificial Sequence: Synthetic peptide
  Seed: FSHEGPAF (TYRP1_HUMAN)
  misc_feature (2)..(2): Xaa can be Ala, Ser, Thr, Tyr, Pro, Val, Phe, Ile, Gly, Leu, Arg, Met, Gln, Asn, Cys, Trp, Asp, Glu, His, or Lys
  misc_feature (8)..(8): Xaa can be Phe, Leu, Tyr, Met, Ile, Val, Trp, His, Lys, Arg, Ala, Gln, Cys, Thr, Ser, Pro, Glu, Gly, or Asn
FXHEGPAX

SEQ ID NO: 181980 - protein, 9 aa, Artificial Sequence
  Description of Artificial Sequence: Synthetic peptide
  Seed: FSHEGPAFL (TYRP1_HUMAN)
  misc_feature (2)..(2): Xaa can be Tyr, Ala, Met, Leu, Ser, Pro, Gln, Val, Ile, Phe, Arg, Thr, Gly, Trp, Cys, Asn, His, Glu, Asp, or Lys
  misc_feature (9)..(9): Xaa can be Met, Trp, Leu, Val, His, Tyr, Ile, Phe, Arg, Lys, Ala, Cys, Thr, Gln, Ser, Gly, Pro, Glu, Asn, or Asp
FXHEGPAFX

SEQ ID NO: 181981 - protein, 11 aa, Artificial Sequence
  Description of Artificial Sequence: Synthetic peptide
  Seed: FSHEGPAFLTW (TYRP1_HUMAN)
  misc_feature (2)..(2): Xaa can be Ala, Ser, Val, Thr, Gln, Ile, Gly, Cys, Leu, Pro, Met, Glu, Asn, Phe, Tyr, Asp, Arg, Lys, or Trp
  misc_feature (11)..(11): Xaa can be Trp, Tyr, Phe, Met, Lys, Leu, His, Ile, Arg, Val, Cys, Ala, Gln, Ser, Thr, or Asn
FXHEGPAFLTX

SEQ ID NO: 181982 - protein, 8 aa, Artificial Sequence
  Description of Artificial Sequence: Synthetic peptide
  Seed: FSLPYWNF (TYRP1_HUMAN)
  misc_feature (2)..(2): Xaa can be Ala, Ser, Thr, Asn, Cys, Ile, Gly, or Val
  misc_feature (8)..(8): Xaa can be Trp, Leu, Tyr, Phe, or Met
FXLPYWNX

SEQ ID NO: 181983 - protein, 9 aa, Artificial Sequence
  Description of Artificial Sequence: Synthetic peptide
  Seed: FSLPYWNFA (TYRP1_HUMAN)
  misc_feature (2)..(2): Xaa can be Met, Leu, Gln, Pro, Ala, Ile, Val, Ser, Thr, Gly, Cys, Phe, Glu, Asn, Trp, Lys, Tyr, or As p
  misc_feature (9)..(9): Xaa can be Val, Ile, Leu, Ala, Tyr, Phe, Met, Thr, Ser, Cys, Pro, Trp, Glu, Gly, His, Gln, Arg, or Ly s
FXLPYWNFX

SEQ ID NO: 181984 - protein, 10 aa, Artificial Sequence
  Description of Artificial Sequence: Synthetic peptide
  Seed: FSLPYWNFAT (TYRP1_HUMAN)
  misc_feature (2)..(2): Xaa can be Leu, Met, Gln, Ile, Val, Asn, Gly, Trp, Arg, His, Ala, Thr, Ser, Pro, Asp, Tyr, Glu, Phe, Lys, or Cys
  misc_feature (10)..(10): Xaa can be Thr, Ala, Ser, Cys, Ile, Leu, Val, Phe, Met, Pro, Gly, Asn, Tyr, Gln, His, Asp, Trp, Lys, Arg, or Glu
FXLPYWNFAX

SEQ ID NO: 181985 - protein, 9 aa, Artificial Sequence
  Description of Artificial Sequence: Synthetic peptide
  Seed: FSVPEIIAI (TYRP1_HUMAN)
  misc_feature (2)..(2): Xaa can be Pro, Ala, Leu, Met, Arg, Ser, Tyr, Gln, Ile, Val, Thr, Gly, Phe, Glu, Asn, Trp, Cys, His, Asp, or Lys
  misc_feature (9)..(9): Xaa can be Trp, His, Phe, Tyr, Lys, Ile, Leu, Met, Arg, Val, Ala, Cys, Gln, Thr, Ser, Pro, Gly, Asn, Glu, or Asp
FXVPEIIAX

SEQ ID NO: 181986 - protein, 10 aa, Artificial Sequence
  Description of Artificial Sequence: Synthetic peptide
  Seed: FSVPEIIAIA (TYRP1_HUMAN)
  misc_feature (2)..(2): Xaa can be Val, Ile, Met, Leu, Gln, Thr, Phe, Pro, His, Asp, Gly, Tyr, Ser, Ala, Asn, Trp, Cys, Glu, Arg, or Lys
  misc_feature (10)..(10): Xaa can be Leu, Ile, Thr, Ala, Val, Met, Phe, Ser, Pro, Lys, Cys, Trp, His, Gln, Arg, Glu, Asp, Gly, Tyr, or Asn
FXVPEIIAIX

SEQ ID NO: 181987 - protein, 11 aa, Artificial Sequence
  Description of Artificial Sequence: Synthetic peptide
  Seed: FSVPEIIAIAV (TYRP1_HUMAN)
  misc_feature (2)..(2): Xaa can be Ala, Met, Thr, Ser, Val, Gln, Ile, Leu, Gly, Pro, Cys, Phe, Tyr, or Glu
  misc_feature (11)..(11): Xaa can be Met, Leu, Val, Ile, Ala, Phe, Thr, or Cys
FXVPEIIAIAX

SEQ ID NO: 181988 - protein, 9 aa, Artificial Sequence
  Description of Artificial Sequence: Synthetic peptide
  Seed: FTDAVFDEW (TYRP1_HUMAN)
  misc_feature (2)..(2): Xaa can be Ala, Thr, Ser, Met, Leu, Ile, Val, Tyr, Phe, Gln, Gly, Cys, Asn, Trp, Pro, Arg, Asp, Glu, Lys, or His
  misc_feature (9)..(9): Xaa can be Lys, Ile, Met, Tyr, Val, Phe, Arg, Trp, Leu, Ala, Cys, His, Thr, Gln, Ser, Pro, Asn, Glu, or Gly
FXDAVFDEX

SEQ ID NO: 181989 - protein, 10 aa, Artificial Sequence
  Description of Artificial Sequence: Synthetic peptide
  Seed: FTDAVFDEWL (TYRP1_HUMAN)
  misc_feature (2)..(2): Xaa can be Thr, Leu, Met, Ser, Ile, Val, Gln, Ala, Gly, Phe, Cys, Asn, Tyr, Pro, Glu, Asp, or Trp
  misc_feature (10)..(10): Xaa can be Tyr, Leu, Met, Phe, Ile, Val, Ala, Thr, Trp, Lys, His, Cys, Ser, Arg, or Gln
FXDAVFDEWX

SEQ ID NO: 181990 - protein, 11 aa, Artificial Sequence
  Description of Artificial Sequence: Synthetic peptide
  Seed: FTDAVFDEWLR (TYRP1_HUMAN)
  misc_feature (2)..(2): Xaa can be Thr, Ser, Val, Leu, Ile, Ala, Met, Gly, Asp, Gln, Glu, Trp, Asn, Phe, Cys, Lys, Tyr, Arg, Pro, or His
  misc_feature (11)..(11): Xaa can be Lys, Arg, Tyr, His, Phe, Trp, Gln, or Met
FXDAVFDEWLX

SEQ ID NO: 181991 - protein, 10 aa, Artificial Sequence
  Description of Artificial Sequence: Synthetic peptide
  Seed: FVLLHTFTDA (TYRP1_HUMAN)
  misc_feature (2)..(2): Xaa can be Met, Leu, Gln, His, Pro, Ala, Cys, Gly, Ser, Ile, Thr, Phe, Lys, Asp, Asn, Glu, Trp, Arg, Tyr, or Val
  misc_feature (10)..(10): Xaa can be Thr, Met, Ile, Ala, Leu, Val, Phe, Ser, or Cys
FXLLHTFTDX

SEQ ID NO: 181992 - protein, 11 aa, Artificial Sequence
  Description of Artificial Sequence: Synthetic peptide
  Seed: FVLLHTFTDAV (TYRP1_HUMAN)
  misc_feature (2)..(2): Xaa can be Met, Leu, Ile, Ala, Asn, Pro, Phe, Trp, Tyr, Arg, Asp, Glu, His, Cys, Gly, Ser, Thr, Lys, Val, or Gln
  misc_feature (11)..(11): Xaa can be Ile, Ala, Leu, Met, Val, Ser, or Thr
FXLLHTFTDAX

SEQ ID NO: 181993 - protein, 9 aa, Artificial Sequence
  Description of Artificial Sequence: Synthetic peptide
  Seed: FVRALDMAK (TYRP1_HUMAN)
  misc_feature (2)..(2): Xaa can be Thr, Val, Ser, Leu, Ile, Met, Ala, Gln, Gly, Tyr, Asn, Phe, Asp, Trp, Glu, His, Cys, or Pr o
  misc_feature (9)..(9): Xaa can be Arg, Lys, Tyr, Met, Phe, Leu, Val, Ala, His, or Ile
FXRALDMAX

SEQ ID NO: 181994 - protein, 10 aa, Artificial Sequence
  Description of Artificial Sequence: Synthetic peptide
  Seed: FVRALDMAKR (TYRP1_HUMAN)
  misc_feature (2)..(2): Xaa can be Thr, Val, Ile, Tyr, Ala, Leu, Met, Trp, Phe, Ser, Pro, Asn, Gly, Asp, or Gln
  misc_feature (10)..(10): Xaa can be Arg, Lys, Tyr, or Met
FXRALDMAKX

SEQ ID NO: 181995 - protein, 8 aa, Artificial Sequence
  Description of Artificial Sequence: Synthetic peptide
  Seed: FVTAPDNL (TYRP1_HUMAN)
  misc_feature (2)..(2): Xaa can be Ala, Ile, Ser, Thr, or Val
  misc_feature (8)..(8): Xaa can be Leu, or Met
FXTAPDNX

SEQ ID NO: 181996 - protein, 10 aa, Artificial Sequence
  Description of Artificial Sequence: Synthetic peptide
  Seed: FVTAPDNLGY (TYRP1_HUMAN)
  misc_feature (2)..(2): Xaa can be Ala, Pro, Ser, Thr, Val, Met, Gln, Gly, Ile, Tyr, Leu, Asn, Asp, Phe, Trp, Glu, Cys, Lys, His, or Arg
  misc_feature (10)..(10): Xaa can be Trp, Met, Phe, Tyr, Lys, Arg, Leu, His, Ile, Val, or Cys
FXTAPDNLGX

SEQ ID NO: 181997 - protein, 9 aa, Artificial Sequence
  Description of Artificial Sequence: Synthetic peptide
  Seed: FVWTHYYSV (TYRP1_HUMAN)
  misc_feature (2)..(2): Xaa can be Met, Leu, Pro, Gln, Ile, Val, Ala, Thr, Ser, Arg, Gly, Tyr, Glu, Cys, Phe, Trp, Asn, Asp, His, or Lys
  misc_feature (9)..(9): Xaa can be Met, Tyr, Phe, Val, Ile, Leu, Lys, Ala, Arg, Trp, Thr, Cys, His, Ser, Pro, Gly, Glu, Asp, Gln, or Asn
FXWTHYYSX

SEQ ID NO: 181998 - protein, 10 aa, Artificial Sequence
  Description of Artificial Sequence: Synthetic peptide
  Seed: FVWTHYYSVK (TYRP1_HUMAN)
  misc_feature (2)..(2): Xaa can be Gln, Leu, Val, Ile, Ala, Met, Thr, Ser, Gly, Phe, Trp, Arg, Tyr, His, Asn, Lys, Cys, Pro, or Glu
  misc_feature (10)..(10): Xaa can be Arg, Lys, Val, Thr, Ile, Met, Leu, Ala, Glu, Asp, His, Phe, Pro, Gln, Ser, Gly, Trp, Tyr, Cys, or Asn
FXWTHYYSVX

SEQ ID NO: 181999 - protein, 11 aa, Artificial Sequence
  Description of Artificial Sequence: Synthetic peptide
  Seed: FVWTHYYSVKK (TYRP1_HUMAN)
  misc_feature (2)..(2): Xaa can be Gly, Val, Thr, Cys, Ile, Lys, Arg, Asp, Pro, Ala, Asn, His, Glu, Ser, Met, Phe, Gln, Leu, Tyr, or Trp
  misc_feature (11)..(11): Xaa can be Lys, or Arg
FXWTHYYSVKX

SEQ ID NO: 182000 - protein, 10 aa, Artificial Sequence
  Description of Artificial Sequence: Synthetic peptide
  Seed: FWPPVTNTEM (TYRP1_HUMAN)
  misc_feature (2)..(2): Xaa can be Ala, Tyr, Phe, Ser, Val, Leu, Thr, Ile, Met, Arg, Trp, Gln, Gly, Cys, Pro, His, Asn, Glu, Lys, or Asp
  misc_feature (10)..(10): Xaa can be Ile, Tyr, Met, Leu, Phe, Val, Lys, Trp, His, Arg, Cys, Ala, Gln, Thr, Ser, Asn, Gly, Pro, or Glu
FXPPVTNTEX

SEQ ID NO: 182001 - protein, 11 aa, Artificial Sequence
  Description of Artificial Sequence: Synthetic peptide
  Seed: FWPPVTNTEMF (TYRP1_HUMAN)
  misc_feature (2)..(2): Xaa can be Arg, Ala, Tyr, Thr, Ser, Gly, Phe, Ile, Val, Trp, Gln, Met, Leu, Asp, Cys, Glu, His, Lys, Asn, or Pro
  misc_feature (11)..(11): Xaa can be Phe, Met, Tyr, Trp, Leu, Lys, Ile, Val, Arg, His, or Cys
FXPPVTNTEMX

SEQ ID NO: 182002 - protein, 9 aa, Artificial Sequence
  Description of Artificial Sequence: Synthetic peptide
  Seed: FYSNSTNSF (TYRP1_HUMAN)
  misc_feature (2)..(2): Xaa can be Pro, Tyr, Ala, Gln, Phe, Ser, Met, Arg, Val, Ile, Gly, Thr, Asn, Leu, Lys, Trp, Glu, Asp, His, or Cys
  misc_feature (9)..(9): Xaa can be Leu, Phe, Met, Tyr, Ile, Trp, Val, His, Lys, Ala, Arg, Cys, Thr, Ser, Gly, Gln, Glu, Pro, Asn, or Asp
FXSNSTNSX

SEQ ID NO: 182003 - protein, 10 aa, Artificial Sequence
  Description of Artificial Sequence: Synthetic peptide
  Seed: FYSNSTNSFR (TYRP1_HUMAN)
  misc_feature (2)..(2): Xaa can be Tyr, Phe, Trp, Met, Thr, Val, Ile, Leu, Ala, Ser, His, Gln, Glu, Pro, Lys, Gly, Asn, Asp, Cys, or Arg
  misc_feature (10)..(10): Xaa can be Lys, Arg, Tyr, Met, Leu, Phe, His, Val, Ile, Trp, Asn, Gly, Gln, Ser, Glu, Asp, Cys, Pro, Ala, or Thr
FXSNSTNSFX

SEQ ID NO: 182004 - protein, 9 aa, Artificial Sequence
  Description of Artificial Sequence: Synthetic peptide
  Seed: GAACDQRVL (TYRP1_HUMAN)
  misc_feature (2)..(2): Xaa can be Ala, Ser, Val, Thr, Ile, Gln, Gly, Met, Glu, Leu, or Asp
  misc_feature (9)..(9): Xaa can be Tyr, Phe, Lys, Met, Leu, Ile, Val, Arg, or His
GXACDQRVX

SEQ ID NO: 182005 - protein, 8 aa, Artificial Sequence
  Description of Artificial Sequence: Synthetic peptide
  Seed: GALLLVAL (TYRP1_HUMAN)
  misc_feature (2)..(2): Xaa can be Gln, Ala, Ser, Glu, Asn, Asp, or Gly
  misc_feature (8)..(8): Xaa can be Val, Ile, Leu, Phe, Tyr, or Met
GXLLLVAX

SEQ ID NO: 182006 - protein, 9 aa, Artificial Sequence
  Description of Artificial Sequence: Synthetic peptide
  Seed: GALLLVALI (TYRP1_HUMAN)
  misc_feature (2)..(2): Xaa can be Gln, Met, Leu, Ile, Ala, Ser, Thr, Val, or Glu
  misc_feature (9)..(9): Xaa can be Leu, Val, Ile, Met, Ala, Thr, Cys, Phe, or Trp
GXLLLVALX

SEQ ID NO: 182007 - protein, 9 aa, Artificial Sequence
  Description of Artificial Sequence: Synthetic peptide
  Seed: GCIFFPLLL (TYRP1_HUMAN)
  misc_feature (2)..(2): Xaa can be Ala, Ser, Thr, Gly, Val, Ile, Asn, Gln, Cys, Met, or Leu
  misc_feature (9)..(9): Xaa can be Leu, Met, Ile, Val, Tyr, Phe, Lys, Trp, or Arg
GXIFFPLLX

SEQ ID NO: 182008 - protein, 9 aa, Artificial Sequence
  Description of Artificial Sequence: Synthetic peptide
  Seed: GEVDFSHEG (TYRP1_HUMAN)
  misc_feature (2)..(2): Xaa can be Glu, Asp, Gln, Lys, Ala, Ser, Leu, Val, Gly, Arg, Ile, Thr, His, Asn, Pro, or Met
  misc_feature (9)..(9): Xaa can be Trp, Leu, Tyr, Met, Cys, Thr, Phe, Ile, Val, Pro, Ala, Ser, Gly, Arg, Lys, Gln, Asp, Asn, Glu, or His
GXVDFSHEX

SEQ ID NO: 182009 - protein, 10 aa, Artificial Sequence
  Description of Artificial Sequence: Synthetic peptide
  Seed: GEVDFSHEGP (TYRP1_HUMAN)
  misc_feature (2)..(2): Xaa can be Glu, Asp, or Gln
  misc_feature (10)..(10): Xaa can be Val, Phe, Cys, Met, Ile, Ala, Leu, Lys, Gln, Asp, Thr, Tyr, Gly, Glu, Pro, Arg, Ser, or Tr p
GXVDFSHEGX

SEQ ID NO: 182010 - protein, 11 aa, Artificial Sequence
  Description of Artificial Sequence: Synthetic peptide
  Seed: GEVDFSHEGPA (TYRP1_HUMAN)
  misc_feature (2)..(2): Xaa can be Glu, or Asp
  misc_feature (11)..(11): Xaa can be Leu, Ala, Met, Gly, Val, Cys, Thr, Pro, Trp, Ile, Phe, Ser, or Tyr
GXVDFSHEGPX

SEQ ID NO: 182011 - protein, 9 aa, Artificial Sequence
  Description of Artificial Sequence: Synthetic peptide
  Seed: GHNRQYNMV (TYRP1_HUMAN)
  misc_feature (2)..(2): Xaa can be , or His
  misc_feature (9)..(9): Xaa can be Trp, Met, Phe, Val, Leu, Ile, or Ala
GXNRQYNMX

SEQ ID NO: 182012 - protein, 10 aa, Artificial Sequence
  Description of Artificial Sequence: Synthetic peptide
  Seed: GKYDPAVRSL (TYRP1_HUMAN)
  misc_feature (2)..(2): Xaa can be Arg, His, Gln, Glu, Lys, Tyr, Ala, Met, Pro, Leu, Val, Ser, Asn, Ile, Phe, Gly, Asp, Thr, Trp, or Cys
  misc_feature (10)..(10): Xaa can be Leu, Tyr, Met, Phe, Ile, Val, Trp, His, Ala, Cys, Lys, Arg, Thr, Pro, Ser, Gly, Gln, Asp, Asn, or Glu
GXYDPAVRSX

SEQ ID NO: 182013 - protein, 8 aa, Artificial Sequence
  Description of Artificial Sequence: Synthetic peptide
  Seed: GLFDTPPF (TYRP1_HUMAN)
  misc_feature (2)..(2): Xaa can be Gln, Met, Lys, His, Ala, Leu, Ser, Ile, Val, Thr, or Glu
  misc_feature (8)..(8): Xaa can be Tyr, Phe, Met, Leu, Trp, or Ile
GXFDTPPX

SEQ ID NO: 182014 - protein, 9 aa, Artificial Sequence
  Description of Artificial Sequence: Synthetic peptide
  Seed: GLFDTPPFY (TYRP1_HUMAN)
  misc_feature (2)..(2): Xaa can be Leu, Met, Arg, Val, Ile, Ala, Thr, Gln, Ser, Tyr, Gly, Phe, Asn, Lys, Glu, Cys, His, Trp, Pro, or Asp
  misc_feature (9)..(9): Xaa can be Tyr, Phe, Arg, Met, Lys, Leu, Ile, Val, Trp, His, Ala, Thr, Cys, Pro, Gly, Ser, or Gln
GXFDTPPFX

SEQ ID NO: 182015 - protein, 10 aa, Artificial Sequence
  Description of Artificial Sequence: Synthetic peptide
  Seed: GLFDTPPFYS (TYRP1_HUMAN)
  misc_feature (2)..(2): Xaa can be Met, Leu, Val, Ile, Ala, Gln, Thr, Ser, Glu, Cys, Phe, Tyr, Trp, Asn, or Gly
  misc_feature (10)..(10): Xaa can be Val, Leu, Ile, Met, Ala, Thr, Ser, Cys, Phe, Pro, Arg, Lys, Tyr, Gly, or Glu
GXFDTPPFYX

SEQ ID NO: 182016 - protein, 10 aa, Artificial Sequence
  Description of Artificial Sequence: Synthetic peptide
  Seed: GMCCPDLSPV (TYRP1_HUMAN)
  misc_feature (2)..(2): Xaa can be Met, Leu, Val, Ile, Gln, Thr, Ala, or Ser
  misc_feature (10)..(10): Xaa can be Val, Leu, Ile, Met, Ala, or Thr
GXCCPDLSPX

SEQ ID NO: 182017 - protein, 10 aa, Artificial Sequence
  Description of Artificial Sequence: Synthetic peptide
  Seed: GNVARPMVQR (TYRP1_HUMAN)
  misc_feature (2)..(2): Xaa can be Thr, Pro, Asn, Glu, Lys, Met, Ser, Gly, Cys, Asp, Ile, Ala, Val, Leu, Tyr, Phe, Gln, His, Trp, or Arg
  misc_feature (10)..(10): Xaa can be Lys, Arg, or Tyr
GXVARPMVQX

SEQ ID NO: 182018 - protein, 9 aa, Artificial Sequence
  Description of Artificial Sequence: Synthetic peptide
  Seed: GPAFLTWHR (TYRP1_HUMAN)
  misc_feature (2)..(2): Xaa can be Ala, Val, Ser, Thr, Ile, Trp, Tyr, Gln, Met, Leu, Pro, Glu, Asp, Cys, Asn, Gly, Phe, His, Arg, or Lys
  misc_feature (9)..(9): Xaa can be Arg, Lys, His, or Tyr
GXAFLTWHX

SEQ ID NO: 182019 - protein, 10 aa, Artificial Sequence
  Description of Artificial Sequence: Synthetic peptide
  Seed: GPAFLTWHRY (TYRP1_HUMAN)
  misc_feature (2)..(2): Xaa can be Tyr, Trp, Met, Thr, Gln, Ser, Phe, Gly, Arg, Glu, Asn, Lys, Ile, Cys, Asp, Ala, Leu, Val, Pro, or His
  misc_feature (10)..(10): Xaa can be Tyr, or Phe
GXAFLTWHRX

SEQ ID NO: 182020 - protein, 9 aa, Artificial Sequence
  Description of Artificial Sequence: Synthetic peptide
  Seed: GPDGNTPQF (TYRP1_HUMAN)
  misc_feature (2)..(2): Xaa can be Ala, Val, Thr, Phe, Ile, Ser, Tyr, Gly, Leu, Met, Arg, Pro, Trp, Gln, Asn, Cys, Asp, Lys, His, or Glu
  misc_feature (9)..(9): Xaa can be Phe, Tyr, Val, Ile, Leu, Met, Ala, Cys, Trp, Lys, Arg, Thr, Ser, or Pro
GXDGNTPQX

SEQ ID NO: 182021 - protein, 8 aa, Artificial Sequence
  Description of Artificial Sequence: Synthetic peptide
  Seed: GPIRRNPA (TYRP1_HUMAN)
  misc_feature (2)..(2): Xaa can be , or Pro
  misc_feature (8)..(8): Xaa can be Ile, Leu, Val, Phe, Met, or Ala
GXIRRNPX

SEQ ID NO: 182022 - protein, 9 aa, Artificial Sequence
  Description of Artificial Sequence: Synthetic peptide
  Seed: GPIRRNPAG (TYRP1_HUMAN)
  misc_feature (2)..(2): Xaa can be Pro, Ala, Val, Ile, Thr, or Ser
  misc_feature (9)..(9): Xaa can be Leu, Met, Ala, Phe, Val, Ile, Cys, His, Ser, Tyr, Thr, Gly, Pro, or Trp
GXIRRNPAX

SEQ ID NO: 182023 - protein, 11 aa, Artificial Sequence
  Description of Artificial Sequence: Synthetic peptide
  Seed: GPIRRNPAGNV (TYRP1_HUMAN)
  misc_feature (2)..(2): Xaa can be , or Pro
  misc_feature (11)..(11): Xaa can be Ile, Leu, Phe, Val, Met, Ala, or Cys
GXIRRNPAGNX

SEQ ID NO: 182024 - protein, 10 aa, Artificial Sequence
  Description of Artificial Sequence: Synthetic peptide
  Seed: GQESFGEVDF (TYRP1_HUMAN)
  misc_feature (2)..(2): Xaa can be Gln, Glu, Met, Leu, Lys, Pro, or Arg
  misc_feature (10)..(10): Xaa can be Tyr, Phe, Trp, Leu, Met, or Ile
GXESFGEVDX

SEQ ID NO: 182025 - protein, 11 aa, Artificial Sequence
  Description of Artificial Sequence: Synthetic peptide
  Seed: GRCEAVTADSR (TYRP1_HUMAN)
  misc_feature (2)..(2): Xaa can be , or Arg
  misc_feature (11)..(11): Xaa can be Val, Arg, Phe, Ile, Met, Tyr, His, Ala, Trp, Lys, or Leu
GXCEAVTADSX

SEQ ID NO: 182026 - protein, 10 aa, Artificial Sequence
  Description of Artificial Sequence: Synthetic peptide
  Seed: GRDDREVWPL (TYRP1_HUMAN)
  misc_feature (2)..(2): Xaa can be Arg, Tyr, Gln, Phe, His, Trp, Ala, or Met
  misc_feature (10)..(10): Xaa can be Leu, Phe, Met, Tyr, Ile, Arg, Lys, Val, His, or Trp
GXDDREVWPX

SEQ ID NO: 182027 - protein, 11 aa, Artificial Sequence
  Description of Artificial Sequence: Synthetic peptide
  Seed: GRDDREVWPLR (TYRP1_HUMAN)
  misc_feature (2)..(2): Xaa can be , or Arg
  misc_feature (11)..(11): Xaa can be Tyr, Phe, Arg, Lys, Met, Leu, or Trp
GXDDREVWPLX

SEQ ID NO: 182028 - protein, 10 aa, Artificial Sequence
  Description of Artificial Sequence: Synthetic peptide
  Seed: GRGRCEAVTA (TYRP1_HUMAN)
  misc_feature (2)..(2): Xaa can be , or Arg
  misc_feature (10)..(10): Xaa can be Leu, Ala, Ile, Met, Tyr, Phe, Val, or Trp
GXGRCEAVTX

SEQ ID NO: 182029 - protein, 9 aa, Artificial Sequence
  Description of Artificial Sequence: Synthetic peptide
  Seed: GSRSNFDST (TYRP1_HUMAN)
  misc_feature (2)..(2): Xaa can be Thr, Ser, Val, Met, Tyr, Ile, Ala, Phe, Gln, Gly, Leu, Cys, Trp, or Asn
  misc_feature (9)..(9): Xaa can be Lys, Ala, Val, Ile, Arg, Met, Tyr, Leu, Thr, Ser, Phe, Gly, or His
GXRSNFDSX

SEQ ID NO: 182030 - protein, 10 aa, Artificial Sequence
  Description of Artificial Sequence: Synthetic peptide
  Seed: GSRSNFDSTL (TYRP1_HUMAN)
  misc_feature (2)..(2): Xaa can be Thr, Ser, Val, Tyr, Ala, Arg, Ile, Asn, Phe, Gly, Leu, Met, Trp, Gln, His, Cys, Pro, Asp, Glu, or Lys
  misc_feature (10)..(10): Xaa can be Met, Phe, Leu, Ile, Lys, Ala, Val, Tyr, Arg, Ser, or Thr
GXRSNFDSTX

SEQ ID NO: 182031 - protein, 9 aa, Artificial Sequence
  Description of Artificial Sequence: Synthetic peptide
  Seed: GTASYLIRA (TYRP1_HUMAN)
  misc_feature (2)..(2): Xaa can be Met, Leu, Gln, Val, Ile, Ser, Thr, Ala, Gly, Cys, Phe, Asn, or Glu
  misc_feature (9)..(9): Xaa can be Leu, Val, Ile, Met, Ala, Thr, Cys, Phe, Gly, Ser, or Pro
GXASYLIRX

SEQ ID NO: 182032 - protein, 10 aa, Artificial Sequence
  Description of Artificial Sequence: Synthetic peptide
  Seed: GTASYLIRAR (TYRP1_HUMAN)
  misc_feature (2)..(2): Xaa can be Met, Thr, Ile, Gln, Tyr, Ser, Gly, Ala, Phe, Val, Trp, Leu, Asn, His, Glu, Arg, Pro, Lys, Asp, or Cys
  misc_feature (10)..(10): Xaa can be Arg, Lys, or Tyr
GXASYLIRAX

SEQ ID NO: 182033 - protein, 11 aa, Artificial Sequence
  Description of Artificial Sequence: Synthetic peptide
  Seed: GTASYLIRARR (TYRP1_HUMAN)
  misc_feature (2)..(2): Xaa can be Leu, Ile, Phe, Tyr, Gln, Val, Thr, Met, Ser, Ala, Pro, Gly, Lys, Arg, Cys, His, Asp, Glu, Trp, or Asn
  misc_feature (11)..(11): Xaa can be Arg, or Lys
GXASYLIRARX

SEQ ID NO: 182034 - protein, 10 aa, Artificial Sequence
  Description of Artificial Sequence: Synthetic peptide
  Seed: GTCRPGWRGA (TYRP1_HUMAN)
  misc_feature (2)..(2): Xaa can be Thr, Ser, Val, Ala, Tyr, Gln, Met, Leu, Ile, Gly, or Phe
  misc_feature (10)..(10): Xaa can be Lys, Ala, Val, Ile, Leu, Met, Ser, or Tyr
GXCRPGWRGX

SEQ ID NO: 182035 - protein, 11 aa, Artificial Sequence
  Description of Artificial Sequence: Synthetic peptide
  Seed: GTDRCGSSSGR (TYRP1_HUMAN)
  misc_feature (2)..(2): Xaa can be Thr, Ser, Ala, Val, Met, Ile, Gly, Glu, Phe, Asn, Leu, Gln, Asp, Tyr, Cys, or Trp
  misc_feature (11)..(11): Xaa can be Tyr, Lys, Arg, Trp, Phe, His, or Leu
GXDRCGSSSGX

SEQ ID NO: 182036 - protein, 10 aa, Artificial Sequence
  Description of Artificial Sequence: Synthetic peptide
  Seed: GVGQESFGEV (TYRP1_HUMAN)
  misc_feature (2)..(2): Xaa can be Leu, Met, Val, Ile, or Gln
  misc_feature (10)..(10): Xaa can be Val, Leu, Ile, Met, or Ala
GXGQESFGEX

SEQ ID NO: 182037 - protein, 10 aa, Artificial Sequence
  Description of Artificial Sequence: Synthetic peptide
  Seed: GWRGAACDQR (TYRP1_HUMAN)
  misc_feature (2)..(2): Xaa can be Thr, Tyr, Trp, Val, Phe, Leu, Ser, Ala, Met, or Ile
  misc_feature (10)..(10): Xaa can be , or Arg
GXRGAACDQX

SEQ ID NO: 182038 - protein, 9 aa, Artificial Sequence
  Description of Artificial Sequence: Synthetic peptide
  Seed: GYSDPTGKY (TYRP1_HUMAN)
  misc_feature (2)..(2): Xaa can be Ala, Arg, Ser, Val, Gln, Ile, Thr, Phe, Tyr, Met, Gly, Leu, Glu, Asn, Lys, Trp, His, Asp, Cys, or Pro
  misc_feature (9)..(9): Xaa can be Phe, Tyr, Met, Leu, Lys, Arg, Trp, His, Ile, Val, Ala, Cys, Gln, or Thr
GXSDPTGKX

SEQ ID NO: 182039 - protein, 11 aa, Artificial Sequence
  Description of Artificial Sequence: Synthetic peptide
  Seed: GYTYEIQWPSR (TYRP1_HUMAN)
  misc_feature (2)..(2): Xaa can be His, Tyr, Phe, Glu, Asn, Arg, Asp, Lys, Met, Trp, Ser, Thr, Cys, Val, Leu, Gly, Gln, Ile, or Ala
  misc_feature (11)..(11): Xaa can be Arg, or Lys
GXTYEIQWPSX

SEQ ID NO: 182040 - protein, 10 aa, Artificial Sequence
  Description of Artificial Sequence: Synthetic peptide
  Seed: HDGRDDREVW (TYRP1_HUMAN)
  misc_feature (2)..(2): Xaa can be Glu, Gln, Thr, Ser, Val, Cys, Asn, Leu, Asp, Gly, Ile, Met, Phe, Trp, Pro, or Ala
  misc_feature (10)..(10): Xaa can be Trp, Phe, Tyr, Met, Leu, or Ile
HXGRDDREVX

SEQ ID NO: 182041 - protein, 8 aa, Artificial Sequence
  Description of Artificial Sequence: Synthetic peptide
  Seed: HEGPAFLT (TYRP1_HUMAN)
  misc_feature (2)..(2): Xaa can be Glu, Asp, or Gln
  misc_feature (8)..(8): Xaa can be Leu, Ala, Phe, Ile, Val, Met, Gly, Cys, Ser, Thr, Pro, or Tyr
HXGPAFLX

SEQ ID NO: 182042 - protein, 9 aa, Artificial Sequence
  Description of Artificial Sequence: Synthetic peptide
  Seed: HEGPAFLTW (TYRP1_HUMAN)
  misc_feature (2)..(2): Xaa can be Glu, Ala, Ser, His, Gln, Asp, Val, Ile, Thr, Leu, Pro, Gly, Met, Asn, Arg, Cys, Lys, Tyr, Phe, or Trp
  misc_feature (9)..(9): Xaa can be Trp, Met, Tyr, Phe, Leu, Ile, Val, His, Ala, Cys, Lys, Arg, Thr, Gln, Ser, Pro, Gly, Glu, Asn, or Asp
HXGPAFLTX

SEQ ID NO: 182043 - protein, 11 aa, Artificial Sequence
  Description of Artificial Sequence: Synthetic peptide
  Seed: HEGPAFLTWHR (TYRP1_HUMAN)
  misc_feature (2)..(2): Xaa can be Ser, Met, Leu, Ile, Phe, Thr, Ala, Asn, Val, Gly, Cys, Lys, Pro, Tyr, Glu, Asp, Trp, Gln, His, or Arg
  misc_feature (11)..(11): Xaa can be Arg, or Lys
HXGPAFLTWHX

SEQ ID NO: 182044 - protein, 8 aa, Artificial Sequence
  Description of Artificial Sequence: Synthetic peptide
  Seed: HFVRALDM (TYRP1_HUMAN)
  misc_feature (2)..(2): Xaa can be Phe, or Tyr
  misc_feature (8)..(8): Xaa can be Met, Leu, Tyr, or Phe
HXVRALDX

SEQ ID NO: 182045 - protein, 10 aa, Artificial Sequence
  Description of Artificial Sequence: Synthetic peptide
  Seed: HFVRALDMAK (TYRP1_HUMAN)
  misc_feature (2)..(2): Xaa can be Thr, Arg, Ser, Met, Lys, Trp, Phe, Tyr, Ala, Ile, Asn, Val, Gly, Gln, Leu, Asp, Pro, Cys, His, or Glu
  misc_feature (10)..(10): Xaa can be Ala, Lys, Arg, Val, Ile, Tyr, Leu, or Met
HXVRALDMAX

SEQ ID NO: 182046 - protein, 11 aa, Artificial Sequence
  Description of Artificial Sequence: Synthetic peptide
  Seed: HFVRALDMAKR (TYRP1_HUMAN)
  misc_feature (2)..(2): Xaa can be Ile, Tyr, Ser, Met, Ala, Phe, Arg, Thr, Lys, Trp, or Val
  misc_feature (11)..(11): Xaa can be , or Arg
HXVRALDMAKX

SEQ ID NO: 182047 - protein, 9 aa, Artificial Sequence
  Description of Artificial Sequence: Synthetic peptide
  Seed: HLSPNDPIF (TYRP1_HUMAN)
  misc_feature (2)..(2): Xaa can be Pro, Ala, Gln, Arg, Ser, His, Met, Val, Tyr, Thr, Ile, Leu, Gly, Phe, Glu, Asn, Asp, Cys, Trp, or Lys
  misc_feature (9)..(9): Xaa can be Met, Phe, Tyr, Leu, Trp, Ile, Lys, Arg, Val, His, Ala, Cys, Thr, or Gln
HXSPNDPIX

SEQ ID NO: 182048 - protein, 10 aa, Artificial Sequence
  Description of Artificial Sequence: Synthetic peptide
  Seed: HLSPNDPIFV (TYRP1_HUMAN)
  misc_feature (2)..(2): Xaa can be Leu, Gln, Ala, Met, Thr, Val, Ile, Ser, Gly, Glu, Pro, Cys, Phe, Asn, Tyr, Trp, Lys, or Ar g
  misc_feature (10)..(10): Xaa can be Leu, Met, Phe, Trp, Val, Ile, Tyr, Ala, Thr, or Cys
HXSPNDPIFX

SEQ ID NO: 182049 - protein, 11 aa, Artificial Sequence
  Description of Artificial Sequence: Synthetic peptide
  Seed: HLSPNDPIFVL (TYRP1_HUMAN)
  misc_feature (2)..(2): Xaa can be Arg, Ala, Leu, Ile, Met, Gln, Val, Tyr, Pro, Gly, Thr, Ser, Phe, Glu, His, Trp, Cys, Lys, Asn, or Asp
  misc_feature (11)..(11): Xaa can be Phe, Tyr, Met, Lys, Leu, Arg, Trp, Ile, Val, His, Ala, Cys, or Gln
HXSPNDPIFVX

SEQ ID NO: 182050 - protein, 10 aa, Artificial Sequence
  Description of Artificial Sequence: Synthetic peptide
  Seed: HNCGTCRPGW (TYRP1_HUMAN)
  misc_feature (2)..(2): Xaa can be Thr, Ser, Ala, Val, Cys, Tyr, Asn, Phe, Ile, Glu, Gly, Pro, Lys, Gln, Trp, Met, Leu, or As p
  misc_feature (10)..(10): Xaa can be Trp, Phe, Leu, or Tyr
HXCGTCRPGX

SEQ ID NO: 182051 - protein, 8 aa, Artificial Sequence
  Description of Artificial Sequence: Synthetic peptide
  Seed: HNLAHLFL (TYRP1_HUMAN)
  misc_feature (2)..(2): Xaa can be Arg, His, Gln, Asp, Ser, Asn, Lys, Ala, Glu, or Pro
  misc_feature (8)..(8): Xaa can be Leu, Ile, Met, Val, or Phe
HXLAHLFX

SEQ ID NO: 182052 - protein, 10 aa, Artificial Sequence
  Description of Artificial Sequence: Synthetic peptide
  Seed: HNRQYNMVPF (TYRP1_HUMAN)
  misc_feature (2)..(2): Xaa can be Gln, Met, Arg, Thr, Cys, Pro, Asn, Val, His, Asp, Lys, Leu, Ala, Gly, Ser, Tyr, Trp, Glu, Phe, or Ile
  misc_feature (10)..(10): Xaa can be Ile, Phe, Met, Leu, Tyr, Trp, His, Val, or Ala
HXRQYNMVPX

SEQ ID NO: 182053 - protein, 8 aa, Artificial Sequence
  Description of Artificial Sequence: Synthetic peptide
  Seed: HPLFVIAT (TYRP1_HUMAN)
  misc_feature (2)..(2): Xaa can be Pro, or Ala
  misc_feature (8)..(8): Xaa can be Ala, Tyr, Cys, Thr, Gly, Leu, Ile, Lys, Met, Ser, Phe, Val, or Pro
HXLFVIAX

SEQ ID NO: 182054 - protein, 9 aa, Artificial Sequence
  Description of Artificial Sequence: Synthetic peptide
  Seed: HPLFVIATR (TYRP1_HUMAN)
  misc_feature (2)..(2): Xaa can be Pro, Ala, Thr, Val, Ser, Ile, Gly, Met, Tyr, Leu, Asn, Glu, Gln, Asp, Phe, Trp, Cys, His, Lys, or Arg
  misc_feature (9)..(9): Xaa can be Arg, Lys, Leu, Tyr, His, Ala, Phe, Met, Val, Cys, Gln, Ile, Ser, Gly, Thr, Glu, Trp, Pro, or Asn
HXLFVIATX

SEQ ID NO: 182055 - protein, 10 aa, Artificial Sequence
  Description of Artificial Sequence: Synthetic peptide
  Seed: HPLFVIATRR (TYRP1_HUMAN)
  misc_feature (2)..(2): Xaa can be Val, Tyr, Phe, Ser, Thr, Met, Ala, Ile, Trp, Asn, Asp, Arg, Lys, Glu, Gly, Pro, Gln, His, Cys, or Leu
  misc_feature (10)..(10): Xaa can be Arg, Lys, Tyr, His, Met, Leu, Ile, Phe, Val, Trp, Glu, Pro, Thr, Cys, Asp, Gly, Ser, Gln, Ala, or Asn
HXLFVIATRX

SEQ ID NO: 182056 - protein, 8 aa, Artificial Sequence
  Description of Artificial Sequence: Synthetic peptide
  Seed: HRYHLLRL (TYRP1_HUMAN)
  misc_feature (2)..(2): Xaa can be His, Arg, Gln, Tyr, Glu, Phe, Pro, Asp, or Ala
  misc_feature (8)..(8): Xaa can be Leu, Phe, Tyr, Ala, Val, Met, Ile, Cys, Thr, Ser, Arg, Lys, Gly, Trp, or Pro
HXYHLLRX

SEQ ID NO: 182057 - protein, 9 aa, Artificial Sequence
  Description of Artificial Sequence: Synthetic peptide
  Seed: HRYHLLRLE (TYRP1_HUMAN)
  misc_feature (2)..(2): Xaa can be Arg, Gln, or Lys
  misc_feature (9)..(9): Xaa can be Lys, Tyr, Arg, Phe, Ile, Met, Leu, Cys, Trp, Gly, His, Asn, Ser, Val, Glu, Ala, Pro, Gln, or Thr
HXYHLLRLX

SEQ ID NO: 182058 - protein, 10 aa, Artificial Sequence
  Description of Artificial Sequence: Synthetic peptide
  Seed: HRYHLLRLEK (TYRP1_HUMAN)
  misc_feature (2)..(2): Xaa can be Arg, Tyr, Gln, Thr, Ser, His, Lys, Phe, Val, Ile, Leu, Glu, Trp, Pro, Ala, Asn, Asp, Met, Cys, or Gly
  misc_feature (10)..(10): Xaa can be Arg, Lys, Phe, Tyr, Ala, Leu, Ile, Met, Val, His, Thr, Gln, Glu, Trp, Ser, Gly, or Cys
HXYHLLRLEX

SEQ ID NO: 182059 - protein, 11 aa, Artificial Sequence
  Description of Artificial Sequence: Synthetic peptide
  Seed: HRYHLLRLEKD (TYRP1_HUMAN)
  misc_feature (2)..(2): Xaa can be , or Arg
  misc_feature (11)..(11): Xaa can be Ser, Ile, Gln, Asp, Tyr, Phe, Arg, His, Thr, Ala, Cys, Leu, Pro, Trp, Asn, Gly, Val, Met, Lys, or Glu
HXYHLLRLEKX

SEQ ID NO: 182060 - protein, 10 aa, Artificial Sequence
  Description of Artificial Sequence: Synthetic peptide
  Seed: HSPQYPHDGR (TYRP1_HUMAN)
  misc_feature (2)..(2): Xaa can be Val, Ser, Thr, Ala, Ile, Met, Phe, Tyr, Leu, Gly, Gln, Asn, or Trp
  misc_feature (10)..(10): Xaa can be Arg, Lys, Phe, Tyr, Met, or Leu
HXPQYPHDGX

SEQ ID NO: 182061 - protein, 8 aa, Artificial Sequence
  Description of Artificial Sequence: Synthetic peptide
  Seed: HTFTDAVF (TYRP1_HUMAN)
  misc_feature (2)..(2): Xaa can be Ala, Gln, Ser, Thr, Met, Val, Leu, Ile, Lys, Arg, Tyr, Gly, Phe, Glu, or His
  misc_feature (8)..(8): Xaa can be Tyr, Phe, Met, Trp, Lys, Leu, Val, Ile, or His
HXFTDAVX

SEQ ID NO: 182062 - protein, 11 aa, Artificial Sequence
  Description of Artificial Sequence: Synthetic peptide
  Seed: HTFTDAVFDEW (TYRP1_HUMAN)
  misc_feature (2)..(2): Xaa can be Thr, Gln, Met, Ser, Leu, Ala, Ile, Val, Pro, Gly, Glu, Asn, Cys, Asp, Phe, Tyr, Arg, Lys, His, or Trp
  misc_feature (11)..(11): Xaa can be Trp, Tyr, Lys, Phe, Leu, Arg, Met, Ile, Val, or His
HXFTDAVFDEX

SEQ ID NO: 182063 - protein, 9 aa, Artificial Sequence
  Description of Artificial Sequence: Synthetic peptide
  Seed: HYYSVKKTF (TYRP1_HUMAN)
  misc_feature (2)..(2): Xaa can be Arg, Gln, His, Ala, Ser, Tyr, Met, Phe, Thr, Val, Ile, Leu, Glu, Lys, Pro, Asp, Gly, Trp, Cys, or Asn
  misc_feature (9)..(9): Xaa can be Phe, Met, Val, Tyr, Leu, Ile, Trp, His, Ala, Cys, Arg, Thr, Gln, Lys, Ser, or Pro
HXYSVKKTX

SEQ ID NO: 182064 - protein, 10 aa, Artificial Sequence
  Description of Artificial Sequence: Synthetic peptide
  Seed: HYYSVKKTFL (TYRP1_HUMAN)
  misc_feature (2)..(2): Xaa can be Arg, Tyr, Phe, Trp, Gln, Glu, Ala, Lys, Met, His, Ser, Thr, Asn, Asp, Cys, Ile, Leu, Pro, Val, or Gly
  misc_feature (10)..(10): Xaa can be Phe, Tyr, Leu, Met, Ile, Val, Trp, His, Lys, Arg, Thr, Cys, or Ala
HXYSVKKTFX

SEQ ID NO: 182065 - protein, 9 aa, Artificial Sequence
  Description of Artificial Sequence: Synthetic peptide
  Seed: IAIAVVGAL (TYRP1_HUMAN)
  misc_feature (2)..(2): Xaa can be Pro, Gln, Ala, Met, Arg, Tyr, Leu, Thr, Gly, Val, Ser, Ile, Phe, Asn, Glu, Asp, Lys, His, Trp, or Cys
  misc_feature (9)..(9): Xaa can be Tyr, Phe, Trp, Met, Leu, Lys, Ile, Val, His, Arg, Ala, Thr, Cys, Ser, Gly, Asn, Gln, Glu, or Pro
IXIAVVGAX

SEQ ID NO: 182066 - protein, 10 aa, Artificial Sequence
  Description of Artificial Sequence: Synthetic peptide
  Seed: IAIAVVGALL (TYRP1_HUMAN)
  misc_feature (2)..(2): Xaa can be Leu, Met, Thr, Ser, Ala, Gln, Val, Ile, Gly, Cys, Glu, Asn, Phe, Asp, Pro, Tyr, Arg, Lys, Trp, or His
  misc_feature (10)..(10): Xaa can be Leu, Val, Ile, Trp, Lys, Arg, Phe, Tyr, Ala, Met, Thr, His, Ser, Pro, Cys, Gly, Asn, Glu, Asp, or Gln
IXIAVVGALX

SEQ ID NO: 182067 - protein, 11 aa, Artificial Sequence
  Description of Artificial Sequence: Synthetic peptide
  Seed: IAIAVVGALLL (TYRP1_HUMAN)
  misc_feature (2)..(2): Xaa can be Thr, Ser, Ala, Gly, Ile, Asn, Val, Leu, Met, Glu, Cys, Asp, Gln, or Pro
  misc_feature (11)..(11): Xaa can be Trp, Phe, Lys, Met, Leu, Tyr, Ile, Arg, Val, or Cys
IXIAVVGALLX

SEQ ID NO: 182068 - protein, 9 aa, Artificial Sequence
  Description of Artificial Sequence: Synthetic peptide
  Seed: IATRRSEEI (TYRP1_HUMAN)
  misc_feature (2)..(2): Xaa can be Arg, Ala, Gln, Thr, Phe, Ser, Val, Met, Ile, Asn, Pro, Cys, Glu, Tyr, Leu, Gly, Asp, His, Lys, or Trp
  misc_feature (9)..(9): Xaa can be Leu, Met, Ile, Phe, Tyr, Trp, Val, Lys, His, or Arg
IXTRRSEEX

SEQ ID NO: 182069 - protein, 8 aa, Artificial Sequence
  Description of Artificial Sequence: Synthetic peptide
  Seed: IAVVGALL (TYRP1_HUMAN)
  misc_feature (2)..(2): Xaa can be Ala, Ser, Gly, Thr, Pro, Val, Gln, Ile, Asn, Leu, Met, Glu, Asp, His, Cys, Arg, Tyr, or Ph e
  misc_feature (8)..(8): Xaa can be Leu, Val, Ile, Lys, Phe, Tyr, Met, Arg, His, Cys, or Ala
IXVVGALX

SEQ ID NO: 182070 - protein, 9 aa, Artificial Sequence
  Description of Artificial Sequence: Synthetic peptide
  Seed: IAVVGALLL (TYRP1_HUMAN)
  misc_feature (2)..(2): Xaa can be Pro, Gln, Ala, Ser, Thr, Arg, Met, Val, Leu, Tyr, Gly, Ile, Asn, Glu, Phe, Asp, Lys, Trp, Cys, or His
  misc_feature (9)..(9): Xaa can be Leu, Phe, Val, Tyr, Trp, Ile, Met, His, Lys, Arg, Ala, Cys, Thr, Pro, Gln, or Ser
IXVVGALLX

SEQ ID NO: 182071 - protein, 10 aa, Artificial Sequence
  Description of Artificial Sequence: Synthetic peptide
  Seed: IAVVGALLLV (TYRP1_HUMAN)
  misc_feature (2)..(2): Xaa can be Ala, Ser, Thr, Gln, Met, Leu, Ile, Gly, Phe, Asp, Val, Tyr, Glu, Pro, Lys, Asn, Trp, His, Arg, or Cys
  misc_feature (10)..(10): Xaa can be Leu, Ala, Ile, Val, Met, Thr, Lys, Phe, or Tyr
IXVVGALLLX

SEQ ID NO: 182072 - protein, 8 aa, Artificial Sequence
  Description of Artificial Sequence: Synthetic peptide
  Seed: IFFPLLLF (TYRP1_HUMAN)
  misc_feature (2)..(2): Xaa can be Tyr, Arg, Phe, Trp, His, Ala, Met, Gln, Val, Ile, Thr, Leu, Ser, or Asn
  misc_feature (8)..(8): Xaa can be Tyr, Leu, Phe, Met, Ile, Trp, or Val
IXFPLLLX

SEQ ID NO: 182073 - protein, 8 aa, Artificial Sequence
  Description of Artificial Sequence: Synthetic peptide
  Seed: IFGTASYL (TYRP1_HUMAN)
  misc_feature (2)..(2): Xaa can be Ala, Tyr, Phe, Thr, Ser, Val, Trp, Arg, Gly, His, Ile, Asp, Asn, Glu, or Gln
  misc_feature (8)..(8): Xaa can be Leu, Tyr, Phe, Met, Val, Ile, or Trp
IXGTASYX

SEQ ID NO: 182074 - protein, 9 aa, Artificial Sequence
  Description of Artificial Sequence: Synthetic peptide
  Seed: IFGTASYLI (TYRP1_HUMAN)
  misc_feature (2)..(2): Xaa can be Tyr, Phe, Trp, Met, Leu, His, Val, Thr, Ile, Gln, Cys, Arg, Ser, Ala, Asn, or Gly
  misc_feature (9)..(9): Xaa can be Phe, Trp, Leu, Ile, Met, Val, Tyr, Cys, Gly, or Ala
IXGTASYLX

SEQ ID NO: 182075 - protein, 10 aa, Artificial Sequence
  Description of Artificial Sequence: Synthetic peptide
  Seed: IFGTASYLIR (TYRP1_HUMAN)
  misc_feature (2)..(2): Xaa can be Val, Leu, Thr, Met, Trp, Ile, Phe, Tyr, Asn, Asp, Pro, Arg, Ser, Cys, His, Lys, Glu, Gln, Gly, or Ala
  misc_feature (10)..(10): Xaa can be Arg, or Lys
IXGTASYLIX

SEQ ID NO: 182076 - protein, 8 aa, Artificial Sequence
  Description of Artificial Sequence: Synthetic peptide
  Seed: IFVLLHTF (TYRP1_HUMAN)
  misc_feature (2)..(2): Xaa can be Tyr, Phe, Trp, Arg, or His
  misc_feature (8)..(8): Xaa can be Phe, Tyr, Leu, Met, Ile, Trp, or Val
IXVLLHTX

SEQ ID NO: 182077 - protein, 9 aa, Artificial Sequence
  Description of Artificial Sequence: Synthetic peptide
  Seed: IGHNRQYNM (TYRP1_HUMAN)
  misc_feature (2)..(2): Xaa can be Arg, Thr, Ala, Ser, Ile, His, Asn, Tyr, Val, Gln, Phe, Gly, Glu, Met, Asp, Leu, Lys, Cys, Trp, or Pro
  misc_feature (9)..(9): Xaa can be Leu, Phe, Met, Tyr, Ile, Val, Trp, His, or Lys
IXHNRQYNX

SEQ ID NO: 182078 - protein, 9 aa, Artificial Sequence
  Description of Artificial Sequence: Synthetic peptide
  Seed: IIAIAVVGA (TYRP1_HUMAN)
  misc_feature (2)..(2): Xaa can be Met, Leu, Gln, Ile, Thr, Val, Ser, Ala, Asn, or Gly
  misc_feature (9)..(9): Xaa can be Val, Ala, Leu, Ile, Met, Thr, Cys, Ser, Gly, or Phe
IXAIAVVGX

SEQ ID NO: 182079 - protein, 10 aa, Artificial Sequence
  Description of Artificial Sequence: Synthetic peptide
  Seed: IIAIAVVGAL (TYRP1_HUMAN)
  misc_feature (2)..(2): Xaa can be Met, Leu, Gln, Thr, Ile, Val, Tyr, Ser, Ala, or Phe
  misc_feature (10)..(10): Xaa can be Val, Leu, Ala, Ile, Met, Ser, Pro, Thr, Cys, Phe, or Gly
IXAIAVVGAX

SEQ ID NO: 182080 - protein, 11 aa, Artificial Sequence
  Description of Artificial Sequence: Synthetic peptide
  Seed: ILGPDGNTPQF (TYRP1_HUMAN)
  misc_feature (2)..(2): Xaa can be Ala, Gln, Met, Leu, Tyr, Ile, Ser, Arg, Thr, Gly, Val, Glu, Trp, Pro, Phe, Cys, Asn, His, Asp, or Lys
  misc_feature (11)..(11): Xaa can be Tyr, Trp, Phe, Leu, Lys, Met, Ile, Arg, Val, His, Cys, Ala, or Gln
IXGPDGNTPQX

SEQ ID NO: 182081 - protein, 8 aa, Artificial Sequence
  Description of Artificial Sequence: Synthetic peptide
  Seed: IQWPSREF (TYRP1_HUMAN)
  misc_feature (2)..(2): Xaa can be Ala, Gln, Ser, Glu, Arg, Thr, Gly, Ile, Val, Asp, Phe, Tyr, Lys, Met, Asn, His, Pro, Leu, Cys, or Trp
  misc_feature (8)..(8): Xaa can be Met, Tyr, Phe, Leu, Ile, Val, His, Trp, Ala, Lys, Cys, Thr, Gln, or Arg
IXWPSREX

SEQ ID NO: 182082 - protein, 10 aa, Artificial Sequence
  Description of Artificial Sequence: Synthetic peptide
  Seed: IQWPSREFSV (TYRP1_HUMAN)
  misc_feature (2)..(2): Xaa can be Leu, Met, Gln, Glu, Ile, Val, Thr, Ser, or Ala
  misc_feature (10)..(10): Xaa can be Val, Leu, Ile, Ala, Met, Phe, Trp, Cys, Thr, Ser, or Tyr
IXWPSREFSX

SEQ ID NO: 182083 - protein, 9 aa, Artificial Sequence
  Description of Artificial Sequence: Synthetic peptide
  Seed: IRRNPAGNV (TYRP1_HUMAN)
  misc_feature (2)..(2): Xaa can be Arg, Tyr, Ala, Gln, Phe, Gly, Trp, Ser, Met, His, Thr, Ile, Leu, Lys, Val, Asn, or Cys
  misc_feature (9)..(9): Xaa can be Leu, Ile, Phe, Tyr, Met, Lys, Arg, Trp, Val, or His
IXRNPAGNX

SEQ ID NO: 182084 - protein, 10 aa, Artificial Sequence
  Description of Artificial Sequence: Synthetic peptide
  Seed: IRRNPAGNVA (TYRP1_HUMAN)
  misc_feature (2)..(2): Xaa can be Arg, His, Gln, Pro, or Lys
  misc_feature (10)..(10): Xaa can be Leu, Val, Ala, Cys, Phe, Met, Ile, Thr, Pro, Tyr, or Trp
IXRNPAGNVX

SEQ ID NO: 182085 - protein, 11 aa, Artificial Sequence
  Description of Artificial Sequence: Synthetic peptide
  Seed: IRRNPAGNVAR (TYRP1_HUMAN)
  misc_feature (2)..(2): Xaa can be Arg, Tyr, Gln, Gly, Val, Ala, Met, Phe, Ser, Lys, His, Trp, Leu, Thr, Ile, Pro, Glu, or As n
  misc_feature (11)..(11): Xaa can be Phe, Leu, Met, Tyr, Lys, Trp, Ile, His, Arg, Cys, Gln, Val, or Ala
IXRNPAGNVAX

SEQ ID NO: 182086 - protein, 9 aa, Artificial Sequence
  Description of Artificial Sequence: Synthetic peptide
  Seed: ISIYNYFVW (TYRP1_HUMAN)
  misc_feature (2)..(2): Xaa can be Gln, Tyr, Lys, Met, Ala, Trp, Ser, Thr, Glu, Pro, His, Phe, Leu, Arg, Ile, Val, Asn, Gly, Cys, or Asp
  misc_feature (9)..(9): Xaa can be Trp, Phe, Tyr, Leu, Met, Ile, Val, His, Ala, Gly, Thr, Cys, Ser, or Lys
IXIYNYFVX

SEQ ID NO: 182087 - protein, 10 aa, Artificial Sequence
  Description of Artificial Sequence: Synthetic peptide
  Seed: ISIYNYFVWT (TYRP1_HUMAN)
  misc_feature (2)..(2): Xaa can be Ser, Thr, Ala, Cys, Asn, Pro, Leu, Ile, Gly, Val, Gln, or Met
  misc_feature (10)..(10): Xaa can be Trp, Leu, Arg, Tyr, Val, Lys, Cys, Glu, Phe, Asn, Ile, Gly, Ser, Met, Thr, Ala, Pro, Gln, Asp, or His
IXIYNYFVWX

SEQ ID NO: 182088 - protein, 10 aa, Artificial Sequence
  Description of Artificial Sequence: Synthetic peptide
  Seed: ISPNSVFSQW (TYRP1_HUMAN)
  misc_feature (2)..(2): Xaa can be Ala, Thr, Ser, Val, Ile, Gln, Gly, Leu, Met, Pro, Cys, Phe, Tyr, Asn, Glu, Asp, His, Lys, Arg, or Trp
  misc_feature (10)..(10): Xaa can be Trp, Phe, Tyr, Leu, Met, Lys, Arg, Val, or Ile
IXPNSVFSQX

SEQ ID NO: 182089 - protein, 11 aa, Artificial Sequence
  Description of Artificial Sequence: Synthetic peptide
  Seed: ISPNSVFSQWR (TYRP1_HUMAN)
  misc_feature (2)..(2): Xaa can be Ser, Thr, Met, Tyr, Phe, Val, Ile, Ala, Gln, Leu, or Trp
  misc_feature (11)..(11): Xaa can be Arg, Lys, Trp, Asp, Tyr, Gly, Asn, Gln, Thr, Ile, Ala, Cys, Leu, Met, His, Val, Pro, Ser, Glu, or Phe
IXPNSVFSQWX

SEQ ID NO: 182090 - protein, 9 aa, Artificial Sequence
  Description of Artificial Sequence: Synthetic peptide
  Seed: IVRRNLLDL (TYRP1_HUMAN)
  misc_feature (2)..(2): Xaa can be Thr, Ser, Ala, Val, Pro, Ile, Gln, Met, Arg, Asn, Leu, Gly, Phe, Tyr, Glu, Cys, Asp, Trp, or Lys
  misc_feature (9)..(9): Xaa can be Leu, Ile, Tyr, Lys, Phe, Val, Met, Ala, Ser, Arg, Thr, Cys, His, or Gly
IXRRNLLDX

SEQ ID NO: 182091 - protein, 11 aa, Artificial Sequence
  Description of Artificial Sequence: Synthetic peptide
  Seed: IVRRNLLDLSK (TYRP1_HUMAN)
  misc_feature (2)..(2): Xaa can be Thr, Phe, Met, Gln, Val, Tyr, Ser, or Ala
  misc_feature (11)..(11): Xaa can be Lys, or Ala
IXRRNLLDLSX

SEQ ID NO: 182092 - protein, 9 aa, Artificial Sequence
  Description of Artificial Sequence: Synthetic peptide
  Seed: IYNYFVWTH (TYRP1_HUMAN)
  misc_feature (2)..(2): Xaa can be Tyr, Phe, Trp, Met, Val, Ile, Thr, Leu, Ala, Gln, His, Ser, Cys, Gly, Asn, Lys, Arg, Pro, Glu, or Asp
  misc_feature (9)..(9): Xaa can be Arg, Lys, His, Phe, Tyr, Leu, Ile, Met, Val, or Trp
IXNYFVWTX

SEQ ID NO: 182093 - protein, 10 aa, Artificial Sequence
  Description of Artificial Sequence: Synthetic peptide
  Seed: IYNYFVWTHY (TYRP1_HUMAN)
  misc_feature (2)..(2): Xaa can be Trp, Tyr, Phe, Gln, Met, Thr, His, Ser, Cys, Glu, Pro, Ile, Leu, Asp, Lys, Asn, Ala, Arg, Val, or Gly
  misc_feature (10)..(10): Xaa can be Tyr, Phe, Ile, Leu, Trp, Met, or Val
IXNYFVWTHX

SEQ ID NO: 182094 - protein, 11 aa, Artificial Sequence
  Description of Artificial Sequence: Synthetic peptide
  Seed: IYNYFVWTHYY (TYRP1_HUMAN)
  misc_feature (2)..(2): Xaa can be Ser, Tyr, Val, Cys, Gln, Met, His, Arg, Pro, Ile, Glu, Lys, Ala, Asp, Trp, Asn, Thr, Leu, Gly, or Phe
  misc_feature (11)..(11): Xaa can be Met, Leu, Ile, Trp, Phe, Tyr, or Val
IXNYFVWTHYX

SEQ ID NO: 182095 - protein, 8 aa, Artificial Sequence
  Description of Artificial Sequence: Synthetic peptide
  Seed: KEEKNHFV (TYRP1_HUMAN)
  misc_feature (2)..(2): Xaa can be Glu, Asp, or Gln
  misc_feature (8)..(8): Xaa can be Leu, Phe, Ile, Met, Tyr, Thr, Pro, Cys, Val, Ala, or Trp
KXEKNHFX

SEQ ID NO: 182096 - protein, 9 aa, Artificial Sequence
  Description of Artificial Sequence: Synthetic peptide
  Seed: KEEKNHFVR (TYRP1_HUMAN)
  misc_feature (2)..(2): Xaa can be Glu, Asp, or Gln
  misc_feature (9)..(9): Xaa can be Ile, Trp, Met, Leu, Tyr, Val, Phe, Arg, His, Cys, Ala, or Thr
KXEKNHFVX

SEQ ID NO: 182097 - protein, 10 aa, Artificial Sequence
  Description of Artificial Sequence: Synthetic peptide
  Seed: KEEKNHFVRA (TYRP1_HUMAN)
  misc_feature (2)..(2): Xaa can be Glu, Asp, or Gln
  misc_feature (10)..(10): Xaa can be Met, Phe, Leu, Val, Ala, Ile, Ser, Tyr, Thr, Gly, Cys, Trp, or Pro
KXEKNHFVRX

SEQ ID NO: 182098 - protein, 11 aa, Artificial Sequence
  Description of Artificial Sequence: Synthetic peptide
  Seed: KEEKNHFVRAL (TYRP1_HUMAN)
  misc_feature (2)..(2): Xaa can be Glu, Asp, Gln, Trp, or Arg
  misc_feature (11)..(11): Xaa can be Leu, Tyr, Trp, Phe, Met, Pro, Val, His, Ile, Cys, Gly, Thr, Ser, or Ala
KXEKNHFVRAX

SEQ ID NO: 182099 - protein, 9 aa, Artificial Sequence
  Description of Artificial Sequence: Synthetic peptide
  Seed: KLLSLGCIF (TYRP1_HUMAN)
  misc_feature (2)..(2): Xaa can be Gln, Thr, Met, Val, Ser, Tyr, Lys, Ala, Trp, Phe, Ile, Leu, Glu, Gly, Cys, His, Arg, Asn, Asp, or Pro
  misc_feature (9)..(9): Xaa can be Phe, Tyr, Trp, Met, Leu, Ile, Val, Cys, His, Ala, Lys, Arg, Ser, Gly, or Thr
KXLSLGCIX

SEQ ID NO: 182100 - protein, 10 aa, Artificial Sequence
  Description of Artificial Sequence: Synthetic peptide
  Seed: KLLSLGCIFF (TYRP1_HUMAN)
  misc_feature (2)..(2): Xaa can be Met, Gln, Leu, Thr, Tyr, Ile, Ser, Val, Trp, Ala, Phe, Glu, Lys, Cys, Gly, Arg, His, Asn, Pro, or Asp
  misc_feature (10)..(10): Xaa can be Tyr, Phe, Trp, Met, Leu, Ile, Val, Ala, Cys, Thr, Lys, Pro, Asp, Gly, Glu, Gln, Arg, Asn, His, or Ser
KXLSLGCIFX

SEQ ID NO: 182101 - protein, 9 aa, Artificial Sequence
  Description of Artificial Sequence: Synthetic peptide
  Seed: KLQNPNQSV (TYRP1_HUMAN)
  misc_feature (2)..(2): Xaa can be Ala, Gln, Leu, Val, Ile, Thr, Ser, Met, Gly, Tyr, Phe, Arg, Asn, Trp, Cys, Glu, Asp, Lys, His, or Pro
  misc_feature (9)..(9): Xaa can be Phe, Met, Leu, Tyr, Ile, Val, Trp, Lys, Arg, His, Ala, Cys, Thr, or Gln
KXQNPNQSX

SEQ ID NO: 182102 - protein, 10 aa, Artificial Sequence
  Description of Artificial Sequence: Synthetic peptide
  Seed: KLQNPNQSVV (TYRP1_HUMAN)
  misc_feature (2)..(2): Xaa can be Gln, Leu, Met, Val, Ile, Glu, Ala, Thr, Ser, Asn, or Lys
  misc_feature (10)..(10): Xaa can be Trp, Phe, Leu, Val, Ile, Met, Tyr, Ala, or Cys
KXQNPNQSVX

SEQ ID NO: 182103 - protein, 8 aa, Artificial Sequence
  Description of Artificial Sequence: Synthetic peptide
  Seed: KNHFVRAL (TYRP1_HUMAN)
  misc_feature (2)..(2): Xaa can be Gln, Leu, Asn, Gly, Asp, Met, Glu, Val, Ser, Ile, Ala, Thr, Arg, or His
  misc_feature (8)..(8): Xaa can be Leu, Ile, Val, Met, or Phe
KXHFVRAX

SEQ ID NO: 182104 - protein, 8 aa, Artificial Sequence
  Description of Artificial Sequence: Synthetic peptide
  Seed: KRTTHPLF (TYRP1_HUMAN)
  misc_feature (2)..(2): Xaa can be Arg, Tyr, Phe, His, or Ala
  misc_feature (8)..(8): Xaa can be Phe, Leu, Tyr, Met, Ile, or Val
KXTTHPLX

SEQ ID NO: 182105 - protein, 9 aa, Artificial Sequence
  Description of Artificial Sequence: Synthetic peptide
  Seed: KRTTHPLFV (TYRP1_HUMAN)
  misc_feature (2)..(2): Xaa can be Arg, Gln, Lys, Glu, Ile, Leu, Tyr, Met, His, Asn, Gly, Ala, Pro, Thr, Ser, Val, Phe, Asp, Trp, or Cys
  misc_feature (9)..(9): Xaa can be Leu, Met, Phe, Tyr, Val, Ile, Lys, Arg, Ala, Cys, Thr, Trp, Gln, or His
KXTTHPLFX

SEQ ID NO: 182106 - protein, 10 aa, Artificial Sequence
  Description of Artificial Sequence: Synthetic peptide
  Seed: KRTTHPLFVI (TYRP1_HUMAN)
  misc_feature (2)..(2): Xaa can be Arg, Ser, Asn, Cys, Asp, Pro, Met, Tyr, Lys, Phe, Trp, Ala, Leu, Glu, His, Val, Ile, Gln, Gly, or Thr
  misc_feature (10)..(10): Xaa can be Tyr, Phe, Trp, Leu, Ile, Met, Val, His, Cys, Lys, Ala, or Arg
KXTTHPLFVX

SEQ ID NO: 182107 - protein, 11 aa, Artificial Sequence
  Description of Artificial Sequence: Synthetic peptide
  Seed: KRTTHPLFVIA (TYRP1_HUMAN)
  misc_feature (2)..(2): Xaa can be Trp, Phe, Thr, Leu, Met, His, Arg, Glu, Asp, Pro, Gly, Lys, Tyr, Ile, Ala, Gln, Val, Cys, Asn, or Ser
  misc_feature (11)..(11): Xaa can be Ala, or Lys
KXTTHPLFVIX

SEQ ID NO: 182108 - protein, 11 aa, Artificial Sequence
  Description of Artificial Sequence: Synthetic peptide
  Seed: KTFLGVGQESF (TYRP1_HUMAN)
  misc_feature (2)..(2): Xaa can be Gln, Thr, Ser, Met, Ala, Val, Leu, Ile, Glu, Asn, Gly, Lys, Cys, Asp, His, Tyr, Pro, Arg, Phe, or Trp
  misc_feature (11)..(11): Xaa can be Tyr, Trp, Phe, Leu, Met, Ile, Val, His, Cys, Lys, or Ala
KXFLGVGQESX

SEQ ID NO: 182109 - protein, 9 aa, Artificial Sequence
  Description of Artificial Sequence: Synthetic peptide
  Seed: KYDPAVRSL (TYRP1_HUMAN)
  misc_feature (2)..(2): Xaa can be Ala, Tyr, Arg, Glu, Phe, Ser, Thr, Val, Ile, Trp, Leu, Gly, Met, Asn, Pro, Gln, His, Asp, Cys, or Lys
  misc_feature (9)..(9): Xaa can be Ile, Trp, Phe, Met, Ala, Cys, Tyr, Leu, Val, Thr, Arg, Lys, His, Ser, Pro, Gly, Gln, Glu, or Asn
KXDPAVRSX

SEQ ID NO: 182110 - protein, 10 aa, Artificial Sequence
  Description of Artificial Sequence: Synthetic peptide
  Seed: KYDPAVRSLH (TYRP1_HUMAN)
  misc_feature (2)..(2): Xaa can be Tyr, Phe, Leu, Trp, Met, Thr, Ile, Ser, Ala, Val, Gln, His, Cys, Asp, Lys, Asn, Gly, Pro, Arg, or Glu
  misc_feature (10)..(10): Xaa can be Tyr, Phe, Trp, Met, Leu, Ile, Val, Arg, Lys, or His
KXDPAVRSLX

SEQ ID NO: 182111 - protein, 9 aa, Artificial Sequence
  Description of Artificial Sequence: Synthetic peptide
  Seed: LEDYDTLGT (TYRP1_HUMAN)
  misc_feature (2)..(2): Xaa can be , or Glu
  misc_feature (9)..(9): Xaa can be Cys, Ile, Met, Ser, Val, Leu, Phe, Ala, Pro, or Thr
LXDYDTLGX

SEQ ID NO: 182112 - protein, 10 aa, Artificial Sequence
  Description of Artificial Sequence: Synthetic peptide
  Seed: LEDYDTLGTL (TYRP1_HUMAN)
  misc_feature (2)..(2): Xaa can be Glu, Asp, or Gln
  misc_feature (10)..(10): Xaa can be Trp, Phe, Leu, Ile, Met, Gly, Ala, Val, Ser, Cys, Thr, Pro, or Tyr
LXDYDTLGTX

SEQ ID NO: 182113 - protein, 11 aa, Artificial Sequence
  Description of Artificial Sequence: Synthetic peptide
  Seed: LEDYDTLGTLC (TYRP1_HUMAN)
  misc_feature (2)..(2): Xaa can be , or Glu
  misc_feature (11)..(11): Xaa can be Met, Cys, Thr, Phe, Leu, Val, Pro, Ala, or Ile
LXDYDTLGTLX

SEQ ID NO: 182114 - protein, 8 aa, Artificial Sequence
  Description of Artificial Sequence: Synthetic peptide
  Seed: LEKDMQEM (TYRP1_HUMAN)
  misc_feature (2)..(2): Xaa can be Glu, Asp, or Gln
  misc_feature (8)..(8): Xaa can be Trp, Leu, Ala, Val, Ile, Met, Tyr, Phe, Pro, Cys, Thr, His, or Ser
LXKDMQEX

SEQ ID NO: 182115 - protein, 9 aa, Artificial Sequence
  Description of Artificial Sequence: Synthetic peptide
  Seed: LEKDMQEML (TYRP1_HUMAN)
  misc_feature (2)..(2): Xaa can be Glu, Gln, Asp, His, Ser, Ile, Met, Leu, Ala, Val, Tyr, Arg, Thr, Phe, Gly, Asn, Lys, or Tr p
  misc_feature (9)..(9): Xaa can be Leu, Met, Phe, Ile, Val, Trp, Cys, Tyr, Ala, Arg, Pro, Lys, His, Gly, Ser, Glu, Asp, Gln, or Thr
LXKDMQEMX

SEQ ID NO: 182116 - protein, 10 aa, Artificial Sequence
  Description of Artificial Sequence: Synthetic peptide
  Seed: LENAPIGHNR (TYRP1_HUMAN)
  misc_feature (2)..(2): Xaa can be Ala, Thr, Ser, Val, Ile, Met, Gly, Leu, Phe, Pro, Trp, Gln, Asn, Tyr, Asp, Glu, Arg, Lys, His, or Cys
  misc_feature (10)..(10): Xaa can be Arg, Lys, Leu, Met, Phe, Tyr, Ile, or Val
LXNAPIGHNX

SEQ ID NO: 182117 - protein, 9 aa, Artificial Sequence
  Description of Artificial Sequence: Synthetic peptide
  Seed: LEVGLFDTP (TYRP1_HUMAN)
  misc_feature (2)..(2): Xaa can be Glu, Asp, or Gln
  misc_feature (9)..(9): Xaa can be Val, Cys, Ala, Met, Phe, Ile, Leu, Thr, Pro, Lys, Gly, Ser, Tyr, Glu, Trp, or Asp
LXVGLFDTX

SEQ ID NO: 182118 - protein, 10 aa, Artificial Sequence
  Description of Artificial Sequence: Synthetic peptide
  Seed: LEVGLFDTPP (TYRP1_HUMAN)
  misc_feature (2)..(2): Xaa can be , or Glu
  misc_feature (10)..(10): Xaa can be Cys, Ile, Phe, Leu, Met, Ala, Thr, Val, or Pro
LXVGLFDTPX

SEQ ID NO: 182119 - protein, 11 aa, Artificial Sequence
  Description of Artificial Sequence: Synthetic peptide
  Seed: LEVGLFDTPPF (TYRP1_HUMAN)
  misc_feature (2)..(2): Xaa can be Gln, Glu, Lys, Met, Arg, Ser, Ala, His, or Leu
  misc_feature (11)..(11): Xaa can be Tyr, Phe, Met, Leu, Ile, or Trp
LXVGLFDTPPX

SEQ ID NO: 182120 - protein, 8 aa, Artificial Sequence
  Description of Artificial Sequence: Synthetic peptide
  Seed: LFDTPPFY (TYRP1_HUMAN)
  misc_feature (2)..(2): Xaa can be Thr, Ser, Phe, Tyr, Ala, Met, Ile, Leu, Val, Gly, Gln, Trp, Asn, His, Cys, Asp, Pro, Arg, Glu, or Lys
  misc_feature (8)..(8): Xaa can be Leu, Met, Phe, Tyr, Ile, Val, Lys, Arg, Trp, Cys, Ala, or His
LXDTPPFX

SEQ ID NO: 182121 - protein, 9 aa, Artificial Sequence
  Description of Artificial Sequence: Synthetic peptide
  Seed: LFDTPPFYS (TYRP1_HUMAN)
  misc_feature (2)..(2): Xaa can be Tyr, Phe, Trp, Met, Ile, Leu, Ala, His, Gln, Cys, Arg, Ser, Pro, Val, Asp, Asn, Thr, Gly, Glu, or Lys
  misc_feature (9)..(9): Xaa can be Met, Leu, Phe, Ile, Val, Cys, Thr, Tyr, Trp, Ala, Ser, Pro, or Gln
LXDTPPFYX

SEQ ID NO: 182122 - protein, 9 aa, Artificial Sequence
  Description of Artificial Sequence: Synthetic peptide
  Seed: LFQQARAQF (TYRP1_HUMAN)
  misc_feature (2)..(2): Xaa can be Gln, Tyr, Met, Arg, Phe, Thr, Ser, Ala, Trp, Val, Glu, Leu, Lys, His, Ile, Gly, Pro, Asn, Asp, or Cys
  misc_feature (9)..(9): Xaa can be Tyr, Phe, Leu, Met, Ile, Val, Trp, His, or Ala
LXQQARAQX

SEQ ID NO: 182123 - protein, 11 aa, Artificial Sequence
  Description of Artificial Sequence: Synthetic peptide
  Seed: LFQQARAQFPR (TYRP1_HUMAN)
  misc_feature (2)..(2): Xaa can be Ser, Met, Gln, Ile, Val, Tyr, Arg, Trp, Phe, Leu, Ala, Thr, Gly, Pro, His, Asp, Asn, Cys, Glu, or Lys
  misc_feature (11)..(11): Xaa can be Arg, or Lys
LXQQARAQFPX

SEQ ID NO: 182124 - protein, 9 aa, Artificial Sequence
  Description of Artificial Sequence: Synthetic peptide
  Seed: LGCIFFPLL (TYRP1_HUMAN)
  misc_feature (2)..(2): Xaa can be Thr, Met, Leu, Ser, Ile, Gln, Ala, Val, Gly, Cys, Asn, Asp, Pro, Glu, Arg, Lys, Phe, or Ty r
  misc_feature (9)..(9): Xaa can be Trp, Phe, Leu, Val, Met, Ile, Ala, Tyr, Cys, or Thr
LXCIFFPLX

SEQ ID NO: 182125 - protein, 10 aa, Artificial Sequence
  Description of Artificial Sequence: Synthetic peptide
  Seed: LGPDGNTPQF (TYRP1_HUMAN)
  misc_feature (2)..(2): Xaa can be Ala, Tyr, Met, Thr, Phe, Ser, Val, Arg, Ile, Leu, Gly, Gln, Asn, Glu, Pro, His, Trp, Asp, Cys, or Lys
  misc_feature (10)..(10): Xaa can be Met, Tyr, Leu, Phe, Trp, Ile, Val, Lys, Arg, His, Ala, Cys, Thr, or Gln
LXPDGNTPQX

SEQ ID NO: 182126 - protein, 9 aa, Artificial Sequence
  Description of Artificial Sequence: Synthetic peptide
  Seed: LGYTYEIQW (TYRP1_HUMAN)
  misc_feature (2)..(2): Xaa can be Thr, Ser, Pro, Ala, Met, Val, Ile, Leu, Gln, Gly, Cys, Asn, Arg, His, Asp, Tyr, Glu, Phe, Trp, or Lys
  misc_feature (9)..(9): Xaa can be Trp, Phe, Tyr, Leu, Ile, Met, Val, or Cys
LXYTYEIQX

SEQ ID NO: 182127 - protein, 8 aa, Artificial Sequence
  Description of Artificial Sequence: Synthetic peptide
  Seed: LHNLAHLF (TYRP1_HUMAN)
  misc_feature (2)..(2): Xaa can be His, Arg, Tyr, Phe, or Gln
  misc_feature (8)..(8): Xaa can be Leu, Phe, Tyr, Met, Val, or Ile
LXNLAHLX

SEQ ID NO: 182128 - protein, 9 aa, Artificial Sequence
  Description of Artificial Sequence: Synthetic peptide
  Seed: LHNLAHLFL (TYRP1_HUMAN)
  misc_feature (2)..(2): Xaa can be His, Gln, Arg, Met, Lys, Ala, Tyr, Phe, Ser, Leu, Val, Ile, Glu, Gly, Thr, Asn, Trp, Pro, or Asp
  misc_feature (9)..(9): Xaa can be Leu, Phe, Tyr, Met, Ile, Val, Trp, Ala, His, Thr, Cys, or Gly
LXNLAHLFX

SEQ ID NO: 182129 - protein, 8 aa, Artificial Sequence
  Description of Artificial Sequence: Synthetic peptide
  Seed: LHTFTDAV (TYRP1_HUMAN)
  misc_feature (2)..(2): Xaa can be , or His
  misc_feature (8)..(8): Xaa can be Val, Ala, Ile, or Leu
LXTFTDAX

SEQ ID NO: 182130 - protein, 9 aa, Artificial Sequence
  Description of Artificial Sequence: Synthetic peptide
  Seed: LHTFTDAVF (TYRP1_HUMAN)
  misc_feature (2)..(2): Xaa can be Gln, Lys, Met, His, Arg, Leu, Ala, Glu, Tyr, Val, Ile, Asn, Thr, Ser, Phe, Pro, Gly, or Tr p
  misc_feature (9)..(9): Xaa can be Phe, Tyr, Met, Leu, Val, Trp, Ile, His, or Ala
LXTFTDAVX

SEQ ID NO: 182131 - protein, 8 aa, Artificial Sequence
  Description of Artificial Sequence: Synthetic peptide
  Seed: LIFGTASY (TYRP1_HUMAN)
  misc_feature (2)..(2): Xaa can be Gln, Met, Lys, Ser, Ala, Pro, Arg, Leu, Glu, Ile, Thr, His, Val, Phe, Tyr, Asn, Gly, Trp, or Asp
  misc_feature (8)..(8): Xaa can be Tyr, Phe, Met, Leu, Ile, Trp, His, Val, Ala, or Pro
LXFGTASX

SEQ ID NO: 182132 - protein, 9 aa, Artificial Sequence
  Description of Artificial Sequence: Synthetic peptide
  Seed: LIFGTASYL (TYRP1_HUMAN)
  misc_feature (2)..(2): Xaa can be Gln, Leu, Met, Ala, Thr, Ile, Tyr, Val, Ser, Phe, Glu, Gly, Trp, Lys, Pro, Asn, Cys, Arg, His, or Asp
  misc_feature (9)..(9): Xaa can be Val, Tyr, Met, Phe, Leu, Ile, Trp, Arg, His, Lys, Ala, Thr, Cys, Ser, Gly, Pro, Gln, or As n
LXFGTASYX

SEQ ID NO: 182133 - protein, 10 aa, Artificial Sequence
  Description of Artificial Sequence: Synthetic peptide
  Seed: LIFGTASYLI (TYRP1_HUMAN)
  misc_feature (2)..(2): Xaa can be Met, Leu, Thr, Val, Tyr, Gln, Ala, Ile, Trp, Ser, Phe, Gly, Pro, Asn, Glu, Arg, Lys, His, Asp, or Cys
  misc_feature (10)..(10): Xaa can be Ile, Leu, Phe, Trp, Val, Met, Ala, Thr, Tyr, Gly, His, Arg, Pro, Ser, Cys, Lys, Glu, Gln, Asp, or Asn
LXFGTASYLX

SEQ ID NO: 182134 - protein, 11 aa, Artificial Sequence
  Description of Artificial Sequence: Synthetic peptide
  Seed: LIFGTASYLIR (TYRP1_HUMAN)
  misc_feature (2)..(2): Xaa can be Val, Thr, Ile, Ser, Tyr, Met, Trp, Phe, Leu, Gln, Ala, Asn, His, Gly, Arg, or Lys
  misc_feature (11)..(11): Xaa can be Arg, Lys, or Tyr
LXFGTASYLIX

SEQ ID NO: 182135 - protein, 8 aa, Artificial Sequence
  Description of Artificial Sequence: Synthetic peptide
  Seed: LIRARRSM (TYRP1_HUMAN)
  misc_feature (2)..(2): Xaa can be Met, Pro, Leu, Phe, Val, Ala, Ile, Gln, Asn, Ser, Gly, Tyr, Asp, Arg, Lys, Trp, Thr, Glu, His, or Cys
  misc_feature (8)..(8): Xaa can be Leu, Met, Ile, Val, Phe, Ala, or Cys
LXRARRSX

SEQ ID NO: 182136 - protein, 8 aa, Artificial Sequence
  Description of Artificial Sequence: Synthetic peptide
  Seed: LISPNSVF (TYRP1_HUMAN)
  misc_feature (2)..(2): Xaa can be Ala, Ser, Thr, Ile, Gly, Val, Met, Leu, Phe, Pro, Gln, Glu, or Tyr
  misc_feature (8)..(8): Xaa can be Tyr, Phe, Leu, Met, Val, Ile, His, Trp, or Lys
LXSPNSVX

SEQ ID NO: 182137 - protein, 11 aa, Artificial Sequence
  Description of Artificial Sequence: Synthetic peptide
  Seed: LISPNSVFSQW (TYRP1_HUMAN)
  misc_feature (2)..(2): Xaa can be Thr, Ser, Ala, Gln, Gly, Val, Met, Ile, Leu, Cys, Glu, Asn, Pro, Tyr, Asp, Phe, Arg, His, Lys, or Trp
  misc_feature (11)..(11): Xaa can be Phe, Trp, Tyr, Lys, Leu, Met, Ile, Arg, Val, Cys, or His
LXSPNSVFSQX

SEQ ID NO: 182138 - protein, 8 aa, Artificial Sequence
  Description of Artificial Sequence: Synthetic peptide
  Seed: LIVRRNLL (TYRP1_HUMAN)
  misc_feature (2)..(2): Xaa can be Pro, Met, Leu, Ala, Arg, Ile, Lys, Gln, Tyr, Phe, His, Asn, Gly, Val, or Ser
  misc_feature (8)..(8): Xaa can be Leu, Met, Ile, Phe, or Val
LXVRRNLX

SEQ ID NO: 182139 - protein, 10 aa, Artificial Sequence
  Description of Artificial Sequence: Synthetic peptide
  Seed: LIVRRNLLDL (TYRP1_HUMAN)
  misc_feature (2)..(2): Xaa can be Arg, Gly, Thr, Gln, Ser, Glu, Leu, Ala, Val, Met, Asp, Ile, Asn, or Cys
  misc_feature (10)..(10): Xaa can be Leu, Ile, Phe, Lys, Tyr, or Met
LXVRRNLLDX

SEQ ID NO: 182140 - protein, 9 aa, Artificial Sequence
  Description of Artificial Sequence: Synthetic peptide
  Seed: LLDLSKEEK (TYRP1_HUMAN)
  misc_feature (2)..(2): Xaa can be Thr, Ser, Met, Ala, Ile, Val, Tyr, Phe, Leu, Gly, Trp, Asn, Gln, Cys, Pro, Glu, or Asp
  misc_feature (9)..(9): Xaa can be Tyr, Lys, Met, Phe, Leu, Arg, Ile, Trp, Val, His, or Gln
LXDLSKEEX

SEQ ID NO: 182141 - protein, 10 aa, Artificial Sequence
  Description of Artificial Sequence: Synthetic peptide
  Seed: LLFQQARAQF (TYRP1_HUMAN)
  misc_feature (2)..(2): Xaa can be Gln, Met, Tyr, Trp, Phe, Ile, His, Arg, Ala, Val, Thr, Leu, Ser, Lys, Asp, Asn, Pro, Glu, Gly, or Cys
  misc_feature (10)..(10): Xaa can be Met, Phe, Tyr, Trp, Leu, Ile, Val, His, or Ala
LXFQQARAQX

SEQ ID NO: 182142 - protein, 9 aa, Artificial Sequence
  Description of Artificial Sequence: Synthetic peptide
  Seed: LLHTFTDAV (TYRP1_HUMAN)
  misc_feature (2)..(2): Xaa can be Leu, Gln, Met, Val, Ile, Ala, Thr, Ser, Glu, Gly, Asn, Asp, or Phe
  misc_feature (9)..(9): Xaa can be Ile, Val, Leu, Arg, Lys, Met, Ala, Tyr, Phe, Thr, Cys, or Trp
LXHTFTDAX

SEQ ID NO: 182143 - protein, 10 aa, Artificial Sequence
  Description of Artificial Sequence: Synthetic peptide
  Seed: LLHTFTDAVF (TYRP1_HUMAN)
  misc_feature (2)..(2): Xaa can be Leu, Met, Gln, Ile, Val, Thr, Lys, His, Ala, Ser, Glu, Asn, Arg, Gly, Phe, Tyr, Asp, Pro, Cys, or Trp
  misc_feature (10)..(10): Xaa can be Leu, Tyr, Phe, Met, Trp, Ile, Val, Ala, His, Lys, Arg, Thr, Asn, Cys, Ser, Gln, Glu, Pro, Gly, or Asp
LXHTFTDAVX

SEQ ID NO: 182144 - protein, 9 aa, Artificial Sequence
  Description of Artificial Sequence: Synthetic peptide
  Seed: LLLFQQARA (TYRP1_HUMAN)
  misc_feature (2)..(2): Xaa can be Met, Leu, Val, Gln, Ile, Thr, or Ala
  misc_feature (9)..(9): Xaa can be Val, Leu, Ile, Met, or Ala
LXLFQQARX

SEQ ID NO: 182145 - protein, 11 aa, Artificial Sequence
  Description of Artificial Sequence: Synthetic peptide
  Seed: LLLFQQARAQF (TYRP1_HUMAN)
  misc_feature (2)..(2): Xaa can be Met, Leu, Gln, Arg, Val, Ile, Phe, Tyr, Ala, or Ser
  misc_feature (11)..(11): Xaa can be Tyr, or Phe
LXLFQQARAQX

SEQ ID NO: 182146 - protein, 10 aa, Artificial Sequence
  Description of Artificial Sequence: Synthetic peptide
  Seed: LLLVALIFGT (TYRP1_HUMAN)
  misc_feature (2)..(2): Xaa can be Met, Leu, Phe, Tyr, Ala, Ile, Gln, Lys, Glu, His, Ser, Trp, Asp, Arg, Cys, Pro, Asn, Thr, Val, or Gly
  misc_feature (10)..(10): Xaa can be Ala, Leu, Val, Ile, Met, or Thr
LXLVALIFGX

SEQ ID NO: 182147 - protein, 8 aa, Artificial Sequence
  Description of Artificial Sequence: Synthetic peptide
  Seed: LLSLGCIF (TYRP1_HUMAN)
  misc_feature (2)..(2): Xaa can be Met, Leu, or Gln
  misc_feature (8)..(8): Xaa can be Phe, Tyr, or Met
LXSLGCIX

SEQ ID NO: 182148 - protein, 9 aa, Artificial Sequence
  Description of Artificial Sequence: Synthetic peptide
  Seed: LLSLGCIFF (TYRP1_HUMAN)
  misc_feature (2)..(2): Xaa can be Gln, Tyr, Ser, Thr, Leu, Met, Ala, Trp, Phe, Pro, Val, Glu, Ile, Gly, Asn, Cys, Asp, His, Lys, or Arg
  misc_feature (9)..(9): Xaa can be Tyr, Phe, Trp, Leu, Ile, Met, or Val
LXSLGCIFX

SEQ ID NO: 182149 - protein, 11 aa, Artificial Sequence
  Description of Artificial Sequence: Synthetic peptide
  Seed: LLSLGCIFFPL (TYRP1_HUMAN)
  misc_feature (2)..(2): Xaa can be Met, Tyr, Phe, Ile, Leu, Thr, Gln, His, Pro, Cys, Val, Gly, Arg, Asn, Trp, Asp, Glu, Lys, Ser, or Ala
  misc_feature (11)..(11): Xaa can be Ile, Leu, Val, Ala, or Met
LXSLGCIFFPX

SEQ ID NO: 182150 - protein, 9 aa, Artificial Sequence
  Description of Artificial Sequence: Synthetic peptide
  Seed: LLTDQYQCY (TYRP1_HUMAN)
  misc_feature (2)..(2): Xaa can be Ala, Thr, Ser, Val, Gln, Met, Ile, Gly, Leu, Cys, Phe, Glu, Tyr, Arg, Asp, Pro, Asn, Lys, His, or Trp
  misc_feature (9)..(9): Xaa can be Tyr, Phe, Met, Leu, Lys, Val, Ile, His, Trp, or Ala
LXTDQYQCX

SEQ ID NO: 182151 - protein, 10 aa, Artificial Sequence
  Description of Artificial Sequence: Synthetic peptide
  Seed: LLTDQYQCYA (TYRP1_HUMAN)
  misc_feature (2)..(2): Xaa can be Met, Leu, Ile, Thr, Val, Gln, Ser, Lys, Asn, Pro, Glu, Cys, Ala, Asp, Phe, His, Trp, Tyr, Arg, or Gly
  misc_feature (10)..(10): Xaa can be Val, Leu, Ile, Ala, Thr, Met, or Cys
LXTDQYQCYX

SEQ ID NO: 182152 - protein, 9 aa, Artificial Sequence
  Description of Artificial Sequence: Synthetic peptide
  Seed: LLVALIFGT (TYRP1_HUMAN)
  misc_feature (2)..(2): Xaa can be Met, Gln, Leu, Ile, Val, Ser, Thr, Ala, Gly, Glu, Cys, Asn, Phe, Tyr, Trp, or Asp
  misc_feature (9)..(9): Xaa can be Leu, Val, Ile, Met, Ala, Thr, Cys, Ser, Phe, Pro, Gly, or Tyr
LXVALIFGX

SEQ ID NO: 182153 - protein, 10 aa, Artificial Sequence
  Description of Artificial Sequence: Synthetic peptide
  Seed: LLVALIFGTA (TYRP1_HUMAN)
  misc_feature (2)..(2): Xaa can be Met, Gln, Leu, Thr, Ile, Phe, Val, Ala, Ser, Tyr, Lys, His, Asn, Arg, Gly, Cys, Glu, Trp, Pro, or Asp
  misc_feature (10)..(10): Xaa can be Ala, Val, Leu, Ile, Met, Thr, Ser, or Phe
LXVALIFGTX

SEQ ID NO: 182154 - protein, 9 aa, Artificial Sequence
  Description of Artificial Sequence: Synthetic peptide
  Seed: LPEPQDVAQ (TYRP1_HUMAN)
  misc_feature (2)..(2): Xaa can be Pro, Ala, Val, Thr, Ile, Ser, Gly, Tyr, Cys, Met, Leu, Phe, Gln, or Trp
  misc_feature (9)..(9): Xaa can be Tyr, Phe, Met, Leu, Trp, Ile, Val, Cys, Gln, Arg, His, Thr, Ser, or Ala
LXEPQDVAX

SEQ ID NO: 182155 - protein, 10 aa, Artificial Sequence
  Description of Artificial Sequence: Synthetic peptide
  Seed: LPEPQDVAQC (TYRP1_HUMAN)
  misc_feature (2)..(2): Xaa can be , or Pro
  misc_feature (10)..(10): Xaa can be Met, Val, Ile, Leu, Tyr, Ala, Phe, or Cys
LXEPQDVAQX

SEQ ID NO: 182156 - protein, 11 aa, Artificial Sequence
  Description of Artificial Sequence: Synthetic peptide
  Seed: LPEPQDVAQCL (TYRP1_HUMAN)
  misc_feature (2)..(2): Xaa can be Pro, Ile, Val, Gly, Tyr, Ser, Thr, Ala, Cys, Leu, Met, Trp, Phe, Gln, or Asn
  misc_feature (11)..(11): Xaa can be Leu, Met, Phe, Ile, Val, Trp, Tyr, Thr, Ala, His, or Cys
LXEPQDVAQCX

SEQ ID NO: 182157 - protein, 8 aa, Artificial Sequence
  Description of Artificial Sequence: Synthetic peptide
  Seed: LPYWNFAT (TYRP1_HUMAN)
  misc_feature (2)..(2): Xaa can be , or Pro
  misc_feature (8)..(8): Xaa can be Thr, Cys, Ser, Ile, Met, Phe, Pro, Val, Ala, or Leu
LXYWNFAX

SEQ ID NO: 182158 - protein, 9 aa, Artificial Sequence
  Description of Artificial Sequence: Synthetic peptide
  Seed: LPYWNFATG (TYRP1_HUMAN)
  misc_feature (2)..(2): Xaa can be Pro, Ala, Val, Thr, Ser, Met, Gly, Ile, Leu, Glu, Gln, Phe, Cys, Tyr, His, Asn, or Lys
  misc_feature (9)..(9): Xaa can be Tyr, Phe, Met, Ala, Leu, His, Val, Trp, Thr, Ile, Ser, Cys, Asp, Gln, Gly, Arg, Glu, Asn, Pro, or Lys
LXYWNFATX

SEQ ID NO: 182159 - protein, 10 aa, Artificial Sequence
  Description of Artificial Sequence: Synthetic peptide
  Seed: LPYWNFATGK (TYRP1_HUMAN)
  misc_feature (2)..(2): Xaa can be Val, Thr, Met, Leu, Ser, Ile, Ala, Asn, Gly, His, Cys, Tyr, Gln, Trp, Lys, Pro, Asp, Glu, Arg, or Phe
  misc_feature (10)..(10): Xaa can be Lys, Arg, Tyr, or His
LXYWNFATGX

SEQ ID NO: 182160 - protein, 8 aa, Artificial Sequence
  Description of Artificial Sequence: Synthetic peptide
  Seed: LQEPSFSL (TYRP1_HUMAN)
  misc_feature (2)..(2): Xaa can be Tyr, Gln, Ser, Phe, Ala, His, Arg, or Gly
  misc_feature (8)..(8): Xaa can be Leu, Phe, Ile, Met, or Val
LXEPSFSX

SEQ ID NO: 182161 - protein, 10 aa, Artificial Sequence
  Description of Artificial Sequence: Synthetic peptide
  Seed: LQEPSFSLPY (TYRP1_HUMAN)
  misc_feature (2)..(2): Xaa can be Gln, Met, Thr, Ala, Val, Ile, Leu, Ser, Lys, Arg, Gly, Phe, Asn, Tyr, His, Glu, Pro, Asp, Cys, or Trp
  misc_feature (10)..(10): Xaa can be Phe, Tyr, Met, Lys, Arg, Trp, Leu, His, Ile, or Val
LXEPSFSLPX

SEQ ID NO: 182162 - protein, 11 aa, Artificial Sequence
  Description of Artificial Sequence: Synthetic peptide
  Seed: LQEPSFSLPYW (TYRP1_HUMAN)
  misc_feature (2)..(2): Xaa can be Gln, Thr, Ser, Lys, Met, Trp, Cys, Val, Ala, Arg, Phe, Ile, Leu, Glu, Pro, Asn, His, Gly, Tyr, or Asp
  misc_feature (11)..(11): Xaa can be Phe, Trp, Tyr, Leu, Ile, Met, Pro, Ser, Val, Asn, Lys, Thr, His, Arg, Gln, Gly, Asp, Glu, Ala, or Cys
LXEPSFSLPYX

SEQ ID NO: 182163 - protein, 8 aa, Artificial Sequence
  Description of Artificial Sequence: Synthetic peptide
  Seed: LQNPNQSV (TYRP1_HUMAN)
  misc_feature (2)..(2): Xaa can be Gln, Ala, Glu, or Met
  misc_feature (8)..(8): Xaa can be Val, Ile, Leu, or Met
LXNPNQSX

SEQ ID NO: 182164 - protein, 9 aa, Artificial Sequence
  Description of Artificial Sequence: Synthetic peptide
  Seed: LQNPNQSVV (TYRP1_HUMAN)
  misc_feature (2)..(2): Xaa can be Glu, Ala, Gln, His, Ser, Asp, Arg, Thr, Val, Gly, Ile, Leu, Tyr, Met, Lys, Phe, Asn, Pro, Cys, or Trp
  misc_feature (9)..(9): Xaa can be Tyr, Val, Met, Phe, Ile, Leu, Trp, His, Ala, Lys, Arg, Cys, Thr, Pro, Gly, Gln, Ser, Asp, or Glu
LXNPNQSVX

SEQ ID NO: 182165 - protein, 9 aa, Artificial Sequence
  Description of Artificial Sequence: Synthetic peptide
  Seed: LRFFNRTCH (TYRP1_HUMAN)
  misc_feature (2)..(2): Xaa can be Arg, or Gly
  misc_feature (9)..(9): Xaa can be Leu, Tyr, Trp, His, Met, Phe, Val, Lys, Ile, or Arg
LXFFNRTCX

SEQ ID NO: 182166 - protein, 10 aa, Artificial Sequence
  Description of Artificial Sequence: Synthetic peptide
  Seed: LRLEKDMQEM (TYRP1_HUMAN)
  misc_feature (2)..(2): Xaa can be Arg, Gln, Tyr, His, Phe, Thr, Ile, Met, Ser, Gly, Ala, Leu, Val, Asn, or Glu
  misc_feature (10)..(10): Xaa can be Leu, Phe, Tyr, Met, Lys, Ile, Arg, His, Val, Ala, Cys, or Trp
LXLEKDMQEX

SEQ ID NO: 182167 - protein, 11 aa, Artificial Sequence
  Description of Artificial Sequence: Synthetic peptide
  Seed: LRLEKDMQEML (TYRP1_HUMAN)
  misc_feature (2)..(2): Xaa can be , or Arg
  misc_feature (11)..(11): Xaa can be Tyr, Leu, Lys, Trp, Val, Phe, Ile, Arg, or Met
LXLEKDMQEMX

SEQ ID NO: 182168 - protein, 11 aa, Artificial Sequence
  Description of Artificial Sequence: Synthetic peptide
  Seed: LRRYNADISTF (TYRP1_HUMAN)
  misc_feature (2)..(2): Xaa can be Arg, Met, Gln, Lys, Tyr, His, Glu, Ile, Ala, Val, Ser, Phe, Leu, Thr, Trp, Asn, Cys, Pro, Gly, or Asp
  misc_feature (11)..(11): Xaa can be Trp, Leu, Ile, Phe, Tyr, Met, Lys, Arg, or Val
LXRYNADISTX

SEQ ID NO: 182169 - protein, 10 aa, Artificial Sequence
  Description of Artificial Sequence: Synthetic peptide
  Seed: LRSGMCCPDL (TYRP1_HUMAN)
  misc_feature (2)..(2): Xaa can be , or Arg
  misc_feature (10)..(10): Xaa can be Met, Leu, or Phe
LXSGMCCPDX

SEQ ID NO: 182170 - protein, 9 aa, Artificial Sequence
  Description of Artificial Sequence: Synthetic peptide
  Seed: LSKEEKNHF (TYRP1_HUMAN)
  misc_feature (2)..(2): Xaa can be Ala, Gln, Thr, Ile, Ser, Val, Arg, Tyr, Pro, Met, Phe, Gly, Lys, Leu, Trp, Asn, Glu, His, Cys, or Asp
  misc_feature (9)..(9): Xaa can be Phe, Tyr, Trp, Leu, Met, Ile, Val, His, or Ala
LXKEEKNHX

SEQ ID NO: 182171 - protein, 11 aa, Artificial Sequence
  Description of Artificial Sequence: Synthetic peptide
  Seed: LSKEEKNHFVR (TYRP1_HUMAN)
  misc_feature (2)..(2): Xaa can be Val, Thr, Ile, Leu, Met, Ser, Tyr, Ala, Trp, Phe, or Gln
  misc_feature (11)..(11): Xaa can be Arg, or Lys
LXKEEKNHFVX

SEQ ID NO: 182172 - protein, 8 aa, Artificial Sequence
  Description of Artificial Sequence: Synthetic peptide
  Seed: LSLGCIFF (TYRP1_HUMAN)
  misc_feature (2)..(2): Xaa can be Ser, Thr, Val, Ala, or Gly
  misc_feature (8)..(8): Xaa can be Trp, or Phe
LXLGCIFX

SEQ ID NO: 182173 - protein, 10 aa, Artificial Sequence
  Description of Artificial Sequence: Synthetic peptide
  Seed: LSLGCIFFPL (TYRP1_HUMAN)
  misc_feature (2)..(2): Xaa can be Leu, Met, Gln, Ala, Ser, Thr, Asn, Cys, Val, Pro, Gly, Ile, Arg, Trp, Asp, Lys, His, Tyr, Glu, or Phe
  misc_feature (10)..(10): Xaa can be Ala, Thr, Leu, Ile, Val, Met, Trp, Phe, Pro, Cys, Ser, or Tyr
LXLGCIFFPX

SEQ ID NO: 182174 - protein, 11 aa, Artificial Sequence
  Description of Artificial Sequence: Synthetic peptide
  Seed: LSLGCIFFPLL (TYRP1_HUMAN)
  misc_feature (2)..(2): Xaa can be Ser, Thr, or Ala
  misc_feature (11)..(11): Xaa can be Phe, Trp, Tyr, Met, or Leu
LXLGCIFFPLX

SEQ ID NO: 182175 - protein, 9 aa, Artificial Sequence
  Description of Artificial Sequence: Synthetic peptide
  Seed: LSPNDPIFV (TYRP1_HUMAN)
  misc_feature (2)..(2): Xaa can be Leu, Ala, Met, Ile, Ser, Val, Gln, Tyr, Thr, Asn, Phe, Gly, Cys, Trp, Pro, Arg, Glu, Asp, His, or Lys
  misc_feature (9)..(9): Xaa can be Leu, Met, Val, Trp, Phe, Ile, Tyr, Lys, Arg, Cys, Ala, Thr, or His
LXPNDPIFX

SEQ ID NO: 182176 - protein, 10 aa, Artificial Sequence
  Description of Artificial Sequence: Synthetic peptide
  Seed: LSPNDPIFVL (TYRP1_HUMAN)
  misc_feature (2)..(2): Xaa can be Val, Ala, Met, Leu, Ser, Gln, Gly, Asn, Thr, Ile, Asp, Glu, Lys, Tyr, Pro, Cys, His, Arg, Trp, or Phe
  misc_feature (10)..(10): Xaa can be Leu, Tyr, Ala, Phe, Trp, Ile, Met, Val, Lys, or Arg
LXPNDPIFVX

SEQ ID NO: 182177 - protein, 11 aa, Artificial Sequence
  Description of Artificial Sequence: Synthetic peptide
  Seed: LSPNDPIFVLL (TYRP1_HUMAN)
  misc_feature (2)..(2): Xaa can be Thr, Ser, Ala, Met, Cys, Ile, Gly, Val, Asp, Pro, Glu, Asn, Phe, Leu, or Gln
  misc_feature (11)..(11): Xaa can be Trp, Phe, Leu, Tyr, Met, or Ile
LXPNDPIFVLX

SEQ ID NO: 182178 - protein, 11 aa, Artificial Sequence
  Description of Artificial Sequence: Synthetic peptide
  Seed: LSPVSGPGTDR (TYRP1_HUMAN)
  misc_feature (2)..(2): Xaa can be Ala, Ser, Thr, Val, Met, Leu, Gly, Ile, Glu, Gln, Asn, Asp, Cys, or Phe
  misc_feature (11)..(11): Xaa can be Lys, Arg, Phe, Leu, Met, Tyr, Trp, Ile, or Val
LXPVSGPGTDX

SEQ ID NO: 182179 - protein, 8 aa, Artificial Sequence
  Description of Artificial Sequence: Synthetic peptide
  Seed: LTDQYQCY (TYRP1_HUMAN)
  misc_feature (2)..(2): Xaa can be Ala, Thr, Val, Ser, Ile, Phe, Tyr, Met, Leu, Asn, Gly, Trp, Asp, Cys, Glu, or Gln
  misc_feature (8)..(8): Xaa can be Tyr, Leu, Lys, Phe, Met, Arg, Ile, or Val
LXDQYQCX

SEQ ID NO: 182180 - protein, 9 aa, Artificial Sequence
  Description of Artificial Sequence: Synthetic peptide
  Seed: LTDQYQCYA (TYRP1_HUMAN)
  misc_feature (2)..(2): Xaa can be Thr, Ala, Val, Ile, Ser, Met, Leu, Gly, Phe, Asn, Gln, Asp, Tyr, Cys, Trp, Glu, Pro, His, Lys, or Arg
  misc_feature (9)..(9): Xaa can be Leu, Tyr, Met, Ile, Phe, Val, Lys, Arg, His, Cys, Trp, Gln, Ala, Thr, or Ser
LXDQYQCYX

SEQ ID NO: 182181 - protein, 8 aa, Artificial Sequence
  Description of Artificial Sequence: Synthetic peptide
  Seed: LTWHRYHL (TYRP1_HUMAN)
  misc_feature (2)..(2): Xaa can be Ala, Ser, or Thr
  misc_feature (8)..(8): Xaa can be Phe, Leu, Tyr, or Met
LXWHRYHX

SEQ ID NO: 182182 - protein, 9 aa, Artificial Sequence
  Description of Artificial Sequence: Synthetic peptide
  Seed: LTWHRYHLL (TYRP1_HUMAN)
  misc_feature (2)..(2): Xaa can be Leu, Met, Ile, Thr, Gln, Ser, Ala, Val, Tyr, Arg, Gly, Pro, Glu, Phe, Trp, Cys, Asn, Asp, His, or Lys
  misc_feature (9)..(9): Xaa can be Leu, Phe, Met, Tyr, Trp, Arg, Lys, Val, Ile, His, Cys, Ala, Thr, Gly, Pro, or Ser
LXWHRYHLX

SEQ ID NO: 182183 - protein, 10 aa, Artificial Sequence
  Description of Artificial Sequence: Synthetic peptide
  Seed: LTWHRYHLLR (TYRP1_HUMAN)
  misc_feature (2)..(2): Xaa can be Ser, Leu, Met, Phe, Val, Ile, Trp, Tyr, Thr, Gln, Asn, His, Cys, Lys, Pro, Glu, Gly, Asp, Ala, or Arg
  misc_feature (10)..(10): Xaa can be Arg, Lys, His, or Tyr
LXWHRYHLLX

SEQ ID NO: 182184 - protein, 11 aa, Artificial Sequence
  Description of Artificial Sequence: Synthetic peptide
  Seed: LTWHRYHLLRL (TYRP1_HUMAN)
  misc_feature (2)..(2): Xaa can be Phe, Thr, Met, Gln, Val, Ser, Tyr, Leu, Ala, Trp, Ile, Gly, Arg, His, Lys, or Asn
  misc_feature (11)..(11): Xaa can be Arg, Lys, Phe, Tyr, Trp, Leu, His, Gly, Val, Asp, Ile, Asn, Ser, Ala, Pro, Thr, Cys, Glu, Met, or Gln
LXWHRYHLLRX

SEQ ID NO: 182185 - protein, 9 aa, Artificial Sequence
  Description of Artificial Sequence: Synthetic peptide
  Seed: LVALIFGTA (TYRP1_HUMAN)
  misc_feature (2)..(2): Xaa can be Pro, Met, Leu, Thr, Gln, Ile, Val, Ser, Ala, Gly, or Asn
  misc_feature (9)..(9): Xaa can be Val, Leu, Met, Ile, Ala, Thr, Ser, Pro, Gly, Lys, Phe, Arg, Gln, Cys, Tyr, Glu, or His
LXALIFGTX

SEQ ID NO: 182186 - protein, 11 aa, Artificial Sequence
  Description of Artificial Sequence: Synthetic peptide
  Seed: LVALIFGTASY (TYRP1_HUMAN)
  misc_feature (2)..(2): Xaa can be Gln, Ser, Met, Thr, Lys, Ile, Val, Arg, Tyr, Ala, Asp, Trp, Glu, Pro, Gly, Cys, His, Phe, Asn, or Leu
  misc_feature (11)..(11): Xaa can be Met, Tyr, Phe, Trp, Leu, or Ile
LXALIFGTASX

SEQ ID NO: 182187 - protein, 9 aa, Artificial Sequence
  Description of Artificial Sequence: Synthetic peptide
  Seed: MAKRTTHPL (TYRP1_HUMAN)
  misc_feature (2)..(2): Xaa can be Pro, Thr, Ser, Ala, Met, Val, Tyr, Ile, Gln, Phe, Leu, Gly, Trp, His, Arg, Asn, Lys, Glu, Cys, or Asp
  misc_feature (9)..(9): Xaa can be Tyr, Trp, Leu, Met, Phe, Ile, Val, Lys, Ala, His, Arg, Thr, Ser, Gly, Cys, Asn, Gln, Pro, Glu, or Asp
MXKRTTHPX

SEQ ID NO: 182188 - protein, 10 aa, Artificial Sequence
  Description of Artificial Sequence: Synthetic peptide
  Seed: MAKRTTHPLF (TYRP1_HUMAN)
  misc_feature (2)..(2): Xaa can be Met, Leu, Pro, Gln, Ile, Ala, Ser, Thr, Asn, Phe, Glu, Val, Gly, Asp, Trp, His, Cys, Lys, Arg, or Tyr
  misc_feature (10)..(10): Xaa can be Tyr, Met, Phe, Leu, Trp, Ile, Val, Ala, His, Lys, Glu, Arg, Asp, Gly, Thr, Gln, Cys, Ser, Pro, or Asn
MXKRTTHPLX

SEQ ID NO: 182189 - protein, 11 aa, Artificial Sequence
  Description of Artificial Sequence: Synthetic peptide
  Seed: MAKRTTHPLFV (TYRP1_HUMAN)
  misc_feature (2)..(2): Xaa can be Thr, Ser, Val, Met, Ile, Ala, Gln, Phe, Tyr, Leu, Gly, Asn, His, or Trp
  misc_feature (11)..(11): Xaa can be Lys, Ala, Val, Ile, Leu, Met, Ser, or Tyr
MXKRTTHPLFX

SEQ ID NO: 182190 - protein, 9 aa, Artificial Sequence
  Description of Artificial Sequence: Synthetic peptide
  Seed: MCCPDLSPV (TYRP1_HUMAN)
  misc_feature (2)..(2): Xaa can be Met, Leu, Ala, Ile, Gln, Val, Ser, Thr, Gly, Asn, Cys, Glu, Phe, Asp, Tyr, or Pro
  misc_feature (9)..(9): Xaa can be Val, Leu, Ile, Met, Ala, Phe, Thr, Cys, Ser, Pro, Arg, Lys, Tyr, or Gly
MXCPDLSPX

SEQ ID NO: 182191 - protein, 8 aa, Artificial Sequence
  Description of Artificial Sequence: Synthetic peptide
  Seed: MDEANQPL (TYRP1_HUMAN)
  misc_feature (2)..(2): Xaa can be Glu, or Asp
  misc_feature (8)..(8): Xaa can be Met, Leu, Phe, Ile, or Val
MXEANQPX

SEQ ID NO: 182192 - protein, 9 aa, Artificial Sequence
  Description of Artificial Sequence: Synthetic peptide
  Seed: MDEANQPLL (TYRP1_HUMAN)
  misc_feature (2)..(2): Xaa can be Glu, Asp, Gln, Ala, Cys, Leu, Ile, Tyr, Met, Val, Gly, Arg, Ser, Phe, His, Thr, Trp, Pro, Asn, or Lys
  misc_feature (9)..(9): Xaa can be Leu, Met, Ile, Phe, Val, Cys, Ala, Tyr, Pro, Trp, Glu, Thr, Ser, Asp, Gly, Lys, Gln, or Ar g
MXEANQPLX

SEQ ID NO: 182193 - protein, 9 aa, Artificial Sequence
  Description of Artificial Sequence: Synthetic peptide
  Seed: MFVTAPDNL (TYRP1_HUMAN)
  misc_feature (2)..(2): Xaa can be Arg, Ala, Ser, Thr, Tyr, Val, Phe, Trp, Ile, Gly, Met, Gln, His, Leu, Pro, Asn, Glu, Lys, or Cys
  misc_feature (9)..(9): Xaa can be Leu, Met, Phe, Tyr, Ile, Trp, Lys, Val, Arg, His, Cys, or Ala
MXVTAPDNX

SEQ ID NO: 182194 - protein, 11 aa, Artificial Sequence
  Description of Artificial Sequence: Synthetic peptide
  Seed: MFVTAPDNLGY (TYRP1_HUMAN)
  misc_feature (2)..(2): Xaa can be Thr, Ser, Gln, Met, Ala, Val, Asn, Asp, Phe, Ile, Gly, Leu, Cys, Tyr, Trp, Glu, Pro, Lys, Arg, or His
  misc_feature (11)..(11): Xaa can be Met, Phe, Tyr, Trp, Lys, Arg, Leu, His, or Ile
MXVTAPDNLGX

SEQ ID NO: 182195 - protein, 11 aa, Artificial Sequence
  Description of Artificial Sequence: Synthetic peptide
  Seed: MGSRSNFDSTL (TYRP1_HUMAN)
  misc_feature (2)..(2): Xaa can be Arg, Tyr, Met, Gln, Thr, Ser, Glu, Asn, His, Phe, Ile, Leu, Lys, Cys, Pro, Ala, Trp, Val, Gly, or Asp
  misc_feature (11)..(11): Xaa can be Leu, Met, Phe, Ile, or Val
MXSRSNFDSTX

SEQ ID NO: 182196 - protein, 9 aa, Artificial Sequence
  Description of Artificial Sequence: Synthetic peptide
  Seed: MLQEPSFSL (TYRP1_HUMAN)
  misc_feature (2)..(2): Xaa can be Pro, Arg, Met, Leu, Gln, Ala, His, Tyr, Thr, Ile, Val, Phe, Ser, Lys, Glu, Gly, Asn, Trp, Cys, or Asp
  misc_feature (9)..(9): Xaa can be Arg, Phe, Leu, Tyr, Trp, Val, Ile, Met, Lys, His, Ala, Cys, Thr, Ser, Gly, Pro, Glu, Asn, Gln, or Asp
MXQEPSFSX

SEQ ID NO: 182197 - protein, 10 aa, Artificial Sequence
  Description of Artificial Sequence: Synthetic peptide
  Seed: MLQEPSFSLP (TYRP1_HUMAN)
  misc_feature (2)..(2): Xaa can be Leu, Met, Ile, Gln, Val, Thr, Gly, Tyr, Phe, Trp, Ser, Ala, Asn, or Cys
  misc_feature (10)..(10): Xaa can be Val, Leu, Ile, Ala, Met, Arg, Glu, Asn, Thr, Asp, Gly, Tyr, Gln, Trp, His, Ser, Pro, Cys, Phe, or Lys
MXQEPSFSLX

SEQ ID NO: 182198 - protein, 11 aa, Artificial Sequence
  Description of Artificial Sequence: Synthetic peptide
  Seed: MLQEPSFSLPY (TYRP1_HUMAN)
  misc_feature (2)..(2): Xaa can be Leu, Met, Gln, Ala, Ile, Val, Pro, Thr, Ser, Lys, His, Phe, Arg, Glu, Trp, Tyr, Gly, Cys, Asp, or Asn
  misc_feature (11)..(11): Xaa can be Tyr, Phe, Met, Leu, Val, His, Lys, Ile, Arg, Trp, Ala, Gly, Asp, Ser, Asn, Thr, Cys, Glu, Gln, or Pro
MXQEPSFSLPX

SEQ ID NO: 182199 - protein, 10 aa, Artificial Sequence
  Description of Artificial Sequence: Synthetic peptide
  Seed: MQEMLQEPSF (TYRP1_HUMAN)
  misc_feature (2)..(2): Xaa can be Met, Phe, Trp, Glu, Pro, Tyr, Asp, Lys, Ile, Gln, Ser, Thr, Val, Arg, Cys, Asn, His, Ala, Leu, or Gly
  misc_feature (10)..(10): Xaa can be Tyr, Leu, Ile, Met, Phe, Val, or Trp
MXEMLQEPSX

SEQ ID NO: 182200 - protein, 9 aa, Artificial Sequence
  Description of Artificial Sequence: Synthetic peptide
  Seed: MSAPKLLSL (TYRP1_HUMAN)
  misc_feature (2)..(2): Xaa can be Pro, Glu, Ala, Arg, Gln, Met, Leu, Ser, His, Val, Tyr, Thr, Ile, Gly, Asp, Phe, Lys, Asn, Trp, or Cys
  misc_feature (9)..(9): Xaa can be Leu, Ala, Val, Met, Ile, Trp, His, Cys, Tyr, Arg, Phe, Lys, Thr, Pro, Ser, Gln, Gly, Asn, Glu, or Asp
MXAPKLLSX

SEQ ID NO: 182201 - protein, 10 aa, Artificial Sequence
  Description of Artificial Sequence: Synthetic peptide
  Seed: MSAPKLLSLG (TYRP1_HUMAN)
  misc_feature (2)..(2): Xaa can be Ser, Ala, Thr, Met, Gly, Val, Gln, Asn, Leu, Ile, Cys, Asp, His, Lys, Trp, Pro, Glu, Phe, Arg, or Tyr
  misc_feature (10)..(10): Xaa can be Trp, Phe, Tyr, Leu, Ile, Met, Val, Gly, Asp, or Asn
MXAPKLLSLX

SEQ ID NO: 182202 - protein, 11 aa, Artificial Sequence
  Description of Artificial Sequence: Synthetic peptide
  Seed: MSAPKLLSLGC (TYRP1_HUMAN)
  misc_feature (2)..(2): Xaa can be Thr, Ser, Ala, Gln, Met, Val, Leu, Cys, Asn, Gly, Ile, Phe, Trp, Pro, Glu, or Asp
  misc_feature (11)..(11): Xaa can be Trp, Phe, Ile, Leu, Met, Tyr, Cys, or Val
MXAPKLLSLGX

SEQ ID NO: 182203 - protein, 8 aa, Artificial Sequence
  Description of Artificial Sequence: Synthetic peptide
  Seed: MVPFWPPV (TYRP1_HUMAN)
  misc_feature (2)..(2): Xaa can be Leu, Met, Gln, Trp, Ile, Phe, Val, Tyr, Ala, Ser, Thr, or Asn
  misc_feature (8)..(8): Xaa can be Val, Leu, Ile, Met, or Ala
MXPFWPPX

SEQ ID NO: 182204 - protein, 10 aa, Artificial Sequence
  Description of Artificial Sequence: Synthetic peptide
  Seed: MVPFWPPVTN (TYRP1_HUMAN)
  misc_feature (2)..(2): Xaa can be Asn, Ala, Asp, Ser, Val, Met, Gly, Ile, Lys, Cys, His, Glu, Leu, Trp, Gln, Thr, Phe, Pro, Tyr, or Arg
  misc_feature (10)..(10): Xaa can be Phe, Asn, Met, Gly, Val, Ala, His, Tyr, Gln, Ser, Trp, Glu, Cys, Leu, Ile, or Thr
MXPFWPPVTX

SEQ ID NO: 182205 - protein, 9 aa, Artificial Sequence
  Description of Artificial Sequence: Synthetic peptide
  Seed: NADISTFPL (TYRP1_HUMAN)
  misc_feature (2)..(2): Xaa can be Ala, Phe, Pro, Thr, Ser, Trp, Tyr, Gln, His, Met, Val, Ile, Leu, Gly, Arg, Asn, Cys, Lys, Glu, or Asp
  misc_feature (9)..(9): Xaa can be Met, Leu, Phe, Tyr, Val, Ile, Lys, Ala, Arg, Cys, Trp, Thr, or His
NXDISTFPX

SEQ ID NO: 182206 - protein, 8 aa, Artificial Sequence
  Description of Artificial Sequence: Synthetic peptide
  Seed: NAPIGHNR (TYRP1_HUMAN)
  misc_feature (2)..(2): Xaa can be Val, Ser, Ile, Thr, or Ala
  misc_feature (8)..(8): Xaa can be , or Arg
NXPIGHNX

SEQ ID NO: 182207 - protein, 10 aa, Artificial Sequence
  Description of Artificial Sequence: Synthetic peptide
  Seed: NAPIGHNRQY (TYRP1_HUMAN)
  misc_feature (2)..(2): Xaa can be Thr, Ser, Ala, Gln, Ile, Pro, Met, Val, Leu, Phe, Tyr, Asp, Trp, or Glu
  misc_feature (10)..(10): Xaa can be Tyr, Phe, Leu, Met, or Lys
NXPIGHNRQX

SEQ ID NO: 182208 - protein, 9 aa, Artificial Sequence
  Description of Artificial Sequence: Synthetic peptide
  Seed: NCGTCRPGW (TYRP1_HUMAN)
  misc_feature (2)..(2): Xaa can be Ala, Thr, Ser, Gly, Ile, Leu, Asn, Cys, Pro, Gln, Phe, Val, or Met
  misc_feature (9)..(9): Xaa can be Trp, or Phe
NXGTCRPGX

SEQ ID NO: 182209 - protein, 8 aa, Artificial Sequence
  Description of Artificial Sequence: Synthetic peptide
  Seed: NDPIFVLL (TYRP1_HUMAN)
  misc_feature (2)..(2): Xaa can be Glu, Asp, Gln, Asn, Ala, Ser, Arg, His, or Gly
  misc_feature (8)..(8): Xaa can be Leu, Met, Phe, Ile, or Val
NXPIFVLX

SEQ ID NO: 182210 - protein, 9 aa, Artificial Sequence
  Description of Artificial Sequence: Synthetic peptide
  Seed: NFDSTLISP (TYRP1_HUMAN)
  misc_feature (2)..(2): Xaa can be Tyr, Phe, Trp, Leu, Ile, Met, Ala, Val, His, Ser, Asn, Gln, Gly, Cys, Pro, Asp, Arg, Thr, Lys, or Glu
  misc_feature (9)..(9): Xaa can be Leu, Phe, Met, Ile, Val, Cys, Tyr, Trp, Lys, Ala, Thr, Ser, Gln, Arg, His, Glu, Pro, or Gl y
NXDSTLISX

SEQ ID NO: 182211 - protein, 11 aa, Artificial Sequence
  Description of Artificial Sequence: Synthetic peptide
  Seed: NFSGHNCGTCR (TYRP1_HUMAN)
  misc_feature (2)..(2): Xaa can be Met, Trp, Ile, Thr, Ala, Val, Ser, Phe, Tyr, Asn, Cys, Glu, Gln, Gly, or Leu
  misc_feature (11)..(11): Xaa can be Arg, or Lys
NXSGHNCGTCX

SEQ ID NO: 182212 - protein, 9 aa, Artificial Sequence
  Description of Artificial Sequence: Synthetic peptide
  Seed: NGTGGQTHL (TYRP1_HUMAN)
  misc_feature (2)..(2): Xaa can be Ala, Ser, Thr, Val, Ile, Gln, Gly, Leu, Tyr, Arg, Phe, Glu, Asn, Met, Cys, Asp, His, Lys, Trp, or Pro
  misc_feature (9)..(9): Xaa can be Leu, Phe, Tyr, Met, Lys, Ile, Val, Arg, His, Trp, or Ala
NXTGGQTHX

SEQ ID NO: 182213 - protein, 9 aa, Artificial Sequence
  Description of Artificial Sequence: Synthetic peptide
  Seed: NHFVRALDM (TYRP1_HUMAN)
  misc_feature (2)..(2): Xaa can be His, Arg, Gln, Pro, Glu, Lys, Met, Tyr, Ser, Asn, Gly, Ala, Phe, Thr, Ile, Val, Asp, Trp, Leu, or Cys
  misc_feature (9)..(9): Xaa can be Leu, Met, Phe, Ile, Tyr, Val, Ala, Cys, Thr, Trp, His, Lys, Arg, Ser, Gly, or Pro
NXFVRALDX

SEQ ID NO: 182214 - protein, 10 aa, Artificial Sequence
  Description of Artificial Sequence: Synthetic peptide
  Seed: NHFVRALDMA (TYRP1_HUMAN)
  misc_feature (2)..(2): Xaa can be , or His
  misc_feature (10)..(10): Xaa can be Val, Leu, or Ala
NXFVRALDMX

SEQ ID NO: 182215 - protein, 9 aa, Artificial Sequence
  Description of Artificial Sequence: Synthetic peptide
  Seed: NISIYNYFV (TYRP1_HUMAN)
  misc_feature (2)..(2): Xaa can be Leu, Met, Val, Thr, Gln, Ala, Ile, Ser, Gly, Asn, Phe, or Pro
  misc_feature (9)..(9): Xaa can be Val, Ala, Leu, Ile, Met, Thr, Cys, Ser, or Phe
NXSIYNYFX

SEQ ID NO: 182216 - protein, 10 aa, Artificial Sequence
  Description of Artificial Sequence: Synthetic peptide
  Seed: NISIYNYFVW (TYRP1_HUMAN)
  misc_feature (2)..(2): Xaa can be Ser, Arg, Thr, Phe, Leu, Met, Val, Tyr, His, Lys, Ile, Ala, Trp, Gln, Cys, Asn, Glu, Gly, Asp, or Pro
  misc_feature (10)..(10): Xaa can be Trp, Phe, or Tyr
NXSIYNYFVX

SEQ ID NO: 182217 - protein, 10 aa, Artificial Sequence
  Description of Artificial Sequence: Synthetic peptide
  Seed: NLAHLFLNGT (TYRP1_HUMAN)
  misc_feature (2)..(2): Xaa can be Leu, Met, Gln, Ile, Val, Thr, Ser, or Ala
  misc_feature (10)..(10): Xaa can be Val, Ile, Leu, Ala, Thr, or Met
NXAHLFLNGX

SEQ ID NO: 182218 - protein, 8 aa, Artificial Sequence
  Description of Artificial Sequence: Synthetic peptide
  Seed: NLGYTYEI (TYRP1_HUMAN)
  misc_feature (2)..(2): Xaa can be Leu, or Met
  misc_feature (8)..(8): Xaa can be Leu, Ile, or Val
NXGYTYEX

SEQ ID NO: 182219 - protein, 10 aa, Artificial Sequence
  Description of Artificial Sequence: Synthetic peptide
  Seed: NLLDLSKEEK (TYRP1_HUMAN)
  misc_feature (2)..(2): Xaa can be Ala, Thr, Ser, Met, Val, Ile, Gln, Leu, Glu, Gly, Phe, Asn, Asp, Tyr, Cys, Trp, or Pro
  misc_feature (10)..(10): Xaa can be Lys, Arg, Tyr, Phe, Met, Leu, Trp, or His
NXLDLSKEEX

SEQ ID NO: 182220 - protein, 9 aa, Artificial Sequence
  Description of Artificial Sequence: Synthetic peptide
  Seed: NMVPFWPPV (TYRP1_HUMAN)
  misc_feature (2)..(2): Xaa can be Gln, Met, Leu, Tyr, Val, Thr, Ile, Ala, Ser, Phe, Trp, Gly, Asn, Glu, Lys, Arg, His, Pro, or Cys
  misc_feature (9)..(9): Xaa can be Phe, Tyr, Val, Ile, Arg, Leu, Met, Lys, Ala, Thr, Cys, Ser, Trp, or His
NXVPFWPPX

SEQ ID NO: 182221 - protein, 10 aa, Artificial Sequence
  Description of Artificial Sequence: Synthetic peptide
  Seed: NMVPFWPPVT (TYRP1_HUMAN)
  misc_feature (2)..(2): Xaa can be Met, Leu, Ile, Val, Thr, Gln, Ala, or Ser
  misc_feature (10)..(10): Xaa can be Val, Leu, Ile, Ala, Glu, Tyr, Met, Trp, Ser, Pro, Lys, His, Arg, Gln, Thr, Cys, Asn, Asp, Phe, or Gly
NXVPFWPPVX

SEQ ID NO: 182222 - protein, 9 aa, Artificial Sequence
  Description of Artificial Sequence: Synthetic peptide
  Seed: NPAGNVARP (TYRP1_HUMAN)
  misc_feature (2)..(2): Xaa can be Pro, or Ala
  misc_feature (9)..(9): Xaa can be Ala, Ile, Tyr, Met, Leu, Ser, Pro, Thr, Val, Cys, or Phe
NXAGNVARX

SEQ ID NO: 182223 - protein, 10 aa, Artificial Sequence
  Description of Artificial Sequence: Synthetic peptide
  Seed: NPAGNVARPM (TYRP1_HUMAN)
  misc_feature (2)..(2): Xaa can be Pro, Ala, Val, Ser, Met, or Ile
  misc_feature (10)..(10): Xaa can be Tyr, Phe, Ala, Met, Leu, Thr, Ser, Cys, Gly, Pro, Val, Ile, or Trp
NXAGNVARPX

SEQ ID NO: 182224 - protein, 11 aa, Artificial Sequence
  Description of Artificial Sequence: Synthetic peptide
  Seed: NPAGNVARPMV (TYRP1_HUMAN)
  misc_feature (2)..(2): Xaa can be , or Pro
  misc_feature (11)..(11): Xaa can be Ala, Leu, Val, Ile, Thr, Pro, Cys, Ser, Met, Tyr, or Phe
NXAGNVARPMX

SEQ ID NO: 182225 - protein, 9 aa, Artificial Sequence
  Description of Artificial Sequence: Synthetic peptide
  Seed: NQPLLTDQY (TYRP1_HUMAN)
  misc_feature (2)..(2): Xaa can be Arg, Ala, Tyr, Phe, Ile, His, Ser, Thr, Gln, Gly, Val, Trp, Met, Leu, Lys, Glu, Pro, Asn, or Asp
  misc_feature (9)..(9): Xaa can be Tyr, Phe, Leu, Met, Val, Ile, Trp, or His
NXPLLTDQX

SEQ ID NO: 182226 - protein, 9 aa, Artificial Sequence
  Description of Artificial Sequence: Synthetic peptide
  Seed: NRQYNMVPF (TYRP1_HUMAN)
  misc_feature (2)..(2): Xaa can be Arg, His, Tyr, Gln, Phe, Met, Lys, Trp, Ser, Leu, Ala, Val, Thr, Glu, Ile, Gly, Asn, or Pr o
  misc_feature (9)..(9): Xaa can be Phe, Leu, Tyr, Met, Ile, Val, Trp, Ala, His, Thr, Cys, Lys, or Arg
NXQYNMVPX

SEQ ID NO: 182227 - protein, 10 aa, Artificial Sequence
  Description of Artificial Sequence: Synthetic peptide
  Seed: NRQYNMVPFW (TYRP1_HUMAN)
  misc_feature (2)..(2): Xaa can be Arg, Met, Trp, Phe, Leu, Tyr, or Gln
  misc_feature (10)..(10): Xaa can be Trp, Phe, Leu, or Tyr
NXQYNMVPFX

SEQ ID NO: 182228 - protein, 10 aa, Artificial Sequence
  Description of Artificial Sequence: Synthetic peptide
  Seed: NSFRNTVEGY (TYRP1_HUMAN)
  misc_feature (2)..(2): Xaa can be Thr, Ala, Val, Gln, Met, Ser, Ile, Leu, Gly, Pro, Asn, Tyr, Phe, Cys, His, Lys, Glu, Asp, Arg, or Trp
  misc_feature (10)..(10): Xaa can be Tyr, Trp, Phe, Lys, Arg, Met, Leu, or His
NXFRNTVEGX

SEQ ID NO: 182229 - protein, 9 aa, Artificial Sequence
  Description of Artificial Sequence: Synthetic peptide
  Seed: NSTEDGPIR (TYRP1_HUMAN)
  misc_feature (2)..(2): Xaa can be Ala, Ser, Ile, Val, Thr, Gly, Gln, Met, Leu, Phe, Tyr, Cys, Glu, Asp, Asn, Pro, or Trp
  misc_feature (9)..(9): Xaa can be Lys, Arg, Tyr, Met, Phe, Leu, His, Ile, Val, or Trp
NXTEDGPIX

SEQ ID NO: 182230 - protein, 10 aa, Artificial Sequence
  Description of Artificial Sequence: Synthetic peptide
  Seed: NSTEDGPIRR (TYRP1_HUMAN)
  misc_feature (2)..(2): Xaa can be Ala, Ser, Thr, Val, Gly, Glu, Met, Gln, Asn, Tyr, Phe, Asp, Leu, Ile, Cys, Trp, Lys, His, Arg, or Pro
  misc_feature (10)..(10): Xaa can be Arg, Tyr, Lys, Leu, Met, or Phe
NXTEDGPIRX

SEQ ID NO: 182231 - protein, 10 aa, Artificial Sequence
  Description of Artificial Sequence: Synthetic peptide
  Seed: NSTNSFRNTV (TYRP1_HUMAN)
  misc_feature (2)..(2): Xaa can be Thr, Lys, Cys, Tyr, Val, Glu, Gly, Asp, Ile, Arg, Pro, Ser, Ala, Gln, His, Met, Trp, Phe, Asn, or Leu
  misc_feature (10)..(10): Xaa can be Leu, Ile, Val, or Ala
NXTNSFRNTX

SEQ ID NO: 182232 - protein, 8 aa, Artificial Sequence
  Description of Artificial Sequence: Synthetic peptide
  Seed: NSVFSQWR (TYRP1_HUMAN)
  misc_feature (2)..(2): Xaa can be Thr, Val, Ile, Ala, or Ser
  misc_feature (8)..(8): Xaa can be Arg, or Lys
NXVFSQWX

SEQ ID NO: 182233 - protein, 9 aa, Artificial Sequence
  Description of Artificial Sequence: Synthetic peptide
  Seed: NSVFSQWRV (TYRP1_HUMAN)
  misc_feature (2)..(2): Xaa can be Thr, Met, Gln, Val, Ala, Ser, Ile, Leu, Asn, or Gly
  misc_feature (9)..(9): Xaa can be Val, Leu, Ile, Ala, Met, or Thr
NXVFSQWRX

SEQ ID NO: 182234 - protein, 10 aa, Artificial Sequence
  Description of Artificial Sequence: Synthetic peptide
  Seed: NSVFSQWRVV (TYRP1_HUMAN)
  misc_feature (2)..(2): Xaa can be Thr, Val, Met, Ile, Ala, or Ser
  misc_feature (10)..(10): Xaa can be Val, Ala, Ile, Leu, or Met
NXVFSQWRVX

SEQ ID NO: 182235 - protein, 10 aa, Artificial Sequence
  Description of Artificial Sequence: Synthetic peptide
  Seed: NTPQFENISI (TYRP1_HUMAN)
  misc_feature (2)..(2): Xaa can be Thr, Val, Ser, Ile, or Ala
  misc_feature (10)..(10): Xaa can be Val, Ala, Leu, or Ile
NXPQFENISX

SEQ ID NO: 182236 - protein, 11 aa, Artificial Sequence
  Description of Artificial Sequence: Synthetic peptide
  Seed: NTPQFENISIY (TYRP1_HUMAN)
  misc_feature (2)..(2): Xaa can be Thr, Ser, Ile, Leu, Val, Ala, Cys, His, Asn, Trp, Phe, Gln, Gly, Tyr, Met, Arg, Pro, Lys, Glu, or Asp
  misc_feature (11)..(11): Xaa can be Tyr, Phe, Met, or Lys
NXPQFENISIX

SEQ ID NO: 182237 - protein, 10 aa, Artificial Sequence
  Description of Artificial Sequence: Synthetic peptide
  Seed: NTVEGYSDPT (TYRP1_HUMAN)
  misc_feature (2)..(2): Xaa can be Thr, Val, Ser, Ala, Ile, Leu, Met, or Asn
  misc_feature (10)..(10): Xaa can be Val, Leu, Ile, Ala, Met, or Thr
NXVEGYSDPX

SEQ ID NO: 182238 - protein, 9 aa, Artificial Sequence
  Description of Artificial Sequence: Synthetic peptide
  Seed: NVARPMVQR (TYRP1_HUMAN)
  misc_feature (2)..(2): Xaa can be Val, Thr, Ile, Ala, Met, Leu, Ser, Asn, Pro, Phe, Gly, Asp, Tyr, Glu, Gln, Cys, Trp, Lys, Arg, or His
  misc_feature (9)..(9): Xaa can be Arg, Lys, His, Tyr, Leu, Met, Phe, Gln, Val, or Ile
NXARPMVQX

SEQ ID NO: 182239 - protein, 10 aa, Artificial Sequence
  Description of Artificial Sequence: Synthetic peptide
  Seed: NVARPMVQRL (TYRP1_HUMAN)
  misc_feature (2)..(2): Xaa can be Val, Ile, Thr, Ser, Ala, Leu, Met, Gln, Phe, Gly, Asn, or Pro
  misc_feature (10)..(10): Xaa can be Arg, Lys, Val, Tyr, Asn, Ala, Trp, Cys, Leu, Glu, Asp, Gln, Met, Pro, Ser, His, Phe, Ile, Thr, or Gly
NXARPMVQRX

SEQ ID NO: 182240 - protein, 8 aa, Artificial Sequence
  Description of Artificial Sequence: Synthetic peptide
  Seed: NYFVWTHY (TYRP1_HUMAN)
  misc_feature (2)..(2): Xaa can be Tyr, Trp, Arg, Phe, His, Gln, Glu, Ser, Met, Gly, Val, Asn, Leu, Ile, Ala, or Thr
  misc_feature (8)..(8): Xaa can be Tyr, Phe, Leu, Met, Ile, or Val
NXFVWTHX

SEQ ID NO: 182241 - protein, 9 aa, Artificial Sequence
  Description of Artificial Sequence: Synthetic peptide
  Seed: NYFVWTHYY (TYRP1_HUMAN)
  misc_feature (2)..(2): Xaa can be Tyr, Pro, Phe, Met, Arg, Thr, Ala, Leu, Ile, Val, Trp, Ser, Gln, His, Gly, Cys, Asn, Glu, Lys, or Asp
  misc_feature (9)..(9): Xaa can be Arg, Phe, Tyr, Lys, Leu, Met, Trp, Ile, Val, His, Ala, Gln, Thr, Glu, Gly, Cys, or Ser
NXFVWTHYX

SEQ ID NO: 182242 - protein, 10 aa, Artificial Sequence
  Description of Artificial Sequence: Synthetic peptide
  Seed: NYFVWTHYYS (TYRP1_HUMAN)
  misc_feature (2)..(2): Xaa can be Tyr, Leu, Val, Gln, Trp, Phe, Ser, Thr, Met, Ile, Ala, Pro, Cys, His, Gly, Glu, Arg, Asn, Lys, or Asp
  misc_feature (10)..(10): Xaa can be Phe, Met, Tyr, His, Ala, Val, Arg, Trp, Leu, Lys, Ile, Pro, Asp, Asn, Gln, Thr, Cys, Gly, Glu, or Ser
NXFVWTHYYX

SEQ ID NO: 182243 - protein, 11 aa, Artificial Sequence
  Description of Artificial Sequence: Synthetic peptide
  Seed: NYFVWTHYYSV (TYRP1_HUMAN)
  misc_feature (2)..(2): Xaa can be Met, Tyr, Leu, Trp, Ile, Gln, Val, Thr, Phe, Arg, Ser, Lys, His, Glu, Asp, Pro, Asn, Ala, Gly, or Cys
  misc_feature (11)..(11): Xaa can be Val, Phe, Ile, Leu, Trp, Met, Thr, Ala, or Tyr
NXFVWTHYYSX

SEQ ID NO: 182244 - protein, 9 aa, Artificial Sequence
  Description of Artificial Sequence: Synthetic peptide
  Seed: PAFLTWHRY (TYRP1_HUMAN)
  misc_feature (2)..(2): Xaa can be Gln, Asn, Thr, Tyr, Ala, Trp, Leu, Ile, Ser, Glu, Gly, Phe, Asp, Val, or Met
  misc_feature (9)..(9): Xaa can be Tyr, or Phe
PXFLTWHRX

SEQ ID NO: 182245 - protein, 9 aa, Artificial Sequence
  Description of Artificial Sequence: Synthetic peptide
  Seed: PAGNVARPM (TYRP1_HUMAN)
  misc_feature (2)..(2): Xaa can be Ala, Val, or Ser
  misc_feature (9)..(9): Xaa can be Tyr, Met, or Phe
PXGNVARPX

SEQ ID NO: 182246 - protein, 10 aa, Artificial Sequence
  Description of Artificial Sequence: Synthetic peptide
  Seed: PAVRSLHNLA (TYRP1_HUMAN)
  misc_feature (2)..(2): Xaa can be Arg, Lys, Ser, Met, His, Ala, Phe, Cys, Tyr, Gly, Gln, Thr, Leu, Val, or Ile
  misc_feature (10)..(10): Xaa can be Lys, Ala, Val, Gly, Ile, Phe, Ser, Met, Tyr, Leu, Thr, Arg, or Pro
PXVRSLHNLX

SEQ ID NO: 182247 - protein, 8 aa, Artificial Sequence
  Description of Artificial Sequence: Synthetic peptide
  Seed: PEIIAIAV (TYRP1_HUMAN)
  misc_feature (2)..(2): Xaa can be , or Glu
  misc_feature (8)..(8): Xaa can be Ala, Leu, or Val
PXIIAIAX

SEQ ID NO: 182248 - protein, 9 aa, Artificial Sequence
  Description of Artificial Sequence: Synthetic peptide
  Seed: PEIIAIAVV (TYRP1_HUMAN)
  misc_feature (2)..(2): Xaa can be Glu, Ala, or Gln
  misc_feature (9)..(9): Xaa can be Ile, Val, Cys, Pro, Phe, Leu, Thr, Met, or Ala
PXIIAIAVX

SEQ ID NO: 182249 - protein, 11 aa, Artificial Sequence
  Description of Artificial Sequence: Synthetic peptide
  Seed: PFWPPVTNTEM (TYRP1_HUMAN)
  misc_feature (2)..(2): Xaa can be Tyr, Phe, or Trp
  misc_feature (11)..(11): Xaa can be Phe, Tyr, Met, or Leu
PXWPPVTNTEX

SEQ ID NO: 182250 - protein, 10 aa, Artificial Sequence
  Description of Artificial Sequence: Synthetic peptide
  Seed: PFYSNSTNSF (TYRP1_HUMAN)
  misc_feature (2)..(2): Xaa can be Arg, Tyr, Trp, Ile, Ser, Phe, Met, Val, His, Leu, Ala, Thr, Lys, Asn, Pro, Glu, Asp, Gly, Cys, or Gln
  misc_feature (10)..(10): Xaa can be Phe, Met, Leu, Trp, Tyr, or Ile
PXYSNSTNSX

SEQ ID NO: 182251 - protein, 11 aa, Artificial Sequence
  Description of Artificial Sequence: Synthetic peptide
  Seed: PFYSNSTNSFR (TYRP1_HUMAN)
  misc_feature (2)..(2): Xaa can be Met, Arg, His, Glu, Gln, Gly, Val, Tyr, Trp, Ala, Cys, Lys, Ile, Phe, Thr, Ser, or Leu
  misc_feature (11)..(11): Xaa can be Arg, or Lys
PXYSNSTNSFX

SEQ ID NO: 182252 - protein, 9 aa, Artificial Sequence
  Description of Artificial Sequence: Synthetic peptide
  Seed: PIFVLLHTF (TYRP1_HUMAN)
  misc_feature (2)..(2): Xaa can be Tyr, Phe, Thr, Ser, Trp, Ala, Gln, Met, Asn, Glu, Ile, Gly, Val, Leu, His, Asp, Cys, Pro, or Arg
  misc_feature (9)..(9): Xaa can be Phe, Tyr, Trp, Met, Leu, Ile, Val, or Cys
PXFVLLHTX

SEQ ID NO: 182253 - protein, 10 aa, Artificial Sequence
  Description of Artificial Sequence: Synthetic peptide
  Seed: PKLLSLGCIF (TYRP1_HUMAN)
  misc_feature (2)..(2): Xaa can be Ser, Lys, Met, Tyr, Arg, Leu, Ile, Phe, Thr, Ala, Gln, Val, or His
  misc_feature (10)..(10): Xaa can be Tyr, or Phe
PXLLSLGCIX

SEQ ID NO: 182254 - protein, 9 aa, Artificial Sequence
  Description of Artificial Sequence: Synthetic peptide
  Seed: PLFVIATRR (TYRP1_HUMAN)
  misc_feature (2)..(2): Xaa can be Thr, Met, Leu, Gln, Ile, Phe, Val, Trp, Ala, Ser, Tyr, Gly, or Asn
  misc_feature (9)..(9): Xaa can be Arg, or Lys
PXFVIATRX

SEQ ID NO: 182255 - protein, 9 aa, Artificial Sequence
  Description of Artificial Sequence: Synthetic peptide
  Seed: PLLLFQQAR (TYRP1_HUMAN)
  misc_feature (2)..(2): Xaa can be Ala, Leu, Ile, Ser, Tyr, Thr, Phe, Met, Asn, or Val
  misc_feature (9)..(9): Xaa can be , or Arg
PXLLFQQAX

SEQ ID NO: 182256 - protein, 8 aa, Artificial Sequence
  Description of Artificial Sequence: Synthetic peptide
  Seed: PNDPIFVL (TYRP1_HUMAN)
  misc_feature (2)..(2): Xaa can be Ser, Thr, Ala, Ile, Val, Met, Leu, Phe, Asn, Gly, Cys, Trp, Gln, or Tyr
  misc_feature (8)..(8): Xaa can be Leu, Met, Ile, Phe, or Val
PXDPIFVX

SEQ ID NO: 182257 - protein, 9 aa, Artificial Sequence
  Description of Artificial Sequence: Synthetic peptide
  Seed: PNDPIFVLL (TYRP1_HUMAN)
  misc_feature (2)..(2): Xaa can be Tyr, Ala, Phe, Trp, Thr, Ser, Val, Ile, Cys, His, Arg, Gln, Leu, Asn, Met, Gly, Pro, Asp, Glu, or Lys
  misc_feature (9)..(9): Xaa can be Leu, Met, Ile, Phe, Val, Tyr, Ala, Cys, Trp, or Thr
PXDPIFVLX

SEQ ID NO: 182258 - protein, 11 aa, Artificial Sequence
  Description of Artificial Sequence: Synthetic peptide
  Seed: PPFYSNSTNSF (TYRP1_HUMAN)
  misc_feature (2)..(2): Xaa can be Tyr, Arg, Ile, Lys, Val, Phe, Trp, Met, Ser, Asn, Ala, His, Thr, Leu, Pro, Asp, Gln, Gly, Glu, or Cys
  misc_feature (11)..(11): Xaa can be Phe, Met, Tyr, Leu, Trp, or Ile
PXFYSNSTNSX

SEQ ID NO: 182259 - protein, 8 aa, Artificial Sequence
  Description of Artificial Sequence: Synthetic peptide
  Seed: PPVTNTEM (TYRP1_HUMAN)
  misc_feature (2)..(2): Xaa can be , or Pro
  misc_feature (8)..(8): Xaa can be Met, or Leu
PXVTNTEX

SEQ ID NO: 182260 - protein, 9 aa, Artificial Sequence
  Description of Artificial Sequence: Synthetic peptide
  Seed: PPVTNTEMF (TYRP1_HUMAN)
  misc_feature (2)..(2): Xaa can be Pro, or Ala
  misc_feature (9)..(9): Xaa can be Tyr, or Phe
PXVTNTEMX

SEQ ID NO: 182261 - protein, 8 aa, Artificial Sequence
  Description of Artificial Sequence: Synthetic peptide
  Seed: PQDVAQCL (TYRP1_HUMAN)
  misc_feature (2)..(2): Xaa can be Thr, Ser, Phe, Tyr, Ala, Trp, Ile, Leu, Gln, Gly, Met, Val, or Asn
  misc_feature (8)..(8): Xaa can be Leu, Met, Ile, Phe, or Val
PXDVAQCX

SEQ ID NO: 182262 - protein, 8 aa, Artificial Sequence
  Description of Artificial Sequence: Synthetic peptide
  Seed: PQFENISI (TYRP1_HUMAN)
  misc_feature (2)..(2): Xaa can be Gln, Ala, or Glu
  misc_feature (8)..(8): Xaa can be Val, Ile, or Leu
PXFENISX

SEQ ID NO: 182263 - protein, 9 aa, Artificial Sequence
  Description of Artificial Sequence: Synthetic peptide
  Seed: PQFENISIY (TYRP1_HUMAN)
  misc_feature (2)..(2): Xaa can be Ala, Gln, His, Ser, Met, Thr, Val, Ile, Glu, Leu, Arg, Gly, Asn, Tyr, Lys, Phe, Pro, Asp, Cys, or Trp
  misc_feature (9)..(9): Xaa can be Tyr, Phe, Met, Leu, or His
PXFENISIX

SEQ ID NO: 182264 - protein, 11 aa, Artificial Sequence
  Description of Artificial Sequence: Synthetic peptide
  Seed: PQFENISIYNY (TYRP1_HUMAN)
  misc_feature (2)..(2): Xaa can be Ile, Phe, Ser, Trp, Tyr, Thr, Leu, Gln, Met, or Val
  misc_feature (11)..(11): Xaa can be , or Tyr
PXFENISIYNX

SEQ ID NO: 182265 - protein, 11 aa, Artificial Sequence
  Description of Artificial Sequence: Synthetic peptide
  Seed: PRQCATVEALR (TYRP1_HUMAN)
  misc_feature (2)..(2): Xaa can be Arg, or Met
  misc_feature (11)..(11): Xaa can be , or Arg
PXQCATVEALX

SEQ ID NO: 182266 - protein, 8 aa, Artificial Sequence
  Description of Artificial Sequence: Synthetic peptide
  Seed: PSFSLPYW (TYRP1_HUMAN)
  misc_feature (2)..(2): Xaa can be Thr, Ala, or Ser
  misc_feature (8)..(8): Xaa can be , or Trp
PXFSLPYX

SEQ ID NO: 182267 - protein, 10 aa, Artificial Sequence
  Description of Artificial Sequence: Synthetic peptide
  Seed: PSFSLPYWNF (TYRP1_HUMAN)
  misc_feature (2)..(2): Xaa can be Trp, Tyr, Phe, Met, Ser, Thr, Val, Ala, Asn, His, Gln, Lys, Ile, Leu, Arg, or Gly
  misc_feature (10)..(10): Xaa can be Phe, Trp, Leu, Ile, Val, or Met
PXFSLPYWNX

SEQ ID NO: 182268 - protein, 9 aa, Artificial Sequence
  Description of Artificial Sequence: Synthetic peptide
  Seed: PVSGPGTDR (TYRP1_HUMAN)
  misc_feature (2)..(2): Xaa can be Ala, Val, Thr, Leu, Ile, Met, Ser, Tyr, or Phe
  misc_feature (9)..(9): Xaa can be Arg, Lys, Met, or Leu
PXSGPGTDX

SEQ ID NO: 182269 - protein, 9 aa, Artificial Sequence
  Description of Artificial Sequence: Synthetic peptide
  Seed: PYWNFATGK (TYRP1_HUMAN)
  misc_feature (2)..(2): Xaa can be Tyr, Thr, Met, Trp, Phe, Ile, Ser, Gly, Ala, Leu, Val, or Gln
  misc_feature (9)..(9): Xaa can be Arg, or Lys
PXWNFATGX

SEQ ID NO: 182270 - protein, 8 aa, Artificial Sequence
  Description of Artificial Sequence: Synthetic peptide
  Seed: QARAQFPR (TYRP1_HUMAN)
  misc_feature (2)..(2): Xaa can be Met, Phe, Trp, Tyr, Ile, Ala, Thr, Gln, Val, Leu, or Ser
  misc_feature (8)..(8): Xaa can be Arg, or Lys
QXRAQFPX

SEQ ID NO: 182271 - protein, 9 aa, Artificial Sequence
  Description of Artificial Sequence: Synthetic peptide
  Seed: QCATVEALR (TYRP1_HUMAN)
  misc_feature (2)..(2): Xaa can be Val, Thr, Ile, Ala, Met, Leu, Ser, Gln, Pro, Asn, Phe, Trp, Glu, Asp, Cys, Gly, Tyr, Lys, Arg, or His
  misc_feature (9)..(9): Xaa can be Arg, Lys, His, Tyr, Met, Leu, Phe, Gln, Ile, or Val
QXATVEALX

SEQ ID NO: 182272 - protein, 9 aa, Artificial Sequence
  Description of Artificial Sequence: Synthetic peptide
  Seed: QCYAEEYEK (TYRP1_HUMAN)
  misc_feature (2)..(2): Xaa can be Thr, Ala, Ile, Val, Ser, Leu, Met, Asn, Gln, Gly, Asp, Pro, Cys, Tyr, Phe, or Glu
  misc_feature (9)..(9): Xaa can be Lys, Arg, Tyr, or His
QXYAEEYEX

SEQ ID NO: 182273 - protein, 10 aa, Artificial Sequence
  Description of Artificial Sequence: Synthetic peptide
  Seed: QCYAEEYEKL (TYRP1_HUMAN)
  misc_feature (2)..(2): Xaa can be Tyr, Trp, Gly, Asp, Thr, Phe, Cys, Lys, Pro, Ile, Ser, Gln, Ala, Asn, His, Met, Val, Glu, Arg, or Leu
  misc_feature (10)..(10): Xaa can be Leu, Trp, Phe, Ile, Met, or Val
QXYAEEYEKX

SEQ ID NO: 182274 - protein, 9 aa, Artificial Sequence
  Description of Artificial Sequence: Synthetic peptide
  Seed: QDVAQCLEV (TYRP1_HUMAN)
  misc_feature (2)..(2): Xaa can be Glu, Asp, or Gln
  misc_feature (9)..(9): Xaa can be Phe, Val, Ile, Ala, Cys, Leu, Met, Pro, Tyr, Thr, Gly, Asp, Ser, Trp, Lys, or Glu
QXVAQCLEX

SEQ ID NO: 182275 - protein, 9 aa, Artificial Sequence
  Description of Artificial Sequence: Synthetic peptide
  Seed: QEMLQEPSF (TYRP1_HUMAN)
  misc_feature (2)..(2): Xaa can be Glu, Gln, Asp, Met, His, Leu, Ile, Thr, Ser, Val, Ala, Lys, Arg, Asn, Pro, Gly, Cys, Tyr, Phe, or Trp
  misc_feature (9)..(9): Xaa can be Tyr, Phe, Met, Leu, Trp, Ile, Val, His, Pro, Ala, Cys, Arg, Thr, Lys, Ser, Glu, Gly, Asn, Asp, or Gln
QXMLQEPSX

SEQ ID NO: 182276 - protein, 10 aa, Artificial Sequence
  Description of Artificial Sequence: Synthetic peptide
  Seed: QEMLQEPSFS (TYRP1_HUMAN)
  misc_feature (2)..(2): Xaa can be , or Glu
  misc_feature (10)..(10): Xaa can be Val, Pro, Ser, Cys, Leu, Gly, Met, Phe, Ala, Ile, or Thr
QXMLQEPSFX

SEQ ID NO: 182277 - protein, 11 aa, Artificial Sequence
  Description of Artificial Sequence: Synthetic peptide
  Seed: QEMLQEPSFSL (TYRP1_HUMAN)
  misc_feature (2)..(2): Xaa can be Glu, Asp, Met, Leu, Tyr, Gln, Phe, Trp, Lys, Ile, Gly, Arg, Ala, Ser, Asn, Cys, Pro, His, Val, or Thr
  misc_feature (11)..(11): Xaa can be Val, Ile, Leu, Ala, Met, Thr, Trp, Phe, Tyr, Cys, Gly, His, Pro, or Ser
QXMLQEPSFSX

SEQ ID NO: 182278 - protein, 9 aa, Artificial Sequence
  Description of Artificial Sequence: Synthetic peptide
  Seed: QEPSFSLPY (TYRP1_HUMAN)
  misc_feature (2)..(2): Xaa can be Ala, Met, Glu, Gln, Ser, Val, Lys, Asp, Ile, Gly, Thr, Leu, Arg, His, Pro, Cys, Phe, Trp, Asn, or Tyr
  misc_feature (9)..(9): Xaa can be Phe, Tyr, Met, Leu, His, Ile, Val, Trp, Ala, Cys, Lys, or Arg
QXPSFSLPX

SEQ ID NO: 182279 - protein, 10 aa, Artificial Sequence
  Description of Artificial Sequence: Synthetic peptide
  Seed: QEPSFSLPYW (TYRP1_HUMAN)
  misc_feature (2)..(2): Xaa can be Glu, His, Trp, Leu, Met, Thr, Tyr, Cys, Ser, Phe, Ala, Lys, Gly, Gln, Val, Asn, Ile, Asp, Pro, or Arg
  misc_feature (10)..(10): Xaa can be Trp, Phe, Met, Ile, Leu, or Tyr
QXPSFSLPYX

SEQ ID NO: 182280 - protein, 9 aa, Artificial Sequence
  Description of Artificial Sequence: Synthetic peptide
  Seed: QESFGEVDF (TYRP1_HUMAN)
  misc_feature (2)..(2): Xaa can be Glu, Asp, Gln, Ser, Val, Pro, Leu, Ile, Met, Ala, Phe, or Thr
  misc_feature (9)..(9): Xaa can be Tyr, Phe, Trp, Met, Leu, Val, Ala, Ile, Pro, Ser, Cys, Gly, or Thr
QXSFGEVDX

SEQ ID NO: 182281 - protein, 8 aa, Artificial Sequence
  Description of Artificial Sequence: Synthetic peptide
  Seed: QFENISIY (TYRP1_HUMAN)
  misc_feature (2)..(2): Xaa can be Phe, Tyr, Arg, Ile, Trp, Gln, His, or Met
  misc_feature (8)..(8): Xaa can be Tyr, Phe, or Met
QXENISIX

SEQ ID NO: 182282 - protein, 10 aa, Artificial Sequence
  Description of Artificial Sequence: Synthetic peptide
  Seed: QFENISIYNY (TYRP1_HUMAN)
  misc_feature (2)..(2): Xaa can be Ala, Met, Ser, Thr, Ile, Leu, Glu, Val, Asn, Pro, Lys, Arg, Gln, Gly, Phe, Tyr, Asp, Trp, Cys, or His
  misc_feature (10)..(10): Xaa can be Trp, Met, Tyr, Phe, Ile, Lys, Leu, or Arg
QXENISIYNX

SEQ ID NO: 182283 - protein, 11 aa, Artificial Sequence
  Description of Artificial Sequence: Synthetic peptide
  Seed: QFENISIYNYF (TYRP1_HUMAN)
  misc_feature (2)..(2): Xaa can be Tyr, Trp, or Phe
  misc_feature (11)..(11): Xaa can be Phe, Trp, Ile, Met, or Leu
QXENISIYNYX

SEQ ID NO: 182284 - protein, 9 aa, Artificial Sequence
  Description of Artificial Sequence: Synthetic peptide
  Seed: QFPRQCATV (TYRP1_HUMAN)
  misc_feature (2)..(2): Xaa can be Phe, Tyr, Trp, Met, Leu, Ala, Ile, Val, Thr, or Gln
  misc_feature (9)..(9): Xaa can be Phe, Met, Leu, Tyr, Ile, Trp, or Val
QXPRQCATX

SEQ ID NO: 182285 - protein, 11 aa, Artificial Sequence
  Description of Artificial Sequence: Synthetic peptide
  Seed: QFPRQCATVEA (TYRP1_HUMAN)
  misc_feature (2)..(2): Xaa can be Met, or Phe
  misc_feature (11)..(11): Xaa can be , or Ala
QXPRQCATVEX

SEQ ID NO: 182286 - protein, 8 aa, Artificial Sequence
  Description of Artificial Sequence: Synthetic peptide
  Seed: QPLLTDQY (TYRP1_HUMAN)
  misc_feature (2)..(2): Xaa can be Gln, Glu, Pro, Met, or Ala
  misc_feature (8)..(8): Xaa can be Tyr, or Phe
QXLLTDQX

SEQ ID NO: 182287 - protein, 11 aa, Artificial Sequence
  Description of Artificial Sequence: Synthetic peptide
  Seed: QPLLTDQYQCY (TYRP1_HUMAN)
  misc_feature (2)..(2): Xaa can be , or Pro
  misc_feature (11)..(11): Xaa can be Tyr, or Phe
QXLLTDQYQCX

SEQ ID NO: 182288 - protein, 9 aa, Artificial Sequence
  Description of Artificial Sequence: Synthetic peptide
  Seed: QQARAQFPR (TYRP1_HUMAN)
  misc_feature (2)..(2): Xaa can be Val, Met, Thr, Ile, Ala, Ser, Leu, Asp, Pro, Gly, Gln, Tyr, Glu, Cys, Phe, Asn, Trp, Arg, His, or Lys
  misc_feature (9)..(9): Xaa can be Arg, Lys, Tyr, His, Leu, or Met
QXARAQFPX

SEQ ID NO: 182289 - protein, 9 aa, Artificial Sequence
  Description of Artificial Sequence: Synthetic peptide
  Seed: QRLPEPQDV (TYRP1_HUMAN)
  misc_feature (2)..(2): Xaa can be Arg, His, Gln, Ala, Tyr, Phe, Lys, Trp, Glu, Met, Asn, Gly, Thr, Val, Leu, Ile, Pro, Ser, or Asp
  misc_feature (9)..(9): Xaa can be Leu, Met, Phe, Tyr, Ile, Val, Ala, Trp, Pro, Thr, Lys, Cys, His, Ser, Arg, or Gly
QXLPEPQDX

SEQ ID NO: 182290 - protein, 10 aa, Artificial Sequence
  Description of Artificial Sequence: Synthetic peptide
  Seed: QRLPEPQDVA (TYRP1_HUMAN)
  misc_feature (2)..(2): Xaa can be Arg, His, or Gln
  misc_feature (10)..(10): Xaa can be Leu, Ala, Ser, Ile, Cys, Met, Phe, Pro, Thr, Val, Gly, Arg, Lys, Trp, or Tyr
QXLPEPQDVX

SEQ ID NO: 182291 - protein, 11 aa, Artificial Sequence
  Description of Artificial Sequence: Synthetic peptide
  Seed: QRLPEPQDVAQ (TYRP1_HUMAN)
  misc_feature (2)..(2): Xaa can be Arg, or Gln
  misc_feature (11)..(11): Xaa can be Lys, Phe, Leu, Ile, Ala, His, Pro, Val, Gly, Tyr, Thr, Cys, Gln, Asn, Ser, Glu, Arg, Trp, or Met
QXLPEPQDVAX

SEQ ID NO: 182292 - protein, 10 aa, Artificial Sequence
  Description of Artificial Sequence: Synthetic peptide
  Seed: QRVLIVRRNL (TYRP1_HUMAN)
  misc_feature (2)..(2): Xaa can be , or Arg
  misc_feature (10)..(10): Xaa can be Tyr, Val, Arg, Lys, Ile, Phe, Leu, Met, or Trp
QXVLIVRRNX

SEQ ID NO: 182293 - protein, 11 aa, Artificial Sequence
  Description of Artificial Sequence: Synthetic peptide
  Seed: QRVLIVRRNLL (TYRP1_HUMAN)
  misc_feature (2)..(2): Xaa can be , or Arg
  misc_feature (11)..(11): Xaa can be Leu, Met, Trp, Tyr, Lys, Ile, or Phe
QXVLIVRRNLX

SEQ ID NO: 182294 - protein, 10 aa, Artificial Sequence
  Description of Artificial Sequence: Synthetic peptide
  Seed: QTHLSPNDPI (TYRP1_HUMAN)
  misc_feature (2)..(2): Xaa can be Thr, or Val
  misc_feature (10)..(10): Xaa can be Val, or Ile
QXHLSPNDPX

SEQ ID NO: 182295 - protein, 11 aa, Artificial Sequence
  Description of Artificial Sequence: Synthetic peptide
  Seed: QTHLSPNDPIF (TYRP1_HUMAN)
  misc_feature (2)..(2): Xaa can be Thr, Ser, Met, Val, Ala, Cys, Ile, Leu, or Gly
  misc_feature (11)..(11): Xaa can be Trp, or Phe
QXHLSPNDPIX

SEQ ID NO: 182296 - protein, 9 aa, Artificial Sequence
  Description of Artificial Sequence: Synthetic peptide
  Seed: QWPSREFSV (TYRP1_HUMAN)
  misc_feature (2)..(2): Xaa can be Tyr, Phe, Trp, Met, Leu, Gln, Thr, Ile, or Val
  misc_feature (9)..(9): Xaa can be Phe, Trp, Leu, Ile, Met, Val, or Tyr
QXPSREFSX

SEQ ID NO: 182297 - protein, 9 aa, Artificial Sequence
  Description of Artificial Sequence: Synthetic peptide
  Seed: QWRVVCDSL (TYRP1_HUMAN)
  misc_feature (2)..(2): Xaa can be Tyr, Trp, or Phe
  misc_feature (9)..(9): Xaa can be Phe, Leu, Trp, Ile, Met, or Val
QXRVVCDSX

SEQ ID NO: 182298 - protein, 8 aa, Artificial Sequence
  Description of Artificial Sequence: Synthetic peptide
  Seed: QYNMVPFW (TYRP1_HUMAN)
  misc_feature (2)..(2): Xaa can be Tyr, Phe, or Trp
  misc_feature (8)..(8): Xaa can be Phe, Trp, Leu, or Ile
QXNMVPFX

SEQ ID NO: 182299 - protein, 11 aa, Artificial Sequence
  Description of Artificial Sequence: Synthetic peptide
  Seed: QYNMVPFWPPV (TYRP1_HUMAN)
  misc_feature (2)..(2): Xaa can be Tyr, Trp, Phe, Leu, Met, Lys, Cys, Gly, Ala, Gln, Val, Arg, Thr, Ile, Ser, His, Asn, Asp, Glu, or Pro
  misc_feature (11)..(11): Xaa can be Ile, Val, Leu, Trp, Phe, Ala, or Met
QXNMVPFWPPX

SEQ ID NO: 182300 - protein, 9 aa, Artificial Sequence
  Description of Artificial Sequence: Synthetic peptide
  Seed: QYQCYAEEY (TYRP1_HUMAN)
  misc_feature (2)..(2): Xaa can be Arg, Tyr, Ala, Trp, Phe, Gln, Met, Ser, Thr, Ile, Val, Leu, Gly, His, Glu, Asn, Pro, Lys, Asp, or Cys
  misc_feature (9)..(9): Xaa can be Tyr, Phe, Met, Leu, Ile, Trp, or Val
QXQCYAEEX

SEQ ID NO: 182301 - protein, 11 aa, Artificial Sequence
  Description of Artificial Sequence: Synthetic peptide
  Seed: QYQCYAEEYEK (TYRP1_HUMAN)
  misc_feature (2)..(2): Xaa can be Phe, Tyr, Met, Gln, Ile, Ser, Thr, Leu, or Val
  misc_feature (11)..(11): Xaa can be Arg, or Lys
QXQCYAEEYEX

SEQ ID NO: 182302 - protein, 11 aa, Artificial Sequence
  Description of Artificial Sequence: Synthetic peptide
  Seed: RALDMAKRTTH (TYRP1_HUMAN)
  misc_feature (2)..(2): Xaa can be Ala, Val, Ser, Thr, Ile, Met, Gly, Glu, Gln, Leu, or Cys
  misc_feature (11)..(11): Xaa can be Tyr, Phe, Met, Leu, His, Ile, or Trp
RXLDMAKRTTX

SEQ ID NO: 182303 - protein, 9 aa, Artificial Sequence
  Description of Artificial Sequence: Synthetic peptide
  Seed: RAQFPRQCA (TYRP1_HUMAN)
  misc_feature (2)..(2): Xaa can be Thr, Val, Pro, Ser, Met, Ala, Ile, Leu, Phe, Tyr, Gln, Trp, Gly, Asn, Glu, Cys, or His
  misc_feature (9)..(9): Xaa can be Lys, Ala, Tyr, Val, Met, Ile, Arg, Phe, Leu, Ser, Gly, Thr, His, Pro, Gln, Cys, Trp, or As n
RXQFPRQCX

SEQ ID NO: 182304 - protein, 9 aa, Artificial Sequence
  Description of Artificial Sequence: Synthetic peptide
  Seed: RARRSMDEA (TYRP1_HUMAN)
  misc_feature (2)..(2): Xaa can be Met, Val, Phe, Tyr, Ile, Ser, Thr, Leu, Ala, Trp, Gln, Gly, Pro, Asn, Cys, Arg, Lys, or Hi s
  misc_feature (9)..(9): Xaa can be Lys, Ala, Met, Val, Leu, Ile, Thr, Tyr, Arg, Cys, Ser, Gly, Phe, His, Pro, Asn, Gln, or Gl u
RXRRSMDEX

SEQ ID NO: 182305 - protein, 9 aa, Artificial Sequence
  Description of Artificial Sequence: Synthetic peptide
  Seed: RDDREVWPL (TYRP1_HUMAN)
  misc_feature (2)..(2): Xaa can be Glu, Asp, Arg, Tyr, Phe, His, Gln, Ala, Trp, Ile, Asn, Ser, Thr, Lys, Gly, Leu, Met, or Va l
  misc_feature (9)..(9): Xaa can be Met, Leu, Phe, Val, Ile, Cys, Ala, Trp, Tyr, Ser, Thr, Asp, Glu, Pro, or Gly
RXDREVWPX

SEQ ID NO: 182306 - protein, 11 aa, Artificial Sequence
  Description of Artificial Sequence: Synthetic peptide
  Seed: RDDREVWPLRF (TYRP1_HUMAN)
  misc_feature (2)..(2): Xaa can be Glu, Gln, or Asp
  misc_feature (11)..(11): Xaa can be Trp, Phe, Tyr, Leu, Cys, Ile, Val, or Met
RXDREVWPLRX

SEQ ID NO: 182307 - protein, 8 aa, Artificial Sequence
  Description of Artificial Sequence: Synthetic peptide
  Seed: REFSVPEI (TYRP1_HUMAN)
  misc_feature (2)..(2): Xaa can be Glu, Asp, Gln, Ala, Arg, Met, Ser, His, Gly, Leu, Pro, Val, Ile, Asn, Tyr, Phe, Thr, Cys, or Lys
  misc_feature (8)..(8): Xaa can be Val, Ile, Leu, Met, Phe, Cys, Thr, Tyr, Ala, Trp, Pro, Ser, Gly, Lys, Arg, His, Glu, Asp, or Gln
RXFSVPEX

SEQ ID NO: 182308 - protein, 9 aa, Artificial Sequence
  Description of Artificial Sequence: Synthetic peptide
  Seed: REFSVPEII (TYRP1_HUMAN)
  misc_feature (2)..(2): Xaa can be Glu, Arg, Gln, Asp, His, Met, Leu, Ile, Val, Ser, Pro, Thr, Ala, Lys, Asn, Phe, Gly, Cys, Tyr, or Trp
  misc_feature (9)..(9): Xaa can be Leu, Met, Tyr, Phe, Val, Ile, Trp, Ala, Cys, Thr, His, Gly, Pro, Ser, Lys, Arg, Gln, Asn, Glu, or Asp
RXFSVPEIX

SEQ ID NO: 182309 - protein, 10 aa, Artificial Sequence
  Description of Artificial Sequence: Synthetic peptide
  Seed: REFSVPEIIA (TYRP1_HUMAN)
  misc_feature (2)..(2): Xaa can be Glu, Gln, His, Asp, Leu, Met, Ile, Val, Ala, Arg, Thr, Ser, Lys, Pro, or Asn
  misc_feature (10)..(10): Xaa can be Val, Leu, Ile, Ala, Phe, Met, Cys, Thr, Trp, Gly, Tyr, Pro, Ser, Asp, Lys, Gln, Glu, His, Arg, or Asn
RXFSVPEIIX

SEQ ID NO: 182310 - protein, 11 aa, Artificial Sequence
  Description of Artificial Sequence: Synthetic peptide
  Seed: REFSVPEIIAI (TYRP1_HUMAN)
  misc_feature (2)..(2): Xaa can be Glu, Gln, Asp, Arg, Met, Leu, Ile, Val, Gly, Thr, Ser, Asn, His, Ala, Pro, Phe, Trp, Cys, Lys, or Tyr
  misc_feature (11)..(11): Xaa can be Leu, Met, Phe, Ile, Trp, Tyr, Val, Cys, Ala, Thr, Lys, Pro, Ser, His, Gly, Arg, Glu, Asp, Gln, or Asn
RXFSVPEIIAX

SEQ ID NO: 182311 - protein, 8 aa, Artificial Sequence
  Description of Artificial Sequence: Synthetic peptide
  Seed: REVWPLRF (TYRP1_HUMAN)
  misc_feature (2)..(2): Xaa can be Glu, Asp, Gln, Lys, His, or Arg
  misc_feature (8)..(8): Xaa can be Tyr, Phe, Met, Trp, Leu, Ile, Val, Ala, Cys, Thr, Pro, or Ser
RXVWPLRX

SEQ ID NO: 182312 - protein, 9 aa, Artificial Sequence
  Description of Artificial Sequence: Synthetic peptide
  Seed: REVWPLRFF (TYRP1_HUMAN)
  misc_feature (2)..(2): Xaa can be Glu, Asp, Gln, Met, Leu, His, Lys, Ile, Arg, Ser, Val, Ala, Asn, Tyr, Thr, Gly, Phe, or Pr o
  misc_feature (9)..(9): Xaa can be Tyr, Phe, Met, Leu, Trp, Ile, Val, Ala, His, Cys, Lys, Ser, Gly, Pro, or Thr
RXVWPLRFX

SEQ ID NO: 182313 - protein, 11 aa, Artificial Sequence
  Description of Artificial Sequence: Synthetic peptide
  Seed: REVWPLRFFNR (TYRP1_HUMAN)
  misc_feature (2)..(2): Xaa can be Met, Arg, Val, Gln, Ser, Phe, Thr, Tyr, Trp, Ile, Lys, Leu, Glu, Asp, Asn, Ala, Cys, His, Pro, or Gly
  misc_feature (11)..(11): Xaa can be Lys, Arg, His, or Tyr
RXVWPLRFFNX

SEQ ID NO: 182314 - protein, 9 aa, Artificial Sequence
  Description of Artificial Sequence: Synthetic peptide
  Seed: RFFNRTCHC (TYRP1_HUMAN)
  misc_feature (2)..(2): Xaa can be Tyr, Met, Val, Thr, Phe, Ser, Ile, Ala, Trp, Leu, Gln, Gly, Asn, His, Arg, Pro, Cys, or Ly s
  misc_feature (9)..(9): Xaa can be Lys, Met, Leu, Phe, Val, Tyr, Ala, Ile, Arg, Ser, Gly, Pro, Thr, Cys, His, Asn, Gln, Glu, or Trp
RXFNRTCHX

SEQ ID NO: 182315 - protein, 9 aa, Artificial Sequence
  Description of Artificial Sequence: Synthetic peptide
  Seed: RGAACDQRV (TYRP1_HUMAN)
  misc_feature (2)..(2): Xaa can be Gln, Met, Ile, Leu, Val, Glu, Ser, Ala, Thr, Gly, or Asn
  misc_feature (9)..(9): Xaa can be Val, Leu, Ile, Met, Phe, Ala, Trp, Thr, Tyr, or Cys
RXAACDQRX

SEQ ID NO: 182316 - protein, 9 aa, Artificial Sequence
  Description of Artificial Sequence: Synthetic peptide
  Seed: RGRCEAVTA (TYRP1_HUMAN)
  misc_feature (2)..(2): Xaa can be Val, Thr, Ser, Ile, Met, Tyr, Ala, Phe, Pro, Leu, Gln, Trp, Asn, Gly, Cys, Arg, His, or Ly s
  misc_feature (9)..(9): Xaa can be Lys, Ala, Ile, Arg, Val, Ser, Met, Tyr, Leu, Gly, Thr, Gln, Asn, Phe, Cys, His, Pro, Glu, or Trp
RXRCEAVTX

SEQ ID NO: 182317 - protein, 9 aa, Artificial Sequence
  Description of Artificial Sequence: Synthetic peptide
  Seed: RLEKDMQEM (TYRP1_HUMAN)
  misc_feature (2)..(2): Xaa can be Met, Leu, Gln, Ala, Thr, Val, Ile, Arg, Ser, Gly, Phe, Glu, Tyr, His, Asn, Trp, Lys, Pro, Cys, or Asp
  misc_feature (9)..(9): Xaa can be Leu, Met, Tyr, Phe, Ile, Val, Trp, Cys, Lys, or Ala
RXEKDMQEX

SEQ ID NO: 182318 - protein, 10 aa, Artificial Sequence
  Description of Artificial Sequence: Synthetic peptide
  Seed: RLEKDMQEML (TYRP1_HUMAN)
  misc_feature (2)..(2): Xaa can be Leu, Met, Gln, Ala, Glu, Thr, Ile, Val, Ser, His, Asn, Cys, Arg, Pro, Gly, Asp, Tyr, Lys, Trp, or Phe
  misc_feature (10)..(10): Xaa can be Leu, Val, Met, Ile, Phe, Trp, or Tyr
RXEKDMQEMX

SEQ ID NO: 182319 - protein, 9 aa, Artificial Sequence
  Description of Artificial Sequence: Synthetic peptide
  Seed: RLPEPQDVA (TYRP1_HUMAN)
  misc_feature (2)..(2): Xaa can be Gln, Leu, Met, Ile, Glu, Ala, Thr, Val, Ser, Gly, Asn, or Asp
  misc_feature (9)..(9): Xaa can be Val, Ile, Leu, Met, Phe, Ala, Cys, Trp, Thr, or Tyr
RXPEPQDVX

SEQ ID NO: 182320 - protein, 11 aa, Artificial Sequence
  Description of Artificial Sequence: Synthetic peptide
  Seed: RLPEPQDVAQC (TYRP1_HUMAN)
  misc_feature (2)..(2): Xaa can be Leu, Met, Gln, Ile, Val, Glu, Ala, Ser, Thr, Asn, Gly, His, Lys, Arg, Asp, Phe, or Cys
  misc_feature (11)..(11): Xaa can be Trp, Phe, Leu, Ile, Met, Val, Tyr, Ala, Cys, or Thr
RXPEPQDVAQX

SEQ ID NO: 182321 - protein, 9 aa, Artificial Sequence
  Description of Artificial Sequence: Synthetic peptide
  Seed: RNPAGNVAR (TYRP1_HUMAN)
  misc_feature (2)..(2): Xaa can be Arg, Leu, Met, Ile, Ala, Thr, Gly, Ser, Val, Gln, Lys, Trp, Phe, Asn, Tyr, Pro, Glu, or Cy s
  misc_feature (9)..(9): Xaa can be Leu, Arg, Lys, Tyr, Phe, Met, Ile, Val, His, Gln, Thr, Trp, Ala, Cys, Pro, or Asn
RXPAGNVAX

SEQ ID NO: 182322 - protein, 8 aa, Artificial Sequence
  Description of Artificial Sequence: Synthetic peptide
  Seed: RPGWRGAA (TYRP1_HUMAN)
  misc_feature (2)..(2): Xaa can be Pro, Ala, or Val
  misc_feature (8)..(8): Xaa can be Leu, Ser, Pro, Cys, Phe, Ala, Thr, Met, Val, Tyr, or Ile
RXGWRGAX

SEQ ID NO: 182323 - protein, 9 aa, Artificial Sequence
  Description of Artificial Sequence: Synthetic peptide
  Seed: RPGWRGAAC (TYRP1_HUMAN)
  misc_feature (2)..(2): Xaa can be Pro, Ala, Ser, Ile, Val, Thr, Met, Leu, Gly, Gln, or Phe
  misc_feature (9)..(9): Xaa can be Met, Leu, Phe, Ile, Val, Ala, Cys, His, Gly, Asn, Ser, Tyr, Gln, Thr, Arg, Trp, Glu, Pro, Asp, or Lys
RXGWRGAAX

SEQ ID NO: 182324 - protein, 8 aa, Artificial Sequence
  Description of Artificial Sequence: Synthetic peptide
  Seed: RPHSPQYP (TYRP1_HUMAN)
  misc_feature (2)..(2): Xaa can be , or Pro
  misc_feature (8)..(8): Xaa can be Ala, Pro, Met, Leu, Ile, or Val
RXHSPQYX

SEQ ID NO: 182325 - protein, 9 aa, Artificial Sequence
  Description of Artificial Sequence: Synthetic peptide
  Seed: RPHSPQYPH (TYRP1_HUMAN)
  misc_feature (2)..(2): Xaa can be Pro, Ala, Val, Ile, Ser, Thr, Met, Leu, or Gly
  misc_feature (9)..(9): Xaa can be Leu, Met, Phe, Tyr, Val, Ile, Ala, Cys, Gly, Lys, Glu, Trp, Asn, Ser, Asp, Thr, Gln, His, Pro, or Arg
RXHSPQYPX

SEQ ID NO: 182326 - protein, 11 aa, Artificial Sequence
  Description of Artificial Sequence: Synthetic peptide
  Seed: RPHSPQYPHDG (TYRP1_HUMAN)
  misc_feature (2)..(2): Xaa can be , or Pro
  misc_feature (11)..(11): Xaa can be Thr, Pro, Val, Met, Phe, Cys, Tyr, Ser, Gly, Ala, Leu, or Ile
RXHSPQYPHDX

SEQ ID NO: 182327 - protein, 8 aa, Artificial Sequence
  Description of Artificial Sequence: Synthetic peptide
  Seed: RPMVQRLP (TYRP1_HUMAN)
  misc_feature (2)..(2): Xaa can be , or Pro
  misc_feature (8)..(8): Xaa can be Glu, Thr, Phe, Ser, Pro, Ile, Leu, Ala, Met, Val, Tyr, or Cys
RXMVQRLX

SEQ ID NO: 182328 - protein, 9 aa, Artificial Sequence
  Description of Artificial Sequence: Synthetic peptide
  Seed: RPMVQRLPE (TYRP1_HUMAN)
  misc_feature (2)..(2): Xaa can be Pro, Ala, Val, Ile, Met, Thr, Ser, Leu, Gly, Gln, Phe, Cys, Arg, Asn, Glu, Lys, or Tyr
  misc_feature (9)..(9): Xaa can be Leu, Met, Ile, Val, Phe, Ala, Thr, Cys, Glu, Arg, Tyr, Pro, Lys, Gln, Asn, Asp, His, Trp, Ser, or Gly
RXMVQRLPX

SEQ ID NO: 182329 - protein, 10 aa, Artificial Sequence
  Description of Artificial Sequence: Synthetic peptide
  Seed: RPMVQRLPEP (TYRP1_HUMAN)
  misc_feature (2)..(2): Xaa can be Pro, Ala, Val, Thr, Leu, Met, Ile, or Ser
  misc_feature (10)..(10): Xaa can be Met, Leu, Phe, Ile, Val, Glu, Cys, Pro, Trp, Gly, His, Thr, Ser, Ala, Tyr, or Gln
RXMVQRLPEX

SEQ ID NO: 182330 - protein, 9 aa, Artificial Sequence
  Description of Artificial Sequence: Synthetic peptide
  Seed: RQCATVEAL (TYRP1_HUMAN)
  misc_feature (2)..(2): Xaa can be Glu, Arg, His, Gln, Asp, Ala, Met, Leu, Lys, Gly, Ser, Val, Ile, Asn, Thr, Pro, Tyr, Phe, Cys, or Trp
  misc_feature (9)..(9): Xaa can be Phe, Tyr, Leu, Met, Val, Ile, Trp, Ala, His, Lys, Thr, Cys, Arg, Pro, Gly, Ser, Gln, Glu, Asn, or Asp
RXCATVEAX

SEQ ID NO: 182331 - protein, 10 aa, Artificial Sequence
  Description of Artificial Sequence: Synthetic peptide
  Seed: RQCATVEALR (TYRP1_HUMAN)
  misc_feature (2)..(2): Xaa can be Arg, Glu, Gln, Trp, Phe, Met, Leu, Tyr, Val, Ile, Thr, Asn, Ser, Gly, Lys, Ala, Asp, Cys, Pro, or His
  misc_feature (10)..(10): Xaa can be Arg, Lys, Tyr, His, Trp, Met, Phe, Leu, Cys, Val, Thr, Ile, Ala, Asn, or Gln
RXCATVEALX

SEQ ID NO: 182332 - protein, 8 aa, Artificial Sequence
  Description of Artificial Sequence: Synthetic peptide
  Seed: RQYNMVPF (TYRP1_HUMAN)
  misc_feature (2)..(2): Xaa can be Gln, Arg, Met, Glu, Lys, Asp, His, Ser, Leu, Ala, Val, Trp, Asn, Ile, Gly, Tyr, Thr, Phe, Cys, or Pro
  misc_feature (8)..(8): Xaa can be Tyr, Phe, Met, Leu, Ile, Val, Ala, Trp, His, Cys, Thr, Lys, Ser, Gly, or Pro
RXYNMVPX

SEQ ID NO: 182333 - protein, 9 aa, Artificial Sequence
  Description of Artificial Sequence: Synthetic peptide
  Seed: RQYNMVPFW (TYRP1_HUMAN)
  misc_feature (2)..(2): Xaa can be Arg, Gln, Tyr, Met, Glu, Ser, Thr, Trp, Leu, Lys, Ile, Val, Ala, Phe, His, Gly, Pro, Asn, Asp, or Cys
  misc_feature (9)..(9): Xaa can be Tyr, Ile, Phe, Met, Trp, Leu, Val, His, Lys, Arg, Cys, Ala, Gly, Thr, Ser, Pro, Asn, Gln, Asp, or Glu
RXYNMVPFX

SEQ ID NO: 182334 - protein, 9 aa, Artificial Sequence
  Description of Artificial Sequence: Synthetic peptide
  Seed: RRNLLDLSK (TYRP1_HUMAN)
  misc_feature (2)..(2): Xaa can be Arg, Gln, Lys, Gly, Ala, His, Ile, Leu, Met, Asn, Thr, Glu, Phe, Ser, Val, Tyr, Cys, Trp, Asp, or Pro
  misc_feature (9)..(9): Xaa can be Leu, Phe, Ile, Lys, Met, Tyr, Arg, Val, His, Trp, Ala, Thr, Glu, Ser, Cys, Gln, Gly, Pro, or Asn
RXNLLDLSX

SEQ ID NO: 182335 - protein, 10 aa, Artificial Sequence
  Description of Artificial Sequence: Synthetic peptide
  Seed: RRNLLDLSKE (TYRP1_HUMAN)
  misc_feature (2)..(2): Xaa can be Arg, Gln, Lys, Asn, Gly, His, Glu, Met, Thr, Ser, Ala, Ile, or Leu
  misc_feature (10)..(10): Xaa can be Leu, Phe, Lys, Tyr, Arg, Ile, Trp, Met, Gly, Cys, Gln, Glu, Pro, Asn, Ser, Val, Ala, Thr, His, or Asp
RXNLLDLSKX

SEQ ID NO: 182336 - protein, 8 aa, Artificial Sequence
  Description of Artificial Sequence: Synthetic peptide
  Seed: RRNPAGNV (TYRP1_HUMAN)
  misc_feature (2)..(2): Xaa can be , or Arg
  misc_feature (8)..(8): Xaa can be Met, Val, Ile, Leu, or Phe
RXNPAGNX

SEQ ID NO: 182337 - protein, 9 aa, Artificial Sequence
  Description of Artificial Sequence: Synthetic peptide
  Seed: RRNPAGNVA (TYRP1_HUMAN)
  misc_feature (2)..(2): Xaa can be Arg, His, Tyr, Gln, Ala, Gly, Met, Ser, Phe, Lys, Ile, Glu, Asn, Leu, Val, Trp, Thr, Pro, Asp, or Cys
  misc_feature (9)..(9): Xaa can be Leu, Val, Met, Ile, Tyr, Phe, Lys, Ala, Cys, Arg, Trp, His, Thr, Gly, Ser, Pro, Glu, Asn, or Gln
RXNPAGNVX

SEQ ID NO: 182338 - protein, 10 aa, Artificial Sequence
  Description of Artificial Sequence: Synthetic peptide
  Seed: RRNPAGNVAR (TYRP1_HUMAN)
  misc_feature (2)..(2): Xaa can be Arg, Lys, Gln, Tyr, Ala, His, Met, Phe, Gly, Leu, Ile, Asn, Glu, Pro, Ser, Trp, Thr, Val, Cys, or Asp
  misc_feature (10)..(10): Xaa can be Phe, Tyr, Met, Leu, Lys, Arg, Ile, Trp, Val, His, Cys, Asn, Thr, Gly, Glu, Ser, Gln, Pro, or Ala
RXNPAGNVAX

SEQ ID NO: 182339 - protein, 11 aa, Artificial Sequence
  Description of Artificial Sequence: Synthetic peptide
  Seed: RRNPAGNVARP (TYRP1_HUMAN)
  misc_feature (2)..(2): Xaa can be Arg, Gln, Lys, His, Gly, Glu, Met, Ala, or Asn
  misc_feature (11)..(11): Xaa can be Lys, Phe, Leu, Trp, Ile, Met, Tyr, Arg, Val, Gly, Cys, Asn, Thr, Glu, Gln, Pro, Ala, His, or Ser
RXNPAGNVARX

SEQ ID NO: 182340 - protein, 9 aa, Artificial Sequence
  Description of Artificial Sequence: Synthetic peptide
  Seed: RRSEEILGP (TYRP1_HUMAN)
  misc_feature (2)..(2): Xaa can be Arg, Gln, Lys, His, Ala, Gly, Asn, Glu, Met, Leu, Ser, Val, Ile, Thr, Phe, Trp, Asp, Pro, Tyr, or Cys
  misc_feature (9)..(9): Xaa can be Phe, Lys, Arg, Leu, Ile, Met, Tyr, His, Val, Trp, Ala, Gln, Gly, Glu, Ser, Asn, Thr, Cys, or Pro
RXSEEILGX

SEQ ID NO: 182341 - protein, 9 aa, Artificial Sequence
  Description of Artificial Sequence: Synthetic peptide
  Seed: RRSMDEANQ (TYRP1_HUMAN)
  misc_feature (2)..(2): Xaa can be Arg, Gln, Gly, Asn, Lys, Ala, Met, Leu, Glu, Thr, Ile, or Val
  misc_feature (9)..(9): Xaa can be Leu, Lys, Arg, Phe, Tyr, Met, His, Gln, Ala, Thr, Ile, Val, or Trp
RXSMDEANX

SEQ ID NO: 182342 - protein, 11 aa, Artificial Sequence
  Description of Artificial Sequence: Synthetic peptide
  Seed: RRSMDEANQPL (TYRP1_HUMAN)
  misc_feature (2)..(2): Xaa can be Arg, Gln, Tyr, Gly, Glu, Met, Phe, Leu, Trp, Ile, Ser, Val, Thr, Cys, His, Lys, Asn, Pro, Ala, or Asp
  misc_feature (11)..(11): Xaa can be Ile, Val, Leu, Met, Lys, Arg, Phe, Trp, Ala, His, Gln, Cys, or Tyr
RXSMDEANQPX

SEQ ID NO: 182343 - protein, 9 aa, Artificial Sequence
  Description of Artificial Sequence: Synthetic peptide
  Seed: RRYNADIST (TYRP1_HUMAN)
  misc_feature (2)..(2): Xaa can be Arg, His, Gln, Lys, Tyr, Ala, Glu, Ser, Met, Gly, Asn, Leu, Thr, Phe, Ile, Val, Trp, Cys, Pro, or Asp
  misc_feature (9)..(9): Xaa can be Phe, Tyr, Leu, Met, Ile, Lys, Arg, Val, Trp, His, Ala, Cys, Pro, Gly, Asn, Thr, Ser, Glu, or Gln
RXYNADISX

SEQ ID NO: 182344 - protein, 10 aa, Artificial Sequence
  Description of Artificial Sequence: Synthetic peptide
  Seed: RRYNADISTF (TYRP1_HUMAN)
  misc_feature (2)..(2): Xaa can be Arg, Gln, Met, Glu, His, Lys, Leu, Ile, Gly, Tyr, Ala, Val, Asn, Ser, Thr, Trp, Phe, Pro, Asp, or Cys
  misc_feature (10)..(10): Xaa can be Phe, Leu, Ile, Met, Trp, Tyr, Val, His, Cys, Lys, Ala, Arg, Gln, Gly, Thr, Asn, Ser, Pro, or Glu
RXYNADISTX

SEQ ID NO: 182345 - protein, 11 aa, Artificial Sequence
  Description of Artificial Sequence: Synthetic peptide
  Seed: RRYNADISTFP (TYRP1_HUMAN)
  misc_feature (2)..(2): Xaa can be Asn, Tyr, Cys, Met, Leu, Trp, Gly, Ala, Pro, Ser, Val, Gln, Asp, Glu, Phe, Ile, Thr, His, Lys, or Arg
  misc_feature (11)..(11): Xaa can be Cys, Gly, Glu, Lys, Ala, Tyr, Asn, Phe, Thr, Ile, Val, Ser, Leu, Asp, Met, Arg, Pro, Gln, Trp, or His
RXYNADISTFX

SEQ ID NO: 182346 - protein, 9 aa, Artificial Sequence
  Description of Artificial Sequence: Synthetic peptide
  Seed: RSGMCCPDL (TYRP1_HUMAN)
  misc_feature (2)..(2): Xaa can be Ala, Thr, Ser, Val, Leu, Cys, Gly, Met, or Ile
  misc_feature (9)..(9): Xaa can be Trp, Phe, Leu, Met, Ile, or Val
RXGMCCPDX

SEQ ID NO: 182347 - protein, 9 aa, Artificial Sequence
  Description of Artificial Sequence: Synthetic peptide
  Seed: RSLHNLAHL (TYRP1_HUMAN)
  misc_feature (2)..(2): Xaa can be Arg, Thr, Gln, Leu, Met, Ser, Val, Ile, Ala, Tyr, Phe, Lys, Gly, Asn, Trp, Glu, Asp, Cys, His, or Pro
  misc_feature (9)..(9): Xaa can be Lys, Tyr, Phe, Leu, Trp, Met, Val, Arg, Ile, His, Ala, Cys, Thr, Ser, Gly, Gln, Glu, or As n
RXLHNLAHX

SEQ ID NO: 182348 - protein, 10 aa, Artificial Sequence
  Description of Artificial Sequence: Synthetic peptide
  Seed: RSLHNLAHLF (TYRP1_HUMAN)
  misc_feature (2)..(2): Xaa can be Tyr, Thr, Ser, Gln, Trp, Met, Phe, Ala, Ile, Glu, Leu, Val, Lys, Cys, Gly, His, Asn, Asp, Arg, or Pro
  misc_feature (10)..(10): Xaa can be Phe, Met, Trp, Tyr, Leu, Ile, Val, His, Cys, Gly, Lys, Ala, Asp, Glu, Pro, Arg, Asn, Ser, Gln, or Thr
RXLHNLAHLX

SEQ ID NO: 182349 - protein, 11 aa, Artificial Sequence
  Description of Artificial Sequence: Synthetic peptide
  Seed: RSLHNLAHLFL (TYRP1_HUMAN)
  misc_feature (2)..(2): Xaa can be Thr, Ser, Ala, Val, Ile, Gly, Cys, Met, Pro, Glu, Phe, Asn, Gln, Asp, or Leu
  misc_feature (11)..(11): Xaa can be Trp, Phe, Tyr, Met, Leu, Ile, Val, Thr, Cys, His, Asn, Arg, Pro, Ala, Lys, Ser, Glu, Gly, Gln, or Asp
RXLHNLAHLFX

SEQ ID NO: 182350 - protein, 10 aa, Artificial Sequence
  Description of Artificial Sequence: Synthetic peptide
  Seed: RSMDEANQPL (TYRP1_HUMAN)
  misc_feature (2)..(2): Xaa can be Leu, Ile, Val, Gln, Ala, Met, Ser, Gly, Thr, Asp, His, Lys, Arg, Cys, Trp, Glu, Tyr, Phe, Pro, or Asn
  misc_feature (10)..(10): Xaa can be Ile, Leu, Met, Ala, Val, Tyr, Trp, Phe, His, Lys, Cys, Arg, Thr, Ser, Gly, or Gln
RXMDEANQPX

SEQ ID NO: 182351 - protein, 11 aa, Artificial Sequence
  Description of Artificial Sequence: Synthetic peptide
  Seed: RSMDEANQPLL (TYRP1_HUMAN)
  misc_feature (2)..(2): Xaa can be Gln, Leu, Met, Ile, Val, Ser, Ala, Thr, Arg, Glu, Gly, Tyr, Asp, Lys, Asn, Trp, His, Cys, Phe, or Pro
  misc_feature (11)..(11): Xaa can be Met, Leu, Tyr, Trp, Phe, Ile, Val, Lys, Cys, Arg, His, Ala, Thr, Pro, Ser, or Gly
RXMDEANQPLX

SEQ ID NO: 182352 - protein, 8 aa, Artificial Sequence
  Description of Artificial Sequence: Synthetic peptide
  Seed: RSNFDSTL (TYRP1_HUMAN)
  misc_feature (2)..(2): Xaa can be Ser, Ala, or Thr
  misc_feature (8)..(8): Xaa can be , or Leu
RXNFDSTX

SEQ ID NO: 182353 - protein, 9 aa, Artificial Sequence
  Description of Artificial Sequence: Synthetic peptide
  Seed: RSNFDSTLI (TYRP1_HUMAN)
  misc_feature (2)..(2): Xaa can be Ala, Gln, Thr, Ser, Met, Ile, Val, Gly, Leu, Asn, Glu, Cys, Asp, Tyr, Phe, Trp, Pro, Arg, His, or Lys
  misc_feature (9)..(9): Xaa can be Trp, Phe, Leu, Lys, Tyr, Met, Val, Ile, Ala, Cys, His, Arg, or Thr
RXNFDSTLX

SEQ ID NO: 182354 - protein, 9 aa, Artificial Sequence
  Description of Artificial Sequence: Synthetic peptide
  Seed: RTCHCNGNF (TYRP1_HUMAN)
  misc_feature (2)..(2): Xaa can be Ala, Met, Thr, Gln, Leu, Ser, Ile, Val, Glu, Gly, Tyr, Cys, Phe, Pro, Asn, Trp, Arg, Lys, Asp, or His
  misc_feature (9)..(9): Xaa can be Tyr, Phe, Trp, Leu, Ile, Met, Val, or His
RXCHCNGNX

SEQ ID NO: 182355 - protein, 10 aa, Artificial Sequence
  Description of Artificial Sequence: Synthetic peptide
  Seed: RTCHCNGNFS (TYRP1_HUMAN)
  misc_feature (2)..(2): Xaa can be Thr, Ser, Val, Met, Ala, Tyr, Ile, Phe, His, Asn, Gln, Gly, Trp, or Leu
  misc_feature (10)..(10): Xaa can be Lys, Ala, Val, Leu, Arg, Met, Tyr, Ile, or Ser
RXCHCNGNFX

SEQ ID NO: 182356 - protein, 8 aa, Artificial Sequence
  Description of Artificial Sequence: Synthetic peptide
  Seed: RTTHPLFV (TYRP1_HUMAN)
  misc_feature (2)..(2): Xaa can be Ala, Thr, Ser, Val, Ile, or Gly
  misc_feature (8)..(8): Xaa can be Leu, Val, Ile, Met, or Phe
RXTHPLFX

SEQ ID NO: 182357 - protein, 9 aa, Artificial Sequence
  Description of Artificial Sequence: Synthetic peptide
  Seed: RTTHPLFVI (TYRP1_HUMAN)
  misc_feature (2)..(2): Xaa can be Thr, Ser, Met, Gln, Ala, Leu, Val, Tyr, Ile, Gly, Asn, Cys, Glu, Asp, Phe, Trp, Pro, Lys, Arg, or His
  misc_feature (9)..(9): Xaa can be Tyr, Trp, Phe, Leu, Lys, Ile, Val, Met, Arg, Ala, His, Cys, Gly, Ser, or Thr
RXTHPLFVX

SEQ ID NO: 182358 - protein, 10 aa, Artificial Sequence
  Description of Artificial Sequence: Synthetic peptide
  Seed: RTTHPLFVIA (TYRP1_HUMAN)
  misc_feature (2)..(2): Xaa can be Trp, Val, Ser, Thr, Met, Phe, Tyr, Ile, Leu, Lys, Ala, His, Asn, Glu, Cys, Arg, Pro, Gln, Gly, or Asp
  misc_feature (10)..(10): Xaa can be Val, Ile, Leu, Ser, Met, Ala, Lys, Arg, Tyr, Gly, Thr, or His
RXTHPLFVIX

SEQ ID NO: 182359 - protein, 9 aa, Artificial Sequence
  Description of Artificial Sequence: Synthetic peptide
  Seed: RVLIVRRNL (TYRP1_HUMAN)
  misc_feature (2)..(2): Xaa can be Thr, Arg, Val, Ser, Met, Ile, Tyr, Ala, Phe, Leu, Pro, Asn, Gln, Trp, Gly, Lys, Glu, Cys, Asp, or His
  misc_feature (9)..(9): Xaa can be Leu, Tyr, Phe, Lys, Ile, Trp, Met, Val, Ala, Arg, Ser, Gly, Thr, Pro, Cys, Asn, Gln, Glu, or His
RXLIVRRNX

SEQ ID NO: 182360 - protein, 10 aa, Artificial Sequence
  Description of Artificial Sequence: Synthetic peptide
  Seed: RVLIVRRNLL (TYRP1_HUMAN)
  misc_feature (2)..(2): Xaa can be Thr, Ser, Val, Met, Ala, Tyr, Phe, Ile, Trp, Gly, Gln, Cys, Pro, Leu, Asn, Arg, Lys, Asp, His, or Glu
  misc_feature (10)..(10): Xaa can be Lys, Met, Leu, Ala, Val, Ile, Ser, Tyr, Phe, Arg, Gly, Thr, Gln, Pro, His, or Cys
RXLIVRRNLX

SEQ ID NO: 182361 - protein, 10 aa, Artificial Sequence
  Description of Artificial Sequence: Synthetic peptide
  Seed: RVVCDSLEDY (TYRP1_HUMAN)
  misc_feature (2)..(2): Xaa can be Thr, Gln, Ser, Met, Ala, Ile, Val, Lys, Leu, Glu, His, Arg, Phe, Gly, Asn, Cys, Pro, Trp, or Tyr
  misc_feature (10)..(10): Xaa can be Tyr, Phe, Met, Trp, Leu, Lys, Ile, Arg, or His
RXVCDSLEDX

SEQ ID NO: 182362 - protein, 9 aa, Artificial Sequence
  Description of Artificial Sequence: Synthetic peptide
  Seed: RYHLLRLEK (TYRP1_HUMAN)
  misc_feature (2)..(2): Xaa can be Val, Thr, Ser, Met, Ile, Tyr, Ala, Leu, Phe, Gly, Gln, Trp, Asn, Cys, His, Asp, Glu, Lys, or Arg
  misc_feature (9)..(9): Xaa can be Lys, Arg, Ala, Val, Ile, Leu, Ser, Met, Tyr, Gly, Thr, His, Gln, Phe, Asn, Pro, Cys, or Gl u
RXHLLRLEX

SEQ ID NO: 182363 - protein, 9 aa, Artificial Sequence
  Description of Artificial Sequence: Synthetic peptide
  Seed: RYNADISTF (TYRP1_HUMAN)
  misc_feature (2)..(2): Xaa can be Gln, Arg, Met, Ala, Tyr, Leu, Ile, Ser, Val, Thr, Lys, Phe, Glu, His, Gly, Trp, Asp, Asn, Cys, or Pro
  misc_feature (9)..(9): Xaa can be Phe, Leu, Tyr, Met, Ile, Val, Trp, His, Lys, Arg, Ala, Cys, Gly, Thr, Ser, or Gln
RXNADISTX

SEQ ID NO: 182364 - protein, 10 aa, Artificial Sequence
  Description of Artificial Sequence: Synthetic peptide
  Seed: RYNADISTFP (TYRP1_HUMAN)
  misc_feature (2)..(2): Xaa can be Tyr, Trp, Phe, or Met
  misc_feature (10)..(10): Xaa can be Trp, Phe, Ile, Leu, Met, Tyr, Thr, Glu, Pro, Ser, Asp, His, Val, Gly, Arg, Cys, Asn, Lys, Gln, or Ala
RXNADISTFX

SEQ ID NO: 182365 - protein, 11 aa, Artificial Sequence
  Description of Artificial Sequence: Synthetic peptide
  Seed: RYNADISTFPL (TYRP1_HUMAN)
  misc_feature (2)..(2): Xaa can be Tyr, Trp, Phe, or Met
  misc_feature (11)..(11): Xaa can be Phe, Trp, Leu, Met, Ile, Val, Ser, Tyr, Pro, Asn, Lys, Cys, Glu, Gly, Asp, Ala, His, Thr, Arg, or Gln
RXNADISTFPX

SEQ ID NO: 182366 - protein, 8 aa, Artificial Sequence
  Description of Artificial Sequence: Synthetic peptide
  Seed: SAPKLLSL (TYRP1_HUMAN)
  misc_feature (2)..(2): Xaa can be Ala, Gln, Ser, Val, Thr, Pro, Arg, Gly, Ile, Tyr, Met, Leu, Trp, His, Phe, Asn, Cys, Glu, Lys, or Asp
  misc_feature (8)..(8): Xaa can be Leu, Val, Ile, Met, Phe, Tyr, Trp, Cys, Ala, His, or Lys
SXPKLLSX

SEQ ID NO: 182367 - protein, 9 aa, Artificial Sequence
  Description of Artificial Sequence: Synthetic peptide
  Seed: SEEILGPDG (TYRP1_HUMAN)
  misc_feature (2)..(2): Xaa can be Glu, Gln, or Asp
  misc_feature (9)..(9): Xaa can be Ile, Ala, Val, Leu, Cys, Phe, Ser, Tyr, Gly, Pro, Thr, or Met
SXEILGPDX

SEQ ID NO: 182368 - protein, 11 aa, Artificial Sequence
  Description of Artificial Sequence: Synthetic peptide
  Seed: SEEILGPDGNT (TYRP1_HUMAN)
  misc_feature (2)..(2): Xaa can be , or Glu
  misc_feature (11)..(11): Xaa can be Cys, Ile, Ala, Thr, Leu, Phe, Ser, Met, Pro, Trp, Val, or Gly
SXEILGPDGNX

SEQ ID NO: 182369 - protein, 9 aa, Artificial Sequence
  Description of Artificial Sequence: Synthetic peptide
  Seed: SFRNTVEGY (TYRP1_HUMAN)
  misc_feature (2)..(2): Xaa can be Ala, Ile, Ser, Val, Arg, Gln, Tyr, Thr, Met, Leu, Phe, Gly, Trp, Glu, Lys, His, Asn, Pro, Cys, or Asp
  misc_feature (9)..(9): Xaa can be Phe, Tyr, Met, Leu, His, Ile, Val, Trp, Lys, Ala, or Arg
SXRNTVEGX

SEQ ID NO: 182370 - protein, 9 aa, Artificial Sequence
  Description of Artificial Sequence: Synthetic peptide
  Seed: SFSLPYWNF (TYRP1_HUMAN)
  misc_feature (2)..(2): Xaa can be Tyr, Arg, Phe, Trp, Met, Thr, His, Gln, Leu, Ala, Lys, Gly, Asn, Ile, Ser, Val, Asp, Pro, Glu, or Cys
  misc_feature (9)..(9): Xaa can be Tyr, Phe, Trp, Met, Leu, Ile, Val, Gly, Cys, Ala, Arg, His, or Lys
SXSLPYWNX

SEQ ID NO: 182371 - protein, 10 aa, Artificial Sequence
  Description of Artificial Sequence: Synthetic peptide
  Seed: SFSLPYWNFA (TYRP1_HUMAN)
  misc_feature (2)..(2): Xaa can be Lys, Arg, Ser, Thr, Val, Ala, Met, Tyr, Trp, Gln, Phe, Glu, Leu, Ile, His, Asp, Pro, Cys, Asn, or Gly
  misc_feature (10)..(10): Xaa can be Lys, or Ala
SXSLPYWNFX

SEQ ID NO: 182372 - protein, 9 aa, Artificial Sequence
  Description of Artificial Sequence: Synthetic peptide
  Seed: SGHNCGTCR (TYRP1_HUMAN)
  misc_feature (2)..(2): Xaa can be Ala, Val, Ile, Thr, Ser, Gln, Leu, Gly, Met, Asn, Cys, Phe, Tyr, Glu, Trp, Pro, Asp, His, or Lys
  misc_feature (9)..(9): Xaa can be Tyr, Arg, Lys, Phe, Met, Leu, His, Trp, Val, Ala, Ile, Gln, Thr, or Cys
SXHNCGTCX

SEQ ID NO: 182373 - protein, 11 aa, Artificial Sequence
  Description of Artificial Sequence: Synthetic peptide
  Seed: SGPGTDRCGSS (TYRP1_HUMAN)
  misc_feature (2)..(2): Xaa can be Gly, Ala, Pro, Gln, Arg, Val, Ser, Ile, Asn, Leu, Met, Lys, His, Asp, Glu, Thr, or Cys
  misc_feature (11)..(11): Xaa can be Lys, Phe, Asn, Glu, Arg, Tyr, Leu, Gln, His, Gly, Asp, Ser, Pro, or Met
SXPGTDRCGSX

SEQ ID NO: 182374 - protein, 9 aa, Artificial Sequence
  Description of Artificial Sequence: Synthetic peptide
  Seed: SGRGRCEAV (TYRP1_HUMAN)
  misc_feature (2)..(2): Xaa can be Pro, Met, Ala, Ile, Leu, Val, Gln, Ser, Thr, Asn, Arg, Phe, Gly, Glu, Tyr, Lys, Cys, Asp, Trp, or His
  misc_feature (9)..(9): Xaa can be Met, Leu, Ile, Val, Phe, Ala, Cys, Thr, Gly, Trp, Gln, Pro, Arg, Lys, Tyr, Ser, or His
SXRGRCEAX

SEQ ID NO: 182375 - protein, 8 aa, Artificial Sequence
  Description of Artificial Sequence: Synthetic peptide
  Seed: SHEGPAFL (TYRP1_HUMAN)
  misc_feature (2)..(2): Xaa can be , or His
  misc_feature (8)..(8): Xaa can be Ile, Phe, or Leu
SXEGPAFX

SEQ ID NO: 182376 - protein, 9 aa, Artificial Sequence
  Description of Artificial Sequence: Synthetic peptide
  Seed: SHEGPAFLT (TYRP1_HUMAN)
  misc_feature (2)..(2): Xaa can be His, Arg, Gln, Glu, or Lys
  misc_feature (9)..(9): Xaa can be Leu, Ile, Val, Phe, Trp, Met, Ala, Cys, Gly, Pro, Thr, Ser, or Tyr
SXEGPAFLX

SEQ ID NO: 182377 - protein, 10 aa, Artificial Sequence
  Description of Artificial Sequence: Synthetic peptide
  Seed: SHEGPAFLTW (TYRP1_HUMAN)
  misc_feature (2)..(2): Xaa can be Glu, His, Gln, Arg, Val, Phe, Leu, Cys, Ala, Ser, Asp, Asn, Met, Pro, Gly, Lys, Thr, Tyr, Trp, or Ile
  misc_feature (10)..(10): Xaa can be Phe, Trp, Tyr, Ile, Leu, Met, Val, Ala, Thr, Cys, His, Gln, Lys, or Arg
SXEGPAFLTX

SEQ ID NO: 182378 - protein, 8 aa, Artificial Sequence
  Description of Artificial Sequence: Synthetic peptide
  Seed: SIYNYFVW (TYRP1_HUMAN)
  misc_feature (2)..(2): Xaa can be Ser, Thr, Ala, Asn, Phe, Trp, Gln, Ile, Leu, Cys, Met, Tyr, Val, or Gly
  misc_feature (8)..(8): Xaa can be Trp, Phe, Tyr, Met, Leu, or Ile
SXYNYFVX

SEQ ID NO: 182379 - protein, 9 aa, Artificial Sequence
  Description of Artificial Sequence: Synthetic peptide
  Seed: SIYNYFVWT (TYRP1_HUMAN)
  misc_feature (2)..(2): Xaa can be Met, Leu, Gln, Ile, Thr, Val, Ala, Ser, Phe, Asn, Cys, Gly, Glu, Trp, or Tyr
  misc_feature (9)..(9): Xaa can be Val, Leu, Ala, Ile, Thr, Met, Ser, Cys, Pro, Phe, Gln, Arg, Gly, Glu, or Lys
SXYNYFVWX

SEQ ID NO: 182380 - protein, 10 aa, Artificial Sequence
  Description of Artificial Sequence: Synthetic peptide
  Seed: SIYNYFVWTH (TYRP1_HUMAN)
  misc_feature (2)..(2): Xaa can be Met, Ser, Trp, Val, Phe, Gln, Leu, Thr, Tyr, Ile, Gly, Arg, Ala, Lys, Cys, Glu, His, Pro, Asp, or Asn
  misc_feature (10)..(10): Xaa can be Arg, Lys, His, Tyr, Ala, or Val
SXYNYFVWTX

SEQ ID NO: 182381 - protein, 11 aa, Artificial Sequence
  Description of Artificial Sequence: Synthetic peptide
  Seed: SIYNYFVWTHY (TYRP1_HUMAN)
  misc_feature (2)..(2): Xaa can be Gln, Met, Ala, Leu, Ser, Lys, Val, Thr, Ile, Glu, His, Arg, Tyr, Phe, Asn, Trp, or Gly
  misc_feature (11)..(11): Xaa can be Tyr, Phe, Arg, Met, Lys, Leu, Val, His, Trp, Ile, or Ala
SXYNYFVWTHX

SEQ ID NO: 182382 - protein, 9 aa, Artificial Sequence
  Description of Artificial Sequence: Synthetic peptide
  Seed: SKEEKNHFV (TYRP1_HUMAN)
  misc_feature (2)..(2): Xaa can be Arg, Tyr, Phe, Leu, Gln, Val, Gly, Asn, Ser, Met, His, Trp, Thr, Ile, Glu, Lys, Ala, Asp, Cys, or Pro
  misc_feature (9)..(9): Xaa can be Phe, Ile, Leu, Met, Val, Tyr, Cys, or Ala
SXEEKNHFX

SEQ ID NO: 182383 - protein, 8 aa, Artificial Sequence
  Description of Artificial Sequence: Synthetic peptide
  Seed: SLEDYDTL (TYRP1_HUMAN)
  misc_feature (2)..(2): Xaa can be Ala, Phe, Ile, Ser, Leu, Thr, or Val
  misc_feature (8)..(8): Xaa can be Leu, Ile, Phe, or Met
SXEDYDTX

SEQ ID NO: 182384 - protein, 11 aa, Artificial Sequence
  Description of Artificial Sequence: Synthetic peptide
  Seed: SLEDYDTLGTL (TYRP1_HUMAN)
  misc_feature (2)..(2): Xaa can be Met, Leu, Val, Ile, Gln, Ala, Arg, Ser, Cys, Thr, Tyr, Gly, Phe, His, Trp, Glu, Lys, Pro, or Asn
  misc_feature (11)..(11): Xaa can be Leu, Met, Phe, Ile, Val, Trp, Tyr, Ala, or Thr
SXEDYDTLGTX

SEQ ID NO: 182385 - protein, 9 aa, Artificial Sequence
  Description of Artificial Sequence: Synthetic peptide
  Seed: SLGCIFFPL (TYRP1_HUMAN)
  misc_feature (2)..(2): Xaa can be Met, Leu, Val, Thr, Ile, Gln, Ala, Ser, Gly, Asn, Phe, Pro, Cys, Trp, Glu, Tyr, Asp, or Ly s
  misc_feature (9)..(9): Xaa can be Arg, Val, Lys, Leu, Ile, Ala, Met, Thr, Trp, Phe, Tyr, Ser, Cys, His, Pro, or Gly
SXGCIFFPX

SEQ ID NO: 182386 - protein, 10 aa, Artificial Sequence
  Description of Artificial Sequence: Synthetic peptide
  Seed: SLGCIFFPLL (TYRP1_HUMAN)
  misc_feature (2)..(2): Xaa can be Leu, Met, Gln, Ile, Val, Thr, Ala, or Ser
  misc_feature (10)..(10): Xaa can be Val, Ala, Ile, Leu, Met, Phe, Thr, Tyr, Arg, Cys, His, Trp, Ser, Lys, Asn, Glu, Pro, Gly, Gln, or Asp
SXGCIFFPLX

SEQ ID NO: 182387 - protein, 11 aa, Artificial Sequence
  Description of Artificial Sequence: Synthetic peptide
  Seed: SLGCIFFPLLL (TYRP1_HUMAN)
  misc_feature (2)..(2): Xaa can be Met, Leu, Ile, Gln, Val, or Thr
  misc_feature (11)..(11): Xaa can be Val, Ile, Met, Leu, Ala, or Thr
SXGCIFFPLLX

SEQ ID NO: 182388 - protein, 8 aa, Artificial Sequence
  Description of Artificial Sequence: Synthetic peptide
  Seed: SLHNLAHL (TYRP1_HUMAN)
  misc_feature (2)..(2): Xaa can be Leu, or Met
  misc_feature (8)..(8): Xaa can be Val, Ile, or Leu
SXHNLAHX

SEQ ID NO: 182389 - protein, 9 aa, Artificial Sequence
  Description of Artificial Sequence: Synthetic peptide
  Seed: SLHNLAHLF (TYRP1_HUMAN)
  misc_feature (2)..(2): Xaa can be Ala, Gln, Leu, Met, Arg, Tyr, Phe, Ser, Thr, Val, Ile, Trp, Gly, Glu, Asp, Asn, Cys, Pro, Lys, or His
  misc_feature (9)..(9): Xaa can be Ile, Leu, Tyr, Phe, Trp, Met, Val, Arg, Lys, His, Ala, Cys, Thr, or Gln
SXHNLAHLX

SEQ ID NO: 182390 - protein, 10 aa, Artificial Sequence
  Description of Artificial Sequence: Synthetic peptide
  Seed: SLHNLAHLFL (TYRP1_HUMAN)
  misc_feature (2)..(2): Xaa can be Met, Leu, Ile, His, Val, Gln, Ala, Thr, Gly, Arg, Cys, Asn, Lys, Ser, Phe, Tyr, Pro, Asp, Trp, or Glu
  misc_feature (10)..(10): Xaa can be Leu, Val, Ile, Ala, Met, Thr, or Phe
SXHNLAHLFX

SEQ ID NO: 182391 - protein, 9 aa, Artificial Sequence
  Description of Artificial Sequence: Synthetic peptide
  Seed: SLPYWNFAT (TYRP1_HUMAN)
  misc_feature (2)..(2): Xaa can be Leu, Met, Gln, Ile, Val, Thr, Ala, Phe, Ser, Tyr, Trp, Cys, or Gly
  misc_feature (9)..(9): Xaa can be Val, Leu, Ile, Ala, Met, Thr, Cys, Phe, Ser, Pro, or Gly
SXPYWNFAX

SEQ ID NO: 182392 - protein, 11 aa, Artificial Sequence
  Description of Artificial Sequence: Synthetic peptide
  Seed: SLPYWNFATGK (TYRP1_HUMAN)
  misc_feature (2)..(2): Xaa can be Thr, Asp, Ser, Ile, Trp, Gly, Val, Pro, His, Glu, Leu, Asn, Lys, Ala, Cys, Arg, Met, Tyr, Phe, or Gln
  misc_feature (11)..(11): Xaa can be Lys, or Arg
SXPYWNFATGX

SEQ ID NO: 182393 - protein, 9 aa, Artificial Sequence
  Description of Artificial Sequence: Synthetic peptide
  Seed: SMDEANQPL (TYRP1_HUMAN)
  misc_feature (2)..(2): Xaa can be Ala, Phe, Tyr, Ile, Thr, Ser, Glu, Val, Pro, Met, Leu, Arg, Gln, His, Gly, Trp, Cys, Asn, Asp, or Lys
  misc_feature (9)..(9): Xaa can be Leu, Arg, Trp, Met, Val, Tyr, Ile, Phe, Lys, Cys, Ala, Thr, His, Ser, Pro, Gln, Gly, or Gl u
SXDEANQPX

SEQ ID NO: 182394 - protein, 10 aa, Artificial Sequence
  Description of Artificial Sequence: Synthetic peptide
  Seed: SMDEANQPLL (TYRP1_HUMAN)
  misc_feature (2)..(2): Xaa can be Thr, Ala, Leu, Met, Ser, Val, Ile, Phe, Tyr, Glu, Trp, Gln, Gly, Arg, Asn, Cys, Asp, Pro, His, or Lys
  misc_feature (10)..(10): Xaa can be Tyr, Phe, Leu, Met, Lys, Trp, Ile, Arg, Val, Cys, Ala, His, Thr, Gln, Ser, Asn, or Glu
SXDEANQPLX

SEQ ID NO: 182395 - protein, 11 aa, Artificial Sequence
  Description of Artificial Sequence: Synthetic peptide
  Seed: SMDEANQPLLT (TYRP1_HUMAN)
  misc_feature (2)..(2): Xaa can be Leu, Met, Ile, Val, Thr, Gln, Ala, or Ser
  misc_feature (11)..(11): Xaa can be Leu, Ile, Met, Phe, Val, Ala, Cys, Tyr, Thr, or Trp
SXDEANQPLLX

SEQ ID NO: 182396 - protein, 8 aa, Artificial Sequence
  Description of Artificial Sequence: Synthetic peptide
  Seed: SNFDSTLI (TYRP1_HUMAN)
  misc_feature (2)..(2): Xaa can be Gln, Leu, Glu, Gly, Met, Ala, Ser, Asn, Val, Ile, or Pro
  misc_feature (8)..(8): Xaa can be Ile, Val, Leu, Met, Phe, or Ala
SXFDSTLX

SEQ ID NO: 182397 - protein, 8 aa, Artificial Sequence
  Description of Artificial Sequence: Synthetic peptide
  Seed: SPNDPIFV (TYRP1_HUMAN)
  misc_feature (2)..(2): Xaa can be , or Pro
  misc_feature (8)..(8): Xaa can be Val, Met, Ile, Phe, Leu, or Ala
SXNDPIFX

SEQ ID NO: 182398 - protein, 9 aa, Artificial Sequence
  Description of Artificial Sequence: Synthetic peptide
  Seed: SPNDPIFVL (TYRP1_HUMAN)
  misc_feature (2)..(2): Xaa can be Pro, Arg, Ala, His, Val, Ser, Thr, Gln, Gly, Tyr, Ile, Leu, Met, Asn, Phe, Glu, Trp, Cys, Lys, or Asp
  misc_feature (9)..(9): Xaa can be Lys, Val, Phe, Tyr, Met, Ile, Leu, Arg, Trp, His, Cys, Ala, Thr, Gln, Ser, Pro, Gly, Glu, Asn, or Asp
SXNDPIFVX

SEQ ID NO: 182399 - protein, 10 aa, Artificial Sequence
  Description of Artificial Sequence: Synthetic peptide
  Seed: SPNDPIFVLL (TYRP1_HUMAN)
  misc_feature (2)..(2): Xaa can be Pro, Ala, Thr, Ser, Arg, Gln, Tyr, Glu, Phe, Val, Met, Cys, Ile, Leu, Gly, His, Asn, Lys, Trp, or Asp
  misc_feature (10)..(10): Xaa can be Phe, Leu, Lys, Met, Tyr, Ile, Arg, Val, Trp, Cys, Ala, His, Thr, Gln, Glu, Ser, Gly, or Pr o
SXNDPIFVLX

SEQ ID NO: 182400 - protein, 9 aa, Artificial Sequence
  Description of Artificial Sequence: Synthetic peptide
  Seed: SPNSVFSQW (TYRP1_HUMAN)
  misc_feature (2)..(2): Xaa can be Pro, Glu, Ala, Gln, Val, Ser, Thr, Ile, Phe, Leu, Met, Asp, Tyr, Cys, Gly, Lys, His, Asn, Trp, or Arg
  misc_feature (9)..(9): Xaa can be Tyr, Trp, Phe, Met, Leu, Ile, Val, Ala, Cys, His, Arg, Gln, Lys, Thr, Ser, Gly, Pro, Glu, or Asn
SXNSVFSQX

SEQ ID NO: 182401 - protein, 10 aa, Artificial Sequence
  Description of Artificial Sequence: Synthetic peptide
  Seed: SPNSVFSQWR (TYRP1_HUMAN)
  misc_feature (2)..(2): Xaa can be Thr, Ala, Phe, Gln, Trp, Asn, Tyr, Met, Val, Leu, Ile, Gly, Ser, Lys, Arg, Cys, Pro, His, Asp, or Glu
  misc_feature (10)..(10): Xaa can be Arg, Lys, or Tyr
SXNSVFSQWX

SEQ ID NO: 182402 - protein, 11 aa, Artificial Sequence
  Description of Artificial Sequence: Synthetic peptide
  Seed: SPNSVFSQWRV (TYRP1_HUMAN)
  misc_feature (2)..(2): Xaa can be , or Pro
  misc_feature (11)..(11): Xaa can be Leu, Val, Cys, or Ala
SXNSVFSQWRX

SEQ ID NO: 182403 - protein, 9 aa, Artificial Sequence
  Description of Artificial Sequence: Synthetic peptide
  Seed: SPQYPHDGR (TYRP1_HUMAN)
  misc_feature (2)..(2): Xaa can be Tyr, Val, Ile, Thr, Ser, Ala, His, Trp, Phe, Met, Gln, Asp, Leu, Gly, Pro, or Asn
  misc_feature (9)..(9): Xaa can be Arg, or Lys
SXQYPHDGX

SEQ ID NO: 182404 - protein, 8 aa, Artificial Sequence
  Description of Artificial Sequence: Synthetic peptide
  Seed: SPVSGPGT (TYRP1_HUMAN)
  misc_feature (2)..(2): Xaa can be , or Pro
  misc_feature (8)..(8): Xaa can be Phe, Ile, Val, Ala, Pro, Met, Cys, Leu, or Thr
SXVSGPGX

SEQ ID NO: 182405 - protein, 9 aa, Artificial Sequence
  Description of Artificial Sequence: Synthetic peptide
  Seed: SPVSGPGTD (TYRP1_HUMAN)
  misc_feature (2)..(2): Xaa can be Pro, Ala, Val, Ser, Gly, Thr, Met, Ile, or Leu
  misc_feature (9)..(9): Xaa can be Ala, Val, Thr, Cys, Pro, Met, Ile, Leu, Gln, Asp, His, Lys, Tyr, Arg, Trp, Gly, Glu, Phe, Asn, or Ser
SXVSGPGTX

SEQ ID NO: 182406 - protein, 10 aa, Artificial Sequence
  Description of Artificial Sequence: Synthetic peptide
  Seed: SPVSGPGTDR (TYRP1_HUMAN)
  misc_feature (2)..(2): Xaa can be Pro, Ala, Arg, Gly, Val, Thr, Ser, Ile, Leu, Met, Gln, Cys, Lys, Trp, Asp, Tyr, Phe, Asn, Glu, or His
  misc_feature (10)..(10): Xaa can be Lys, Arg, Phe, Leu, Met, Tyr, Val, Gln, Ile, His, Ala, Trp, Gly, Cys, Asn, Glu, Pro, Ser, or Thr
SXVSGPGTDX

SEQ ID NO: 182407 - protein, 11 aa, Artificial Sequence
  Description of Artificial Sequence: Synthetic peptide
  Seed: SPVSGPGTDRC (TYRP1_HUMAN)
  misc_feature (2)..(2): Xaa can be , or Pro
  misc_feature (11)..(11): Xaa can be Val, Cys, Phe, Trp, Pro, Ser, Ala, Ile, Leu, Thr, Met, Gly, or Tyr
SXVSGPGTDRX

SEQ ID NO: 182408 - protein, 10 aa, Artificial Sequence
  Description of Artificial Sequence: Synthetic peptide
  Seed: SQWRVVCDSL (TYRP1_HUMAN)
  misc_feature (2)..(2): Xaa can be Arg, Gln, Leu, Met, Ile, Val, Thr, Glu, Lys, Ser, Ala, or His
  misc_feature (10)..(10): Xaa can be Phe, Tyr, Val, Ile, Leu, Met, Ala, Trp, Thr, Ser, His, Gly, or Cys
SXWRVVCDSX

SEQ ID NO: 182409 - protein, 9 aa, Artificial Sequence
  Description of Artificial Sequence: Synthetic peptide
  Seed: SREFSVPEI (TYRP1_HUMAN)
  misc_feature (2)..(2): Xaa can be Arg, His, Tyr, Gln, Phe, Trp, Ala, Gly, Glu, Ser, Ile, Thr, Met, Val, Lys, Pro, Leu, Asn, Cys, or Asp
  misc_feature (9)..(9): Xaa can be Leu, Met, Phe, Ile, Val, Tyr, Ala, Cys, Trp, Thr, Pro, Arg, Ser, Lys, or His
SXEFSVPEX

SEQ ID NO: 182410 - protein, 10 aa, Artificial Sequence
  Description of Artificial Sequence: Synthetic peptide
  Seed: SREFSVPEII (TYRP1_HUMAN)
  misc_feature (2)..(2): Xaa can be Glu, Arg, Pro, Cys, Leu, His, Tyr, Gln, Ser, Met, Asp, Gly, Ala, Phe, Lys, Thr, Trp, Asn, Ile, or Val
  misc_feature (10)..(10): Xaa can be Ile, Leu, Met, Val, Phe, Ala, Pro, Thr, Cys, or Tyr
SXEFSVPEIX

SEQ ID NO: 182411 - protein, 8 aa, Artificial Sequence
  Description of Artificial Sequence: Synthetic peptide
  Seed: SRPHSPQY (TYRP1_HUMAN)
  misc_feature (2)..(2): Xaa can be Arg, Tyr, His, Phe, Ala, Trp, or Gln
  misc_feature (8)..(8): Xaa can be Phe, Leu, Met, Tyr, or Ile
SXPHSPQX

SEQ ID NO: 182412 - protein, 9 aa, Artificial Sequence
  Description of Artificial Sequence: Synthetic peptide
  Seed: SRSNFDSTL (TYRP1_HUMAN)
  misc_feature (2)..(2): Xaa can be Arg, His, Gln, Met, Tyr, Ala, Lys, Phe, Leu, Gly, Val, Ile, Ser, Thr, Glu, Cys, Trp, Pro, Asn, or Asp
  misc_feature (9)..(9): Xaa can be Leu, Tyr, Phe, Met, Ile, Val, Arg, Lys, Trp, Ala, His, Pro, Cys, Thr, Gly, or Ser
SXSNFDSTX

SEQ ID NO: 182413 - protein, 10 aa, Artificial Sequence
  Description of Artificial Sequence: Synthetic peptide
  Seed: SRSNFDSTLI (TYRP1_HUMAN)
  misc_feature (2)..(2): Xaa can be Arg, Tyr, Gln, Phe, His, Trp, or Ala
  misc_feature (10)..(10): Xaa can be Phe, Tyr, Leu, Met, Cys, Ile, Trp, Arg, Lys, Ala, Pro, His, or Val
SXSNFDSTLX

SEQ ID NO: 182414 - protein, 9 aa, Artificial Sequence
  Description of Artificial Sequence: Synthetic peptide
  Seed: STEDGPIRR (TYRP1_HUMAN)
  misc_feature (2)..(2): Xaa can be Ala, Thr, Met, Ile, Val, Ser, Leu, Phe, Tyr, Gly, Trp, Pro, Cys, Asn, Gln, Glu, Asp, His, or Lys
  misc_feature (9)..(9): Xaa can be Tyr, Arg, Lys, Leu, Met, Phe, Val, Ile, Trp, His, Gln, or Ala
SXEDGPIRX

SEQ ID NO: 182415 - protein, 10 aa, Artificial Sequence
  Description of Artificial Sequence: Synthetic peptide
  Seed: STFPLENAPI (TYRP1_HUMAN)
  misc_feature (2)..(2): Xaa can be Leu, Met, Thr, Ile, Val, Ser, Ala, Gln, Gly, Asn, Phe, Cys, Glu, Asp, or Tyr
  misc_feature (10)..(10): Xaa can be Lys, Tyr, Arg, Met, Val, Leu, Phe, Ala, Ile, Trp, Thr, Cys, or Ser
SXFPLENAPX

SEQ ID NO: 182416 - protein, 9 aa, Artificial Sequence
  Description of Artificial Sequence: Synthetic peptide
  Seed: STLISPNSV (TYRP1_HUMAN)
  misc_feature (2)..(2): Xaa can be Ala, Gln, Met, Leu, Val, Thr, Ile, Ser, Gly, Pro, Phe, Asp, Glu, Cys, Asn, Tyr, Arg, Trp, His, or Lys
  misc_feature (9)..(9): Xaa can be Leu, Met, Ile, Val, Phe, Trp, Tyr, Lys, Arg, Ala, His, Cys, or Thr
SXLISPNSX

SEQ ID NO: 182417 - protein, 10 aa, Artificial Sequence
  Description of Artificial Sequence: Synthetic peptide
  Seed: STLISPNSVF (TYRP1_HUMAN)
  misc_feature (2)..(2): Xaa can be Gln, Ala, Ser, Thr, Met, Gly, Val, Lys, His, Arg, Phe, Glu, Asn, Trp, Asp, Ile, Cys, Leu, Pro, or Tyr
  misc_feature (10)..(10): Xaa can be Met, Phe, Trp, Tyr, Leu, Lys, His, Ile, Arg, or Val
SXLISPNSVX

SEQ ID NO: 182418 - protein, 9 aa, Artificial Sequence
  Description of Artificial Sequence: Synthetic peptide
  Seed: STNSFRNTV (TYRP1_HUMAN)
  misc_feature (2)..(2): Xaa can be Thr, Ala, Ser, Met, Gln, Val, Leu, Ile, Tyr, Gly, Phe, Arg, Trp, Lys, Cys, Asn, Pro, Asp, His, or Glu
  misc_feature (9)..(9): Xaa can be Leu, Met, Val, Phe, Tyr, Ile, Trp, Lys, Ala, Arg, His, Thr, Cys, Ser, Gly, Asn, or Gln
SXNSFRNTX

SEQ ID NO: 182419 - protein, 9 aa, Artificial Sequence
  Description of Artificial Sequence: Synthetic peptide
  Seed: SVFSQWRVV (TYRP1_HUMAN)
  misc_feature (2)..(2): Xaa can be Met, Thr, Ser, Ala, Val, Gln, Leu, Ile, Gly, Tyr, Phe, Asn, Glu, Trp, Pro, Cys, Asp, or Hi s
  misc_feature (9)..(9): Xaa can be Val, Tyr, Phe, Met, Ile, Lys, Leu, Ala, Trp, His, Thr, Ser, Cys, Arg, Gly, or Gln
SXFSQWRVX

SEQ ID NO: 182420 - protein, 9 aa, Artificial Sequence
  Description of Artificial Sequence: Synthetic peptide
  Seed: SVKKTFLGV (TYRP1_HUMAN)
  misc_feature (2)..(2): Xaa can be Ser, Thr, Val, Met, Ala, Gln, Pro, Ile, Tyr, Leu, Gly, Phe, Asn, Trp, Glu, Cys, Asp, His, Arg, or Lys
  misc_feature (9)..(9): Xaa can be Lys, Tyr, Ile, Val, Ala, Leu, Arg, Met, Phe, Gly, Ser, Thr, His, Cys, Pro, Asn, Trp, Gln, or Glu
SXKKTFLGX

SEQ ID NO: 182421 - protein, 10 aa, Artificial Sequence
  Description of Artificial Sequence: Synthetic peptide
  Seed: SVKKTFLGVG (TYRP1_HUMAN)
  misc_feature (2)..(2): Xaa can be Thr, Ser, Val, Tyr, Ala, Ile, Met, Phe, Gly, Gln, Trp, Leu, His, Cys, or Asn
  misc_feature (10)..(10): Xaa can be Lys, Ala, Val, Ile, Ser, Arg, Tyr, Met, Gly, Leu, Cys, Thr, His, Pro, or Phe
SXKKTFLGVX

SEQ ID NO: 182422 - protein, 8 aa, Artificial Sequence
  Description of Artificial Sequence: Synthetic peptide
  Seed: SVPEIIAI (TYRP1_HUMAN)
  misc_feature (2)..(2): Xaa can be Ala, Gln, Ser, Leu, Met, Ile, Val, Cys, Gly, Asn, Phe, Thr, Pro, Tyr, Glu, Asp, Arg, Trp, Lys, or His
  misc_feature (8)..(8): Xaa can be Leu, Ile, Val, Met, Phe, Arg, Lys, Tyr, Ala, Cys, Trp, Thr, or His
SXPEIIAX

SEQ ID NO: 182423 - protein, 9 aa, Artificial Sequence
  Description of Artificial Sequence: Synthetic peptide
  Seed: SVPEIIAIA (TYRP1_HUMAN)
  misc_feature (2)..(2): Xaa can be Pro, Ala, Leu, Met, Gln, Val, Thr, Ile, Ser, Cys, Gly, Phe, Asn, Glu, Tyr, His, Trp, Arg, Asp, or Lys
  misc_feature (9)..(9): Xaa can be Lys, Tyr, Leu, Met, Phe, Val, Arg, Ile, Trp, Cys, His, Ala, Thr, Ser, Pro, Gly, Gln, Asn, or Glu
SXPEIIAIX

SEQ ID NO: 182424 - protein, 10 aa, Artificial Sequence
  Description of Artificial Sequence: Synthetic peptide
  Seed: SVPEIIAIAV (TYRP1_HUMAN)
  misc_feature (2)..(2): Xaa can be Leu, Met, Ile, Thr, Val, Ala, Ser, Gln, Phe, Tyr, Asn, Trp, Gly, Cys, Pro, Asp, Glu, His, Lys, or Arg
  misc_feature (10)..(10): Xaa can be Met, Val, Phe, Ile, Leu, Lys, Arg, Tyr, Ala, Trp, Thr, Cys, His, Gly, Gln, Pro, Asp, Glu, Ser, or Asn
SXPEIIAIAX

SEQ ID NO: 182425 - protein, 11 aa, Artificial Sequence
  Description of Artificial Sequence: Synthetic peptide
  Seed: SVPEIIAIAVV (TYRP1_HUMAN)
  misc_feature (2)..(2): Xaa can be Leu, Met, Ile, Val, Thr, or Gln
  misc_feature (11)..(11): Xaa can be Val, Ala, Met, Leu, Ile, Thr, Cys, or Phe
SXPEIIAIAVX

SEQ ID NO: 182426 - protein, 8 aa, Artificial Sequence
  Description of Artificial Sequence: Synthetic peptide
  Seed: SYLIRARR (TYRP1_HUMAN)
  misc_feature (2)..(2): Xaa can be Trp, Met, Phe, Val, Tyr, Leu, Thr, Ile, or Ser
  misc_feature (8)..(8): Xaa can be , or Arg
SXLIRARX

SEQ ID NO: 182427 - protein, 10 aa, Artificial Sequence
  Description of Artificial Sequence: Synthetic peptide
  Seed: SYLIRARRSM (TYRP1_HUMAN)
  misc_feature (2)..(2): Xaa can be Tyr, Phe, or Trp
  misc_feature (10)..(10): Xaa can be Met, Phe, Leu, Tyr, Trp, Val, or Ile
SXLIRARRSX

SEQ ID NO: 182428 - protein, 9 aa, Artificial Sequence
  Description of Artificial Sequence: Synthetic peptide
  Seed: TADSRPHSP (TYRP1_HUMAN)
  misc_feature (2)..(2): Xaa can be Ala, Ser, Thr, Leu, Ile, Val, Met, Gln, Phe, Gly, Asn, Tyr, Cys, Trp, Pro, Asp, Glu, Arg, His, or Lys
  misc_feature (9)..(9): Xaa can be Ile, Leu, Phe, Met, Val, Tyr, Trp, Ala, Cys, Thr, Ser, Pro, Gln, Lys, Gly, or Arg
TXDSRPHSX

SEQ ID NO: 182429 - protein, 11 aa, Artificial Sequence
  Description of Artificial Sequence: Synthetic peptide
  Seed: TADSRPHSPQY (TYRP1_HUMAN)
  misc_feature (2)..(2): Xaa can be Thr, Pro, Ser, Ala, Met, Val, Ile, Gln, Tyr, Gly, Glu, Asp, Phe, Cys, Leu, Trp, or Asn
  misc_feature (11)..(11): Xaa can be Tyr, Phe, Trp, Lys, Leu, His, Met, or Arg
TXDSRPHSPQX

SEQ ID NO: 182430 - protein, 8 aa, Artificial Sequence
  Description of Artificial Sequence: Synthetic peptide
  Seed: TAPDNLGY (TYRP1_HUMAN)
  misc_feature (2)..(2): Xaa can be Ala, Thr, Ser, Val, Gly, Ile, or Leu
  misc_feature (8)..(8): Xaa can be Lys, Arg, Leu, Tyr, Met, Phe, or Ile
TXPDNLGX

SEQ ID NO: 182431 - protein, 9 aa, Artificial Sequence
  Description of Artificial Sequence: Synthetic peptide
  Seed: TAPDNLGYT (TYRP1_HUMAN)
  misc_feature (2)..(2): Xaa can be Ala, Met, Ser, Val, Leu, Ile, Thr, Phe, Trp, Gly, Pro, Tyr, Gln, Cys, Asn, Asp, Glu, His, Arg, or Lys
  misc_feature (9)..(9): Xaa can be Leu, Met, Val, Phe, Ile, Cys, Tyr, Ala, Trp, or Thr
TXPDNLGYX

SEQ ID NO: 182432 - protein, 10 aa, Artificial Sequence
  Description of Artificial Sequence: Synthetic peptide
  Seed: TAPDNLGYTY (TYRP1_HUMAN)
  misc_feature (2)..(2): Xaa can be Tyr, Arg, Phe, Ala, Ile, Met, Ser, Leu, Val, Thr, Gln, Trp, Pro, Gly, Glu, Cys, Asn, His, Lys, or Asp
  misc_feature (10)..(10): Xaa can be Tyr, Trp, Phe, Met, Leu, Ile, Lys, Val, Arg, His, Cys, Ala, Gln, or Thr
TXPDNLGYTX

SEQ ID NO: 182433 - protein, 9 aa, Artificial Sequence
  Description of Artificial Sequence: Synthetic peptide
  Seed: TASYLIRAR (TYRP1_HUMAN)
  misc_feature (2)..(2): Xaa can be Val, Thr, Met, Leu, Ser, Ile, Ala, Gly, Phe, Gln, Asn, Trp, Asp, Cys, Glu, Pro, Tyr, or Hi s
  misc_feature (9)..(9): Xaa can be Arg, Lys, Tyr, Leu, Met, His, Val, or Phe
TXSYLIRAX

SEQ ID NO: 182434 - protein, 10 aa, Artificial Sequence
  Description of Artificial Sequence: Synthetic peptide
  Seed: TASYLIRARR (TYRP1_HUMAN)
  misc_feature (2)..(2): Xaa can be Thr, Val, Ala, Met, Ile, Glu, Pro, Phe, Tyr, Gln, Asn, Trp, Leu, Cys, Ser, Asp, Gly, Lys, His, or Arg
  misc_feature (10)..(10): Xaa can be Arg, Lys, Tyr, Ile, Cys, Trp, His, Asp, Gly, Asn, Ser, Leu, Met, Ala, Pro, Phe, Glu, Val, Gln, or Thr
TXSYLIRARX

SEQ ID NO: 182435 - protein, 8 aa, Artificial Sequence
  Description of Artificial Sequence: Synthetic peptide
  Seed: TDAVFDEW (TYRP1_HUMAN)
  misc_feature (2)..(2): Xaa can be Glu, Ala, Leu, Phe, Cys, Thr, Asn, Ser, Pro, Gln, Asp, Val, Gly, Met, or Ile
  misc_feature (8)..(8): Xaa can be Trp, Leu, Phe, or Tyr
TXAVFDEX

SEQ ID NO: 182436 - protein, 9 aa, Artificial Sequence
  Description of Artificial Sequence: Synthetic peptide
  Seed: TDAVFDEWL (TYRP1_HUMAN)
  misc_feature (2)..(2): Xaa can be Glu, or Asp
  misc_feature (9)..(9): Xaa can be Leu, Phe, Val, Ile, or Met
TXAVFDEWX

SEQ ID NO: 182437 - protein, 10 aa, Artificial Sequence
  Description of Artificial Sequence: Synthetic peptide
  Seed: TDAVFDEWLR (TYRP1_HUMAN)
  misc_feature (2)..(2): Xaa can be Val, Thr, Asn, Gln, Leu, Met, Tyr, Gly, Pro, Ser, Cys, His, Ile, Ala, Trp, Lys, Phe, Arg, Asp, or Glu
  misc_feature (10)..(10): Xaa can be Arg, Lys, or Tyr
TXAVFDEWLX

SEQ ID NO: 182438 - protein, 11 aa, Artificial Sequence
  Description of Artificial Sequence: Synthetic peptide
  Seed: TDAVFDEWLRR (TYRP1_HUMAN)
  misc_feature (2)..(2): Xaa can be Trp, Phe, Cys, Val, Ile, Gly, Met, Glu, Lys, Asp, Leu, Gln, Tyr, Ser, Pro, Arg, Ala, Asn, Thr, or His
  misc_feature (11)..(11): Xaa can be Lys, or Arg
TXAVFDEWLRX

SEQ ID NO: 182439 - protein, 11 aa, Artificial Sequence
  Description of Artificial Sequence: Synthetic peptide
  Seed: TDDLMGSRSNF (TYRP1_HUMAN)
  misc_feature (2)..(2): Xaa can be Glu, Asp, or Gln
  misc_feature (11)..(11): Xaa can be Phe, Val, Ile, Leu, Met, or Trp
TXDLMGSRSNX

SEQ ID NO: 182440 - protein, 8 aa, Artificial Sequence
  Description of Artificial Sequence: Synthetic peptide
  Seed: TEDGPIRR (TYRP1_HUMAN)
  misc_feature (2)..(2): Xaa can be Val, Thr, Ala, Ser, Ile, Phe, Tyr, Leu, Met, Gly, Gln, Asn, Trp, Cys, Glu, Asp, or Pro
  misc_feature (8)..(8): Xaa can be Tyr, Lys, Arg, Leu, Phe, Met, His, Ile, Val, or Trp
TXDGPIRX

SEQ ID NO: 182441 - protein, 10 aa, Artificial Sequence
  Description of Artificial Sequence: Synthetic peptide
  Seed: TEDGPIRRNP (TYRP1_HUMAN)
  misc_feature (2)..(2): Xaa can be Glu, Gln, or Asp
  misc_feature (10)..(10): Xaa can be Phe, Leu, Val, Met, Cys, Ala, Pro, Thr, Gly, Ser, Trp, Ile, or Tyr
TXDGPIRRNX

SEQ ID NO: 182442 - protein, 11 aa, Artificial Sequence
  Description of Artificial Sequence: Synthetic peptide
  Seed: TEDGPIRRNPA (TYRP1_HUMAN)
  misc_feature (2)..(2): Xaa can be , or Glu
  misc_feature (11)..(11): Xaa can be Pro, Phe, Gly, Trp, Leu, Thr, Cys, Ile, Val, Met, Ala, or Ser
TXDGPIRRNPX

SEQ ID NO: 182443 - protein, 8 aa, Artificial Sequence
  Description of Artificial Sequence: Synthetic peptide
  Seed: TEMFVTAP (TYRP1_HUMAN)
  misc_feature (2)..(2): Xaa can be Glu, Asp, or Gln
  misc_feature (8)..(8): Xaa can be Ala, Leu, Phe, Ile, Tyr, Val, Met, Ser, Trp, Cys, His, Pro, Thr, or Gly
TXMFVTAX

SEQ ID NO: 182444 - protein, 9 aa, Artificial Sequence
  Description of Artificial Sequence: Synthetic peptide
  Seed: TEMFVTAPD (TYRP1_HUMAN)
  misc_feature (2)..(2): Xaa can be Glu, Asp, Gln, His, Pro, Phe, Ala, Met, Lys, or Asn
  misc_feature (9)..(9): Xaa can be Tyr, Phe, Ala, Pro, Met, Leu, Ile, Val, Ser, Cys, Glu, Asn, Gly, Asp, His, Trp, Gln, or Th r
TXMFVTAPX

SEQ ID NO: 182445 - protein, 11 aa, Artificial Sequence
  Description of Artificial Sequence: Synthetic peptide
  Seed: TEMFVTAPDNL (TYRP1_HUMAN)
  misc_feature (2)..(2): Xaa can be Glu, Asp, or Gln
  misc_feature (11)..(11): Xaa can be Trp, Tyr, Phe, Cys, Met, Val, Ile, Ala, or Leu
TXMFVTAPDNX

SEQ ID NO: 182446 - protein, 10 aa, Artificial Sequence
  Description of Artificial Sequence: Synthetic peptide
  Seed: TFLGVGQESF (TYRP1_HUMAN)
  misc_feature (2)..(2): Xaa can be Arg, Tyr, Phe, Trp, Met, Gln, Leu, Glu, Ile, Val, Ala, Pro, Asp, Ser, Gly, Thr, His, Lys, Asn, or Cys
  misc_feature (10)..(10): Xaa can be Tyr, Phe, Met, Trp, Leu, Ile, Val, or Lys
TXLGVGQESX

SEQ ID NO: 182447 - protein, 9 aa, Artificial Sequence
  Description of Artificial Sequence: Synthetic peptide
  Seed: TFPLENAPI (TYRP1_HUMAN)
  misc_feature (2)..(2): Xaa can be Tyr, Phe, Ala, Met, Leu, Gly, Ser, Gln, Ile, Trp, Arg, Thr, Cys, Val, His, Pro, Asn, Glu, Lys, or Asp
  misc_feature (9)..(9): Xaa can be Leu, Met, Phe, Ile, Val, Tyr, Trp, Ala, His, or Cys
TXPLENAPX

SEQ ID NO: 182448 - protein, 10 aa, Artificial Sequence
  Description of Artificial Sequence: Synthetic peptide
  Seed: TFTDAVFDEW (TYRP1_HUMAN)
  misc_feature (2)..(2): Xaa can be Tyr, Thr, Ser, Trp, Phe, Cys, Ala, Met, Gly, Leu, Ile, Val, Pro, His, Arg, Asp, Gln, Glu, Lys, or Asn
  misc_feature (10)..(10): Xaa can be Trp, Phe, Leu, Met, Tyr, Ile, or Val
TXTDAVFDEX

SEQ ID NO: 182449 - protein, 9 aa, Artificial Sequence
  Description of Artificial Sequence: Synthetic peptide
  Seed: TGKYDPAVR (TYRP1_HUMAN)
  misc_feature (2)..(2): Xaa can be Ala, Thr, Val, Ser, Ile, Leu, Met, Tyr, Gln, Glu, Asn, Pro, Gly, Asp, Phe, or Trp
  misc_feature (9)..(9): Xaa can be Arg, Lys, Leu, Met, Phe, Tyr, Val, Ile, or His
TXKYDPAVX

SEQ ID NO: 182450 - protein, 11 aa, Artificial Sequence
  Description of Artificial Sequence: Synthetic peptide
  Seed: TGKYDPAVRSL (TYRP1_HUMAN)
  misc_feature (2)..(2): Xaa can be Thr, Met, Arg, Val, Glu, Lys, Trp, Gly, Phe, Tyr, Asn, Gln, Leu, Asp, Ser, Cys, His, Pro, Ile, or Ala
  misc_feature (11)..(11): Xaa can be Leu, Met, Phe, or Tyr
TXKYDPAVRSX

SEQ ID NO: 182451 - protein, 9 aa, Artificial Sequence
  Description of Artificial Sequence: Synthetic peptide
  Seed: THLSPNDPI (TYRP1_HUMAN)
  misc_feature (2)..(2): Xaa can be His, Arg, Gln, Pro, or Lys
  misc_feature (9)..(9): Xaa can be Ala, Leu, Val, Cys, Met, Phe, Ile, Pro, Thr, Gly, Trp, Tyr, or Ser
TXLSPNDPX

SEQ ID NO: 182452 - protein, 10 aa, Artificial Sequence
  Description of Artificial Sequence: Synthetic peptide
  Seed: THLSPNDPIF (TYRP1_HUMAN)
  misc_feature (2)..(2): Xaa can be His, Arg, Gln, Met, Lys, or Leu
  misc_feature (10)..(10): Xaa can be Tyr, Phe, Met, Leu, Val, Ile, Cys, Ala, Pro, Trp, or Thr
TXLSPNDPIX

SEQ ID NO: 182453 - protein, 11 aa, Artificial Sequence
  Description of Artificial Sequence: Synthetic peptide
  Seed: THLSPNDPIFV (TYRP1_HUMAN)
  misc_feature (2)..(2): Xaa can be His, Arg, or Gln
  misc_feature (11)..(11): Xaa can be Ile, Leu, Phe, Ala, Trp, Cys, Val, Tyr, or Met
TXLSPNDPIFX

SEQ ID NO: 182454 - protein, 8 aa, Artificial Sequence
  Description of Artificial Sequence: Synthetic peptide
  Seed: THPLFVIA (TYRP1_HUMAN)
  misc_feature (2)..(2): Xaa can be His, or Arg
  misc_feature (8)..(8): Xaa can be Ala, Met, Leu, Val, or Ile
TXPLFVIX

SEQ ID NO: 182455 - protein, 9 aa, Artificial Sequence
  Description of Artificial Sequence: Synthetic peptide
  Seed: THPLFVIAT (TYRP1_HUMAN)
  misc_feature (2)..(2): Xaa can be His, Arg, Gln, Lys, Pro, Glu, Asn, Ala, or Gly
  misc_feature (9)..(9): Xaa can be Leu, Ala, Val, Ile, Met, Cys, Pro, Thr, Phe, Gly, or Ser
TXPLFVIAX

SEQ ID NO: 182456 - protein, 10 aa, Artificial Sequence
  Description of Artificial Sequence: Synthetic peptide
  Seed: THPLFVIATR (TYRP1_HUMAN)
  misc_feature (2)..(2): Xaa can be Thr, Ala, Asn, Phe, Ile, Leu, Trp, Val, Gly, Tyr, Ser, Met, Asp, Gln, Pro, Arg, Cys, Glu, Lys, or His
  misc_feature (10)..(10): Xaa can be Arg, Lys, or Tyr
TXPLFVIATX

SEQ ID NO: 182457 - protein, 11 aa, Artificial Sequence
  Description of Artificial Sequence: Synthetic peptide
  Seed: THPLFVIATRR (TYRP1_HUMAN)
  misc_feature (2)..(2): Xaa can be Phe, Tyr, Cys, Ala, Arg, Val, Lys, Gly, Asp, Met, Thr, Trp, Ile, His, Glu, Pro, Ser, Leu, Asn, or Gln
  misc_feature (11)..(11): Xaa can be Arg, or Lys
TXPLFVIATRX

SEQ ID NO: 182458 - protein, 9 aa, Artificial Sequence
  Description of Artificial Sequence: Synthetic peptide
  Seed: THYYSVKKT (TYRP1_HUMAN)
  misc_feature (2)..(2): Xaa can be His, Gln, or Arg
  misc_feature (9)..(9): Xaa can be Cys, Ile, Leu, Ala, Val, Ser, Gly, Phe, Thr, Met, or Pro
TXYYSVKKX

SEQ ID NO: 182459 - protein, 10 aa, Artificial Sequence
  Description of Artificial Sequence: Synthetic peptide
  Seed: THYYSVKKTF (TYRP1_HUMAN)
  misc_feature (2)..(2): Xaa can be Tyr, Arg, His, Gln, Thr, Asn, Gly, Pro, Cys, Asp, Lys, Leu, Met, Ile, Val, Phe, Trp, Ala, Glu, or Ser
  misc_feature (10)..(10): Xaa can be Met, Tyr, Trp, Leu, Phe, Ile, Val, or His
TXYYSVKKTX

SEQ ID NO: 182460 - protein, 8 aa, Artificial Sequence
  Description of Artificial Sequence: Synthetic peptide
  Seed: TLISPNSV (TYRP1_HUMAN)
  misc_feature (2)..(2): Xaa can be Gln, Met, Ala, Ser, Glu, Leu, Val, Ile, or Gly
  misc_feature (8)..(8): Xaa can be Ile, Val, Leu, or Met
TXISPNSX

SEQ ID NO: 182461 - protein, 9 aa, Artificial Sequence
  Description of Artificial Sequence: Synthetic peptide
  Seed: TLISPNSVF (TYRP1_HUMAN)
  misc_feature (2)..(2): Xaa can be Ala, Gln, Pro, Val, Met, Tyr, Ser, Phe, Arg, Ile, Thr, His, Trp, Leu, Gly, Cys, Asn, Lys, Asp, or Glu
  misc_feature (9)..(9): Xaa can be Tyr, Phe, Met, Leu, Trp, Lys, His, Arg, Ile, Val, Ala, Cys, Thr, Gln, Gly, Ser, Pro, or As n
TXISPNSVX

SEQ ID NO: 182462 - protein, 9 aa, Artificial Sequence
  Description of Artificial Sequence: Synthetic peptide
  Seed: TNTEMFVTA (TYRP1_HUMAN)
  misc_feature (2)..(2): Xaa can be His, Arg, Gln, Pro, Lys, Glu, Asn, Ala, Asp, or Gly
  misc_feature (9)..(9): Xaa can be Ala, Leu, Val, Met, Ile, Cys, Phe, Pro, Ser, Thr, Gly, Trp, or Tyr
TXTEMFVTX

SEQ ID NO: 182463 - protein, 9 aa, Artificial Sequence
  Description of Artificial Sequence: Synthetic peptide
  Seed: TPPFYSNST (TYRP1_HUMAN)
  misc_feature (2)..(2): Xaa can be Pro, Ala, or Val
  misc_feature (9)..(9): Xaa can be Leu, Val, Ala, Ile, Met, Tyr, Ser, Pro, Thr, Gly, Phe, or Cys
TXPFYSNSX

SEQ ID NO: 182464 - protein, 9 aa, Artificial Sequence
  Description of Artificial Sequence: Synthetic peptide
  Seed: TPQFENISI (TYRP1_HUMAN)
  misc_feature (2)..(2): Xaa can be Pro, Ala, Val, Met, Gly, Ser, Thr, Ile, Leu, or Phe
  misc_feature (9)..(9): Xaa can be Tyr, Leu, Phe, Trp, Met, Val, Ala, Ile, Ser, Cys, Pro, His, Thr, or Gly
TXQFENISX

SEQ ID NO: 182465 - protein, 10 aa, Artificial Sequence
  Description of Artificial Sequence: Synthetic peptide
  Seed: TPQFENISIY (TYRP1_HUMAN)
  misc_feature (2)..(2): Xaa can be Ile, Gln, Val, Thr, Pro, Tyr, Ser, Trp, Asp, Asn, Glu, Leu, His, Lys, Arg, Gly, Cys, Met, Phe, or Ala
  misc_feature (10)..(10): Xaa can be Ile, Trp, Leu, Met, Tyr, Phe, or His
TXQFENISIX

SEQ ID NO: 182466 - protein, 8 aa, Artificial Sequence
  Description of Artificial Sequence: Synthetic peptide
  Seed: TTHPLFVI (TYRP1_HUMAN)
  misc_feature (2)..(2): Xaa can be Gln, Thr, Ala, Gly, Ser, Val, Glu, Ile, Asn, His, Pro, Met, Leu, Asp, or Lys
  misc_feature (8)..(8): Xaa can be Val, Ile, Leu, Met, Phe, Tyr, Cys, or Ala
TXHPLFVX

SEQ ID NO: 182467 - protein, 9 aa, Artificial Sequence
  Description of Artificial Sequence: Synthetic peptide
  Seed: TTHPLFVIA (TYRP1_HUMAN)
  misc_feature (2)..(2): Xaa can be Pro, Ala, Thr, Ser, Val, Leu, Met, Ile, Gly, Gln, Asn, Cys, Phe, Glu, Tyr, Trp, Asp, Lys, or Arg
  misc_feature (9)..(9): Xaa can be Tyr, Phe, Leu, Lys, Met, Val, Ile, His, Ala, Trp, Thr, Cys, Ser, Pro, Arg, Gln, Glu, Asp, Gly, or Asn
TXHPLFVIX

SEQ ID NO: 182468 - protein, 10 aa, Artificial Sequence
  Description of Artificial Sequence: Synthetic peptide
  Seed: TTHPLFVIAT (TYRP1_HUMAN)
  misc_feature (2)..(2): Xaa can be Thr, Val, Ser, Ala, Ile, or Met
  misc_feature (10)..(10): Xaa can be Val, Ile, Leu, Ala, Met, or Thr
TXHPLFVIAX

SEQ ID NO: 182469 - protein, 11 aa, Artificial Sequence
  Description of Artificial Sequence: Synthetic peptide
  Seed: TTHPLFVIATR (TYRP1_HUMAN)
  misc_feature (2)..(2): Xaa can be Thr, Met, Ser, Val, Gly, Leu, Ala, Ile, Phe, Tyr, Asn, Trp, or Gln
  misc_feature (11)..(11): Xaa can be Arg, or Lys
TXHPLFVIATX

SEQ ID NO: 182470 - protein, 11 aa, Artificial Sequence
  Description of Artificial Sequence: Synthetic peptide
  Seed: TVEGYSDPTGK (TYRP1_HUMAN)
  misc_feature (2)..(2): Xaa can be Thr, Ala, Val, Ser, Met, Ile, Leu, Gly, Asp, Glu, Asn, Gln, Phe, Cys, Tyr, Trp, or Pro
  misc_feature (11)..(11): Xaa can be Lys, Tyr, Arg, Phe, Trp, His, Met, Leu, or Gln
TXEGYSDPTGX

SEQ ID NO: 182471 - protein, 8 aa, Artificial Sequence
  Description of Artificial Sequence: Synthetic peptide
  Seed: TWHRYHLL (TYRP1_HUMAN)
  misc_feature (2)..(2): Xaa can be Tyr, Trp, or Phe
  misc_feature (8)..(8): Xaa can be Leu, Ile, Phe, Tyr, Met, Trp, or Val
TXHRYHLX

SEQ ID NO: 182472 - protein, 9 aa, Artificial Sequence
  Description of Artificial Sequence: Synthetic peptide
  Seed: TWHRYHLLR (TYRP1_HUMAN)
  misc_feature (2)..(2): Xaa can be Thr, Met, Leu, Val, Phe, Ile, Tyr, Ala, Asn, Gly, Gln, Ser, Trp, Asp, Pro, His, Cys, or Gl u
  misc_feature (9)..(9): Xaa can be Arg, Lys, Tyr, or His
TXHRYHLLX

SEQ ID NO: 182473 - protein, 10 aa, Artificial Sequence
  Description of Artificial Sequence: Synthetic peptide
  Seed: TWHRYHLLRL (TYRP1_HUMAN)
  misc_feature (2)..(2): Xaa can be Tyr, Trp, Phe, or Met
  misc_feature (10)..(10): Xaa can be Phe, Trp, Met, Leu, Ile, or Val
TXHRYHLLRX

SEQ ID NO: 182474 - protein, 9 aa, Artificial Sequence
  Description of Artificial Sequence: Synthetic peptide
  Seed: TYEIQWPSR (TYRP1_HUMAN)
  misc_feature (2)..(2): Xaa can be Met, Ser, Trp, Phe, Ala, Gly, Asn, Val, Gln, Ile, Leu, Thr, or Tyr
  misc_feature (9)..(9): Xaa can be Arg, or Lys
TXEIQWPSX

SEQ ID NO: 182475 - protein, 11 aa, Artificial Sequence
  Description of Artificial Sequence: Synthetic peptide
  Seed: TYEIQWPSREF (TYRP1_HUMAN)
  misc_feature (2)..(2): Xaa can be Tyr, Phe, or Trp
  misc_feature (11)..(11): Xaa can be Phe, Met, Tyr, Ile, Trp, or Leu
TXEIQWPSREX

SEQ ID NO: 182476 - protein, 10 aa, Artificial Sequence
  Description of Artificial Sequence: Synthetic peptide
  Seed: VALIFGTASY (TYRP1_HUMAN)
  misc_feature (2)..(2): Xaa can be Gln, Met, Ser, Ala, Lys, Thr, Glu, Ile, Phe, Asp, Tyr, Asn, His, Cys, Leu, Arg, Val, Gly, Pro, or Trp
  misc_feature (10)..(10): Xaa can be Leu, Met, Trp, Tyr, Phe, Ile, Val, His, or Ala
VXLIFGTASX

SEQ ID NO: 182477 - protein, 11 aa, Artificial Sequence
  Description of Artificial Sequence: Synthetic peptide
  Seed: VALIFGTASYL (TYRP1_HUMAN)
  misc_feature (2)..(2): Xaa can be Ala, Leu, Phe, Met, Tyr, Thr, Ile, Ser, Lys, Arg, His, Gln, Trp, Gly, Val, Cys, Asn, Asp, Pro, or Glu
  misc_feature (11)..(11): Xaa can be Val, Leu, Ile, Ala, Met, Phe, or Tyr
VXLIFGTASYX

SEQ ID NO: 182478 - protein, 9 aa, Artificial Sequence
  Description of Artificial Sequence: Synthetic peptide
  Seed: VAQCLEVGL (TYRP1_HUMAN)
  misc_feature (2)..(2): Xaa can be Arg, Ala, Thr, Ser, Gly, Ile, Gln, Val, Leu, Asp, Phe, Met, Asn, Glu, Trp, or Tyr
  misc_feature (9)..(9): Xaa can be Lys, Leu, Arg, Tyr, Phe, Ile, Val, Met, His, or Trp
VXQCLEVGX

SEQ ID NO: 182479 - protein, 10 aa, Artificial Sequence
  Description of Artificial Sequence: Synthetic peptide
  Seed: VAQCLEVGLF (TYRP1_HUMAN)
  misc_feature (2)..(2): Xaa can be Gln, Met, Leu, Ser, Ile, Pro, Ala, Cys, Gly, Asn, Val, Thr, Tyr, Lys, His, Glu, Arg, Trp, Asp, or Phe
  misc_feature (10)..(10): Xaa can be Tyr, Phe, Trp, or Met
VXQCLEVGLX

SEQ ID NO: 182480 - protein, 8 aa, Artificial Sequence
  Description of Artificial Sequence: Synthetic peptide
  Seed: VARPMVQR (TYRP1_HUMAN)
  misc_feature (2)..(2): Xaa can be Val, Thr, Ile, Ala, Ser, Asp, Gly, or Leu
  misc_feature (8)..(8): Xaa can be Lys, or Arg
VXRPMVQX

SEQ ID NO: 182481 - protein, 9 aa, Artificial Sequence
  Description of Artificial Sequence: Synthetic peptide
  Seed: VARPMVQRL (TYRP1_HUMAN)
  misc_feature (2)..(2): Xaa can be Gln, Ala, Arg, Pro, Thr, Ser, Val, Tyr, Met, Ile, Gly, Leu, Phe, Asn, Trp, Asp, Glu, His, Lys, or Cys
  misc_feature (9)..(9): Xaa can be Trp, Met, Phe, Leu, Tyr, Val, Ile, Lys, Arg, His, Ala, Cys, Thr, Pro, or Ser
VXRPMVQRX

SEQ ID NO: 182482 - protein, 9 aa, Artificial Sequence
  Description of Artificial Sequence: Synthetic peptide
  Seed: VCDICTDDL (TYRP1_HUMAN)
  misc_feature (2)..(2): Xaa can be Ala, Tyr, Phe, Val, Ile, Trp, Leu, Ser, Thr, Gly, Met, Pro, Gln, Cys, Asn, His, Asp, Glu, or Arg
  misc_feature (9)..(9): Xaa can be Leu, Met, Phe, Ile, Val, Tyr, Trp, Cys, or Ala
VXDICTDDX

SEQ ID NO: 182483 - protein, 10 aa, Artificial Sequence
  Description of Artificial Sequence: Synthetic peptide
  Seed: VCDICTDDLM (TYRP1_HUMAN)
  misc_feature (2)..(2): Xaa can be Ala, Val, Ser, Met, Thr, Ile, Phe, Leu, Cys, Tyr, Gln, Gly, Trp, or Pro
  misc_feature (10)..(10): Xaa can be Leu, Met, Phe, Ile, Val, or Tyr
VXDICTDDLX

SEQ ID NO: 182484 - protein, 11 aa, Artificial Sequence
  Description of Artificial Sequence: Synthetic peptide
  Seed: VCDSLEDYDTL (TYRP1_HUMAN)
  misc_feature (2)..(2): Xaa can be Ala, Tyr, Phe, Ile, Val, Thr, Ser, Trp, Gly, Met, Leu, Cys, Gln, Pro, Asn, His, Glu, or As p
  misc_feature (11)..(11): Xaa can be Trp, Leu, Phe, Met, Ile, Val, Tyr, Cys, Lys, or Ala
VXDSLEDYDTX

SEQ ID NO: 182485 - protein, 9 aa, Artificial Sequence
  Description of Artificial Sequence: Synthetic peptide
  Seed: VDFSHEGPA (TYRP1_HUMAN)
  misc_feature (2)..(2): Xaa can be Glu, Asp, or Gln
  misc_feature (9)..(9): Xaa can be Ala, Leu, Pro, Cys, Val, Ile, Thr, Ser, Tyr, Phe, Met, or Gly
VXFSHEGPX

SEQ ID NO: 182486 - protein, 10 aa, Artificial Sequence
  Description of Artificial Sequence: Synthetic peptide
  Seed: VDFSHEGPAF (TYRP1_HUMAN)
  misc_feature (2)..(2): Xaa can be Ala, Glu, Ser, Val, Thr, Gly, Met, Ile, Gln, Leu, Asp, Pro, Asn, Lys, Cys, Tyr, Phe, Arg, Trp, or His
  misc_feature (10)..(10): Xaa can be Phe, Tyr, Met, Leu, Trp, His, Lys, Ile, Val, Cys, Ala, Arg, Gln, Thr, Gly, Ser, Asn, or Pr o
VXFSHEGPAX

SEQ ID NO: 182487 - protein, 11 aa, Artificial Sequence
  Description of Artificial Sequence: Synthetic peptide
  Seed: VDFSHEGPAFL (TYRP1_HUMAN)
  misc_feature (2)..(2): Xaa can be Glu, or Asp
  misc_feature (11)..(11): Xaa can be Phe, Leu, Met, Ile, Cys, Trp, or Val
VXFSHEGPAFX

SEQ ID NO: 182488 - protein, 8 aa, Artificial Sequence
  Description of Artificial Sequence: Synthetic peptide
  Seed: VEALRSGM (TYRP1_HUMAN)
  misc_feature (2)..(2): Xaa can be Glu, or Asp
  misc_feature (8)..(8): Xaa can be Val, Ile, Phe, Leu, Met, or Tyr
VXALRSGX

SEQ ID NO: 182489 - protein, 9 aa, Artificial Sequence
  Description of Artificial Sequence: Synthetic peptide
  Seed: VEALRSGMC (TYRP1_HUMAN)
  misc_feature (2)..(2): Xaa can be Glu, or Asp
  misc_feature (9)..(9): Xaa can be Leu, Met, Ala, Pro, Thr, Cys, Phe, Ser, Val, or Ile
VXALRSGMX

SEQ ID NO: 182490 - protein, 10 aa, Artificial Sequence
  Description of Artificial Sequence: Synthetic peptide
  Seed: VEALRSGMCC (TYRP1_HUMAN)
  misc_feature (2)..(2): Xaa can be , or Glu
  misc_feature (10)..(10): Xaa can be Phe, Ala, Pro, Cys, Met, Ile, Leu, Thr, or Val
VXALRSGMCX

SEQ ID NO: 182491 - protein, 11 aa, Artificial Sequence
  Description of Artificial Sequence: Synthetic peptide
  Seed: VEALRSGMCCP (TYRP1_HUMAN)
  misc_feature (2)..(2): Xaa can be , or Glu
  misc_feature (11)..(11): Xaa can be Cys, Phe, Pro, Val, Thr, Ile, Met, Ala, or Leu
VXALRSGMCCX

SEQ ID NO: 182492 - protein, 9 aa, Artificial Sequence
  Description of Artificial Sequence: Synthetic peptide
  Seed: VEGYSDPTG (TYRP1_HUMAN)
  misc_feature (2)..(2): Xaa can be Glu, or Asp
  misc_feature (9)..(9): Xaa can be Ala, Val, Gly, Pro, Leu, Met, Cys, Ser, Ile, Thr, or Phe
VXGYSDPTX

SEQ ID NO: 182493 - protein, 10 aa, Artificial Sequence
  Description of Artificial Sequence: Synthetic peptide
  Seed: VEGYSDPTGK (TYRP1_HUMAN)
  misc_feature (2)..(2): Xaa can be Ala, Ser, Thr, Val, Met, Gln, Leu, Asn, Ile, Gly, Glu, Asp, Phe, Pro, or Tyr
  misc_feature (10)..(10): Xaa can be Lys, Arg, Tyr, Phe, or Met
VXGYSDPTGX

SEQ ID NO: 182494 - protein, 11 aa, Artificial Sequence
  Description of Artificial Sequence: Synthetic peptide
  Seed: VEGYSDPTGKY (TYRP1_HUMAN)
  misc_feature (2)..(2): Xaa can be Glu, Gln, Ala, Val, Ile, Leu, Met, Gly, Asp, Ser, or Thr
  misc_feature (11)..(11): Xaa can be Tyr, Phe, Trp, or Leu
VXGYSDPTGKX

SEQ ID NO: 182495 - protein, 9 aa, Artificial Sequence
  Description of Artificial Sequence: Synthetic peptide
  Seed: VFDEWLRRY (TYRP1_HUMAN)
  misc_feature (2)..(2): Xaa can be Ala, Ile, Thr, Val, Ser, Tyr, Phe, Gly, Trp, Met, Gln, Leu, Arg, Asn, Cys, Asp, Glu, Pro, Lys, or His
  misc_feature (9)..(9): Xaa can be Leu, Ile, Met, Tyr, Phe, Val, Trp, Lys, Arg, Cys, Ala, His, Thr, Gln, Ser, or Pro
VXDEWLRRX

SEQ ID NO: 182496 - protein, 9 aa, Artificial Sequence
  Description of Artificial Sequence: Synthetic peptide
  Seed: VGALLLVAL (TYRP1_HUMAN)
  misc_feature (2)..(2): Xaa can be Ala, Gln, Arg, Gly, Ser, Met, Leu, Thr, Ile, Val, Asn, Glu, Phe, Cys, Asp, His, Pro, Tyr, Lys, or Trp
  misc_feature (9)..(9): Xaa can be Leu, Val, Met, Ile, Tyr, Phe, His, Ala, Lys, Cys, Trp, Arg, or Thr
VXALLLVAX

SEQ ID NO: 182497 - protein, 9 aa, Artificial Sequence
  Description of Artificial Sequence: Synthetic peptide
  Seed: VGLFDTPPF (TYRP1_HUMAN)
  misc_feature (2)..(2): Xaa can be Pro, Gln, Met, Ala, Ser, Thr, Lys, Val, Leu, Arg, Ile, His, Glu, Asn, Gly, Phe, Tyr, Cys, Trp, or Asp
  misc_feature (9)..(9): Xaa can be Phe, Tyr, Met, Leu, Trp, Ile, His, Val, Ala, Thr, Gln, Gly, Ser, or Cys
VXLFDTPPX

SEQ ID NO: 182498 - protein, 10 aa, Artificial Sequence
  Description of Artificial Sequence: Synthetic peptide
  Seed: VGLFDTPPFY (TYRP1_HUMAN)
  misc_feature (2)..(2): Xaa can be Gln, Met, Lys, Arg, His, Val, Glu, Leu, Phe, Ile, Pro, Asp, Tyr, Trp, Ser, Thr, Asn, Gly, Cys, or Ala
  misc_feature (10)..(10): Xaa can be Phe, Tyr, Arg, Lys, Met, Leu, Val, Asp, Ser, His, Cys, Gln, Ile, Thr, Asn, Gly, Glu, Pro, Ala, or Trp
VXLFDTPPFX

SEQ ID NO: 182499 - protein, 9 aa, Artificial Sequence
  Description of Artificial Sequence: Synthetic peptide
  Seed: VGQESFGEV (TYRP1_HUMAN)
  misc_feature (2)..(2): Xaa can be Ala, Phe, Ser, Ile, Thr, Leu, Val, Asn, Gln, Met, Gly, Tyr, Cys, Trp, Glu, Pro, Asp, or Hi s
  misc_feature (9)..(9): Xaa can be Lys, Leu, Val, Met, Phe, Arg, Ile, Tyr, Trp, Cys, or Ala
VXQESFGEX

SEQ ID NO: 182500 - protein, 11 aa, Artificial Sequence
  Description of Artificial Sequence: Synthetic peptide
  Seed: VGQESFGEVDF (TYRP1_HUMAN)
  misc_feature (2)..(2): Xaa can be Thr, Cys, Ser, Val, Ala, Gly, Ile, Phe, Trp, Pro, Leu, Gln, Met, or Asn
  misc_feature (11)..(11): Xaa can be Trp, Phe, Leu, or Tyr
VXQESFGEVDX

SEQ ID NO: 182501 - protein, 8 aa, Artificial Sequence
  Description of Artificial Sequence: Synthetic peptide
  Seed: VLIVRRNL (TYRP1_HUMAN)
  misc_feature (2)..(2): Xaa can be Pro, Met, Leu, Ile, Ala, Val, Gly, Gln, or Ser
  misc_feature (8)..(8): Xaa can be Leu, Met, Ile, Val, or Phe
VXIVRRNX

SEQ ID NO: 182502 - protein, 9 aa, Artificial Sequence
  Description of Artificial Sequence: Synthetic peptide
  Seed: VLIVRRNLL (TYRP1_HUMAN)
  misc_feature (2)..(2): Xaa can be Arg, Tyr, Pro, Ala, Gln, Thr, Ser, Leu, Met, Phe, Asn, Gly, Val, Trp, Ile, Glu, Asp, Cys, His, or Lys
  misc_feature (9)..(9): Xaa can be Leu, Met, Phe, Tyr, Val, Ile, Trp, Ala, His, Lys, Arg, or Cys
VXIVRRNLX

SEQ ID NO: 182503 - protein, 9 aa, Artificial Sequence
  Description of Artificial Sequence: Synthetic peptide
  Seed: VLLHTFTDA (TYRP1_HUMAN)
  misc_feature (2)..(2): Xaa can be Leu, Met, Gln, Ile, Val, Thr, Ala, or Ser
  misc_feature (9)..(9): Xaa can be Val, Leu, Ile, Ala, Met, or Thr
VXLHTFTDX

SEQ ID NO: 182504 - protein, 10 aa, Artificial Sequence
  Description of Artificial Sequence: Synthetic peptide
  Seed: VLLHTFTDAV (TYRP1_HUMAN)
  misc_feature (2)..(2): Xaa can be Pro, Thr, Tyr, Ser, Val, Arg, Asn, Lys, Cys, Gly, Met, Ile, Phe, His, Glu, Asp, Trp, Ala, Leu, or Gln
  misc_feature (10)..(10): Xaa can be Val, Met, Ala, Leu, or Ile
VXLHTFTDAX

SEQ ID NO: 182505 - protein, 11 aa, Artificial Sequence
  Description of Artificial Sequence: Synthetic peptide
  Seed: VLLHTFTDAVF (TYRP1_HUMAN)
  misc_feature (2)..(2): Xaa can be Gln, Lys, Met, Leu, Arg, Thr, Val, Ala, Tyr, Ile, Ser, Glu, His, Gly, Trp, Asn, or Phe
  misc_feature (11)..(11): Xaa can be Tyr, Phe, Met, or Leu
VXLHTFTDAVX

SEQ ID NO: 182506 - protein, 8 aa, Artificial Sequence
  Description of Artificial Sequence: Synthetic peptide
  Seed: VPEIIAIA (TYRP1_HUMAN)
  misc_feature (2)..(2): Xaa can be , or Pro
  misc_feature (8)..(8): Xaa can be Val, Ala, or Leu
VXEIIAIX

SEQ ID NO: 182507 - protein, 9 aa, Artificial Sequence
  Description of Artificial Sequence: Synthetic peptide
  Seed: VPEIIAIAV (TYRP1_HUMAN)
  misc_feature (2)..(2): Xaa can be Pro, Ala, Ser, Gly, Val, Thr, Gln, Phe, or Glu
  misc_feature (9)..(9): Xaa can be Trp, Tyr, Phe, Val, Leu, Ile, Ala, Met, Pro, Cys, Gly, Ser, His, or Thr
VXEIIAIAX

SEQ ID NO: 182508 - protein, 10 aa, Artificial Sequence
  Description of Artificial Sequence: Synthetic peptide
  Seed: VPEIIAIAVV (TYRP1_HUMAN)
  misc_feature (2)..(2): Xaa can be Pro, Lys, Gly, Trp, Val, Cys, Met, Phe, Ile, Leu, Tyr, Asp, Thr, Ser, Arg, Gln, Glu, Asn, Ala, or His
  misc_feature (10)..(10): Xaa can be Phe, Ile, Val, Leu, Met, or Ala
VXEIIAIAVX

SEQ ID NO: 182509 - protein, 8 aa, Artificial Sequence
  Description of Artificial Sequence: Synthetic peptide
  Seed: VPFWPPVT (TYRP1_HUMAN)
  misc_feature (2)..(2): Xaa can be Pro, Ala, Ser, or Gly
  misc_feature (8)..(8): Xaa can be Ile, Val, Met, Leu, Ala, Gly, Gln, Ser, Lys, Phe, Cys, Tyr, Arg, Pro, or Thr
VXFWPPVX

SEQ ID NO: 182510 - protein, 9 aa, Artificial Sequence
  Description of Artificial Sequence: Synthetic peptide
  Seed: VPFWPPVTN (TYRP1_HUMAN)
  misc_feature (2)..(2): Xaa can be Pro, Ala, Val, Ile, Ser, Gly, Thr, Leu, Met, Gln, Cys, Asp, Phe, Tyr, Glu, or Asn
  misc_feature (9)..(9): Xaa can be Tyr, Phe, Ala, Leu, Met, Cys, Ile, Val, Thr, Ser, His, Pro, Trp, Arg, Gly, Glu, Asp, Asn, Lys, or Gln
VXFWPPVTX

SEQ ID NO: 182511 - protein, 10 aa, Artificial Sequence
  Description of Artificial Sequence: Synthetic peptide
  Seed: VPFWPPVTNT (TYRP1_HUMAN)
  misc_feature (2)..(2): Xaa can be , or Pro
  misc_feature (10)..(10): Xaa can be Phe, Pro, Thr, Ser, Leu, Ile, Gln, Ala, Val, Lys, Tyr, Glu, Met, Trp, Gly, Arg, or Cys
VXFWPPVTNX

SEQ ID NO: 182512 - protein, 10 aa, Artificial Sequence
  Description of Artificial Sequence: Synthetic peptide
  Seed: VQRLPEPQDV (TYRP1_HUMAN)
  misc_feature (2)..(2): Xaa can be , or Gln
  misc_feature (10)..(10): Xaa can be , or Val
VXRLPEPQDX

SEQ ID NO: 182513 - protein, 9 aa, Artificial Sequence
  Description of Artificial Sequence: Synthetic peptide
  Seed: VRALDMAKR (TYRP1_HUMAN)
  misc_feature (2)..(2): Xaa can be , or Arg
  misc_feature (9)..(9): Xaa can be Ile, Met, Phe, Leu, Lys, His, Tyr, Val, Arg, or Trp
VXALDMAKX

SEQ ID NO: 182514 - protein, 8 aa, Artificial Sequence
  Description of Artificial Sequence: Synthetic peptide
  Seed: VRRNLLDL (TYRP1_HUMAN)
  misc_feature (2)..(2): Xaa can be , or Arg
  misc_feature (8)..(8): Xaa can be , or Leu
VXRNLLDX

SEQ ID NO: 182515 - protein, 10 aa, Artificial Sequence
  Description of Artificial Sequence: Synthetic peptide
  Seed: VRRNLLDLSK (TYRP1_HUMAN)
  misc_feature (2)..(2): Xaa can be Arg, Trp, Met, Phe, Lys, Gly, Tyr, Thr, Ile, Asn, Cys, Gln, Val, Ser, Glu, Asp, Pro, His, Ala, or Leu
  misc_feature (10)..(10): Xaa can be Arg, Met, Phe, Lys, Leu, Tyr, Ile, His, Trp, or Val
VXRNLLDLSX

SEQ ID NO: 182516 - protein, 9 aa, Artificial Sequence
  Description of Artificial Sequence: Synthetic peptide
  Seed: VRSLHNLAH (TYRP1_HUMAN)
  misc_feature (2)..(2): Xaa can be Arg, Tyr, Phe, His, Gln, Ala, Gly, Trp, Leu, Met, Ser, Ile, Thr, Asn, Val, Lys, Cys, Pro, or Glu
  misc_feature (9)..(9): Xaa can be Phe, Met, Leu, Tyr, Ile, Val, Trp, Cys, Lys, Arg, Ala, or His
VXSLHNLAX

SEQ ID NO: 182517 - protein, 10 aa, Artificial Sequence
  Description of Artificial Sequence: Synthetic peptide
  Seed: VRSLHNLAHL (TYRP1_HUMAN)
  misc_feature (2)..(2): Xaa can be , or Arg
  misc_feature (10)..(10): Xaa can be Phe, Leu, Trp, Tyr, Val, Ile, Met, Arg, or Lys
VXSLHNLAHX

SEQ ID NO: 182518 - protein, 11 aa, Artificial Sequence
  Description of Artificial Sequence: Synthetic peptide
  Seed: VRSLHNLAHLF (TYRP1_HUMAN)
  misc_feature (2)..(2): Xaa can be Arg, Ser, Thr, Met, Lys, Gln, Ala, His, Cys, Ile, Gly, Trp, Phe, Leu, Tyr, Val, or Asn
  misc_feature (11)..(11): Xaa can be Trp, Tyr, Phe, Met, Leu, Val, Ile, Arg, or Lys
VXSLHNLAHLX

SEQ ID NO: 182519 - protein, 8 aa, Artificial Sequence
  Description of Artificial Sequence: Synthetic peptide
  Seed: VSGPGTDR (TYRP1_HUMAN)
  misc_feature (2)..(2): Xaa can be Ala, Thr, Ser, Ile, Val, Met, Gln, Phe, Gly, Leu, Asn, Tyr, Cys, Asp, Glu, or Pro
  misc_feature (8)..(8): Xaa can be Tyr, Leu, Lys, Phe, Arg, Met, His, Ile, Val, Trp, or Ala
VXGPGTDX

SEQ ID NO: 182520 - protein, 9 aa, Artificial Sequence
  Description of Artificial Sequence: Synthetic peptide
  Seed: VTAPDNLGY (TYRP1_HUMAN)
  misc_feature (2)..(2): Xaa can be Pro, Ala, Ser, Thr, Leu, Met, Ile, Gly, Val, Gln, Asn, Glu, Cys, Tyr, Phe, His, Arg, Trp, Asp, or Lys
  misc_feature (9)..(9): Xaa can be Trp, Phe, Tyr, Lys, Arg, Met, Leu, Ile, Val, His, Cys, or Ala
VXAPDNLGX

SEQ ID NO: 182521 - protein, 11 aa, Artificial Sequence
  Description of Artificial Sequence: Synthetic peptide
  Seed: VTAPDNLGYTY (TYRP1_HUMAN)
  misc_feature (2)..(2): Xaa can be Thr, Ala, Ser, Pro, Val, Ile, Gly, Leu, Gln, Cys, Met, Asn, Phe, Glu, Arg, Asp, Tyr, Trp, Lys, or His
  misc_feature (11)..(11): Xaa can be Phe, Trp, Tyr, Lys, Arg, Met, Leu, Ile, His, Val, Cys, Ala, Thr, Gln, or Gly
VXAPDNLGYTX

SEQ ID NO: 182522 - protein, 9 aa, Artificial Sequence
  Description of Artificial Sequence: Synthetic peptide
  Seed: VVCDSLEDY (TYRP1_HUMAN)
  misc_feature (2)..(2): Xaa can be Thr, Ala, Val, Ser, Gln, Ile, Leu, Pro, Gly, Met, Phe, Tyr, Asn, Glu, Asp, Trp, His, Arg, Lys, or Cys
  misc_feature (9)..(9): Xaa can be Tyr, Phe, Lys, Met, Arg, Leu, His, Trp, Ile, or Val
VXCDSLEDX

SEQ ID NO: 182523 - protein, 9 aa, Artificial Sequence
  Description of Artificial Sequence: Synthetic peptide
  Seed: VVGALLLVA (TYRP1_HUMAN)
  misc_feature (2)..(2): Xaa can be Met, Leu, Ile, Val, Gln, Thr, Ser, or Ala
  misc_feature (9)..(9): Xaa can be Ile, Leu, Val, Ala, Met, or Thr
VXGALLLVX

SEQ ID NO: 182524 - protein, 10 aa, Artificial Sequence
  Description of Artificial Sequence: Synthetic peptide
  Seed: VVGALLLVAL (TYRP1_HUMAN)
  misc_feature (2)..(2): Xaa can be Leu, Met, Val, Ile, Thr, Gln, Ser, or Ala
  misc_feature (10)..(10): Xaa can be Val, Leu, Ile, Ala, or Met
VXGALLLVAX

SEQ ID NO: 182525 - protein, 9 aa, Artificial Sequence
  Description of Artificial Sequence: Synthetic peptide
  Seed: VWPLRFFNR (TYRP1_HUMAN)
  misc_feature (2)..(2): Xaa can be Met, Ser, Ile, Phe, Thr, Val, Leu, Ala, Gln, Gly, Trp, Tyr, Cys, Glu, Pro, His, Asn, or As p
  misc_feature (9)..(9): Xaa can be Arg, Lys, or His
VXPLRFFNX

SEQ ID NO: 182526 - protein, 9 aa, Artificial Sequence
  Description of Artificial Sequence: Synthetic peptide
  Seed: VWTHYYSVK (TYRP1_HUMAN)
  misc_feature (2)..(2): Xaa can be Ala, Thr, Tyr, Trp, Val, Gln, Leu, Ile, Ser, Phe, Met, Gly, or Asn
  misc_feature (9)..(9): Xaa can be Arg, or Lys
VXTHYYSVX

SEQ ID NO: 182527 - protein, 10 aa, Artificial Sequence
  Description of Artificial Sequence: Synthetic peptide
  Seed: VWTHYYSVKK (TYRP1_HUMAN)
  misc_feature (2)..(2): Xaa can be Asp, Cys, Ala, Pro, Leu, Tyr, Met, His, Asn, Ile, Phe, Val, Glu, Gln, Lys, Gly, Arg, Thr, Trp, or Ser
  misc_feature (10)..(10): Xaa can be Lys, or Arg
VXTHYYSVKX

SEQ ID NO: 182528 - protein, 9 aa, Artificial Sequence
  Description of Artificial Sequence: Synthetic peptide
  Seed: WHRYHLLRL (TYRP1_HUMAN)
  misc_feature (2)..(2): Xaa can be Gln, His, Met, Arg, Tyr, Phe, Lys, Trp, Glu, Ala, Thr, Ile, Val, Ser, Leu, Asn, Gly, or Pr o
  misc_feature (9)..(9): Xaa can be Tyr, Phe, Met, Leu, Ile, Val, His, Trp, or Ala
WXRYHLLRX

SEQ ID NO: 182529 - protein, 11 aa, Artificial Sequence
  Description of Artificial Sequence: Synthetic peptide
  Seed: WHRYHLLRLEK (TYRP1_HUMAN)
  misc_feature (2)..(2): Xaa can be Arg, Met, Lys, His, Trp, Tyr, Gly, Ser, Ala, or Phe
  misc_feature (11)..(11): Xaa can be Leu, Lys, Phe, Met, Arg, Trp, Val, Ala, Ile, or Tyr
WXRYHLLRLEX

SEQ ID NO: 182530 - protein, 9 aa, Artificial Sequence
  Description of Artificial Sequence: Synthetic peptide
  Seed: WLRRYNADI (TYRP1_HUMAN)
  misc_feature (2)..(2): Xaa can be Met, Leu, Pro, Ala, Ile, Phe, Val, Gln, or Trp
  misc_feature (9)..(9): Xaa can be Leu, Met, Val, Ile, Phe, or Ala
WXRRYNADX

SEQ ID NO: 182531 - protein, 9 aa, Artificial Sequence
  Description of Artificial Sequence: Synthetic peptide
  Seed: WPLRFFNRT (TYRP1_HUMAN)
  misc_feature (2)..(2): Xaa can be Pro, or Ala
  misc_feature (9)..(9): Xaa can be Ala, Val, Ile, Thr, Pro, Cys, Met, Ser, or Leu
WXLRFFNRX

SEQ ID NO: 182532 - protein, 10 aa, Artificial Sequence
  Description of Artificial Sequence: Synthetic peptide
  Seed: WPLRFFNRTC (TYRP1_HUMAN)
  misc_feature (2)..(2): Xaa can be Pro, or Ala
  misc_feature (10)..(10): Xaa can be Leu, Ser, Thr, Pro, Met, Ile, Phe, Cys, Val, or Ala
WXLRFFNRTX

SEQ ID NO: 182533 - protein, 9 aa, Artificial Sequence
  Description of Artificial Sequence: Synthetic peptide
  Seed: WPPVTNTEM (TYRP1_HUMAN)
  misc_feature (2)..(2): Xaa can be Pro, Ala, Gly, Ser, Val, Gln, Thr, Met, Cys, Tyr, Arg, Phe, Leu, Ile, Asn, His, Trp, Glu, Asp, or Lys
  misc_feature (9)..(9): Xaa can be Leu, Tyr, Met, Phe, Ile, Val, Trp, Ala, Cys, Ser, Gly, Thr, His, or Pro
WXPVTNTEX

SEQ ID NO: 182534 - protein, 10 aa, Artificial Sequence
  Description of Artificial Sequence: Synthetic peptide
  Seed: WPPVTNTEMF (TYRP1_HUMAN)
  misc_feature (2)..(2): Xaa can be Pro, Leu, Met, Ala, Trp, Val, Glu, Gln, His, Gly, Cys, Asn, Arg, Thr, Tyr, Ser, Ile, Asp, Phe, or Lys
  misc_feature (10)..(10): Xaa can be Tyr, Met, Phe, Trp, or Leu
WXPVTNTEMX

SEQ ID NO: 182535 - protein, 8 aa, Artificial Sequence
  Description of Artificial Sequence: Synthetic peptide
  Seed: WPSREFSV (TYRP1_HUMAN)
  misc_feature (2)..(2): Xaa can be , or Pro
  misc_feature (8)..(8): Xaa can be Leu, Val, Met, Ile, or Phe
WXSREFSX

SEQ ID NO: 182536 - protein, 9 aa, Artificial Sequence
  Description of Artificial Sequence: Synthetic peptide
  Seed: WPSREFSVP (TYRP1_HUMAN)
  misc_feature (2)..(2): Xaa can be Pro, or Ala
  misc_feature (9)..(9): Xaa can be Ala, Pro, Leu, Cys, Tyr, Thr, Val, Ser, Met, Ile, or Phe
WXSREFSVX

SEQ ID NO: 182537 - protein, 11 aa, Artificial Sequence
  Description of Artificial Sequence: Synthetic peptide
  Seed: WPSREFSVPEI (TYRP1_HUMAN)
  misc_feature (2)..(2): Xaa can be , or Pro
  misc_feature (11)..(11): Xaa can be Leu, Cys, Ile, Val, Ala, Phe, or Met
WXSREFSVPEX

SEQ ID NO: 182538 - protein, 11 aa, Artificial Sequence
  Description of Artificial Sequence: Synthetic peptide
  Seed: WRGAACDQRVL (TYRP1_HUMAN)
  misc_feature (2)..(2): Xaa can be , or Arg
  misc_feature (11)..(11): Xaa can be Phe, Leu, or Met
WXGAACDQRVX

SEQ ID NO: 182539 - protein, 8 aa, Artificial Sequence
  Description of Artificial Sequence: Synthetic peptide
  Seed: WRVVCDSL (TYRP1_HUMAN)
  misc_feature (2)..(2): Xaa can be Arg, or His
  misc_feature (8)..(8): Xaa can be , or Leu
WXVVCDSX

SEQ ID NO: 182540 - protein, 9 aa, Artificial Sequence
  Description of Artificial Sequence: Synthetic peptide
  Seed: WTHYYSVKK (TYRP1_HUMAN)
  misc_feature (2)..(2): Xaa can be Val, Thr, Met, Leu, Ala, Ser, Ile, Pro, Asn, Gln, Asp, Phe, Gly, Trp, or Tyr
  misc_feature (9)..(9): Xaa can be Arg, Lys, Tyr, His, or Met
WXHYYSVKX

SEQ ID NO: 182541 - protein, 11 aa, Artificial Sequence
  Description of Artificial Sequence: Synthetic peptide
  Seed: WTHYYSVKKTF (TYRP1_HUMAN)
  misc_feature (2)..(2): Xaa can be Tyr, Ser, Thr, Leu, Trp, Ala, Lys, Cys, Phe, Gly, Asn, Asp, Arg, Pro, Val, His, Ile, Gln, Glu, or Met
  misc_feature (11)..(11): Xaa can be Trp, Phe, Tyr, Ile, or Leu
WXHYYSVKKTX

SEQ ID NO: 182542 - protein, 8 aa, Artificial Sequence
  Description of Artificial Sequence: Synthetic peptide
  Seed: YAEEYEKL (TYRP1_HUMAN)
  misc_feature (2)..(2): Xaa can be Ala, Ser, Tyr, Gly, Val, Thr, Ile, Leu, Arg, Gln, Asn, Trp, His, Phe, Cys, Met, Lys, Glu, Asp, or Pro
  misc_feature (8)..(8): Xaa can be Met, Leu, Phe, Tyr, Ile, Val, Lys, Trp, Arg, or His
YXEEYEKX

SEQ ID NO: 182543 - protein, 8 aa, Artificial Sequence
  Description of Artificial Sequence: Synthetic peptide
  Seed: YDPAVRSL (TYRP1_HUMAN)
  misc_feature (2)..(2): Xaa can be Ala, Glu, Arg, Gln, Thr, Tyr, Asp, Ser, Val, Asn, Gly, Leu, His, Ile, Pro, Lys, Cys, Met, Phe, or Trp
  misc_feature (8)..(8): Xaa can be Leu, Met, Tyr, Ile, Phe, Val, Trp, Ala, Cys, His, Thr, Pro, or Lys
YXPAVRSX

SEQ ID NO: 182544 - protein, 10 aa, Artificial Sequence
  Description of Artificial Sequence: Synthetic peptide
  Seed: YEIQWPSREF (TYRP1_HUMAN)
  misc_feature (2)..(2): Xaa can be Glu, Ala, Gln, Arg, Ser, Asp, Val, Met, Tyr, Ile, His, Leu, Thr, Gly, Lys, Phe, Trp, Pro, Asn, or Cys
  misc_feature (10)..(10): Xaa can be Phe, Tyr, Met, Leu, Trp, His, Ile, Val, Ala, Cys, Gly, Pro, Thr, or Ser
YXIQWPSREX

SEQ ID NO: 182545 - protein, 10 aa, Artificial Sequence
  Description of Artificial Sequence: Synthetic peptide
  Seed: YEKLQNPNQS (TYRP1_HUMAN)
  misc_feature (2)..(2): Xaa can be , or Glu
  misc_feature (10)..(10): Xaa can be Cys, Thr, Met, Ala, Ile, Leu, Val, Pro, or Ser
YXKLQNPNQX

SEQ ID NO: 182546 - protein, 11 aa, Artificial Sequence
  Description of Artificial Sequence: Synthetic peptide
  Seed: YEKLQNPNQSV (TYRP1_HUMAN)
  misc_feature (2)..(2): Xaa can be Glu, Asp, Asn, Arg, Ile, Met, Gln, Lys, Pro, His, Ser, Val, Ala, Phe, Gly, Cys, Thr, Trp, Tyr, or Leu
  misc_feature (11)..(11): Xaa can be Leu, Ile, Val, Phe, Met, Pro, Cys, Gly, Ala, Ser, Trp, or Thr
YXKLQNPNQSX

SEQ ID NO: 182547 - protein, 8 aa, Artificial Sequence
  Description of Artificial Sequence: Synthetic peptide
  Seed: YFVWTHYY (TYRP1_HUMAN)
  misc_feature (2)..(2): Xaa can be Tyr, Phe, Met, His, Ala, Trp, Gln, Ser, Thr, Asp, Leu, Gly, Arg, Val, Asn, Ile, Pro, Glu, or Cys
  misc_feature (8)..(8): Xaa can be Tyr, Met, Phe, Leu, Ile, Val, Ala, or His
YXVWTHYX

SEQ ID NO: 182548 - protein, 10 aa, Artificial Sequence
  Description of Artificial Sequence: Synthetic peptide
  Seed: YFVWTHYYSV (TYRP1_HUMAN)
  misc_feature (2)..(2): Xaa can be Met, Leu, Gln, Tyr, Ser, Thr, Phe, Ala, Arg, His, Trp, Val, Gly, Ile, Pro, Asn, Asp, Cys, Glu, or Lys
  misc_feature (10)..(10): Xaa can be Met, Ile, Phe, Ala, Leu, Val, Trp, Tyr, Thr, Ser, Cys, Gly, Pro, or His
YXVWTHYYSX

SEQ ID NO: 182549 - protein, 11 aa, Artificial Sequence
  Description of Artificial Sequence: Synthetic peptide
  Seed: YFVWTHYYSVK (TYRP1_HUMAN)
  misc_feature (2)..(2): Xaa can be Thr, Phe, Trp, Leu, Met, His, Ala, Arg, Ile, Lys, Gln, Tyr, Ser, Gly, Asn, Val, Pro, Glu, Cys, or Asp
  misc_feature (11)..(11): Xaa can be Arg, Lys, or Tyr
YXVWTHYYSVX

SEQ ID NO: 182550 - protein, 9 aa, Artificial Sequence
  Description of Artificial Sequence: Synthetic peptide
  Seed: YLIRARRSM (TYRP1_HUMAN)
  misc_feature (2)..(2): Xaa can be Pro, Tyr, Gln, Phe, Ala, Ser, Met, Val, Thr, Leu, Lys, Trp, Ile, His, Gly, Glu, Arg, Asn, Cys, or Asp
  misc_feature (9)..(9): Xaa can be Tyr, Phe, Met, Leu, Ile, Trp, His, Val, Ala, Cys, Thr, Gln, Ser, Gly, Lys, Glu, Arg, or Pr o
YXIRARRSX

SEQ ID NO: 182551 - protein, 8 aa, Artificial Sequence
  Description of Artificial Sequence: Synthetic peptide
  Seed: YNADISTF (TYRP1_HUMAN)
  misc_feature (2)..(2): Xaa can be Ala, Thr, Ser, Val, Gly, Arg, Ile, Tyr, Met, Gln, Phe, Trp, Cys, His, Leu, Asn, Lys, Pro, Glu, or Asp
  misc_feature (8)..(8): Xaa can be Tyr, Phe, Leu, Met, Ile, His, Lys, Trp, Val, Arg, Ala, or Gln
YXADISTX

SEQ ID NO: 182552 - protein, 10 aa, Artificial Sequence
  Description of Artificial Sequence: Synthetic peptide
  Seed: YNADISTFPL (TYRP1_HUMAN)
  misc_feature (2)..(2): Xaa can be Met, Leu, Gln, Thr, Val, Ile, Pro, Ser, Ala, His, Phe, Tyr, Trp, Gly, Arg, Asn, Cys, Glu, Lys, or Asp
  misc_feature (10)..(10): Xaa can be Tyr, Ile, Phe, Val, Met, Leu, Ala, Thr, Trp, Cys, Ser, Gly, Pro, Glu, His, Asp, Arg, Asn, Gln, or Lys
YXADISTFPX

SEQ ID NO: 182553 - protein, 10 aa, Artificial Sequence
  Description of Artificial Sequence: Synthetic peptide
  Seed: YNMVPFWPPV (TYRP1_HUMAN)
  misc_feature (2)..(2): Xaa can be Met, Gln, Leu, Val, Ile, Thr, Ala, Ser, Lys, Pro, Asn, Gly, Cys, Arg, His, Phe, Tyr, Asp, Glu, or Trp
  misc_feature (10)..(10): Xaa can be Thr, Val, Cys, Ile, Phe, Ser, Leu, Ala, Met, Pro, Gly, Asp, Lys, Tyr, Trp, Arg, Asn, Glu, Gln, or His
YXMVPFWPPX

SEQ ID NO: 182554 - protein, 11 aa, Artificial Sequence
  Description of Artificial Sequence: Synthetic peptide
  Seed: YNMVPFWPPVT (TYRP1_HUMAN)
  misc_feature (2)..(2): Xaa can be Asn, Cys, Leu, Gln, Gly, Ala, Trp, Val, His, Arg, Tyr, Thr, Met, Pro, Asp, Lys, Ser, Ile, Phe, or Glu
  misc_feature (11)..(11): Xaa can be Leu, Glu, Cys, Val, Trp, Gln, Phe, Pro, Lys, Gly, Arg, Tyr, His, Ala, Ile, Met, Thr, Asn, Asp, or Ser
YXMVPFWPPVX

SEQ ID NO: 182555 - protein, 9 aa, Artificial Sequence
  Description of Artificial Sequence: Synthetic peptide
  Seed: YNYFVWTHY (TYRP1_HUMAN)
  misc_feature (2)..(2): Xaa can be Gln, Ala, Met, Arg, Leu, Ser, Thr, Tyr, Val, Lys, Phe, Gly, Ile, Glu, His, Trp, Pro, Asn, Cys, or Asp
  misc_feature (9)..(9): Xaa can be Tyr, Met, Phe, Leu, Arg, Lys, Ile, Val, His, Trp, Ala, Cys, Thr, Ser, Gly, Pro, Asn, or Gl n
YXYFVWTHX

SEQ ID NO: 182556 - protein, 10 aa, Artificial Sequence
  Description of Artificial Sequence: Synthetic peptide
  Seed: YNYFVWTHYY (TYRP1_HUMAN)
  misc_feature (2)..(2): Xaa can be Leu, Lys, Ile, Trp, Phe, Thr, Ser, Gln, Tyr, Val, Ala, Met, Asn, Pro, Gly, His, Cys, Arg, Glu, or Asp
  misc_feature (10)..(10): Xaa can be Leu, Arg, Gly, Trp, Lys, Val, His, Met, Phe, Ile, Tyr, Ala, Pro, Asn, Cys, Gln, Asp, Glu, Ser, or Thr
YXYFVWTHYX

SEQ ID NO: 182557 - protein, 11 aa, Artificial Sequence
  Description of Artificial Sequence: Synthetic peptide
  Seed: YNYFVWTHYYS (TYRP1_HUMAN)
  misc_feature (2)..(2): Xaa can be Met, Gln, Ser, Tyr, Gly, Pro, Glu, Lys, Asn, Thr, Ile, Asp, Phe, Cys, Leu, Val, Ala, Arg, His, or Trp
  misc_feature (11)..(11): Xaa can be Cys, His, Val, Arg, Thr, Phe, Trp, Met, Lys, Gly, Leu, Gln, Ser, Glu, Ile, Tyr, Ala, Asp, Asn, or Pro
YXYFVWTHYYX

SEQ ID NO: 182558 - protein, 11 aa, Artificial Sequence
  Description of Artificial Sequence: Synthetic peptide
  Seed: YPHDGRDDREV (TYRP1_HUMAN)
  misc_feature (2)..(2): Xaa can be Pro, Ala, or Val
  misc_feature (11)..(11): Xaa can be Tyr, Phe, Ala, Ile, Val, Met, Ser, Gly, His, Pro, Trp, Cys, Thr, or Leu
YXHDGRDDREX

SEQ ID NO: 182559 - protein, 8 aa, Artificial Sequence
  Description of Artificial Sequence: Synthetic peptide
  Seed: YQCYAEEY (TYRP1_HUMAN)
  misc_feature (2)..(2): Xaa can be Ala, Thr, Ser, Gln, His, Pro, Glu, Val, Met, Leu, Gly, Asp, Trp, Ile, Phe, Tyr, Lys, Arg, or Asn
  misc_feature (8)..(8): Xaa can be Tyr, Phe, Leu, Met, Val, His, or Ile
YXCYAEEX

SEQ ID NO: 182560 - protein, 11 aa, Artificial Sequence
  Description of Artificial Sequence: Synthetic peptide
  Seed: YQCYAEEYEKL (TYRP1_HUMAN)
  misc_feature (2)..(2): Xaa can be Gln, Ile, Leu, Met, Val, Pro, Glu, Ala, Thr, Gly, Lys, Ser, His, Arg, Asp, Tyr, Cys, Asn, Trp, or Phe
  misc_feature (11)..(11): Xaa can be Ile, Phe, Trp, Leu, Met, or Val
YXCYAEEYEKX

SEQ ID NO: 182561 - protein, 8 aa, Artificial Sequence
  Description of Artificial Sequence: Synthetic peptide
  Seed: YSDPTGKY (TYRP1_HUMAN)
  misc_feature (2)..(2): Xaa can be Ala, Thr, Ser, Val, Ile, Gly, Leu, Met, Tyr, Phe, Asn, Asp, Gln, Pro, Trp, His, Cys, Glu, Arg, or Lys
  misc_feature (8)..(8): Xaa can be Ile, Phe, Tyr, Leu, Met, Trp, Val, Lys, Arg, Cys, Ala, Thr, His, Ser, Gln, or Pro
YXDPTGKX

SEQ ID NO: 182562 - protein, 11 aa, Artificial Sequence
  Description of Artificial Sequence: Synthetic peptide
  Seed: YSDPTGKYDPA (TYRP1_HUMAN)
  misc_feature (2)..(2): Xaa can be Ala, Ser, Thr, Val, Ile, Gly, Leu, Met, Cys, Phe, Gln, Pro, Asn, Trp, Tyr, Asp, or Glu
  misc_feature (11)..(11): Xaa can be Leu, Met, Phe, Ile, Val, Trp, Tyr, Cys, Ala, Thr, or Lys
YXDPTGKYDPX

SEQ ID NO: 182563 - protein, 8 aa, Artificial Sequence
  Description of Artificial Sequence: Synthetic peptide
  Seed: YSNSTNSF (TYRP1_HUMAN)
  misc_feature (2)..(2): Xaa can be Tyr, Thr, Ser, Ala, Val, Gln, Ile, Phe, Trp, Met, Gly, Leu, Arg, Lys, Pro, His, Asn, Glu, Cys, or Asp
  misc_feature (8)..(8): Xaa can be Tyr, Phe, Leu, Met, Trp, Ile, Val, His, Lys, or Ala
YXNSTNSX

SEQ ID NO: 182564 - protein, 9 aa, Artificial Sequence
  Description of Artificial Sequence: Synthetic peptide
  Seed: YSNSTNSFR (TYRP1_HUMAN)
  misc_feature (2)..(2): Xaa can be Ala, Thr, Met, Val, Ile, Leu, Ser, Phe, Gly, Asn, Cys, Gln, Trp, Tyr, Pro, Asp, Glu, Arg, His, or Lys
  misc_feature (9)..(9): Xaa can be Arg, Lys, Tyr, Leu, Met, Phe, Val, Trp, Ile, His, Ala, Cys, or Gln
YXNSTNSFX

SEQ ID NO: 182565 - protein, 10 aa, Artificial Sequence
  Description of Artificial Sequence: Synthetic peptide
  Seed: YSNSTNSFRN (TYRP1_HUMAN)
  misc_feature (2)..(2): Xaa can be Ile, Ser, Val, Thr, Phe, Leu, Ala, Met, Tyr, Gly, Gln, Pro, Asn, Trp, Glu, His, Cys, Lys, Arg, or Asp
  misc_feature (10)..(10): Xaa can be Arg, Lys, Trp, His, Leu, Tyr, Val, Ile, Phe, Met, Thr, Gln, Asn, Cys, Gly, Asp, Pro, Glu, Ala, or Ser
YXNSTNSFRX

SEQ ID NO: 182566 - protein, 8 aa, Artificial Sequence
  Description of Artificial Sequence: Synthetic peptide
  Seed: YSVKKTFL (TYRP1_HUMAN)
  misc_feature (2)..(2): Xaa can be Ala, Ser, Thr, Pro, Glu, Gly, Val, Phe, Gln, Leu, Ile, Met, Asp, Tyr, Asn, Arg, or His
  misc_feature (8)..(8): Xaa can be Leu, Met, Phe, Ile, Tyr, Val, or Trp
YXVKKTFX

SEQ ID NO: 182567 - protein, 10 aa, Artificial Sequence
  Description of Artificial Sequence: Synthetic peptide
  Seed: YSVKKTFLGV (TYRP1_HUMAN)
  misc_feature (2)..(2): Xaa can be Met, Leu, Gln, Ile, Val, Thr, Ser, Ala, Gly, Phe, Tyr, Trp, Cys, Lys, His, Asp, Asn, Glu, Arg, or Pro
  misc_feature (10)..(10): Xaa can be Ile, Val, Ala, Leu, Met, Thr, Ser, Cys, Pro, or Phe
YXVKKTFLGX

SEQ ID NO: 182568 - protein, 9 aa, Artificial Sequence
  Description of Artificial Sequence: Synthetic peptide
  Seed: YTYEIQWPS (TYRP1_HUMAN)
  misc_feature (2)..(2): Xaa can be Ile, Gln, Thr, Leu, Val, Met, Ser, Ala, Phe, Gly, Glu, Trp, Tyr, Cys, Pro, Asn, His, Lys, Asp, or Arg
  misc_feature (9)..(9): Xaa can be Met, Ile, Val, Leu, Ala, Arg, Lys, Thr, Ser, Cys, Phe, Tyr, Gly, Pro, Gln, Glu, His, Asp, Asn, or Trp
YXYEIQWPX

SEQ ID NO: 182569 - protein, 10 aa, Artificial Sequence
  Description of Artificial Sequence: Synthetic peptide
  Seed: YTYEIQWPSR (TYRP1_HUMAN)
  misc_feature (2)..(2): Xaa can be Thr, Leu, Val, Met, Ile, Ala, Ser, Trp, Phe, Tyr, Asn, Cys, Gln, Pro, Arg, Gly, His, Asp, Lys, or Glu
  misc_feature (10)..(10): Xaa can be Arg, Lys, His, Tyr, Met, Val, Ala, Phe, Leu, Ile, Gln, or Glu
YXYEIQWPSX

SEQ ID NO: 182570 - protein, 11 aa, Artificial Sequence
  Description of Artificial Sequence: Synthetic peptide
  Seed: YTYEIQWPSRE (TYRP1_HUMAN)
  misc_feature (2)..(2): Xaa can be Thr, Tyr, Ser, Met, Ala, Phe, Val, Leu, Gly, Gln, Ile, Trp, Asn, His, Lys, Arg, Cys, or Pr o
  misc_feature (11)..(11): Xaa can be Arg, Lys, Thr, Val, Asn, Glu, Gln, Tyr, Met, Ile, Pro, Ala, Asp, Gly, Leu, Trp, Ser, Cys, His, or Phe
YXYEIQWPSRX

SEQ ID NO: 182571 - protein, 8 aa, Artificial Sequence
  Description of Artificial Sequence: Synthetic peptide
  Seed: YYSVKKTF (TYRP1_HUMAN)
  misc_feature (2)..(2): Xaa can be Ser, Ala, Tyr, Thr, Val, Phe, Arg, Trp, Leu, Ile, Gln, His, Met, Gly, Asn, or Cys
  misc_feature (8)..(8): Xaa can be Phe, Leu, Tyr, Met, Ile, Val, or Trp
YXSVKKTX

SEQ ID NO: 182572 - protein, 9 aa, Artificial Sequence
  Description of Artificial Sequence: Synthetic peptide
  Seed: YYSVKKTFL (TYRP1_HUMAN)
  misc_feature (2)..(2): Xaa can be Ala, Arg, Tyr, Phe, Pro, Trp, Thr, Val, Ser, Ile, Gly, Asn, His, Met, Gln, Leu, Glu, Cys, Asp, or Lys
  misc_feature (9)..(9): Xaa can be Leu, Met, Phe, Ile, Val, Tyr, Trp, Cys, His, Ala, Lys, or Arg
YXSVKKTFX

SEQ ID NO: 182573 - protein, 11 aa, Artificial Sequence
  Description of Artificial Sequence: Synthetic peptide
  Seed: YYSVKKTFLGV (TYRP1_HUMAN)
  misc_feature (2)..(2): Xaa can be Tyr, Phe, or Trp
  misc_feature (11)..(11): Xaa can be Trp, Phe, Met, Ile, Leu, or Val
YXSVKKTFLGX

SEQ ID NO: 182574 - protein, 9 aa, Artificial Sequence
  Description of Artificial Sequence: Synthetic peptide
  Seed: ANDPIFVVL (TYRP2_HUMAN)
AADPIFVVL

SEQ ID NO: 182575 - protein, 9 aa, Artificial Sequence
  Description of Artificial Sequence: Synthetic peptide
  Seed: DTRPWSGPY (TYRP2_HUMAN)
DIRPWSGPY

SEQ ID NO: 182576 - protein, 9 aa, Artificial Sequence
  Description of Artificial Sequence: Synthetic peptide
  Seed: FFQNSTFSF (TYRP2_HUMAN)
FMQNSTFSF

SEQ ID NO: 182577 - protein, 9 aa, Artificial Sequence
  Description of Artificial Sequence: Synthetic peptide
  Seed: FQNSTFSFR (TYRP2_HUMAN)
FTNSTFSFR

SEQ ID NO: 182578 - protein, 9 aa, Artificial Sequence
  Description of Artificial Sequence: Synthetic peptide
  Seed: FFQNSTFSF (TYRP2_HUMAN)
FYQNSTFSF

SEQ ID NO: 182579 - protein, 9 aa, Artificial Sequence
  Description of Artificial Sequence: Synthetic peptide
  Seed: FFQNSTFSF (TYRP2_HUMAN)
FYQNSTFSL

SEQ ID NO: 182580 - protein, 10 aa, Artificial Sequence
  Description of Artificial Sequence: Synthetic peptide
  Seed: LTSDQLGYSY (TYRP2_HUMAN)
LMSDQLGYSY

SEQ ID NO: 182581 - protein, 10 aa, Artificial Sequence
  Description of Artificial Sequence: Synthetic peptide
  Seed: MSPLWWGFLL (TYRP2_HUMAN)
MSPLWWGFLF

SEQ ID NO: 182582 - protein, 9 aa, Artificial Sequence
  Description of Artificial Sequence: Synthetic peptide
  Seed: MTVDSLVNK (TYRP2_HUMAN)
MTVDSLVNR

SEQ ID NO: 182583 - protein, 10 aa, Artificial Sequence
  Description of Artificial Sequence: Synthetic peptide
  Seed: RNSMKLPTLK (TYRP2_HUMAN)
RMSMKLPTLK

SEQ ID NO: 182584 - protein, 9 aa, Artificial Sequence
  Description of Artificial Sequence: Synthetic peptide
  Seed: RMYNMVPFF (TYRP2_HUMAN)
RMYNMVPFR

SEQ ID NO: 182585 - protein, 9 aa, Artificial Sequence
  Description of Artificial Sequence: Synthetic peptide
  Seed: RPWSGPYIL (TYRP2_HUMAN)
RPWSGPYIM

SEQ ID NO: 182586 - protein, 9 aa, Artificial Sequence
  Description of Artificial Sequence: Synthetic peptide
  Seed: SLDDYNHLV (TYRP2_HUMAN)
SFDDYNHLM

SEQ ID NO: 182587 - protein, 9 aa, Artificial Sequence
  Description of Artificial Sequence: Synthetic peptide
  Seed: SLDDYNHLV (TYRP2_HUMAN)
SLDDYNHLL

SEQ ID NO: 182588 - protein, 9 aa, Artificial Sequence
  Description of Artificial Sequence: Synthetic peptide
  Seed: SLDDYNHLV (TYRP2_HUMAN)
SMDDYNHLL

SEQ ID NO: 182589 - protein, 9 aa, Artificial Sequence
  Description of Artificial Sequence: Synthetic peptide
  Seed: TLDSQVMSL (TYRP2_HUMAN)
TFDSQVMSL

SEQ ID NO: 182590 - protein, 9 aa, Artificial Sequence
  Description of Artificial Sequence: Synthetic peptide
  Seed: TSDQLGYSY (TYRP2_HUMAN)
TTDQLGYSY

SEQ ID NO: 182591 - protein, 9 aa, Artificial Sequence
  Description of Artificial Sequence: Synthetic peptide
  Seed: TLDSQVMSL (TYRP2_HUMAN)
TYDSQVMSL

SEQ ID NO: 182592 - protein, 9 aa, Artificial Sequence
  Description of Artificial Sequence: Synthetic peptide
  Seed: VLLAFLQYR (TYRP2_HUMAN)
VTLAFLQYK

SEQ ID NO: 182593 - protein, 9 aa, Artificial Sequence
  Description of Artificial Sequence: Synthetic peptide
  Seed: VLLAFLQYR (TYRP2_HUMAN)
VTLAFLQYR

SEQ ID NO: 182594 - protein, 9 aa, Artificial Sequence
  Description of Artificial Sequence: Synthetic peptide
  Seed: YAIDLPVSV (TYRP2_HUMAN)
YAIDLPVSF

SEQ ID NO: 182595 - protein, 9 aa, Artificial Sequence
  Description of Artificial Sequence: Synthetic peptide
  Seed: YAIDLPVSV (TYRP2_HUMAN)
YAIDLPVSL

SEQ ID NO: 182596 - protein, 9 aa, Artificial Sequence
  Description of Artificial Sequence: Synthetic peptide
  Seed: YSYAIDLPV (TYRP2_HUMAN)
YAYAIDLPL

SEQ ID NO: 182597 - protein, 9 aa, Artificial Sequence
  Description of Artificial Sequence: Synthetic peptide
  Seed: YSYAIDLPV (TYRP2_HUMAN)
YAYAIDLPV

SEQ ID NO: 182598 - protein, 9 aa, Artificial Sequence
  Description of Artificial Sequence: Synthetic peptide
  Seed: YAIDLPVSV (TYRP2_HUMAN)
YFIDLPVSL

SEQ ID NO: 182599 - protein, 9 aa, Artificial Sequence
  Description of Artificial Sequence: Synthetic peptide
  Seed: YTPLMETHL (TYRP2_HUMAN)
YMPLMETHL

SEQ ID NO: 182600 - protein, 9 aa, Artificial Sequence
  Description of Artificial Sequence: Synthetic peptide
  Seed: YAIDLPVSV (TYRP2_HUMAN)
YQIDLPVSL

SEQ ID NO: 182601 - protein, 9 aa, Artificial Sequence
  Description of Artificial Sequence: Synthetic peptide
  Seed: YAIDLPVSV (TYRP2_HUMAN)
YQIDLPVSM

SEQ ID NO: 182602 - protein, 9 aa, Artificial Sequence
  Description of Artificial Sequence: Synthetic peptide
  Seed: YAIDLPVSV (TYRP2_HUMAN)
YRIDLPVSF

SEQ ID NO: 182603 - protein, 9 aa, Artificial Sequence
  Description of Artificial Sequence: Synthetic peptide
  Seed: YAIDLPVSV (TYRP2_HUMAN)
YRIDLPVSL

SEQ ID NO: 182604 - protein, 9 aa, Artificial Sequence
  Description of Artificial Sequence: Synthetic peptide
  Seed: YAIDLPVSV (TYRP2_HUMAN)
YRIDLPVSM

SEQ ID NO: 182605 - protein, 9 aa, Artificial Sequence
  Description of Artificial Sequence: Synthetic peptide
  Seed: YAIDLPVSV (TYRP2_HUMAN)
YTIDLPVSV

SEQ ID NO: 182606 - protein, 9 aa, Artificial Sequence
  Description of Artificial Sequence: Synthetic peptide
  Seed: YAIDLPVSV (TYRP2_HUMAN)
YVIDLPVSL

SEQ ID NO: 182607 - protein, 10 aa, Homo sapiens
  Native (TYRP2_HUMAN)
AANDPIFVVL

SEQ ID NO: 182608 - protein, 9 aa, Homo sapiens
  Native (TYRP2_HUMAN)
AIFDEWMKR

SEQ ID NO: 182609 - protein, 9 aa, Homo sapiens
  Native (TYRP2_HUMAN)
CSVYDFFVW

SEQ ID NO: 182610 - protein, 9 aa, Homo sapiens
  Native (TYRP2_HUMAN)
DDYNHLVTL

SEQ ID NO: 182611 - protein, 9 aa, Homo sapiens
  Native (TYRP2_HUMAN)
DTRPWSGPY

SEQ ID NO: 182612 - protein, 10 aa, Homo sapiens
  Native (TYRP2_HUMAN)
ELWPRKFFHR

SEQ ID NO: 182613 - protein, 9 aa, Homo sapiens
  Native (TYRP2_HUMAN)
FANCSVYDF

SEQ ID NO: 182614 - protein, 10 aa, Homo sapiens
  Native (TYRP2_HUMAN)
FFPPVTNEEL

SEQ ID NO: 182615 - protein, 9 aa, Homo sapiens
  Native (TYRP2_HUMAN)
FFQNSTFSF

SEQ ID NO: 182616 - protein, 10 aa, Homo sapiens
  Native (TYRP2_HUMAN)
FPPVTNEELF

SEQ ID NO: 182617 - protein, 9 aa, Homo sapiens
  Native (TYRP2_HUMAN)
FSHQGPAFV

SEQ ID NO: 182618 - protein, 10 aa, Homo sapiens
  Native (TYRP2_HUMAN)
FVWLHYYSVR

SEQ ID NO: 182619 - protein, 9 aa, Homo sapiens
  Native (TYRP2_HUMAN)
GFDKADGTL

SEQ ID NO: 182620 - protein, 10 aa, Homo sapiens
  Native (TYRP2_HUMAN)
GQFPRVCMTV

SEQ ID NO: 182621 - protein, 9 aa, Homo sapiens
  Native (TYRP2_HUMAN)
GTYEGLLRR

SEQ ID NO: 182622 - protein, 11 aa, Homo sapiens
  Native (TYRP2_HUMAN)
HSFTDAIFDEW

SEQ ID NO: 182623 - protein, 9 aa, Homo sapiens
  Native (TYRP2_HUMAN)
HYYSVRDTL

SEQ ID NO: 182624 - protein, 9 aa, Homo sapiens
  Native (TYRP2_HUMAN)
ISRNSRFSS

SEQ ID NO: 182625 - protein, 9 aa, Homo sapiens
  Native (TYRP2_HUMAN)
LERDLQRLI

SEQ ID NO: 182626 - protein, 10 aa, Homo sapiens
  Native (TYRP2_HUMAN)
LFLTSDQLGY

SEQ ID NO: 182627 - protein, 10 aa, Homo sapiens
  Native (TYRP2_HUMAN)
LFVLLAFLQY

SEQ ID NO: 182628 - protein, 9 aa, Homo sapiens
  Native (TYRP2_HUMAN)
LLAFLQYRR

SEQ ID NO: 182629 - protein, 9 aa, Homo sapiens
  Native (TYRP2_HUMAN)
LRKGYTPLM

SEQ ID NO: 182630 - protein, 10 aa, Homo sapiens
  Native (TYRP2_HUMAN)
MSLHNLVHSF

SEQ ID NO: 182631 - protein, 9 aa, Homo sapiens
  Native (TYRP2_HUMAN)
MTVDSLVNK

SEQ ID NO: 182632 - protein, 9 aa, Homo sapiens
  Native (TYRP2_HUMAN)
NESFALPYW

SEQ ID NO: 182633 - protein, 9 aa, Homo sapiens
  Native (TYRP2_HUMAN)
QEREQFLGA

SEQ ID NO: 182634 - protein, 10 aa, Homo sapiens
  Native (TYRP2_HUMAN)
REQFLGALDL

SEQ ID NO: 182635 - protein, 9 aa, Homo sapiens
  Native (TYRP2_HUMAN)
RLRKGYTPL

SEQ ID NO: 182636 - protein, 10 aa, Homo sapiens
  Native (TYRP2_HUMAN)
RNSMKLPTLK

SEQ ID NO: 182637 - protein, 9 aa, Homo sapiens
  Native (TYRP2_HUMAN)
RPWSGPYIL

SEQ ID NO: 182638 - protein, 10 aa, Homo sapiens
  Native (TYRP2_HUMAN)
RRNQMGRNSM

SEQ ID NO: 182639 - protein, 10 aa, Homo sapiens
  Native (TYRP2_HUMAN)
RTCKCTGNFA

SEQ ID NO: 182640 - protein, 9 aa, Homo sapiens
  Native (TYRP2_HUMAN)
SFALPYWNF

SEQ ID NO: 182641 - protein, 9 aa, Homo sapiens
  Native (TYRP2_HUMAN)
SLDDYNHLV

SEQ ID NO: 182642 - protein, 9 aa, Homo sapiens
  Native (TYRP2_HUMAN)
SLHNLVHSF

SEQ ID NO: 182643 - protein, 9 aa, Homo sapiens
  Native (TYRP2_HUMAN)
STFSFRNAL

SEQ ID NO: 182644 - protein, 10 aa, Homo sapiens
  Native (TYRP2_HUMAN)
TEVRADTRPW

SEQ ID NO: 182645 - protein, 9 aa, Homo sapiens
  Native (TYRP2_HUMAN)
TLDSQVMSL

SEQ ID NO: 182646 - protein, 9 aa, Homo sapiens
  Native (TYRP2_HUMAN)
TLLGPGRPY

SEQ ID NO: 182647 - protein, 9 aa, Homo sapiens
  Native (TYRP2_HUMAN)
TPGWPTTLL

SEQ ID NO: 182648 - protein, 9 aa, Homo sapiens
  Native (TYRP2_HUMAN)
TSDQLGYSY

SEQ ID NO: 182649 - protein, 9 aa, Homo sapiens
  Native (TYRP2_HUMAN)
VIRQNIHSL

SEQ ID NO: 182650 - protein, 9 aa, Homo sapiens
  Native (TYRP2_HUMAN)
VSVEETPGW

SEQ ID NO: 182651 - protein, 9 aa, Homo sapiens
  Native (TYRP2_HUMAN)
WPTTLLVVM

SEQ ID NO: 182652 - protein, 9 aa, Homo sapiens
  Native (TYRP2_HUMAN)
YAIDLPVSV

SEQ ID NO: 182653 - protein, 10 aa, Homo sapiens
  Native (TYRP2_HUMAN)
YDFFVWLHYY

SEQ ID NO: 182654 - protein, 9 aa, Homo sapiens
  Native (TYRP2_HUMAN)
YSYAIDLPV

SEQ ID NO: 182655 - protein, 11 aa, Artificial Sequence
  Description of Artificial Sequence: Synthetic peptide
  Seed: VVMGTLVALVG (TYRP2_HUMAN)
VIMGTLVALVV

SEQ ID NO: 182656 - protein, 9 aa, Artificial Sequence
  Description of Artificial Sequence: Synthetic peptide
  Seed: HSAANDPIF (TYRP2_HUMAN)
HVAANDPIY

SEQ ID NO: 182657 - protein, 10 aa, Artificial Sequence
  Description of Artificial Sequence: Synthetic peptide
  Seed: LTSDQLGYSY (TYRP2_HUMAN)
LASDQLGYSF

SEQ ID NO: 182658 - protein, 9 aa, Artificial Sequence
  Description of Artificial Sequence: Synthetic peptide
  Seed: FTDAIFDEW (TYRP2_HUMAN)
FYDAIFDEV

SEQ ID NO: 182659 - protein, 9 aa, Artificial Sequence
  Description of Artificial Sequence: Synthetic peptide
  Seed: RFNPPADAW (TYRP2_HUMAN)
RQNPPADAM

SEQ ID NO: 182660 - protein, 9 aa, Artificial Sequence
  Description of Artificial Sequence: Synthetic peptide
  Seed: VIRQNIHSL (TYRP2_HUMAN)
VVRQNIHSY

SEQ ID NO: 182661 - protein, 9 aa, Artificial Sequence
  Description of Artificial Sequence: Synthetic peptide
  Seed: VHPDYVITT (TYRP2_HUMAN)
VQPDYVITV

SEQ ID NO: 182662 - protein, 9 aa, Artificial Sequence
  Description of Artificial Sequence: Synthetic peptide
  Seed: YYSVRDTLL (TYRP2_HUMAN)
YYSVRDTLW

SEQ ID NO: 182663 - protein, 9 aa, Artificial Sequence
  Description of Artificial Sequence: Synthetic peptide
  Seed: RQNIHSLSP (TYRP2_HUMAN)
RFNIHSLSM

SEQ ID NO: 182664 - protein, 9 aa, Artificial Sequence
  Description of Artificial Sequence: Synthetic peptide
  Seed: ECDVCTDQL (TYRP2_HUMAN)
EADVCTDQL

SEQ ID NO: 182665 - protein, 9 aa, Artificial Sequence
  Description of Artificial Sequence: Synthetic peptide
  Seed: QRLIGNESF (TYRP2_HUMAN)
QHLIGNESF

SEQ ID NO: 182666 - protein, 10 aa, Artificial Sequence
  Description of Artificial Sequence: Synthetic peptide
  Seed: ESANVCGSQQ (TYRP2_HUMAN)
EVANVCGSQR

SEQ ID NO: 182667 - protein, 9 aa, Artificial Sequence
  Description of Artificial Sequence: Synthetic peptide
  Seed: NMVPFFPPV (TYRP2_HUMAN)
NYVPFFPPF

SEQ ID NO: 182668 - protein, 9 aa, Artificial Sequence
  Description of Artificial Sequence: Synthetic peptide
  Seed: KDIRDCLSL (TYRP2_HUMAN)
KQIRDCLSI

SEQ ID NO: 182669 - protein, 11 aa, Artificial Sequence
  Description of Artificial Sequence: Synthetic peptide
  Seed: VCDSLDDYNHL (TYRP2_HUMAN)
VADSLDDYNHI

SEQ ID NO: 182670 - protein, 9 aa, Artificial Sequence
  Description of Artificial Sequence: Synthetic peptide
  Seed: ANDPIFVVL (TYRP2_HUMAN)
ATDPIFVVV

SEQ ID NO: 182671 - protein, 9 aa, Artificial Sequence
  Description of Artificial Sequence: Synthetic peptide
  Seed: RKFFHRTCK (TYRP2_HUMAN)
RCFFHRTCK

SEQ ID NO: 182672 - protein, 9 aa, Artificial Sequence
  Description of Artificial Sequence: Synthetic peptide
  Seed: ILPGAQGQF (TYRP2_HUMAN)
IYPGAQGQF

SEQ ID NO: 182673 - protein, 10 aa, Artificial Sequence
  Description of Artificial Sequence: Synthetic peptide
  Seed: SLHNLVHSFL (TYRP2_HUMAN)
SVHNLVHSFV

SEQ ID NO: 182674 - protein, 9 aa, Artificial Sequence
  Description of Artificial Sequence: Synthetic peptide
  Seed: GTLVALVGL (TYRP2_HUMAN)
GQLVALVGV

SEQ ID NO: 182675 - protein, 11 aa, Artificial Sequence
  Description of Artificial Sequence: Synthetic peptide
  Seed: ANCSVYDFFVW (TYRP2_HUMAN)
ACCSVYDFFVW

SEQ ID NO: 182676 - protein, 9 aa, Artificial Sequence
  Description of Artificial Sequence: Synthetic peptide
  Seed: SSKRYTEEA (TYRP2_HUMAN)
SSKRYTEEK

SEQ ID NO: 182677 - protein, 10 aa, Artificial Sequence
  Description of Artificial Sequence: Synthetic peptide
  Seed: FVWLHYYSVR (TYRP2_HUMAN)
FQWLHYYSVV

SEQ ID NO: 182678 - protein, 9 aa, Artificial Sequence
  Description of Artificial Sequence: Synthetic peptide
  Seed: FSHQGPAFV (TYRP2_HUMAN)
FVHQGPAFA

SEQ ID NO: 182679 - protein, 10 aa, Artificial Sequence
  Description of Artificial Sequence: Synthetic peptide
  Seed: KRFNPPADAW (TYRP2_HUMAN)
KQFNPPADAV

SEQ ID NO: 182680 - protein, 10 aa, Artificial Sequence
  Description of Artificial Sequence: Synthetic peptide
  Seed: LVVMGTLVAL (TYRP2_HUMAN)
LTVMGTLVAV

SEQ ID NO: 182681 - protein, 9 aa, Artificial Sequence
  Description of Artificial Sequence: Synthetic peptide
  Seed: RPWSGPYIL (TYRP2_HUMAN)
RYWSGPYIF

SEQ ID NO: 182682 - protein, 9 aa, Artificial Sequence
  Description of Artificial Sequence: Synthetic peptide
  Seed: LHSFTDAIF (TYRP2_HUMAN)
LESFTDAIF

SEQ ID NO: 182683 - protein, 11 aa, Artificial Sequence
  Description of Artificial Sequence: Synthetic peptide
  Seed: FVVLHSFTDAI (TYRP2_HUMAN)
FWVLHSFTDAL

SEQ ID NO: 182684 - protein, 9 aa, Artificial Sequence
  Description of Artificial Sequence: Synthetic peptide
  Seed: SVYDFFVWL (TYRP2_HUMAN)
SQYDFFVWS

SEQ ID NO: 182685 - protein, 11 aa, Artificial Sequence
  Description of Artificial Sequence: Synthetic peptide
  Seed: RNSRFSSWETV (TYRP2_HUMAN)
RASRFSSWETF

SEQ ID NO: 182686 - protein, 11 aa, Artificial Sequence
  Description of Artificial Sequence: Synthetic peptide
  Seed: SVYDFFVWLHY (TYRP2_HUMAN)
SSYDFFVWLHF

SEQ ID NO: 182687 - protein, 9 aa, Artificial Sequence
  Description of Artificial Sequence: Synthetic peptide
  Seed: KCTGNFAGY (TYRP2_HUMAN)
KLTGNFAGF

SEQ ID NO: 182688 - protein, 10 aa, Artificial Sequence
  Description of Artificial Sequence: Synthetic peptide
  Seed: SHQGPAFVTW (TYRP2_HUMAN)
SEQGPAFVTY

SEQ ID NO: 182689 - protein, 10 aa, Artificial Sequence
  Description of Artificial Sequence: Synthetic peptide
  Seed: FVVLHSFTDA (TYRP2_HUMAN)
FWVLHSFTDV

SEQ ID NO: 182690 - protein, 9 aa, Artificial Sequence
  Description of Artificial Sequence: Synthetic peptide
  Seed: YVITTQHWL (TYRP2_HUMAN)
YIITTQHWW

SEQ ID NO: 182691 - protein, 9 aa, Artificial Sequence
  Description of Artificial Sequence: Synthetic peptide
  Seed: SLDDYNHLV (TYRP2_HUMAN)
SQDDYNHLV

SEQ ID NO: 182692 - protein, 9 aa, Artificial Sequence
  Description of Artificial Sequence: Synthetic peptide
  Seed: YVITTQHWL (TYRP2_HUMAN)
YGITTQHWW

SEQ ID NO: 182693 - protein, 9 aa, Artificial Sequence
  Description of Artificial Sequence: Synthetic peptide
  Seed: SRNSRFSSW (TYRP2_HUMAN)
SRNSRFSSF

SEQ ID NO: 182694 - protein, 8 aa, Artificial Sequence
  Description of Artificial Sequence: Synthetic peptide
  Seed: FLNGTNAL (TYRP2_HUMAN)
FLNGTNAV

SEQ ID NO: 182695 - protein, 11 aa, Artificial Sequence
  Description of Artificial Sequence: Synthetic peptide
  Seed: YSYAIDLPVSV (TYRP2_HUMAN)
YVYAIDLPVSV

SEQ ID NO: 182696 - protein, 10 aa, Artificial Sequence
  Description of Artificial Sequence: Synthetic peptide
  Seed: YNMVPFFPPV (TYRP2_HUMAN)
YKMVPFFPPL

SEQ ID NO: 182697 - protein, 9 aa, Artificial Sequence
  Description of Artificial Sequence: Synthetic peptide
  Seed: LERDLQRLI (TYRP2_HUMAN)
LERDLQRLW

SEQ ID NO: 182698 - protein, 9 aa, Artificial Sequence
  Description of Artificial Sequence: Synthetic peptide
  Seed: HQGPAFVTW (TYRP2_HUMAN)
HRGPAFVTI

SEQ ID NO: 182699 - protein, 9 aa, Artificial Sequence
  Description of Artificial Sequence: Synthetic peptide
  Seed: RLRKGYTPL (TYRP2_HUMAN)
RVRKGYTPR

SEQ ID NO: 182700 - protein, 10 aa, Artificial Sequence
  Description of Artificial Sequence: Synthetic peptide
  Seed: NRMYNMVPFF (TYRP2_HUMAN)
NRMYNMVPFI

SEQ ID NO: 182701 - protein, 8 aa, Artificial Sequence
  Description of Artificial Sequence: Synthetic peptide
  Seed: HSFTDAIF (TYRP2_HUMAN)
HQFTDAIY

SEQ ID NO: 182702 - protein, 9 aa, Artificial Sequence
  Description of Artificial Sequence: Synthetic peptide
  Seed: TSDQLGYSY (TYRP2_HUMAN)
TLDQLGYSI

SEQ ID NO: 182703 - protein, 11 aa, Artificial Sequence
  Description of Artificial Sequence: Synthetic peptide
  Seed: YTPLMETHLSS (TYRP2_HUMAN)
YQPLMETHLSM

SEQ ID NO: 182704 - protein, 9 aa, Artificial Sequence
  Description of Artificial Sequence: Synthetic peptide
  Seed: IGHNRMYNM (TYRP2_HUMAN)
IRHNRMYNF

SEQ ID NO: 182705 - protein, 10 aa, Artificial Sequence
  Description of Artificial Sequence: Synthetic peptide
  Seed: VVMGTLVALV (TYRP2_HUMAN)
VQMGTLVALL

SEQ ID NO: 182706 - protein, 10 aa, Artificial Sequence
  Description of Artificial Sequence: Synthetic peptide
  Seed: LTSDQLGYSY (TYRP2_HUMAN)
LISDQLGYSY

SEQ ID NO: 182707 - protein, 10 aa, Artificial Sequence
  Description of Artificial Sequence: Synthetic peptide
  Seed: RLRKGYTPLM (TYRP2_HUMAN)
RNRKGYTPLK

SEQ ID NO: 182708 - protein, 10 aa, Artificial Sequence
  Description of Artificial Sequence: Synthetic peptide
  Seed: RLIGNESFAL (TYRP2_HUMAN)
RIIGNESFAV

SEQ ID NO: 182709 - protein, 10 aa, Artificial Sequence
  Description of Artificial Sequence: Synthetic peptide
  Seed: FVWLHYYSVR (TYRP2_HUMAN)
FMWLHYYSVG

SEQ ID NO: 182710 - protein, 10 aa, Artificial Sequence
  Description of Artificial Sequence: Synthetic peptide
  Seed: SPLWWGFLLS (TYRP2_HUMAN)
SQLWWGFLLL

SEQ ID NO: 182711 - protein, 10 aa, Artificial Sequence
  Description of Artificial Sequence: Synthetic peptide
  Seed: SSWETVCDSL (TYRP2_HUMAN)
SSWETVCDSW

SEQ ID NO: 182712 - protein, 10 aa, Artificial Sequence
  Description of Artificial Sequence: Synthetic peptide
  Seed: SSWETVCDSL (TYRP2_HUMAN)
SLWETVCDSV

SEQ ID NO: 182713 - protein, 10 aa, Artificial Sequence
  Description of Artificial Sequence: Synthetic peptide
  Seed: FPPVTNEELF (TYRP2_HUMAN)
FAPVTNEELW

SEQ ID NO: 182714 - protein, 9 aa, Artificial Sequence
  Description of Artificial Sequence: Synthetic peptide
  Seed: SLDDYNHLV (TYRP2_HUMAN)
SIDDYNHLY

SEQ ID NO: 182715 - protein, 9 aa, Artificial Sequence
  Description of Artificial Sequence: Synthetic peptide
  Seed: SQVMSLHNL (TYRP2_HUMAN)
SEVMSLHNM

SEQ ID NO: 182716 - protein, 10 aa, Artificial Sequence
  Description of Artificial Sequence: Synthetic peptide
  Seed: LVVMGTLVAL (TYRP2_HUMAN)
LTVMGTLVAF

SEQ ID NO: 182717 - protein, 9 aa, Artificial Sequence
  Description of Artificial Sequence: Synthetic peptide
  Seed: RFNPPADAW (TYRP2_HUMAN)
RANPPADAF

SEQ ID NO: 182718 - protein, 9 aa, Artificial Sequence
  Description of Artificial Sequence: Synthetic peptide
  Seed: YDFFVWLHY (TYRP2_HUMAN)
YVFFVWLHF

SEQ ID NO: 182719 - protein, 9 aa, Artificial Sequence
  Description of Artificial Sequence: Synthetic peptide
  Seed: SRNSRFSSW (TYRP2_HUMAN)
SINSRFSSF

SEQ ID NO: 182720 - protein, 10 aa, Artificial Sequence
  Description of Artificial Sequence: Synthetic peptide
  Seed: FANCSVYDFF (TYRP2_HUMAN)
FMNCSVYDFY

SEQ ID NO: 182721 - protein, 9 aa, Artificial Sequence
  Description of Artificial Sequence: Synthetic peptide
  Seed: VTWHRYHLL (TYRP2_HUMAN)
VRWHRYHLF

SEQ ID NO: 182722 - protein, 11 aa, Artificial Sequence
  Description of Artificial Sequence: Synthetic peptide
  Seed: SLDDYNHLVTL (TYRP2_HUMAN)
SSDDYNHLVTY

SEQ ID NO: 182723 - protein, 9 aa, Artificial Sequence
  Description of Artificial Sequence: Synthetic peptide
  Seed: TLDSQVMSL (TYRP2_HUMAN)
TYDSQVMSF

SEQ ID NO: 182724 - protein, 10 aa, Artificial Sequence
  Description of Artificial Sequence: Synthetic peptide
  Seed: LTSDQLGYSY (TYRP2_HUMAN)
LPSDQLGYSY

SEQ ID NO: 182725 - protein, 11 aa, Artificial Sequence
  Description of Artificial Sequence: Synthetic peptide
  Seed: RNSRFSSWETV (TYRP2_HUMAN)
RFSRFSSWETV

SEQ ID NO: 182726 - protein, 9 aa, Artificial Sequence
  Description of Artificial Sequence: Synthetic peptide
  Seed: CSVYDFFVW (TYRP2_HUMAN)
CPVYDFFVI

SEQ ID NO: 182727 - protein, 9 aa, Artificial Sequence
  Description of Artificial Sequence: Synthetic peptide
  Seed: RLRKGYTPL (TYRP2_HUMAN)
RMRKGYTPG

SEQ ID NO: 182728 - protein, 9 aa, Artificial Sequence
  Description of Artificial Sequence: Synthetic peptide
  Seed: RNQMGRNSM (TYRP2_HUMAN)
RQQMGRNSI

SEQ ID NO: 182729 - protein, 9 aa, Artificial Sequence
  Description of Artificial Sequence: Synthetic peptide
  Seed: FFPPVTNEE (TYRP2_HUMAN)
FGPPVTNEL

SEQ ID NO: 182730 - protein, 9 aa, Artificial Sequence
  Description of Artificial Sequence: Synthetic peptide
  Seed: SLHNLVHSF (TYRP2_HUMAN)
SNHNLVHSL

SEQ ID NO: 182731 - protein, 10 aa, Artificial Sequence
  Description of Artificial Sequence: Synthetic peptide
  Seed: VLLAFLQYRR (TYRP2_HUMAN)
VVLAFLQYRK

SEQ ID NO: 182732 - protein, 10 aa, Artificial Sequence
  Description of Artificial Sequence: Synthetic peptide
  Seed: RRLRKGYTPL (TYRP2_HUMAN)
RDLRKGYTPY

SEQ ID NO: 182733 - protein, 9 aa, Artificial Sequence
  Description of Artificial Sequence: Synthetic peptide
  Seed: FLTSDQLGY (TYRP2_HUMAN)
FTTSDQLGF

SEQ ID NO: 182734 - protein, 9 aa, Artificial Sequence
  Description of Artificial Sequence: Synthetic peptide
  Seed: RAIDFSHQG (TYRP2_HUMAN)
RAIDFSHQY

SEQ ID NO: 182735 - protein, 9 aa, Artificial Sequence
  Description of Artificial Sequence: Synthetic peptide
  Seed: HYYSVRDTL (TYRP2_HUMAN)
HSYSVRDTM

SEQ ID NO: 182736 - protein, 10 aa, Artificial Sequence
  Description of Artificial Sequence: Synthetic peptide
  Seed: KILPGAQGQF (TYRP2_HUMAN)
KILPGAQGQK

SEQ ID NO: 182737 - protein, 9 aa, Artificial Sequence
  Description of Artificial Sequence: Synthetic peptide
  Seed: SRFSSWETV (TYRP2_HUMAN)
SMFSSWETF

SEQ ID NO: 182738 - protein, 10 aa, Artificial Sequence
  Description of Artificial Sequence: Synthetic peptide
  Seed: LHYYSVRDTL (TYRP2_HUMAN)
LKYYSVRDTY

SEQ ID NO: 182739 - protein, 9 aa, Artificial Sequence
  Description of Artificial Sequence: Synthetic peptide
  Seed: LVHSFLNGT (TYRP2_HUMAN)
LQHSFLNGA

SEQ ID NO: 182740 - protein, 10 aa, Artificial Sequence
  Description of Artificial Sequence: Synthetic peptide
  Seed: RTCKCTGNFA (TYRP2_HUMAN)
RMCKCTGNFK

SEQ ID NO: 182741 - protein, 10 aa, Artificial Sequence
  Description of Artificial Sequence: Synthetic peptide
  Seed: RLIGNESFAL (TYRP2_HUMAN)
RVIGNESFAL

SEQ ID NO: 182742 - protein, 9 aa, Artificial Sequence
  Description of Artificial Sequence: Synthetic peptide
  Seed: SLHNLVHSF (TYRP2_HUMAN)
SVHNLVHSI

SEQ ID NO: 182743 - protein, 10 aa, Artificial Sequence
  Description of Artificial Sequence: Synthetic peptide
  Seed: SQVMSLHNLV (TYRP2_HUMAN)
SLVMSLHNLL

SEQ ID NO: 182744 - protein, 10 aa, Artificial Sequence
  Description of Artificial Sequence: Synthetic peptide
  Seed: SQVMSLHNLV (TYRP2_HUMAN)
SQVMSLHNLF

SEQ ID NO: 182745 - protein, 9 aa, Artificial Sequence
  Description of Artificial Sequence: Synthetic peptide
  Seed: SVYDFFVWL (TYRP2_HUMAN)
SSYDFFVWK

SEQ ID NO: 182746 - protein, 10 aa, Artificial Sequence
  Description of Artificial Sequence: Synthetic peptide
  Seed: RELWPRKFFH (TYRP2_HUMAN)
RILWPRKFFK

SEQ ID NO: 182747 - protein, 10 aa, Artificial Sequence
  Description of Artificial Sequence: Synthetic peptide
  Seed: RMYNMVPFFP (TYRP2_HUMAN)
RQYNMVPFFW

SEQ ID NO: 182748 - protein, 10 aa, Artificial Sequence
  Description of Artificial Sequence: Synthetic peptide
  Seed: SLHNLVHSFL (TYRP2_HUMAN)
SMHNLVHSFA

SEQ ID NO: 182749 - protein, 10 aa, Artificial Sequence
  Description of Artificial Sequence: Synthetic peptide
  Seed: FQNSTFSFRN (TYRP2_HUMAN)
FINSTFSFRK

SEQ ID NO: 182750 - protein, 10 aa, Artificial Sequence
  Description of Artificial Sequence: Synthetic peptide
  Seed: ALVGLFVLLA (TYRP2_HUMAN)
AMVGLFVLLI

SEQ ID NO: 182751 - protein, 11 aa, Artificial Sequence
  Description of Artificial Sequence: Synthetic peptide
  Seed: DTLLGPGRPYR (TYRP2_HUMAN)
DFLLGPGRPYR

SEQ ID NO: 182752 - protein, 9 aa, Artificial Sequence
  Description of Artificial Sequence: Synthetic peptide
  Seed: YVITTQHWL (TYRP2_HUMAN)
YSITTQHWY

SEQ ID NO: 182753 - protein, 9 aa, Artificial Sequence
  Description of Artificial Sequence: Synthetic peptide
  Seed: SFALPYWNF (TYRP2_HUMAN)
SMALPYWNY

SEQ ID NO: 182754 - protein, 10 aa, Artificial Sequence
  Description of Artificial Sequence: Synthetic peptide
  Seed: YDFFVWLHYY (TYRP2_HUMAN)
YFFFVWLHYF

SEQ ID NO: 182755 - protein, 9 aa, Artificial Sequence
  Description of Artificial Sequence: Synthetic peptide
  Seed: LQKFDNPPF (TYRP2_HUMAN)
LKKFDNPPY

SEQ ID NO: 182756 - protein, 9 aa, Artificial Sequence
  Description of Artificial Sequence: Synthetic peptide
  Seed: CERKKPPVI (TYRP2_HUMAN)
CQRKKPPVL

SEQ ID NO: 182757 - protein, 9 aa, Artificial Sequence
  Description of Artificial Sequence: Synthetic peptide
  Seed: FQNSTFSFR (TYRP2_HUMAN)
FWNSTFSFR

SEQ ID NO: 182758 - protein, 10 aa, Artificial Sequence
  Description of Artificial Sequence: Synthetic peptide
  Seed: REQFLGALDL (TYRP2_HUMAN)
RIQFLGALDY

SEQ ID NO: 182759 - protein, 10 aa, Artificial Sequence
  Description of Artificial Sequence: Synthetic peptide
  Seed: RNSMKLPTLK (TYRP2_HUMAN)
RTSMKLPTLK

SEQ ID NO: 182760 - protein, 10 aa, Artificial Sequence
  Description of Artificial Sequence: Synthetic peptide
  Seed: SSWETVCDSL (TYRP2_HUMAN)
SMWETVCDSI

SEQ ID NO: 182761 - protein, 10 aa, Artificial Sequence
  Description of Artificial Sequence: Synthetic peptide
  Seed: VYDFFVWLHY (TYRP2_HUMAN)
VADFFVWLHY

SEQ ID NO: 182762 - protein, 9 aa, Artificial Sequence
  Description of Artificial Sequence: Synthetic peptide
  Seed: HQGPAFVTW (TYRP2_HUMAN)
HPGPAFVTM

SEQ ID NO: 182763 - protein, 10 aa, Artificial Sequence
  Description of Artificial Sequence: Synthetic peptide
  Seed: HSFLNGTNAL (TYRP2_HUMAN)
HAFLNGTNAV

SEQ ID NO: 182764 - protein, 9 aa, Artificial Sequence
  Description of Artificial Sequence: Synthetic peptide
  Seed: SVYDFFVWL (TYRP2_HUMAN)
SSYDFFVWR

SEQ ID NO: 182765 - protein, 10 aa, Artificial Sequence
  Description of Artificial Sequence: Synthetic peptide
  Seed: LISRNSRFSS (TYRP2_HUMAN)
LRSRNSRFSA

SEQ ID NO: 182766 - protein, 9 aa, Artificial Sequence
  Description of Artificial Sequence: Synthetic peptide
  Seed: LCLERDLQR (TYRP2_HUMAN)
LFLERDLQR

SEQ ID NO: 182767 - protein, 10 aa, Artificial Sequence
  Description of Artificial Sequence: Synthetic peptide
  Seed: QPQFANCSVY (TYRP2_HUMAN)
QDQFANCSVM

SEQ ID NO: 182768 - protein, 9 aa, Artificial Sequence
  Description of Artificial Sequence: Synthetic peptide
  Seed: WHRYHLLCL (TYRP2_HUMAN)
WMRYHLLCA

SEQ ID NO: 182769 - protein, 11 aa, Artificial Sequence
  Description of Artificial Sequence: Synthetic peptide
  Seed: YRRLRKGYTPL (TYRP2_HUMAN)
YPRLRKGYTPM

SEQ ID NO: 182770 - protein, 9 aa, Artificial Sequence
  Description of Artificial Sequence: Synthetic peptide
  Seed: FTDAIFDEW (TYRP2_HUMAN)
FFDAIFDEY

SEQ ID NO: 182771 - protein, 9 aa, Artificial Sequence
  Description of Artificial Sequence: Synthetic peptide
  Seed: VALVGLFVL (TYRP2_HUMAN)
VSLVGLFVL

SEQ ID NO: 182772 - protein, 10 aa, Artificial Sequence
  Description of Artificial Sequence: Synthetic peptide
  Seed: SYAIDLPVSV (TYRP2_HUMAN)
SYAIDLPVSI

SEQ ID NO: 182773 - protein, 10 aa, Artificial Sequence
  Description of Artificial Sequence: Synthetic peptide
  Seed: HYYSVRDTLL (TYRP2_HUMAN)
HWYSVRDTLW

SEQ ID NO: 182774 - protein, 10 aa, Artificial Sequence
  Description of Artificial Sequence: Synthetic peptide
  Seed: LVVMGTLVAL (TYRP2_HUMAN)
LWVMGTLVAA

SEQ ID NO: 182775 - protein, 10 aa, Artificial Sequence
  Description of Artificial Sequence: Synthetic peptide
  Seed: RMYNMVPFFP (TYRP2_HUMAN)
RQYNMVPFFS

SEQ ID NO: 182776 - protein, 9 aa, Artificial Sequence
  Description of Artificial Sequence: Synthetic peptide
  Seed: SRNSRFSSW (TYRP2_HUMAN)
SGNSRFSSF

SEQ ID NO: 182777 - protein, 10 aa, Artificial Sequence
  Description of Artificial Sequence: Synthetic peptide
  Seed: ELAPIGHNRM (TYRP2_HUMAN)
EVAPIGHNRH

SEQ ID NO: 182778 - protein, 9 aa, Artificial Sequence
  Description of Artificial Sequence: Synthetic peptide
  Seed: HSAANDPIF (TYRP2_HUMAN)
HPAANDPIY

SEQ ID NO: 182779 - protein, 9 aa, Artificial Sequence
  Description of Artificial Sequence: Synthetic peptide
  Seed: SLHNLVHSF (TYRP2_HUMAN)
SAHNLVHSH

SEQ ID NO: 182780 - protein, 10 aa, Artificial Sequence
  Description of Artificial Sequence: Synthetic peptide
  Seed: QPQFANCSVY (TYRP2_HUMAN)
QKQFANCSVL

SEQ ID NO: 182781 - protein, 9 aa, Artificial Sequence
  Description of Artificial Sequence: Synthetic peptide
  Seed: RLRKGYTPL (TYRP2_HUMAN)
RYRKGYTPI

SEQ ID NO: 182782 - protein, 10 aa, Artificial Sequence
  Description of Artificial Sequence: Synthetic peptide
  Seed: AARPDDPTLI (TYRP2_HUMAN)
ATRPDDPTLW

SEQ ID NO: 182783 - protein, 9 aa, Artificial Sequence
  Description of Artificial Sequence: Synthetic peptide
  Seed: FSHQGPAFV (TYRP2_HUMAN)
FPHQGPAFI

SEQ ID NO: 182784 - protein, 9 aa, Artificial Sequence
  Description of Artificial Sequence: Synthetic peptide
  Seed: FPPVTNEEL (TYRP2_HUMAN)
FSPVTNEEM

SEQ ID NO: 182785 - protein, 9 aa, Artificial Sequence
  Description of Artificial Sequence: Synthetic peptide
  Seed: RLRKGYTPL (TYRP2_HUMAN)
RRRKGYTPL

SEQ ID NO: 182786 - protein, 9 aa, Artificial Sequence
  Description of Artificial Sequence: Synthetic peptide
  Seed: GFDKADGTL (TYRP2_HUMAN)
GVDKADGTM

SEQ ID NO: 182787 - protein, 9 aa, Artificial Sequence
  Description of Artificial Sequence: Synthetic peptide
  Seed: CSVYDFFVW (TYRP2_HUMAN)
CPVYDFFVL

SEQ ID NO: 182788 - protein, 9 aa, Artificial Sequence
  Description of Artificial Sequence: Synthetic peptide
  Seed: AIFDEWMKR (TYRP2_HUMAN)
AIFDEWMKK

SEQ ID NO: 182789 - protein, 10 aa, Artificial Sequence
  Description of Artificial Sequence: Synthetic peptide
  Seed: REQFLGALDL (TYRP2_HUMAN)
RCQFLGALDY

SEQ ID NO: 182790 - protein, 9 aa, Artificial Sequence
  Description of Artificial Sequence: Synthetic peptide
  Seed: STFSFRNAL (TYRP2_HUMAN)
SYFSFRNAH

SEQ ID NO: 182791 - protein, 9 aa, Artificial Sequence
  Description of Artificial Sequence: Synthetic peptide
  Seed: VTNEELFLT (TYRP2_HUMAN)
VSNEELFLV

SEQ ID NO: 182792 - protein, 10 aa, Artificial Sequence
  Description of Artificial Sequence: Synthetic peptide
  Seed: ITTQHWLGLL (TYRP2_HUMAN)
IATQHWLGLF

SEQ ID NO: 182793 - protein, 10 aa, Artificial Sequence
  Description of Artificial Sequence: Synthetic peptide
  Seed: SDQLGYSYAI (TYRP2_HUMAN)
SAQLGYSYAL

SEQ ID NO: 182794 - protein, 9 aa, Artificial Sequence
  Description of Artificial Sequence: Synthetic peptide
  Seed: ANDPIFVVL (TYRP2_HUMAN)
AHDPIFVVV

SEQ ID NO: 182795 - protein, 10 aa, Artificial Sequence
  Description of Artificial Sequence: Synthetic peptide
  Seed: LVVMGTLVAL (TYRP2_HUMAN)
LEVMGTLVAF

SEQ ID NO: 182796 - protein, 9 aa, Artificial Sequence
  Description of Artificial Sequence: Synthetic peptide
  Seed: STFSFRNAL (TYRP2_HUMAN)
SLFSFRNAW

SEQ ID NO: 182797 - protein, 9 aa, Artificial Sequence
  Description of Artificial Sequence: Synthetic peptide
  Seed: VTWHRYHLL (TYRP2_HUMAN)
VSWHRYHLR

SEQ ID NO: 182798 - protein, 11 aa, Artificial Sequence
  Description of Artificial Sequence: Synthetic peptide
  Seed: WLHYYSVRDTL (TYRP2_HUMAN)
WIHYYSVRDTW

SEQ ID NO: 182799 - protein, 9 aa, Artificial Sequence
  Description of Artificial Sequence: Synthetic peptide
  Seed: FPPVTNEEL (TYRP2_HUMAN)
FLPVTNEEY

SEQ ID NO: 182800 - protein, 9 aa, Artificial Sequence
  Description of Artificial Sequence: Synthetic peptide
  Seed: AARPDDPTL (TYRP2_HUMAN)
APRPDDPTL

SEQ ID NO: 182801 - protein, 9 aa, Artificial Sequence
  Description of Artificial Sequence: Synthetic peptide
  Seed: TLLGPGRPY (TYRP2_HUMAN)
TMLGPGRPF

SEQ ID NO: 182802 - protein, 9 aa, Artificial Sequence
  Description of Artificial Sequence: Synthetic peptide
  Seed: STFSFRNAL (TYRP2_HUMAN)
SPFSFRNAY

SEQ ID NO: 182803 - protein, 10 aa, Artificial Sequence
  Description of Artificial Sequence: Synthetic peptide
  Seed: RNSRFSSWET (TYRP2_HUMAN)
RFSRFSSWEV

SEQ ID NO: 182804 - protein, 9 aa, Artificial Sequence
  Description of Artificial Sequence: Synthetic peptide
  Seed: STFSFRNAL (TYRP2_HUMAN)
SVFSFRNAV

SEQ ID NO: 182805 - protein, 10 aa, Artificial Sequence
  Description of Artificial Sequence: Synthetic peptide
  Seed: FVLLAFLQYR (TYRP2_HUMAN)
FTLLAFLQYR

SEQ ID NO: 182806 - protein, 10 aa, Artificial Sequence
  Description of Artificial Sequence: Synthetic peptide
  Seed: FLNGTNALPH (TYRP2_HUMAN)
FSNGTNALPY

SEQ ID NO: 182807 - protein, 9 aa, Artificial Sequence
  Description of Artificial Sequence: Synthetic peptide
  Seed: FQNSTFSFR (TYRP2_HUMAN)
FGNSTFSFR

SEQ ID NO: 182808 - protein, 9 aa, Artificial Sequence
  Description of Artificial Sequence: Synthetic peptide
  Seed: GPAFVTWHR (TYRP2_HUMAN)
GAAFVTWHR

SEQ ID NO: 182809 - protein, 10 aa, Artificial Sequence
  Description of Artificial Sequence: Synthetic peptide
  Seed: SDQLGYSYAI (TYRP2_HUMAN)
SSQLGYSYAV

SEQ ID NO: 182810 - protein, 10 aa, Artificial Sequence
  Description of Artificial Sequence: Synthetic peptide
  Seed: FFQNSTFSFR (TYRP2_HUMAN)
FRQNSTFSFK

SEQ ID NO: 182811 - protein, 9 aa, Artificial Sequence
  Description of Artificial Sequence: Synthetic peptide
  Seed: RVHPDYVIT (TYRP2_HUMAN)
RTHPDYVIK

SEQ ID NO: 182812 - protein, 9 aa, Artificial Sequence
  Description of Artificial Sequence: Synthetic peptide
  Seed: VTNEELFLT (TYRP2_HUMAN)
VQNEELFLM

SEQ ID NO: 182813 - protein, 10 aa, Artificial Sequence
  Description of Artificial Sequence: Synthetic peptide
  Seed: RLIGNESFAL (TYRP2_HUMAN)
RMIGNESFAM

SEQ ID NO: 182814 - protein, 10 aa, Artificial Sequence
  Description of Artificial Sequence: Synthetic peptide
  Seed: QGPAFVTWHR (TYRP2_HUMAN)
QFPAFVTWHK

SEQ ID NO: 182815 - protein, 11 aa, Artificial Sequence
  Description of Artificial Sequence: Synthetic peptide
  Seed: WLHYYSVRDTL (TYRP2_HUMAN)
WDHYYSVRDTF

SEQ ID NO: 182816 - protein, 9 aa, Artificial Sequence
  Description of Artificial Sequence: Synthetic peptide
  Seed: HYYSVRDTL (TYRP2_HUMAN)
HWYSVRDTL

SEQ ID NO: 182817 - protein, 10 aa, Artificial Sequence
  Description of Artificial Sequence: Synthetic peptide
  Seed: ETPGWPTTLL (TYRP2_HUMAN)
ELPGWPTTLK

SEQ ID NO: 182818 - protein, 11 aa, Artificial Sequence
  Description of Artificial Sequence: Synthetic peptide
  Seed: FLTSDQLGYSY (TYRP2_HUMAN)
FRTSDQLGYSY

SEQ ID NO: 182819 - protein, 9 aa, Artificial Sequence
  Description of Artificial Sequence: Synthetic peptide
  Seed: ANDPIFVVL (TYRP2_HUMAN)
AFDPIFVVC

SEQ ID NO: 182820 - protein, 10 aa, Artificial Sequence
  Description of Artificial Sequence: Synthetic peptide
  Seed: YAIDLPVSVE (TYRP2_HUMAN)
YLIDLPVSVW

SEQ ID NO: 182821 - protein, 9 aa, Artificial Sequence
  Description of Artificial Sequence: Synthetic peptide
  Seed: FQNSTFSFR (TYRP2_HUMAN)
FINSTFSFR

SEQ ID NO: 182822 - protein, 10 aa, Artificial Sequence
  Description of Artificial Sequence: Synthetic peptide
  Seed: RMYNMVPFFP (TYRP2_HUMAN)
RLYNMVPFFL

SEQ ID NO: 182823 - protein, 10 aa, Artificial Sequence
  Description of Artificial Sequence: Synthetic peptide
  Seed: FSFRNALEGF (TYRP2_HUMAN)
FWFRNALEGF

SEQ ID NO: 182824 - protein, 11 aa, Artificial Sequence
  Description of Artificial Sequence: Synthetic peptide
  Seed: RDTLLGPGRPY (TYRP2_HUMAN)
RQTLLGPGRPY

SEQ ID NO: 182825 - protein, 9 aa, Artificial Sequence
  Description of Artificial Sequence: Synthetic peptide
  Seed: YTPLMETHL (TYRP2_HUMAN)
YSPLMETHL

SEQ ID NO: 182826 - protein, 9 aa, Artificial Sequence
  Description of Artificial Sequence: Synthetic peptide
  Seed: ESANVCGSQ (TYRP2_HUMAN)
EVANVCGSY

SEQ ID NO: 182827 - protein, 9 aa, Artificial Sequence
  Description of Artificial Sequence: Synthetic peptide
  Seed: METHLSSKR (TYRP2_HUMAN)
MLTHLSSKR

SEQ ID NO: 182828 - protein, 9 aa, Artificial Sequence
  Description of Artificial Sequence: Synthetic peptide
  Seed: SVRDTLLGP (TYRP2_HUMAN)
SVRDTLLGK

SEQ ID NO: 182829 - protein, 9 aa, Artificial Sequence
  Description of Artificial Sequence: Synthetic peptide
  Seed: LVGLFVLLA (TYRP2_HUMAN)
LMGLFVLLV

SEQ ID NO: 182830 - protein, 10 aa, Artificial Sequence
  Description of Artificial Sequence: Synthetic peptide
  Seed: VVMGTLVALV (TYRP2_HUMAN)
VLMGTLVALV

SEQ ID NO: 182831 - protein, 9 aa, Artificial Sequence
  Description of Artificial Sequence: Synthetic peptide
  Seed: VHPDYVITT (TYRP2_HUMAN)
VIPDYVITL

SEQ ID NO: 182832 - protein, 9 aa, Artificial Sequence
  Description of Artificial Sequence: Synthetic peptide
  Seed: SLHNLVHSF (TYRP2_HUMAN)
SFHNLVHSV

SEQ ID NO: 182833 - protein, 9 aa, Artificial Sequence
  Description of Artificial Sequence: Synthetic peptide
  Seed: RNQDDRELW (TYRP2_HUMAN)
RVQDDRELF

SEQ ID NO: 182834 - protein, 10 aa, Artificial Sequence
  Description of Artificial Sequence: Synthetic peptide
  Seed: ELAPIGHNRM (TYRP2_HUMAN)
EVAPIGHNRM

SEQ ID NO: 182835 - protein, 9 aa, Artificial Sequence
  Description of Artificial Sequence: Synthetic peptide
  Seed: VSVEETPGW (TYRP2_HUMAN)
VSVEETPGF

SEQ ID NO: 182836 - protein, 9 aa, Artificial Sequence
  Description of Artificial Sequence: Synthetic peptide
  Seed: AANDPIFVV (TYRP2_HUMAN)
ALNDPIFVI

SEQ ID NO: 182837 - protein, 9 aa, Artificial Sequence
  Description of Artificial Sequence: Synthetic peptide
  Seed: DSLDDYNHL (TYRP2_HUMAN)
DILDDYNHV

SEQ ID NO: 182838 - protein, 9 aa, Artificial Sequence
  Description of Artificial Sequence: Synthetic peptide
  Seed: YDFFVWLHY (TYRP2_HUMAN)
YNFFVWLHY

SEQ ID NO: 182839 - protein, 10 aa, Artificial Sequence
  Description of Artificial Sequence: Synthetic peptide
  Seed: FVVLHSFTDA (TYRP2_HUMAN)
FFVLHSFTDV

SEQ ID NO: 182840 - protein, 10 aa, Artificial Sequence
  Description of Artificial Sequence: Synthetic peptide
  Seed: HSFLNGTNAL (TYRP2_HUMAN)
HIFLNGTNAF

SEQ ID NO: 182841 - protein, 10 aa, Artificial Sequence
  Description of Artificial Sequence: Synthetic peptide
  Seed: ELAPIGHNRM (TYRP2_HUMAN)
ESAPIGHNRK

SEQ ID NO: 182842 - protein, 9 aa, Artificial Sequence
  Description of Artificial Sequence: Synthetic peptide
  Seed: HYYSVRDTL (TYRP2_HUMAN)
HSYSVRDTF

SEQ ID NO: 182843 - protein, 10 aa, Artificial Sequence
  Description of Artificial Sequence: Synthetic peptide
  Seed: IGNESFALPY (TYRP2_HUMAN)
IMNESFALPY

SEQ ID NO: 182844 - protein, 8 aa, Artificial Sequence
  Description of Artificial Sequence: Synthetic peptide
  Seed: KFDNPPFF (TYRP2_HUMAN)
KSDNPPFL

SEQ ID NO: 182845 - protein, 10 aa, Artificial Sequence
  Description of Artificial Sequence: Synthetic peptide
  Seed: RRNQMGRNSM (TYRP2_HUMAN)
RMNQMGRNSY

SEQ ID NO: 182846 - protein, 10 aa, Artificial Sequence
  Description of Artificial Sequence: Synthetic peptide
  Seed: CMTVDSLVNK (TYRP2_HUMAN)
CITVDSLVNK

SEQ ID NO: 182847 - protein, 9 aa, Artificial Sequence
  Description of Artificial Sequence: Synthetic peptide
  Seed: QFPRVCMTV (TYRP2_HUMAN)
QLPRVCMTF

SEQ ID NO: 182848 - protein, 10 aa, Artificial Sequence
  Description of Artificial Sequence: Synthetic peptide
  Seed: FFPPVTNEEL (TYRP2_HUMAN)
FWPPVTNEEM

SEQ ID NO: 182849 - protein, 9 aa, Artificial Sequence
  Description of Artificial Sequence: Synthetic peptide
  Seed: WPTTLLVVM (TYRP2_HUMAN)
WATTLLVVW

SEQ ID NO: 182850 - protein, 11 aa, Artificial Sequence
  Description of Artificial Sequence: Synthetic peptide
  Seed: WLHYYSVRDTL (TYRP2_HUMAN)
WNHYYSVRDTW

SEQ ID NO: 182851 - protein, 9 aa, Artificial Sequence
  Description of Artificial Sequence: Synthetic peptide
  Seed: NMVPFFPPV (TYRP2_HUMAN)
NEVPFFPPY

SEQ ID NO: 182852 - protein, 11 aa, Artificial Sequence
  Description of Artificial Sequence: Synthetic peptide
  Seed: WLHYYSVRDTL (TYRP2_HUMAN)
WKHYYSVRDTF

SEQ ID NO: 182853 - protein, 9 aa, Artificial Sequence
  Description of Artificial Sequence: Synthetic peptide
  Seed: MTVDSLVNK (TYRP2_HUMAN)
MIVDSLVNK

SEQ ID NO: 182854 - protein, 10 aa, Artificial Sequence
  Description of Artificial Sequence: Synthetic peptide
  Seed: MSLHNLVHSF (TYRP2_HUMAN)
MYLHNLVHSM

SEQ ID NO: 182855 - protein, 9 aa, Artificial Sequence
  Description of Artificial Sequence: Synthetic peptide
  Seed: GPGRPYRAI (TYRP2_HUMAN)
GPGRPYRAF

SEQ ID NO: 182856 - protein, 9 aa, Artificial Sequence
  Description of Artificial Sequence: Synthetic peptide
  Seed: ANDPIFVVL (TYRP2_HUMAN)
AQDPIFVVV

SEQ ID NO: 182857 - protein, 9 aa, Artificial Sequence
  Description of Artificial Sequence: Synthetic peptide
  Seed: VTNEELFLT (TYRP2_HUMAN)
VINEELFLM

SEQ ID NO: 182858 - protein, 11 aa, Artificial Sequence
  Description of Artificial Sequence: Synthetic peptide
  Seed: HSFTDAIFDEW (TYRP2_HUMAN)
HTFTDAIFDEF

SEQ ID NO: 182859 - protein, 10 aa, Artificial Sequence
  Description of Artificial Sequence: Synthetic peptide
  Seed: MGTLVALVGL (TYRP2_HUMAN)
METLVALVGV

SEQ ID NO: 182860 - protein, 9 aa, Artificial Sequence
  Description of Artificial Sequence: Synthetic peptide
  Seed: RPWSGPYIL (TYRP2_HUMAN)
RAWSGPYIV

SEQ ID NO: 182861 - protein, 10 aa, Artificial Sequence
  Description of Artificial Sequence: Synthetic peptide
  Seed: SDQLGYSYAI (TYRP2_HUMAN)
SVQLGYSYAL

SEQ ID NO: 182862 - protein, 9 aa, Artificial Sequence
  Description of Artificial Sequence: Synthetic peptide
  Seed: SVYDFFVWL (TYRP2_HUMAN)
SAYDFFVWW

SEQ ID NO: 182863 - protein, 9 aa, Artificial Sequence
  Description of Artificial Sequence: Synthetic peptide
  Seed: LLGPGRPYR (TYRP2_HUMAN)
LIGPGRPYR

SEQ ID NO: 182864 - protein, 9 aa, Artificial Sequence
  Description of Artificial Sequence: Synthetic peptide
  Seed: STFSFRNAL (TYRP2_HUMAN)
SCFSFRNAY

SEQ ID NO: 182865 - protein, 11 aa, Artificial Sequence
  Description of Artificial Sequence: Synthetic peptide
  Seed: YNMVPFFPPVT (TYRP2_HUMAN)
YTMVPFFPPVY

SEQ ID NO: 182866 - protein, 11 aa, Artificial Sequence
  Description of Artificial Sequence: Synthetic peptide
  Seed: YNMVPFFPPVT (TYRP2_HUMAN)
YTMVPFFPPVA

SEQ ID NO: 182867 - protein, 10 aa, Artificial Sequence
  Description of Artificial Sequence: Synthetic peptide
  Seed: RLIGNESFAL (TYRP2_HUMAN)
RMIGNESFAI

SEQ ID NO: 182868 - protein, 11 aa, Artificial Sequence
  Description of Artificial Sequence: Synthetic peptide
  Seed: ELAPIGHNRMY (TYRP2_HUMAN)
EAAPIGHNRMR

SEQ ID NO: 182869 - protein, 10 aa, Artificial Sequence
  Description of Artificial Sequence: Synthetic peptide
  Seed: RNQMGRNSMK (TYRP2_HUMAN)
RYQMGRNSMR

SEQ ID NO: 182870 - protein, 9 aa, Artificial Sequence
  Description of Artificial Sequence: Synthetic peptide
  Seed: GLFVLLAFL (TYRP2_HUMAN)
GTFVLLAFK

SEQ ID NO: 182871 - protein, 9 aa, Artificial Sequence
  Description of Artificial Sequence: Synthetic peptide
  Seed: FVWLHYYSV (TYRP2_HUMAN)
FLWLHYYSC

SEQ ID NO: 182872 - protein, 10 aa, Artificial Sequence
  Description of Artificial Sequence: Synthetic peptide
  Seed: LQKFDNPPFF (TYRP2_HUMAN)
LAKFDNPPFF

SEQ ID NO: 182873 - protein, 9 aa, Artificial Sequence
  Description of Artificial Sequence: Synthetic peptide
  Seed: FLTSDQLGY (TYRP2_HUMAN)
FTTSDQLGY

SEQ ID NO: 182874 - protein, 9 aa, Artificial Sequence
  Description of Artificial Sequence: Synthetic peptide
  Seed: SAANDPIFV (TYRP2_HUMAN)
STANDPIFI

SEQ ID NO: 182875 - protein, 9 aa, Artificial Sequence
  Description of Artificial Sequence: Synthetic peptide
  Seed: WHRYHLLCL (TYRP2_HUMAN)
WRRYHLLCL

SEQ ID NO: 182876 - protein, 9 aa, Artificial Sequence
  Description of Artificial Sequence: Synthetic peptide
  Seed: NMVPFFPPV (TYRP2_HUMAN)
NRVPFFPPY

SEQ ID NO: 182877 - protein, 9 aa, Artificial Sequence
  Description of Artificial Sequence: Synthetic peptide
  Seed: DDYNHLVTL (TYRP2_HUMAN)
DGYNHLVTV

SEQ ID NO: 182878 - protein, 10 aa, Artificial Sequence
  Description of Artificial Sequence: Synthetic peptide
  Seed: ESFALPYWNF (TYRP2_HUMAN)
ESFALPYWNW

SEQ ID NO: 182879 - protein, 10 aa, Artificial Sequence
  Description of Artificial Sequence: Synthetic peptide
  Seed: NECDVCTDQL (TYRP2_HUMAN)
NHCDVCTDQI

SEQ ID NO: 182880 - protein, 11 aa, Artificial Sequence
  Description of Artificial Sequence: Synthetic peptide
  Seed: FVVLHSFTDAI (TYRP2_HUMAN)
FFVLHSFTDAI

SEQ ID NO: 182881 - protein, 9 aa, Artificial Sequence
  Description of Artificial Sequence: Synthetic peptide
  Seed: RTCKCTGNF (TYRP2_HUMAN)
RQCKCTGNM

SEQ ID NO: 182882 - protein, 9 aa, Artificial Sequence
  Description of Artificial Sequence: Synthetic peptide
  Seed: LLSCLGCKI (TYRP2_HUMAN)
LQSCLGCKL

SEQ ID NO: 182883 - protein, 9 aa, Artificial Sequence
  Description of Artificial Sequence: Synthetic peptide
  Seed: SLHNLVHSF (TYRP2_HUMAN)
STHNLVHSA

SEQ ID NO: 182884 - protein, 10 aa, Artificial Sequence
  Description of Artificial Sequence: Synthetic peptide
  Seed: NPPFFQNSTF (TYRP2_HUMAN)
NKPFFQNSTY

SEQ ID NO: 182885 - protein, 10 aa, Artificial Sequence
  Description of Artificial Sequence: Synthetic peptide
  Seed: MSPLWWGFLL (TYRP2_HUMAN)
MRPLWWGFLV

SEQ ID NO: 182886 - protein, 9 aa, Artificial Sequence
  Description of Artificial Sequence: Synthetic peptide
  Seed: LVALVGLFV (TYRP2_HUMAN)
LMALVGLFV

SEQ ID NO: 182887 - protein, 11 aa, Artificial Sequence
  Description of Artificial Sequence: Synthetic peptide
  Seed: RELWPRKFFHR (TYRP2_HUMAN)
RILWPRKFFHR

SEQ ID NO: 182888 - protein, 10 aa, Artificial Sequence
  Description of Artificial Sequence: Synthetic peptide
  Seed: RNSRFSSWET (TYRP2_HUMAN)
RRSRFSSWEA

SEQ ID NO: 182889 - protein, 10 aa, Artificial Sequence
  Description of Artificial Sequence: Synthetic peptide
  Seed: RRLRKGYTPL (TYRP2_HUMAN)
RALRKGYTPV

SEQ ID NO: 182890 - protein, 11 aa, Artificial Sequence
  Description of Artificial Sequence: Synthetic peptide
  Seed: RADTRPWSGPY (TYRP2_HUMAN)
RGDTRPWSGPW

SEQ ID NO: 182891 - protein, 8 aa, Artificial Sequence
  Description of Artificial Sequence: Synthetic peptide
  Seed: FSHQGPAF (TYRP2_HUMAN)
FMHQGPAY

SEQ ID NO: 182892 - protein, 9 aa, Artificial Sequence
  Description of Artificial Sequence: Synthetic peptide
  Seed: ETPGWPTTL (TYRP2_HUMAN)
EAPGWPTTR

SEQ ID NO: 182893 - protein, 10 aa, Artificial Sequence
  Description of Artificial Sequence: Synthetic peptide
  Seed: HSFLNGTNAL (TYRP2_HUMAN)
HPFLNGTNAM

SEQ ID NO: 182894 - protein, 9 aa, Artificial Sequence
  Description of Artificial Sequence: Synthetic peptide
  Seed: GTLVALVGL (TYRP2_HUMAN)
GLLVALVGI

SEQ ID NO: 182895 - protein, 8 aa, Artificial Sequence
  Description of Artificial Sequence: Synthetic peptide
  Seed: AIDLPVSV (TYRP2_HUMAN)
ASDLPVSF

SEQ ID NO: 182896 - protein, 9 aa, Artificial Sequence
  Description of Artificial Sequence: Synthetic peptide
  Seed: YVITTQHWL (TYRP2_HUMAN)
YSITTQHWF

SEQ ID NO: 182897 - protein, 11 aa, Artificial Sequence
  Description of Artificial Sequence: Synthetic peptide
  Seed: MYNMVPFFPPV (TYRP2_HUMAN)
MFNMVPFFPPI

SEQ ID NO: 182898 - protein, 10 aa, Artificial Sequence
  Description of Artificial Sequence: Synthetic peptide
  Seed: MGTLVALVGL (TYRP2_HUMAN)
MPTLVALVGV

SEQ ID NO: 182899 - protein, 9 aa, Artificial Sequence
  Description of Artificial Sequence: Synthetic peptide
  Seed: AARPDDPTL (TYRP2_HUMAN)
ATRPDDPTL

SEQ ID NO: 182900 - protein, 10 aa, Artificial Sequence
  Description of Artificial Sequence: Synthetic peptide
  Seed: SLVNKECCPR (TYRP2_HUMAN)
SVVNKECCPR

SEQ ID NO: 182901 - protein, 8 aa, Artificial Sequence
  Description of Artificial Sequence: Synthetic peptide
  Seed: AIDLPVSV (TYRP2_HUMAN)
AMDLPVSV

SEQ ID NO: 182902 - protein, 9 aa, Artificial Sequence
  Description of Artificial Sequence: Synthetic peptide
  Seed: HQGPAFVTW (TYRP2_HUMAN)
HIGPAFVTL

SEQ ID NO: 182903 - protein, 9 aa, Artificial Sequence
  Description of Artificial Sequence: Synthetic peptide
  Seed: AANDPIFVV (TYRP2_HUMAN)
ARNDPIFVM

SEQ ID NO: 182904 - protein, 10 aa, Artificial Sequence
  Description of Artificial Sequence: Synthetic peptide
  Seed: RLRKGYTPLM (TYRP2_HUMAN)
RRRKGYTPLM

SEQ ID NO: 182905 - protein, 11 aa, Artificial Sequence
  Description of Artificial Sequence: Synthetic peptide
  Seed: KADGTLDSQVM (TYRP2_HUMAN)
KVDGTLDSQVL

SEQ ID NO: 182906 - protein, 9 aa, Artificial Sequence
  Description of Artificial Sequence: Synthetic peptide
  Seed: FQNSTFSFR (TYRP2_HUMAN)
FTNSTFSFY

SEQ ID NO: 182907 - protein, 10 aa, Artificial Sequence
  Description of Artificial Sequence: Synthetic peptide
  Seed: NLVHSFLNGT (TYRP2_HUMAN)
NMVHSFLNGA

SEQ ID NO: 182908 - protein, 10 aa, Artificial Sequence
  Description of Artificial Sequence: Synthetic peptide
  Seed: SDQLGYSYAI (TYRP2_HUMAN)
SEQLGYSYAF

SEQ ID NO: 182909 - protein, 9 aa, Artificial Sequence
  Description of Artificial Sequence: Synthetic peptide
  Seed: VVMGTLVAL (TYRP2_HUMAN)
VRMGTLVAY

SEQ ID NO: 182910 - protein, 10 aa, Artificial Sequence
  Description of Artificial Sequence: Synthetic peptide
  Seed: LHYYSVRDTL (TYRP2_HUMAN)
LDYYSVRDTL

SEQ ID NO: 182911 - protein, 10 aa, Artificial Sequence
  Description of Artificial Sequence: Synthetic peptide
  Seed: RLRKGYTPLM (TYRP2_HUMAN)
RSRKGYTPLF

SEQ ID NO: 182912 - protein, 10 aa, Artificial Sequence
  Description of Artificial Sequence: Synthetic peptide
  Seed: VVLHSFTDAI (TYRP2_HUMAN)
VDLHSFTDAL

SEQ ID NO: 182913 - protein, 10 aa, Artificial Sequence
  Description of Artificial Sequence: Synthetic peptide
  Seed: SDQLGYSYAI (TYRP2_HUMAN)
SQQLGYSYAV

SEQ ID NO: 182914 - protein, 9 aa, Artificial Sequence
  Description of Artificial Sequence: Synthetic peptide
  Seed: RDCLSLQKF (TYRP2_HUMAN)
RLCLSLQKF

SEQ ID NO: 182915 - protein, 9 aa, Artificial Sequence
  Description of Artificial Sequence: Synthetic peptide
  Seed: FVLLAFLQY (TYRP2_HUMAN)
FTLLAFLQR

SEQ ID NO: 182916 - protein, 10 aa, Artificial Sequence
  Description of Artificial Sequence: Synthetic peptide
  Seed: ETPGWPTTLL (TYRP2_HUMAN)
ETPGWPTTLK

SEQ ID NO: 182917 - protein, 10 aa, Artificial Sequence
  Description of Artificial Sequence: Synthetic peptide
  Seed: MSPLWWGFLL (TYRP2_HUMAN)
MIPLWWGFLY

SEQ ID NO: 182918 - protein, 10 aa, Artificial Sequence
  Description of Artificial Sequence: Synthetic peptide
  Seed: MSPLWWGFLL (TYRP2_HUMAN)
MQPLWWGFLW

SEQ ID NO: 182919 - protein, 9 aa, Artificial Sequence
  Description of Artificial Sequence: Synthetic peptide
  Seed: FANCSVYDF (TYRP2_HUMAN)
FKNCSVYDY

SEQ ID NO: 182920 - protein, 9 aa, Artificial Sequence
  Description of Artificial Sequence: Synthetic peptide
  Seed: LVALVGLFV (TYRP2_HUMAN)
LIALVGLFV

SEQ ID NO: 182921 - protein, 10 aa, Artificial Sequence
  Description of Artificial Sequence: Synthetic peptide
  Seed: RMYNMVPFFP (TYRP2_HUMAN)
RTYNMVPFFW

SEQ ID NO: 182922 - protein, 9 aa, Artificial Sequence
  Description of Artificial Sequence: Synthetic peptide
  Seed: LAFLQYRRL (TYRP2_HUMAN)
LSFLQYRRW

SEQ ID NO: 182923 - protein, 9 aa, Artificial Sequence
  Description of Artificial Sequence: Synthetic peptide
  Seed: SLDDYNHLV (TYRP2_HUMAN)
SADDYNHLT

SEQ ID NO: 182924 - protein, 9 aa, Artificial Sequence
  Description of Artificial Sequence: Synthetic peptide
  Seed: RLRKGYTPL (TYRP2_HUMAN)
RMRKGYTPV

SEQ ID NO: 182925 - protein, 11 aa, Artificial Sequence
  Description of Artificial Sequence: Synthetic peptide
  Seed: SLDDYNHLVTL (TYRP2_HUMAN)
SWDDYNHLVTL

SEQ ID NO: 182926 - protein, 9 aa, Artificial Sequence
  Description of Artificial Sequence: Synthetic peptide
  Seed: TLDSQVMSL (TYRP2_HUMAN)
TGDSQVMSF

SEQ ID NO: 182927 - protein, 11 aa, Artificial Sequence
  Description of Artificial Sequence: Synthetic peptide
  Seed: TQPQFANCSVY (TYRP2_HUMAN)
TDPQFANCSVM

SEQ ID NO: 182928 - protein, 9 aa, Artificial Sequence
  Description of Artificial Sequence: Synthetic peptide
  Seed: KCTGNFAGY (TYRP2_HUMAN)
KGTGNFAGY

SEQ ID NO: 182929 - protein, 9 aa, Artificial Sequence
  Description of Artificial Sequence: Synthetic peptide
  Seed: ALVGLFVLL (TYRP2_HUMAN)
AAVGLFVLR

SEQ ID NO: 182930 - protein, 10 aa, Artificial Sequence
  Description of Artificial Sequence: Synthetic peptide
  Seed: FVWLHYYSVR (TYRP2_HUMAN)
FQWLHYYSVI

SEQ ID NO: 182931 - protein, 10 aa, Artificial Sequence
  Description of Artificial Sequence: Synthetic peptide
  Seed: KRFNPPADAW (TYRP2_HUMAN)
KTFNPPADAW

SEQ ID NO: 182932 - protein, 9 aa, Artificial Sequence
  Description of Artificial Sequence: Synthetic peptide
  Seed: FFQNSTFSF (TYRP2_HUMAN)
FGQNSTFSW

SEQ ID NO: 182933 - protein, 11 aa, Artificial Sequence
  Description of Artificial Sequence: Synthetic peptide
  Seed: RLIGNESFALP (TYRP2_HUMAN)
RMIGNESFALI

SEQ ID NO: 182934 - protein, 10 aa, Artificial Sequence
  Description of Artificial Sequence: Synthetic peptide
  Seed: EETPGWPTTL (TYRP2_HUMAN)
EHTPGWPTTV

SEQ ID NO: 182935 - protein, 9 aa, Artificial Sequence
  Description of Artificial Sequence: Synthetic peptide
  Seed: AARPDDPTL (TYRP2_HUMAN)
AMRPDDPTF

SEQ ID NO: 182936 - protein, 9 aa, Artificial Sequence
  Description of Artificial Sequence: Synthetic peptide
  Seed: TSDQLGYSY (TYRP2_HUMAN)
TADQLGYSI

SEQ ID NO: 182937 - protein, 10 aa, Artificial Sequence
  Description of Artificial Sequence: Synthetic peptide
  Seed: FFQNSTFSFR (TYRP2_HUMAN)
FHQNSTFSFR

SEQ ID NO: 182938 - protein, 10 aa, Artificial Sequence
  Description of Artificial Sequence: Synthetic peptide
  Seed: RLIGNESFAL (TYRP2_HUMAN)
RQIGNESFAY

SEQ ID NO: 182939 - protein, 9 aa, Artificial Sequence
  Description of Artificial Sequence: Synthetic peptide
  Seed: FANCSVYDF (TYRP2_HUMAN)
FANCSVYDM

SEQ ID NO: 182940 - protein, 9 aa, Artificial Sequence
  Description of Artificial Sequence: Synthetic peptide
  Seed: FFQNSTFSF (TYRP2_HUMAN)
FTQNSTFSL

SEQ ID NO: 182941 - protein, 9 aa, Artificial Sequence
  Description of Artificial Sequence: Synthetic peptide
  Seed: NRMYNMVPF (TYRP2_HUMAN)
NLMYNMVPF

SEQ ID NO: 182942 - protein, 9 aa, Artificial Sequence
  Description of Artificial Sequence: Synthetic peptide
  Seed: NRMYNMVPF (TYRP2_HUMAN)
NYMYNMVPL

SEQ ID NO: 182943 - protein, 11 aa, Artificial Sequence
  Description of Artificial Sequence: Synthetic peptide
  Seed: CDSLDDYNHLV (TYRP2_HUMAN)
CYSLDDYNHLV

SEQ ID NO: 182944 - protein, 10 aa, Artificial Sequence
  Description of Artificial Sequence: Synthetic peptide
  Seed: YSYAIDLPVS (TYRP2_HUMAN)
YIYAIDLPVV

SEQ ID NO: 182945 - protein, 9 aa, Artificial Sequence
  Description of Artificial Sequence: Synthetic peptide
  Seed: LHSFTDAIF (TYRP2_HUMAN)
LSSFTDAIF

SEQ ID NO: 182946 - protein, 9 aa, Artificial Sequence
  Description of Artificial Sequence: Synthetic peptide
  Seed: IGHNRMYNM (TYRP2_HUMAN)
IAHNRMYNY

SEQ ID NO: 182947 - protein, 10 aa, Artificial Sequence
  Description of Artificial Sequence: Synthetic peptide
  Seed: YNMVPFFPPV (TYRP2_HUMAN)
YIMVPFFPPI

SEQ ID NO: 182948 - protein, 9 aa, Artificial Sequence
  Description of Artificial Sequence: Synthetic peptide
  Seed: ELWPRKFFH (TYRP2_HUMAN)
ENWPRKFFR

SEQ ID NO: 182949 - protein, 9 aa, Artificial Sequence
  Description of Artificial Sequence: Synthetic peptide
  Seed: YVITTQHWL (TYRP2_HUMAN)
YSITTQHWV

SEQ ID NO: 182950 - protein, 10 aa, Artificial Sequence
  Description of Artificial Sequence: Synthetic peptide
  Seed: IDFSHQGPAF (TYRP2_HUMAN)
IEFSHQGPAL

SEQ ID NO: 182951 - protein, 9 aa, Artificial Sequence
  Description of Artificial Sequence: Synthetic peptide
  Seed: HYYSVRDTL (TYRP2_HUMAN)
HFYSVRDTW

SEQ ID NO: 182952 - protein, 10 aa, Artificial Sequence
  Description of Artificial Sequence: Synthetic peptide
  Seed: FFPPVTNEEL (TYRP2_HUMAN)
FAPPVTNEEI

SEQ ID NO: 182953 - protein, 9 aa, Artificial Sequence
  Description of Artificial Sequence: Synthetic peptide
  Seed: GTYEGLLRR (TYRP2_HUMAN)
GTYEGLLRM

SEQ ID NO: 182954 - protein, 10 aa, Artificial Sequence
  Description of Artificial Sequence: Synthetic peptide
  Seed: KADGTLDSQV (TYRP2_HUMAN)
KADGTLDSQL

SEQ ID NO: 182955 - protein, 10 aa, Artificial Sequence
  Description of Artificial Sequence: Synthetic peptide
  Seed: RLIGNESFAL (TYRP2_HUMAN)
RKIGNESFAY

SEQ ID NO: 182956 - protein, 10 aa, Artificial Sequence
  Description of Artificial Sequence: Synthetic peptide
  Seed: SLQKFDNPPF (TYRP2_HUMAN)
SNQKFDNPPF

SEQ ID NO: 182957 - protein, 9 aa, Artificial Sequence
  Description of Artificial Sequence: Synthetic peptide
  Seed: ALDLAKKRV (TYRP2_HUMAN)
AVDLAKKRL

SEQ ID NO: 182958 - protein, 9 aa, Artificial Sequence
  Description of Artificial Sequence: Synthetic peptide
  Seed: FVLLAFLQY (TYRP2_HUMAN)
FLLLAFLQR

SEQ ID NO: 182959 - protein, 10 aa, Artificial Sequence
  Description of Artificial Sequence: Synthetic peptide
  Seed: FSFRNALEGF (TYRP2_HUMAN)
FMFRNALEGM

SEQ ID NO: 182960 - protein, 11 aa, Artificial Sequence
  Description of Artificial Sequence: Synthetic peptide
  Seed: LISRNSRFSSW (TYRP2_HUMAN)
LTSRNSRFSSF

SEQ ID NO: 182961 - protein, 8 aa, Artificial Sequence
  Description of Artificial Sequence: Synthetic peptide
  Seed: AIDLPVSV (TYRP2_HUMAN)
AVDLPVSF

SEQ ID NO: 182962 - protein, 9 aa, Artificial Sequence
  Description of Artificial Sequence: Synthetic peptide
  Seed: ANDPIFVVL (TYRP2_HUMAN)
AADPIFVVV

SEQ ID NO: 182963 - protein, 10 aa, Artificial Sequence
  Description of Artificial Sequence: Synthetic peptide
  Seed: AARPDDPTLI (TYRP2_HUMAN)
AARPDDPTLY

SEQ ID NO: 182964 - protein, 9 aa, Artificial Sequence
  Description of Artificial Sequence: Synthetic peptide
  Seed: SWETVCDSL (TYRP2_HUMAN)
SWETVCDSF

SEQ ID NO: 182965 - protein, 9 aa, Artificial Sequence
  Description of Artificial Sequence: Synthetic peptide
  Seed: FSHQGPAFV (TYRP2_HUMAN)
FVHQGPAFW

SEQ ID NO: 182966 - protein, 9 aa, Artificial Sequence
  Description of Artificial Sequence: Synthetic peptide
  Seed: QKFDNPPFF (TYRP2_HUMAN)
QQFDNPPFL

SEQ ID NO: 182967 - protein, 11 aa, Artificial Sequence
  Description of Artificial Sequence: Synthetic peptide
  Seed: WLHYYSVRDTL (TYRP2_HUMAN)
WTHYYSVRDTF

SEQ ID NO: 182968 - protein, 9 aa, Artificial Sequence
  Description of Artificial Sequence: Synthetic peptide
  Seed: SLHNLVHSF (TYRP2_HUMAN)
SLHNLVHSL

SEQ ID NO: 182969 - protein, 10 aa, Artificial Sequence
  Description of Artificial Sequence: Synthetic peptide
  Seed: QPQFANCSVY (TYRP2_HUMAN)
QRQFANCSVF

SEQ ID NO: 182970 - protein, 10 aa, Artificial Sequence
  Description of Artificial Sequence: Synthetic peptide
  Seed: CCPRLGAESA (TYRP2_HUMAN)
CFPRLGAESM

SEQ ID NO: 182971 - protein, 10 aa, Artificial Sequence
  Description of Artificial Sequence: Synthetic peptide
  Seed: MSPLWWGFLL (TYRP2_HUMAN)
MDPLWWGFLV

SEQ ID NO: 182972 - protein, 10 aa, Artificial Sequence
  Description of Artificial Sequence: Synthetic peptide
  Seed: YAIDLPVSVE (TYRP2_HUMAN)
YLIDLPVSVR

SEQ ID NO: 182973 - protein, 9 aa, Artificial Sequence
  Description of Artificial Sequence: Synthetic peptide
  Seed: FANCSVYDF (TYRP2_HUMAN)
FMNCSVYDY

SEQ ID NO: 182974 - protein, 9 aa, Artificial Sequence
  Description of Artificial Sequence: Synthetic peptide
  Seed: SLHNLVHSF (TYRP2_HUMAN)
SIHNLVHSF

SEQ ID NO: 182975 - protein, 9 aa, Artificial Sequence
  Description of Artificial Sequence: Synthetic peptide
  Seed: RNQDDRELW (TYRP2_HUMAN)
RTQDDRELW

SEQ ID NO: 182976 - protein, 10 aa, Artificial Sequence
  Description of Artificial Sequence: Synthetic peptide
  Seed: RNSRFSSWET (TYRP2_HUMAN)
RFSRFSSWEL

SEQ ID NO: 182977 - protein, 9 aa, Artificial Sequence
  Description of Artificial Sequence: Synthetic peptide
  Seed: LQKFDNPPF (TYRP2_HUMAN)
LRKFDNPPY

SEQ ID NO: 182978 - protein, 10 aa, Artificial Sequence
  Description of Artificial Sequence: Synthetic peptide
  Seed: FVLLAFLQYR (TYRP2_HUMAN)
FNLLAFLQYR

SEQ ID NO: 182979 - protein, 10 aa, Artificial Sequence
  Description of Artificial Sequence: Synthetic peptide
  Seed: VGLFVLLAFL (TYRP2_HUMAN)
VLLFVLLAFL

SEQ ID NO: 182980 - protein, 10 aa, Artificial Sequence
  Description of Artificial Sequence: Synthetic peptide
  Seed: MSLHNLVHSF (TYRP2_HUMAN)
MTLHNLVHSF

SEQ ID NO: 182981 - protein, 10 aa, Artificial Sequence
  Description of Artificial Sequence: Synthetic peptide
  Seed: FFQNSTFSFR (TYRP2_HUMAN)
FGQNSTFSFR

SEQ ID NO: 182982 - protein, 10 aa, Artificial Sequence
  Description of Artificial Sequence: Synthetic peptide
  Seed: FFQNSTFSFR (TYRP2_HUMAN)
FNQNSTFSFR

SEQ ID NO: 182983 - protein, 9 aa, Artificial Sequence
  Description of Artificial Sequence: Synthetic peptide
  Seed: YSYAIDLPV (TYRP2_HUMAN)
YEYAIDLPF

SEQ ID NO: 182984 - protein, 8 aa, Artificial Sequence
  Description of Artificial Sequence: Synthetic peptide
  Seed: RLIGNESF (TYRP2_HUMAN)
RQIGNESM

SEQ ID NO: 182985 - protein, 10 aa, Artificial Sequence
  Description of Artificial Sequence: Synthetic peptide
  Seed: RRLRKGYTPL (TYRP2_HUMAN)
RQLRKGYTPL

SEQ ID NO: 182986 - protein, 9 aa, Artificial Sequence
  Description of Artificial Sequence: Synthetic peptide
  Seed: SFLNGTNAL (TYRP2_HUMAN)
SFLNGTNAI

SEQ ID NO: 182987 - protein, 10 aa, Artificial Sequence
  Description of Artificial Sequence: Synthetic peptide
  Seed: QPQFANCSVY (TYRP2_HUMAN)
QLQFANCSVW

SEQ ID NO: 182988 - protein, 9 aa, Artificial Sequence
  Description of Artificial Sequence: Synthetic peptide
  Seed: LSPQEREQF (TYRP2_HUMAN)
LAPQEREQY

SEQ ID NO: 182989 - protein, 9 aa, Artificial Sequence
  Description of Artificial Sequence: Synthetic peptide
  Seed: RMYNMVPFF (TYRP2_HUMAN)
RTYNMVPFC

SEQ ID NO: 182990 - protein, 9 aa, Artificial Sequence
  Description of Artificial Sequence: Synthetic peptide
  Seed: AANDPIFVV (TYRP2_HUMAN)
AFNDPIFVM

SEQ ID NO: 182991 - protein, 9 aa, Artificial Sequence
  Description of Artificial Sequence: Synthetic peptide
  Seed: AANDPIFVV (TYRP2_HUMAN)
AMNDPIFVV

SEQ ID NO: 182992 - protein, 10 aa, Artificial Sequence
  Description of Artificial Sequence: Synthetic peptide
  Seed: RLIGNESFAL (TYRP2_HUMAN)
RAIGNESFAY

SEQ ID NO: 182993 - protein, 9 aa, Artificial Sequence
  Description of Artificial Sequence: Synthetic peptide
  Seed: APIGHNRMY (TYRP2_HUMAN)
AQIGHNRMF

SEQ ID NO: 182994 - protein, 9 aa, Artificial Sequence
  Description of Artificial Sequence: Synthetic peptide
  Seed: FSHQGPAFV (TYRP2_HUMAN)
FRHQGPAFF

SEQ ID NO: 182995 - protein, 10 aa, Artificial Sequence
  Description of Artificial Sequence: Synthetic peptide
  Seed: REQFLGALDL (TYRP2_HUMAN)
RDQFLGALDY

SEQ ID NO: 182996 - protein, 10 aa, Artificial Sequence
  Description of Artificial Sequence: Synthetic peptide
  Seed: SAANDPIFVV (TYRP2_HUMAN)
SVANDPIFVI

SEQ ID NO: 182997 - protein, 9 aa, Artificial Sequence
  Description of Artificial Sequence: Synthetic peptide
  Seed: YYSVRDTLL (TYRP2_HUMAN)
YFSVRDTLY

SEQ ID NO: 182998 - protein, 11 aa, Artificial Sequence
  Description of Artificial Sequence: Synthetic peptide
  Seed: RNSRFSSWETV (TYRP2_HUMAN)
RESRFSSWETL

SEQ ID NO: 182999 - protein, 10 aa, Artificial Sequence
  Description of Artificial Sequence: Synthetic peptide
  Seed: GNESFALPYW (TYRP2_HUMAN)
GKESFALPYW

SEQ ID NO: 183000 - protein, 10 aa, Artificial Sequence
  Description of Artificial Sequence: Synthetic peptide
  Seed: RLIGNESFAL (TYRP2_HUMAN)
RTIGNESFAV

SEQ ID NO: 183001 - protein, 9 aa, Artificial Sequence
  Description of Artificial Sequence: Synthetic peptide
  Seed: FANCSVYDF (TYRP2_HUMAN)
FMNCSVYDW

SEQ ID NO: 183002 - protein, 10 aa, Artificial Sequence
  Description of Artificial Sequence: Synthetic peptide
  Seed: YDFFVWLHYY (TYRP2_HUMAN)
YTFFVWLHYH

SEQ ID NO: 183003 - protein, 9 aa, Artificial Sequence
  Description of Artificial Sequence: Synthetic peptide
  Seed: NMVPFFPPV (TYRP2_HUMAN)
NSVPFFPPA

SEQ ID NO: 183004 - protein, 9 aa, Artificial Sequence
  Description of Artificial Sequence: Synthetic peptide
  Seed: ETPGWPTTL (TYRP2_HUMAN)
ESPGWPTTM

SEQ ID NO: 183005 - protein, 10 aa, Artificial Sequence
  Description of Artificial Sequence: Synthetic peptide
  Seed: RNSRFSSWET (TYRP2_HUMAN)
RHSRFSSWEL

SEQ ID NO: 183006 - protein, 9 aa, Artificial Sequence
  Description of Artificial Sequence: Synthetic peptide
  Seed: VLHSFTDAI (TYRP2_HUMAN)
VHHSFTDAF

SEQ ID NO: 183007 - protein, 8 aa, Artificial Sequence
  Description of Artificial Sequence: Synthetic peptide
  Seed: RPDDPTLI (TYRP2_HUMAN)
RWDDPTLL

SEQ ID NO: 183008 - protein, 9 aa, Artificial Sequence
  Description of Artificial Sequence: Synthetic peptide
  Seed: VLLAFLQYR (TYRP2_HUMAN)
VLLAFLQYK

SEQ ID NO: 183009 - protein, 10 aa, Artificial Sequence
  Description of Artificial Sequence: Synthetic peptide
  Seed: YNMVPFFPPV (TYRP2_HUMAN)
YAMVPFFPPL

SEQ ID NO: 183010 - protein, 10 aa, Artificial Sequence
  Description of Artificial Sequence: Synthetic peptide
  Seed: SDQLGYSYAI (TYRP2_HUMAN)
SNQLGYSYAL

SEQ ID NO: 183011 - protein, 10 aa, Artificial Sequence
  Description of Artificial Sequence: Synthetic peptide
  Seed: LHYYSVRDTL (TYRP2_HUMAN)
LRYYSVRDTI

SEQ ID NO: 183012 - protein, 9 aa, Artificial Sequence
  Description of Artificial Sequence: Synthetic peptide
  Seed: AIFDEWMKR (TYRP2_HUMAN)
ASFDEWMKY

SEQ ID NO: 183013 - protein, 9 aa, Artificial Sequence
  Description of Artificial Sequence: Synthetic peptide
  Seed: RQNIHSLSP (TYRP2_HUMAN)
RTNIHSLSY

SEQ ID NO: 183014 - protein, 10 aa, Artificial Sequence
  Description of Artificial Sequence: Synthetic peptide
  Seed: YNMVPFFPPV (TYRP2_HUMAN)
YEMVPFFPPM

SEQ ID NO: 183015 - protein, 11 aa, Artificial Sequence
  Description of Artificial Sequence: Synthetic peptide
  Seed: HPDYVITTQHW (TYRP2_HUMAN)
HTDYVITTQHF

SEQ ID NO: 183016 - protein, 11 aa, Artificial Sequence
  Description of Artificial Sequence: Synthetic peptide
  Seed: RLIGNESFALP (TYRP2_HUMAN)
RMIGNESFALM

SEQ ID NO: 183017 - protein, 9 aa, Artificial Sequence
  Description of Artificial Sequence: Synthetic peptide
  Seed: QVMSLHNLV (TYRP2_HUMAN)
QTMSLHNLR

SEQ ID NO: 183018 - protein, 11 aa, Artificial Sequence
  Description of Artificial Sequence: Synthetic peptide
  Seed: YNMVPFFPPVT (TYRP2_HUMAN)
YLMVPFFPPVR

SEQ ID NO: 183019 - protein, 11 aa, Artificial Sequence
  Description of Artificial Sequence: Synthetic peptide
  Seed: FVVLHSFTDAI (TYRP2_HUMAN)
FKVLHSFTDAI

SEQ ID NO: 183020 - protein, 9 aa, Artificial Sequence
  Description of Artificial Sequence: Synthetic peptide
  Seed: FFPPVTNEE (TYRP2_HUMAN)
FLPPVTNEF

SEQ ID NO: 183021 - protein, 10 aa, Artificial Sequence
  Description of Artificial Sequence: Synthetic peptide
  Seed: RNQMGRNSMK (TYRP2_HUMAN)
RVQMGRNSMK

SEQ ID NO: 183022 - protein, 10 aa, Artificial Sequence
  Description of Artificial Sequence: Synthetic peptide
  Seed: YNMVPFFPPV (TYRP2_HUMAN)
YSMVPFFPPA

SEQ ID NO: 183023 - protein, 9 aa, Artificial Sequence
  Description of Artificial Sequence: Synthetic peptide
  Seed: FVLLAFLQY (TYRP2_HUMAN)
FPLLAFLQY

SEQ ID NO: 183024 - protein, 10 aa, Artificial Sequence
  Description of Artificial Sequence: Synthetic peptide
  Seed: MSPLWWGFLL (TYRP2_HUMAN)
MFPLWWGFLV

SEQ ID NO: 183025 - protein, 9 aa, Artificial Sequence
  Description of Artificial Sequence: Synthetic peptide
  Seed: SQVMSLHNL (TYRP2_HUMAN)
SLVMSLHNV

SEQ ID NO: 183026 - protein, 9 aa, Artificial Sequence
  Description of Artificial Sequence: Synthetic peptide
  Seed: LRKGYTPLM (TYRP2_HUMAN)
LMKGYTPLM

SEQ ID NO: 183027 - protein, 9 aa, Artificial Sequence
  Description of Artificial Sequence: Synthetic peptide
  Seed: LVHSFLNGT (TYRP2_HUMAN)
LIHSFLNGI

SEQ ID NO: 183028 - protein, 9 aa, Artificial Sequence
  Description of Artificial Sequence: Synthetic peptide
  Seed: FVLLAFLQY (TYRP2_HUMAN)
FGLLAFLQY

SEQ ID NO: 183029 - protein, 10 aa, Artificial Sequence
  Description of Artificial Sequence: Synthetic peptide
  Seed: HNRMYNMVPF (TYRP2_HUMAN)
HSRMYNMVPM

SEQ ID NO: 183030 - protein, 9 aa, Artificial Sequence
  Description of Artificial Sequence: Synthetic peptide
  Seed: SFRNALEGF (TYRP2_HUMAN)
SYRNALEGY

SEQ ID NO: 183031 - protein, 10 aa, Artificial Sequence
  Description of Artificial Sequence: Synthetic peptide
  Seed: TSDQLGYSYA (TYRP2_HUMAN)
TLDQLGYSYY

SEQ ID NO: 183032 - protein, 10 aa, Artificial Sequence
  Description of Artificial Sequence: Synthetic peptide
  Seed: QFANCSVYDF (TYRP2_HUMAN)
QFANCSVYDY

SEQ ID NO: 183033 - protein, 11 aa, Artificial Sequence
  Description of Artificial Sequence: Synthetic peptide
  Seed: SLDDYNHLVTL (TYRP2_HUMAN)
SWDDYNHLVTM

SEQ ID NO: 183034 - protein, 10 aa, Artificial Sequence
  Description of Artificial Sequence: Synthetic peptide
  Seed: LGPNGTQPQF (TYRP2_HUMAN)
LAPNGTQPQL

SEQ ID NO: 183035 - protein, 10 aa, Artificial Sequence
  Description of Artificial Sequence: Synthetic peptide
  Seed: QFANCSVYDF (TYRP2_HUMAN)
QMANCSVYDY

SEQ ID NO: 183036 - protein, 9 aa, Artificial Sequence
  Description of Artificial Sequence: Synthetic peptide
  Seed: SFLNGTNAL (TYRP2_HUMAN)
SYLNGTNAF

SEQ ID NO: 183037 - protein, 8 aa, Artificial Sequence
  Description of Artificial Sequence: Synthetic peptide
  Seed: NESFALPY (TYRP2_HUMAN)
NESFALPF

SEQ ID NO: 183038 - protein, 9 aa, Artificial Sequence
  Description of Artificial Sequence: Synthetic peptide
  Seed: RNQDDRELW (TYRP2_HUMAN)
RQQDDRELI

SEQ ID NO: 183039 - protein, 9 aa, Artificial Sequence
  Description of Artificial Sequence: Synthetic peptide
  Seed: FFQNSTFSF (TYRP2_HUMAN)
FVQNSTFSF

SEQ ID NO: 183040 - protein, 9 aa, Artificial Sequence
  Description of Artificial Sequence: Synthetic peptide
  Seed: IFDEWMKRF (TYRP2_HUMAN)
IYDEWMKRL

SEQ ID NO: 183041 - protein, 9 aa, Artificial Sequence
  Description of Artificial Sequence: Synthetic peptide
  Seed: FANCSVYDF (TYRP2_HUMAN)
FPNCSVYDI

SEQ ID NO: 183042 - protein, 11 aa, Artificial Sequence
  Description of Artificial Sequence: Synthetic peptide
  Seed: MYNMVPFFPPV (TYRP2_HUMAN)
MGNMVPFFPPL

SEQ ID NO: 183043 - protein, 11 aa, Artificial Sequence
  Description of Artificial Sequence: Synthetic peptide
  Seed: MSLHNLVHSFL (TYRP2_HUMAN)
MYLHNLVHSFV

SEQ ID NO: 183044 - protein, 10 aa, Artificial Sequence
  Description of Artificial Sequence: Synthetic peptide
  Seed: LGPNGTQPQF (TYRP2_HUMAN)
LTPNGTQPQW

SEQ ID NO: 183045 - protein, 10 aa, Artificial Sequence
  Description of Artificial Sequence: Synthetic peptide
  Seed: RMYNMVPFFP (TYRP2_HUMAN)
RQYNMVPFFT

SEQ ID NO: 183046 - protein, 10 aa, Artificial Sequence
  Description of Artificial Sequence: Synthetic peptide
  Seed: RNSRFSSWET (TYRP2_HUMAN)
RESRFSSWEL

SEQ ID NO: 183047 - protein, 9 aa, Artificial Sequence
  Description of Artificial Sequence: Synthetic peptide
  Seed: DQLGYSYAI (TYRP2_HUMAN)
DRLGYSYAL

SEQ ID NO: 183048 - protein, 9 aa, Artificial Sequence
  Description of Artificial Sequence: Synthetic peptide
  Seed: YSYAIDLPV (TYRP2_HUMAN)
YMYAIDLPT

SEQ ID NO: 183049 - protein, 10 aa, Artificial Sequence
  Description of Artificial Sequence: Synthetic peptide
  Seed: MSPLWWGFLL (TYRP2_HUMAN)
MCPLWWGFLY

SEQ ID NO: 183050 - protein, 11 aa, Artificial Sequence
  Description of Artificial Sequence: Synthetic peptide
  Seed: YSYAIDLPVSV (TYRP2_HUMAN)
YQYAIDLPVSI

SEQ ID NO: 183051 - protein, 11 aa, Artificial Sequence
  Description of Artificial Sequence: Synthetic peptide
  Seed: SLDDYNHLVTL (TYRP2_HUMAN)
SADDYNHLVTL

SEQ ID NO: 183052 - protein, 10 aa, Artificial Sequence
  Description of Artificial Sequence: Synthetic peptide
  Seed: VVLHSFTDAI (TYRP2_HUMAN)
VELHSFTDAL

SEQ ID NO: 183053 - protein, 11 aa, Artificial Sequence
  Description of Artificial Sequence: Synthetic peptide
  Seed: YNMVPFFPPVT (TYRP2_HUMAN)
YVMVPFFPPVW

SEQ ID NO: 183054 - protein, 9 aa, Artificial Sequence
  Description of Artificial Sequence: Synthetic peptide
  Seed: TSDQLGYSY (TYRP2_HUMAN)
TIDQLGYSI

SEQ ID NO: 183055 - protein, 10 aa, Artificial Sequence
  Description of Artificial Sequence: Synthetic peptide
  Seed: LAPIGHNRMY (TYRP2_HUMAN)
LSPIGHNRMF

SEQ ID NO: 183056 - protein, 10 aa, Artificial Sequence
  Description of Artificial Sequence: Synthetic peptide
  Seed: WPTTLLVVMG (TYRP2_HUMAN)
WPTTLLVVMY

SEQ ID NO: 183057 - protein, 9 aa, Artificial Sequence
  Description of Artificial Sequence: Synthetic peptide
  Seed: YAIDLPVSV (TYRP2_HUMAN)
YLIDLPVSS

SEQ ID NO: 183058 - protein, 10 aa, Artificial Sequence
  Description of Artificial Sequence: Synthetic peptide
  Seed: AIFDEWMKRF (TYRP2_HUMAN)
ACFDEWMKRW

SEQ ID NO: 183059 - protein, 9 aa, Artificial Sequence
  Description of Artificial Sequence: Synthetic peptide
  Seed: IFDEWMKRF (TYRP2_HUMAN)
ISDEWMKRL

SEQ ID NO: 183060 - protein, 9 aa, Artificial Sequence
  Description of Artificial Sequence: Synthetic peptide
  Seed: VHPDYVITT (TYRP2_HUMAN)
VHPDYVITF

SEQ ID NO: 183061 - protein, 11 aa, Artificial Sequence
  Description of Artificial Sequence: Synthetic peptide
  Seed: VHSFLNGTNAL (TYRP2_HUMAN)
VYSFLNGTNAF

SEQ ID NO: 183062 - protein, 9 aa, Artificial Sequence
  Description of Artificial Sequence: Synthetic peptide
  Seed: RKFFHRTCK (TYRP2_HUMAN)
RMFFHRTCR

SEQ ID NO: 183063 - protein, 10 aa, Artificial Sequence
  Description of Artificial Sequence: Synthetic peptide
  Seed: DTLLGPGRPY (TYRP2_HUMAN)
DVLLGPGRPK

SEQ ID NO: 183064 - protein, 10 aa, Artificial Sequence
  Description of Artificial Sequence: Synthetic peptide
  Seed: VVLHSFTDAI (TYRP2_HUMAN)
VFLHSFTDAL

SEQ ID NO: 183065 - protein, 10 aa, Artificial Sequence
  Description of Artificial Sequence: Synthetic peptide
  Seed: HNRMYNMVPF (TYRP2_HUMAN)
HHRMYNMVPF

SEQ ID NO: 183066 - protein, 9 aa, Artificial Sequence
  Description of Artificial Sequence: Synthetic peptide
  Seed: WPTTLLVVM (TYRP2_HUMAN)
WATTLLVVY

SEQ ID NO: 183067 - protein, 10 aa, Artificial Sequence
  Description of Artificial Sequence: Synthetic peptide
  Seed: HSFLNGTNAL (TYRP2_HUMAN)
HYFLNGTNAM

SEQ ID NO: 183068 - protein, 9 aa, Artificial Sequence
  Description of Artificial Sequence: Synthetic peptide
  Seed: RNQMGRNSM (TYRP2_HUMAN)
RAQMGRNSY

SEQ ID NO: 183069 - protein, 8 aa, Artificial Sequence
  Description of Artificial Sequence: Synthetic peptide
  Seed: ADAWPQEL (TYRP2_HUMAN)
AEAWPQEL

SEQ ID NO: 183070 - protein, 9 aa, Artificial Sequence
  Description of Artificial Sequence: Synthetic peptide
  Seed: KCTGNFAGY (TYRP2_HUMAN)
KFTGNFAGY

SEQ ID NO: 183071 - protein, 11 aa, Artificial Sequence
  Description of Artificial Sequence: Synthetic peptide
  Seed: RADTRPWSGPY (TYRP2_HUMAN)
RMDTRPWSGPW

SEQ ID NO: 183072 - protein, 10 aa, Artificial Sequence
  Description of Artificial Sequence: Synthetic peptide
  Seed: AANDPIFVVL (TYRP2_HUMAN)
ALNDPIFVVI

SEQ ID NO: 183073 - protein, 8 aa, Artificial Sequence
  Description of Artificial Sequence: Synthetic peptide
  Seed: AIDLPVSV (TYRP2_HUMAN)
ALDLPVSV

SEQ ID NO: 183074 - protein, 10 aa, Artificial Sequence
  Description of Artificial Sequence: Synthetic peptide
  Seed: NSRFSSWETV (TYRP2_HUMAN)
NVRFSSWETV

SEQ ID NO: 183075 - protein, 9 aa, Artificial Sequence
  Description of Artificial Sequence: Synthetic peptide
  Seed: YSYAIDLPV (TYRP2_HUMAN)
YRYAIDLPW

SEQ ID NO: 183076 - protein, 9 aa, Artificial Sequence
  Description of Artificial Sequence: Synthetic peptide
  Seed: VHPDYVITT (TYRP2_HUMAN)
VGPDYVITL

SEQ ID NO: 183077 - protein, 10 aa, Artificial Sequence
  Description of Artificial Sequence: Synthetic peptide
  Seed: RNSMKLPTLK (TYRP2_HUMAN)
RNSMKLPTLR

SEQ ID NO: 183078 - protein, 10 aa, Artificial Sequence
  Description of Artificial Sequence: Synthetic peptide
  Seed: RNQMGRNSMK (TYRP2_HUMAN)
RTQMGRNSMK

SEQ ID NO: 183079 - protein, 9 aa, Artificial Sequence
  Description of Artificial Sequence: Synthetic peptide
  Seed: SAANDPIFV (TYRP2_HUMAN)
SAANDPIFY

SEQ ID NO: 183080 - protein, 10 aa, Artificial Sequence
  Description of Artificial Sequence: Synthetic peptide
  Seed: FLLSCLGCKI (TYRP2_HUMAN)
FTLSCLGCKL

SEQ ID NO: 183081 - protein, 9 aa, Artificial Sequence
  Description of Artificial Sequence: Synthetic peptide
  Seed: TNALPHSAA (TYRP2_HUMAN)
THALPHSAA

SEQ ID NO: 183082 - protein, 11 aa, Artificial Sequence
  Description of Artificial Sequence: Synthetic peptide
  Seed: RLIGNESFALP (TYRP2_HUMAN)
RLIGNESFALA

SEQ ID NO: 183083 - protein, 11 aa, Artificial Sequence
  Description of Artificial Sequence: Synthetic peptide
  Seed: QPQFANCSVYD (TYRP2_HUMAN)
QRQFANCSVYY

SEQ ID NO: 183084 - protein, 9 aa, Artificial Sequence
  Description of Artificial Sequence: Synthetic peptide
  Seed: YSYAIDLPV (TYRP2_HUMAN)
YVYAIDLPA

SEQ ID NO: 183085 - protein, 10 aa, Artificial Sequence
  Description of Artificial Sequence: Synthetic peptide
  Seed: YNMVPFFPPV (TYRP2_HUMAN)
YMMVPFFPPA

SEQ ID NO: 183086 - protein, 10 aa, Artificial Sequence
  Description of Artificial Sequence: Synthetic peptide
  Seed: YDFFVWLHYY (TYRP2_HUMAN)
YWFFVWLHYM

SEQ ID NO: 183087 - protein, 8 aa, Artificial Sequence
  Description of Artificial Sequence: Synthetic peptide
  Seed: FLNGTNAL (TYRP2_HUMAN)
FYNGTNAI

SEQ ID NO: 183088 - protein, 10 aa, Artificial Sequence
  Description of Artificial Sequence: Synthetic peptide
  Seed: LLAFLQYRRL (TYRP2_HUMAN)
LLAFLQYRRI

SEQ ID NO: 183089 - protein, 9 aa, Artificial Sequence
  Description of Artificial Sequence: Synthetic peptide
  Seed: SPLWWGFLL (TYRP2_HUMAN)
SPLWWGFLM

SEQ ID NO: 183090 - protein, 9 aa, Artificial Sequence
  Description of Artificial Sequence: Synthetic peptide
  Seed: YAIDLPVSV (TYRP2_HUMAN)
YNIDLPVSL

SEQ ID NO: 183091 - protein, 10 aa, Artificial Sequence
  Description of Artificial Sequence: Synthetic peptide
  Seed: GYSYAIDLPV (TYRP2_HUMAN)
GLSYAIDLPV

SEQ ID NO: 183092 - protein, 10 aa, Artificial Sequence
  Description of Artificial Sequence: Synthetic peptide
  Seed: LHYYSVRDTL (TYRP2_HUMAN)
LKYYSVRDTF

SEQ ID NO: 183093 - protein, 9 aa, Artificial Sequence
  Description of Artificial Sequence: Synthetic peptide
  Seed: CSVYDFFVW (TYRP2_HUMAN)
CAVYDFFVW

SEQ ID NO: 183094 - protein, 9 aa, Artificial Sequence
  Description of Artificial Sequence: Synthetic peptide
  Seed: YAIDLPVSV (TYRP2_HUMAN)
YGIDLPVSY

SEQ ID NO: 183095 - protein, 9 aa, Artificial Sequence
  Description of Artificial Sequence: Synthetic peptide
  Seed: FPPVTNEEL (TYRP2_HUMAN)
FAPVTNEEW

SEQ ID NO: 183096 - protein, 10 aa, Artificial Sequence
  Description of Artificial Sequence: Synthetic peptide
  Seed: CCPRLGAESA (TYRP2_HUMAN)
CDPRLGAESM

SEQ ID NO: 183097 - protein, 9 aa, Artificial Sequence
  Description of Artificial Sequence: Synthetic peptide
  Seed: YAIDLPVSV (TYRP2_HUMAN)
YIIDLPVST

SEQ ID NO: 183098 - protein, 9 aa, Artificial Sequence
  Description of Artificial Sequence: Synthetic peptide
  Seed: STFSFRNAL (TYRP2_HUMAN)
SPFSFRNAF

SEQ ID NO: 183099 - protein, 9 aa, Artificial Sequence
  Description of Artificial Sequence: Synthetic peptide
  Seed: VHPDYVITT (TYRP2_HUMAN)
VTPDYVITL

SEQ ID NO: 183100 - protein, 9 aa, Artificial Sequence
  Description of Artificial Sequence: Synthetic peptide
  Seed: YAIDLPVSV (TYRP2_HUMAN)
YCIDLPVSL

SEQ ID NO: 183101 - protein, 9 aa, Artificial Sequence
  Description of Artificial Sequence: Synthetic peptide
  Seed: AANDPIFVV (TYRP2_HUMAN)
AMNDPIFVC

SEQ ID NO: 183102 - protein, 10 aa, Artificial Sequence
  Description of Artificial Sequence: Synthetic peptide
  Seed: YNMVPFFPPV (TYRP2_HUMAN)
YSMVPFFPPI

SEQ ID NO: 183103 - protein, 9 aa, Artificial Sequence
  Description of Artificial Sequence: Synthetic peptide
  Seed: QRLIGNESF (TYRP2_HUMAN)
QHLIGNESV

SEQ ID NO: 183104 - protein, 8 aa, Artificial Sequence
  Description of Artificial Sequence: Synthetic peptide
  Seed: RPDDPTLI (TYRP2_HUMAN)
RLDDPTLL

SEQ ID NO: 183105 - protein, 11 aa, Artificial Sequence
  Description of Artificial Sequence: Synthetic peptide
  Seed: HPDYVITTQHW (TYRP2_HUMAN)
HIDYVITTQHF

SEQ ID NO: 183106 - protein, 9 aa, Artificial Sequence
  Description of Artificial Sequence: Synthetic peptide
  Seed: DFSHQGPAF (TYRP2_HUMAN)
DMSHQGPAF

SEQ ID NO: 183107 - protein, 10 aa, Artificial Sequence
  Description of Artificial Sequence: Synthetic peptide
  Seed: ELWPRKFFHR (TYRP2_HUMAN)
EAWPRKFFHR

SEQ ID NO: 183108 - protein, 10 aa, Artificial Sequence
  Description of Artificial Sequence: Synthetic peptide
  Seed: LVVMGTLVAL (TYRP2_HUMAN)
LWVMGTLVAI

SEQ ID NO: 183109 - protein, 9 aa, Artificial Sequence
  Description of Artificial Sequence: Synthetic peptide
  Seed: YSYAIDLPV (TYRP2_HUMAN)
YLYAIDLPS

SEQ ID NO: 183110 - protein, 9 aa, Artificial Sequence
  Description of Artificial Sequence: Synthetic peptide
  Seed: LLSCLGCKI (TYRP2_HUMAN)
LMSCLGCKI

SEQ ID NO: 183111 - protein, 11 aa, Artificial Sequence
  Description of Artificial Sequence: Synthetic peptide
  Seed: MYNMVPFFPPV (TYRP2_HUMAN)
MSNMVPFFPPV

SEQ ID NO: 183112 - protein, 9 aa, Artificial Sequence
  Description of Artificial Sequence: Synthetic peptide
  Seed: ETPGWPTTL (TYRP2_HUMAN)
EYPGWPTTF

SEQ ID NO: 183113 - protein, 10 aa, Artificial Sequence
  Description of Artificial Sequence: Synthetic peptide
  Seed: ETPGWPTTLL (TYRP2_HUMAN)
ELPGWPTTLR

SEQ ID NO: 183114 - protein, 9 aa, Artificial Sequence
  Description of Artificial Sequence: Synthetic peptide
  Seed: AARPDDPTL (TYRP2_HUMAN)
AYRPDDPTL

SEQ ID NO: 183115 - protein, 11 aa, Artificial Sequence
  Description of Artificial Sequence: Synthetic peptide
  Seed: LLGPNGTQPQF (TYRP2_HUMAN)
LTGPNGTQPQF

SEQ ID NO: 183116 - protein, 10 aa, Artificial Sequence
  Description of Artificial Sequence: Synthetic peptide
  Seed: RELWPRKFFH (TYRP2_HUMAN)
RALWPRKFFR

SEQ ID NO: 183117 - protein, 11 aa, Artificial Sequence
  Description of Artificial Sequence: Synthetic peptide
  Seed: PFFQNSTFSFR (TYRP2_HUMAN)
PKFQNSTFSFR

SEQ ID NO: 183118 - protein, 10 aa, Artificial Sequence
  Description of Artificial Sequence: Synthetic peptide
  Seed: NQDDRELWPR (TYRP2_HUMAN)
NVDDRELWPY

SEQ ID NO: 183119 - protein, 8 aa, Artificial Sequence
  Description of Artificial Sequence: Synthetic peptide
  Seed: FQNSTFSF (TYRP2_HUMAN)
FTNSTFSF

SEQ ID NO: 183120 - protein, 9 aa, Artificial Sequence
  Description of Artificial Sequence: Synthetic peptide
  Seed: ITTQHWLGL (TYRP2_HUMAN)
IATQHWLGL

SEQ ID NO: 183121 - protein, 10 aa, Artificial Sequence
  Description of Artificial Sequence: Synthetic peptide
  Seed: LVVMGTLVAL (TYRP2_HUMAN)
LQVMGTLVAA

SEQ ID NO: 183122 - protein, 9 aa, Artificial Sequence
  Description of Artificial Sequence: Synthetic peptide
  Seed: RFNPPADAW (TYRP2_HUMAN)
RWNPPADAL

SEQ ID NO: 183123 - protein, 10 aa, Artificial Sequence
  Description of Artificial Sequence: Synthetic peptide
  Seed: TQPQFANCSV (TYRP2_HUMAN)
TIPQFANCSL

SEQ ID NO: 183124 - protein, 9 aa, Artificial Sequence
  Description of Artificial Sequence: Synthetic peptide
  Seed: VVMGTLVAL (TYRP2_HUMAN)
VGMGTLVAM

SEQ ID NO: 183125 - protein, 10 aa, Artificial Sequence
  Description of Artificial Sequence: Synthetic peptide
  Seed: VLLAFLQYRR (TYRP2_HUMAN)
VQLAFLQYRK

SEQ ID NO: 183126 - protein, 10 aa, Artificial Sequence
  Description of Artificial Sequence: Synthetic peptide
  Seed: FVVLHSFTDA (TYRP2_HUMAN)
FHVLHSFTDV

SEQ ID NO: 183127 - protein, 10 aa, Artificial Sequence
  Description of Artificial Sequence: Synthetic peptide
  Seed: FFVWLHYYSV (TYRP2_HUMAN)
FMVWLHYYSM

SEQ ID NO: 183128 - protein, 10 aa, Artificial Sequence
  Description of Artificial Sequence: Synthetic peptide
  Seed: LGPNGTQPQF (TYRP2_HUMAN)
LQPNGTQPQW

SEQ ID NO: 183129 - protein, 9 aa, Artificial Sequence
  Description of Artificial Sequence: Synthetic peptide
  Seed: LQKFDNPPF (TYRP2_HUMAN)
LSKFDNPPY

SEQ ID NO: 183130 - protein, 10 aa, Artificial Sequence
  Description of Artificial Sequence: Synthetic peptide
  Seed: LLAFLQYRRL (TYRP2_HUMAN)
LLAFLQYRRV

SEQ ID NO: 183131 - protein, 10 aa, Artificial Sequence
  Description of Artificial Sequence: Synthetic peptide
  Seed: SDQLGYSYAI (TYRP2_HUMAN)
SLQLGYSYAY

SEQ ID NO: 183132 - protein, 10 aa, Artificial Sequence
  Description of Artificial Sequence: Synthetic peptide
  Seed: LHYYSVRDTL (TYRP2_HUMAN)
LTYYSVRDTI

SEQ ID NO: 183133 - protein, 9 aa, Artificial Sequence
  Description of Artificial Sequence: Synthetic peptide
  Seed: HQGPAFVTW (TYRP2_HUMAN)
HIGPAFVTW

SEQ ID NO: 183134 - protein, 10 aa, Artificial Sequence
  Description of Artificial Sequence: Synthetic peptide
  Seed: LVVMGTLVAL (TYRP2_HUMAN)
LNVMGTLVAL

SEQ ID NO: 183135 - protein, 9 aa, Artificial Sequence
  Description of Artificial Sequence: Synthetic peptide
  Seed: AARPDDPTL (TYRP2_HUMAN)
ATRPDDPTM

SEQ ID NO: 183136 - protein, 8 aa, Artificial Sequence
  Description of Artificial Sequence: Synthetic peptide
  Seed: RPDDPTLI (TYRP2_HUMAN)
RADDPTLF

SEQ ID NO: 183137 - protein, 9 aa, Artificial Sequence
  Description of Artificial Sequence: Synthetic peptide
  Seed: ANDPIFVVL (TYRP2_HUMAN)
AQDPIFVVI

SEQ ID NO: 183138 - protein, 9 aa, Artificial Sequence
  Description of Artificial Sequence: Synthetic peptide
  Seed: YAIDLPVSV (TYRP2_HUMAN)
YDIDLPVSY

SEQ ID NO: 183139 - protein, 11 aa, Artificial Sequence
  Description of Artificial Sequence: Synthetic peptide
  Seed: TQPQFANCSVY (TYRP2_HUMAN)
TLPQFANCSVF

SEQ ID NO: 183140 - protein, 9 aa, Artificial Sequence
  Description of Artificial Sequence: Synthetic peptide
  Seed: GPNGTQPQF (TYRP2_HUMAN)
GPNGTQPQY

SEQ ID NO: 183141 - protein, 9 aa, Artificial Sequence
  Description of Artificial Sequence: Synthetic peptide
  Seed: LLAFLQYRR (TYRP2_HUMAN)
LQAFLQYRR

SEQ ID NO: 183142 - protein, 10 aa, Artificial Sequence
  Description of Artificial Sequence: Synthetic peptide
  Seed: FLTSDQLGYS (TYRP2_HUMAN)
FITSDQLGYI

SEQ ID NO: 183143 - protein, 11 aa, Artificial Sequence
  Description of Artificial Sequence: Synthetic peptide
  Seed: FFPPVTNEELF (TYRP2_HUMAN)
FEPPVTNEELW

SEQ ID NO: 183144 - protein, 9 aa, Artificial Sequence
  Description of Artificial Sequence: Synthetic peptide
  Seed: YSYAIDLPV (TYRP2_HUMAN)
YLYAIDLPI

SEQ ID NO: 183145 - protein, 9 aa, Artificial Sequence
  Description of Artificial Sequence: Synthetic peptide
  Seed: NRMYNMVPF (TYRP2_HUMAN)
NFMYNMVPL

SEQ ID NO: 183146 - protein, 9 aa, Artificial Sequence
  Description of Artificial Sequence: Synthetic peptide
  Seed: VIRQNIHSL (TYRP2_HUMAN)
VQRQNIHSL

SEQ ID NO: 183147 - protein, 11 aa, Artificial Sequence
  Description of Artificial Sequence: Synthetic peptide
  Seed: LISRNSRFSSW (TYRP2_HUMAN)
LASRNSRFSSW

SEQ ID NO: 183148 - protein, 9 aa, Artificial Sequence
  Description of Artificial Sequence: Synthetic peptide
  Seed: FVWLHYYSV (TYRP2_HUMAN)
FGWLHYYSL

SEQ ID NO: 183149 - protein, 11 aa, Artificial Sequence
  Description of Artificial Sequence: Synthetic peptide
  Seed: YTPLMETHLSS (TYRP2_HUMAN)
YMPLMETHLSI

SEQ ID NO: 183150 - protein, 9 aa, Artificial Sequence
  Description of Artificial Sequence: Synthetic peptide
  Seed: VTWHRYHLL (TYRP2_HUMAN)
VTWHRYHLR

SEQ ID NO: 183151 - protein, 9 aa, Artificial Sequence
  Description of Artificial Sequence: Synthetic peptide
  Seed: GAQGQFPRV (TYRP2_HUMAN)
GMQGQFPRI

SEQ ID NO: 183152 - protein, 9 aa, Artificial Sequence
  Description of Artificial Sequence: Synthetic peptide
  Seed: FANCSVYDF (TYRP2_HUMAN)
FFNCSVYDM

SEQ ID NO: 183153 - protein, 9 aa, Artificial Sequence
  Description of Artificial Sequence: Synthetic peptide
  Seed: HQGPAFVTW (TYRP2_HUMAN)
HKGPAFVTY

SEQ ID NO: 183154 - protein, 9 aa, Artificial Sequence
  Description of Artificial Sequence: Synthetic peptide
  Seed: HYYSVRDTL (TYRP2_HUMAN)
HHYSVRDTF

SEQ ID NO: 183155 - protein, 8 aa, Artificial Sequence
  Description of Artificial Sequence: Synthetic peptide
  Seed: NSMKLPTL (TYRP2_HUMAN)
NHMKLPTL

SEQ ID NO: 183156 - protein, 8 aa, Artificial Sequence
  Description of Artificial Sequence: Synthetic peptide
  Seed: RMYNMVPF (TYRP2_HUMAN)
RYYNMVPY

SEQ ID NO: 183157 - protein, 10 aa, Artificial Sequence
  Description of Artificial Sequence: Synthetic peptide
  Seed: TDAIFDEWMK (TYRP2_HUMAN)
TFAIFDEWMK

SEQ ID NO: 183158 - protein, 11 aa, Artificial Sequence
  Description of Artificial Sequence: Synthetic peptide
  Seed: KRVHPDYVITT (TYRP2_HUMAN)
KRVHPDYVITF

SEQ ID NO: 183159 - protein, 9 aa, Artificial Sequence
  Description of Artificial Sequence: Synthetic peptide
  Seed: AARPDDPTL (TYRP2_HUMAN)
AQRPDDPTF

SEQ ID NO: 183160 - protein, 10 aa, Artificial Sequence
  Description of Artificial Sequence: Synthetic peptide
  Seed: MSPLWWGFLL (TYRP2_HUMAN)
MGPLWWGFLA

SEQ ID NO: 183161 - protein, 10 aa, Artificial Sequence
  Description of Artificial Sequence: Synthetic peptide
  Seed: LVVMGTLVAL (TYRP2_HUMAN)
LIVMGTLVAA

SEQ ID NO: 183162 - protein, 10 aa, Artificial Sequence
  Description of Artificial Sequence: Synthetic peptide
  Seed: SPLWWGFLLS (TYRP2_HUMAN)
SKLWWGFLLL

SEQ ID NO: 183163 - protein, 10 aa, Artificial Sequence
  Description of Artificial Sequence: Synthetic peptide
  Seed: YDFFVWLHYY (TYRP2_HUMAN)
YFFFVWLHYV

SEQ ID NO: 183164 - protein, 10 aa, Artificial Sequence
  Description of Artificial Sequence: Synthetic peptide
  Seed: KRFNPPADAW (TYRP2_HUMAN)
KEFNPPADAF

SEQ ID NO: 183165 - protein, 9 aa, Artificial Sequence
  Description of Artificial Sequence: Synthetic peptide
  Seed: RLRKGYTPL (TYRP2_HUMAN)
RFRKGYTPG

SEQ ID NO: 183166 - protein, 9 aa, Artificial Sequence
  Description of Artificial Sequence: Synthetic peptide
  Seed: SLDDYNHLV (TYRP2_HUMAN)
SMDDYNHLA

SEQ ID NO: 183167 - protein, 9 aa, Artificial Sequence
  Description of Artificial Sequence: Synthetic peptide
  Seed: TLVALVGLF (TYRP2_HUMAN)
TYVALVGLY

SEQ ID NO: 183168 - protein, 10 aa, Artificial Sequence
  Description of Artificial Sequence: Synthetic peptide
  Seed: WPRKFFHRTC (TYRP2_HUMAN)
WPRKFFHRTI

SEQ ID NO: 183169 - protein, 10 aa, Artificial Sequence
  Description of Artificial Sequence: Synthetic peptide
  Seed: AIFDEWMKRF (TYRP2_HUMAN)
ASFDEWMKRF

SEQ ID NO: 183170 - protein, 9 aa, Artificial Sequence
  Description of Artificial Sequence: Synthetic peptide
  Seed: VTNEELFLT (TYRP2_HUMAN)
VVNEELFLA

SEQ ID NO: 183171 - protein, 10 aa, Artificial Sequence
  Description of Artificial Sequence: Synthetic peptide
  Seed: TQPQFANCSV (TYRP2_HUMAN)
TPPQFANCSL

SEQ ID NO: 183172 - protein, 10 aa, Artificial Sequence
  Description of Artificial Sequence: Synthetic peptide
  Seed: REQFLGALDL (TYRP2_HUMAN)
RKQFLGALDL

SEQ ID NO: 183173 - protein, 9 aa, Artificial Sequence
  Description of Artificial Sequence: Synthetic peptide
  Seed: TLDSQVMSL (TYRP2_HUMAN)
TLDSQVMSY

SEQ ID NO: 183174 - protein, 10 aa, Artificial Sequence
  Description of Artificial Sequence: Synthetic peptide
  Seed: AANDPIFVVL (TYRP2_HUMAN)
ARNDPIFVVL

SEQ ID NO: 183175 - protein, 9 aa, Artificial Sequence
  Description of Artificial Sequence: Synthetic peptide
  Seed: FQNSTFSFR (TYRP2_HUMAN)
FQNSTFSFY

SEQ ID NO: 183176 - protein, 9 aa, Artificial Sequence
  Description of Artificial Sequence: Synthetic peptide
  Seed: FVWLHYYSV (TYRP2_HUMAN)
FMWLHYYSI

SEQ ID NO: 183177 - protein, 9 aa, Artificial Sequence
  Description of Artificial Sequence: Synthetic peptide
  Seed: QRLIGNESF (TYRP2_HUMAN)
QALIGNESY

SEQ ID NO: 183178 - protein, 9 aa, Artificial Sequence
  Description of Artificial Sequence: Synthetic peptide
  Seed: RKFFHRTCK (TYRP2_HUMAN)
RSFFHRTCM

SEQ ID NO: 183179 - protein, 9 aa, Artificial Sequence
  Description of Artificial Sequence: Synthetic peptide
  Seed: AIFDEWMKR (TYRP2_HUMAN)
ASFDEWMKK

SEQ ID NO: 183180 - protein, 9 aa, Artificial Sequence
  Description of Artificial Sequence: Synthetic peptide
  Seed: YSVRDTLLG (TYRP2_HUMAN)
YMVRDTLLW

SEQ ID NO: 183181 - protein, 9 aa, Artificial Sequence
  Description of Artificial Sequence: Synthetic peptide
  Seed: YVITTQHWL (TYRP2_HUMAN)
YQITTQHWM

SEQ ID NO: 183182 - protein, 8 aa, Artificial Sequence
  Description of Artificial Sequence: Synthetic peptide
  Seed: FSHQGPAF (TYRP2_HUMAN)
FSHQGPAI

SEQ ID NO: 183183 - protein, 9 aa, Artificial Sequence
  Description of Artificial Sequence: Synthetic peptide
  Seed: ANDPIFVVL (TYRP2_HUMAN)
AADPIFVVW

SEQ ID NO: 183184 - protein, 9 aa, Artificial Sequence
  Description of Artificial Sequence: Synthetic peptide
  Seed: HPDYVITTQ (TYRP2_HUMAN)
HPDYVITTF

SEQ ID NO: 183185 - protein, 10 aa, Artificial Sequence
  Description of Artificial Sequence: Synthetic peptide
  Seed: AIFDEWMKRF (TYRP2_HUMAN)
AWFDEWMKRY

SEQ ID NO: 183186 - protein, 9 aa, Artificial Sequence
  Description of Artificial Sequence: Synthetic peptide
  Seed: SPQEREQFL (TYRP2_HUMAN)
SPQEREQFY

SEQ ID NO: 183187 - protein, 9 aa, Artificial Sequence
  Description of Artificial Sequence: Synthetic peptide
  Seed: WPQELAPIG (TYRP2_HUMAN)
WPQELAPIL

SEQ ID NO: 183188 - protein, 10 aa, Artificial Sequence
  Description of Artificial Sequence: Synthetic peptide
  Seed: RELWPRKFFH (TYRP2_HUMAN)
RILWPRKFFR

SEQ ID NO: 183189 - protein, 10 aa, Artificial Sequence
  Description of Artificial Sequence: Synthetic peptide
  Seed: ELAPIGHNRM (TYRP2_HUMAN)
ESAPIGHNRR

SEQ ID NO: 183190 - protein, 9 aa, Artificial Sequence
  Description of Artificial Sequence: Synthetic peptide
  Seed: IGHNRMYNM (TYRP2_HUMAN)
IAHNRMYNL

SEQ ID NO: 183191 - protein, 11 aa, Artificial Sequence
  Description of Artificial Sequence: Synthetic peptide
  Seed: FVVLHSFTDAI (TYRP2_HUMAN)
FNVLHSFTDAL

SEQ ID NO: 183192 - protein, 9 aa, Artificial Sequence
  Description of Artificial Sequence: Synthetic peptide
  Seed: NSMKLPTLK (TYRP2_HUMAN)
NTMKLPTLK

SEQ ID NO: 183193 - protein, 9 aa, Artificial Sequence
  Description of Artificial Sequence: Synthetic peptide
  Seed: NMVPFFPPV (TYRP2_HUMAN)
NWVPFFPPF

SEQ ID NO: 183194 - protein, 10 aa, Artificial Sequence
  Description of Artificial Sequence: Synthetic peptide
  Seed: SPLWWGFLLS (TYRP2_HUMAN)
SILWWGFLLL

SEQ ID NO: 183195 - protein, 9 aa, Artificial Sequence
  Description of Artificial Sequence: Synthetic peptide
  Seed: GNESFALPY (TYRP2_HUMAN)
GKESFALPY

SEQ ID NO: 183196 - protein, 9 aa, Artificial Sequence
  Description of Artificial Sequence: Synthetic peptide
  Seed: GTLVALVGL (TYRP2_HUMAN)
GVLVALVGV

SEQ ID NO: 183197 - protein, 10 aa, Artificial Sequence
  Description of Artificial Sequence: Synthetic peptide
  Seed: YDFFVWLHYY (TYRP2_HUMAN)
YMFFVWLHYK

SEQ ID NO: 183198 - protein, 9 aa, Artificial Sequence
  Description of Artificial Sequence: Synthetic peptide
  Seed: VLLAFLQYR (TYRP2_HUMAN)
VQLAFLQYK

SEQ ID NO: 183199 - protein, 9 aa, Artificial Sequence
  Description of Artificial Sequence: Synthetic peptide
  Seed: FSHQGPAFV (TYRP2_HUMAN)
FRHQGPAFM

SEQ ID NO: 183200 - protein, 10 aa, Artificial Sequence
  Description of Artificial Sequence: Synthetic peptide
  Seed: FVVLHSFTDA (TYRP2_HUMAN)
FSVLHSFTDV

SEQ ID NO: 183201 - protein, 10 aa, Artificial Sequence
  Description of Artificial Sequence: Synthetic peptide
  Seed: LISRNSRFSS (TYRP2_HUMAN)
LTSRNSRFSA

SEQ ID NO: 183202 - protein, 9 aa, Artificial Sequence
  Description of Artificial Sequence: Synthetic peptide
  Seed: NMVPFFPPV (TYRP2_HUMAN)
NNVPFFPPV

SEQ ID NO: 183203 - protein, 10 aa, Artificial Sequence
  Description of Artificial Sequence: Synthetic peptide
  Seed: NSTFSFRNAL (TYRP2_HUMAN)
NGTFSFRNAL

SEQ ID NO: 183204 - protein, 9 aa, Artificial Sequence
  Description of Artificial Sequence: Synthetic peptide
  Seed: FTDAIFDEW (TYRP2_HUMAN)
FGDAIFDEV

SEQ ID NO: 183205 - protein, 9 aa, Artificial Sequence
  Description of Artificial Sequence: Synthetic peptide
  Seed: TLDSQVMSL (TYRP2_HUMAN)
TMDSQVMSW

SEQ ID NO: 183206 - protein, 10 aa, Artificial Sequence
  Description of Artificial Sequence: Synthetic peptide
  Seed: RLRKGYTPLM (TYRP2_HUMAN)
RARKGYTPLK

SEQ ID NO: 183207 - protein, 9 aa, Artificial Sequence
  Description of Artificial Sequence: Synthetic peptide
  Seed: FTDAIFDEW (TYRP2_HUMAN)
FGDAIFDEM

SEQ ID NO: 183208 - protein, 9 aa, Artificial Sequence
  Description of Artificial Sequence: Synthetic peptide
  Seed: RAIDFSHQG (TYRP2_HUMAN)
RVIDFSHQF

SEQ ID NO: 183209 - protein, 9 aa, Artificial Sequence
  Description of Artificial Sequence: Synthetic peptide
  Seed: RNSMKLPTL (TYRP2_HUMAN)
RSSMKLPTM

SEQ ID NO: 183210 - protein, 9 aa, Artificial Sequence
  Description of Artificial Sequence: Synthetic peptide
  Seed: RKFFHRTCK (TYRP2_HUMAN)
RVFFHRTCY

SEQ ID NO: 183211 - protein, 9 aa, Artificial Sequence
  Description of Artificial Sequence: Synthetic peptide
  Seed: RKFFHRTCK (TYRP2_HUMAN)
RRFFHRTCW

SEQ ID NO: 183212 - protein, 10 aa, Artificial Sequence
  Description of Artificial Sequence: Synthetic peptide
  Seed: RVCMTVDSLV (TYRP2_HUMAN)
RMCMTVDSLL

SEQ ID NO: 183213 - protein, 11 aa, Artificial Sequence
  Description of Artificial Sequence: Synthetic peptide
  Seed: RADTRPWSGPY (TYRP2_HUMAN)
RSDTRPWSGPW

SEQ ID NO: 183214 - protein, 9 aa, Artificial Sequence
  Description of Artificial Sequence: Synthetic peptide
  Seed: VVMGTLVAL (TYRP2_HUMAN)
VWMGTLVAF

SEQ ID NO: 183215 - protein, 9 aa, Artificial Sequence
  Description of Artificial Sequence: Synthetic peptide
  Seed: SLHNLVHSF (TYRP2_HUMAN)
SVHNLVHSL

SEQ ID NO: 183216 - protein, 10 aa, Artificial Sequence
  Description of Artificial Sequence: Synthetic peptide
  Seed: HSFLNGTNAL (TYRP2_HUMAN)
HKFLNGTNAF

SEQ ID NO: 183217 - protein, 9 aa, Artificial Sequence
  Description of Artificial Sequence: Synthetic peptide
  Seed: YVITTQHWL (TYRP2_HUMAN)
YTITTQHWW

SEQ ID NO: 183218 - protein, 9 aa, Artificial Sequence
  Description of Artificial Sequence: Synthetic peptide
  Seed: VGLFVLLAF (TYRP2_HUMAN)
VRLFVLLAY

SEQ ID NO: 183219 - protein, 10 aa, Artificial Sequence
  Description of Artificial Sequence: Synthetic peptide
  Seed: YDFFVWLHYY (TYRP2_HUMAN)
YYFFVWLHYM

SEQ ID NO: 183220 - protein, 9 aa, Artificial Sequence
  Description of Artificial Sequence: Synthetic peptide
  Seed: LLGPGRPYR (TYRP2_HUMAN)
LMGPGRPYK

SEQ ID NO: 183221 - protein, 9 aa, Artificial Sequence
  Description of Artificial Sequence: Synthetic peptide
  Seed: FANCSVYDF (TYRP2_HUMAN)
FANCSVYDY

SEQ ID NO: 183222 - protein, 9 aa, Artificial Sequence
  Description of Artificial Sequence: Synthetic peptide
  Seed: WMKRFNPPA (TYRP2_HUMAN)
WLKRFNPPF

SEQ ID NO: 183223 - protein, 10 aa, Artificial Sequence
  Description of Artificial Sequence: Synthetic peptide
  Seed: FLLSCLGCKI (TYRP2_HUMAN)
FPLSCLGCKL

SEQ ID NO: 183224 - protein, 10 aa, Artificial Sequence
  Description of Artificial Sequence: Synthetic peptide
  Seed: RPDDPTLISR (TYRP2_HUMAN)
RVDDPTLISL

SEQ ID NO: 183225 - protein, 10 aa, Artificial Sequence
  Description of Artificial Sequence: Synthetic peptide
  Seed: FANCSVYDFF (TYRP2_HUMAN)
FPNCSVYDFY

SEQ ID NO: 183226 - protein, 10 aa, Artificial Sequence
  Description of Artificial Sequence: Synthetic peptide
  Seed: SDQLGYSYAI (TYRP2_HUMAN)
SMQLGYSYAY

SEQ ID NO: 183227 - protein, 10 aa, Artificial Sequence
  Description of Artificial Sequence: Synthetic peptide
  Seed: NSTFSFRNAL (TYRP2_HUMAN)
NFTFSFRNAI

SEQ ID NO: 183228 - protein, 11 aa, Artificial Sequence
  Description of Artificial Sequence: Synthetic peptide
  Seed: RNSRFSSWETV (TYRP2_HUMAN)
RVSRFSSWETL

SEQ ID NO: 183229 - protein, 9 aa, Artificial Sequence
  Description of Artificial Sequence: Synthetic peptide
  Seed: NRMYNMVPF (TYRP2_HUMAN)
NRMYNMVPL

SEQ ID NO: 183230 - protein, 10 aa, Artificial Sequence
  Description of Artificial Sequence: Synthetic peptide
  Seed: SDQLGYSYAI (TYRP2_HUMAN)
SWQLGYSYAV

SEQ ID NO: 183231 - protein, 9 aa, Artificial Sequence
  Description of Artificial Sequence: Synthetic peptide
  Seed: FPPVTNEEL (TYRP2_HUMAN)
FSPVTNEEI

SEQ ID NO: 183232 - protein, 9 aa, Artificial Sequence
  Description of Artificial Sequence: Synthetic peptide
  Seed: SVYDFFVWL (TYRP2_HUMAN)
SCYDFFVWV

SEQ ID NO: 183233 - protein, 9 aa, Artificial Sequence
  Description of Artificial Sequence: Synthetic peptide
  Seed: STFSFRNAL (TYRP2_HUMAN)
SMFSFRNAY

SEQ ID NO: 183234 - protein, 9 aa, Artificial Sequence
  Description of Artificial Sequence: Synthetic peptide
  Seed: VVMGTLVAL (TYRP2_HUMAN)
VIMGTLVAR

SEQ ID NO: 183235 - protein, 9 aa, Artificial Sequence
  Description of Artificial Sequence: Synthetic peptide
  Seed: VLHSFTDAI (TYRP2_HUMAN)
VMHSFTDAW

SEQ ID NO: 183236 - protein, 10 aa, Artificial Sequence
  Description of Artificial Sequence: Synthetic peptide
  Seed: VVLHSFTDAI (TYRP2_HUMAN)
VNLHSFTDAL

SEQ ID NO: 183237 - protein, 9 aa, Artificial Sequence
  Description of Artificial Sequence: Synthetic peptide
  Seed: MTVDSLVNK (TYRP2_HUMAN)
MSVDSLVNL

SEQ ID NO: 183238 - protein, 9 aa, Artificial Sequence
  Description of Artificial Sequence: Synthetic peptide
  Seed: SHQGPAFVT (TYRP2_HUMAN)
SHQGPAFVL

SEQ ID NO: 183239 - protein, 11 aa, Artificial Sequence
  Description of Artificial Sequence: Synthetic peptide
  Seed: YRRLRKGYTPL (TYRP2_HUMAN)
YLRLRKGYTPM

SEQ ID NO: 183240 - protein, 9 aa, Artificial Sequence
  Description of Artificial Sequence: Synthetic peptide
  Seed: RLRKGYTPL (TYRP2_HUMAN)
RYRKGYTPV

SEQ ID NO: 183241 - protein, 9 aa, Artificial Sequence
  Description of Artificial Sequence: Synthetic peptide
  Seed: SLHNLVHSF (TYRP2_HUMAN)
SQHNLVHSV

SEQ ID NO: 183242 - protein, 9 aa, Artificial Sequence
  Description of Artificial Sequence: Synthetic peptide
  Seed: VGLFVLLAF (TYRP2_HUMAN)
VQLFVLLAM

SEQ ID NO: 183243 - protein, 11 aa, Artificial Sequence
  Description of Artificial Sequence: Synthetic peptide
  Seed: YTPLMETHLSS (TYRP2_HUMAN)
YIPLMETHLSV

SEQ ID NO: 183244 - protein, 10 aa, Artificial Sequence
  Description of Artificial Sequence: Synthetic peptide
  Seed: ELAPIGHNRM (TYRP2_HUMAN)
ETAPIGHNRT

SEQ ID NO: 183245 - protein, 9 aa, Artificial Sequence
  Description of Artificial Sequence: Synthetic peptide
  Seed: ILPGAQGQF (TYRP2_HUMAN)
ILPGAQGQY

SEQ ID NO: 183246 - protein, 9 aa, Artificial Sequence
  Description of Artificial Sequence: Synthetic peptide
  Seed: FTDAIFDEW (TYRP2_HUMAN)
FYDAIFDEL

SEQ ID NO: 183247 - protein, 9 aa, Artificial Sequence
  Description of Artificial Sequence: Synthetic peptide
  Seed: FFQNSTFSF (TYRP2_HUMAN)
FTQNSTFSF

SEQ ID NO: 183248 - protein, 11 aa, Artificial Sequence
  Description of Artificial Sequence: Synthetic peptide
  Seed: SLDDYNHLVTL (TYRP2_HUMAN)
SVDDYNHLVTM

SEQ ID NO: 183249 - protein, 10 aa, Artificial Sequence
  Description of Artificial Sequence: Synthetic peptide
  Seed: RMYNMVPFFP (TYRP2_HUMAN)
RKYNMVPFFM

SEQ ID NO: 183250 - protein, 9 aa, Artificial Sequence
  Description of Artificial Sequence: Synthetic peptide
  Seed: FVWLHYYSV (TYRP2_HUMAN)
FQWLHYYSV

SEQ ID NO: 183251 - protein, 9 aa, Artificial Sequence
  Description of Artificial Sequence: Synthetic peptide
  Seed: FLTSDQLGY (TYRP2_HUMAN)
FQTSDQLGY

SEQ ID NO: 183252 - protein, 9 aa, Artificial Sequence
  Description of Artificial Sequence: Synthetic peptide
  Seed: VALVGLFVL (TYRP2_HUMAN)
VLLVGLFVL

SEQ ID NO: 183253 - protein, 10 aa, Artificial Sequence
  Description of Artificial Sequence: Synthetic peptide
  Seed: YNCGDCKFGW (TYRP2_HUMAN)
YACGDCKFGW

SEQ ID NO: 183254 - protein, 9 aa, Artificial Sequence
  Description of Artificial Sequence: Synthetic peptide
  Seed: YSYAIDLPV (TYRP2_HUMAN)
YMYAIDLPA

SEQ ID NO: 183255 - protein, 10 aa, Artificial Sequence
  Description of Artificial Sequence: Synthetic peptide
  Seed: SLQKFDNPPF (TYRP2_HUMAN)
SHQKFDNPPF

SEQ ID NO: 183256 - protein, 10 aa, Artificial Sequence
  Description of Artificial Sequence: Synthetic peptide
  Seed: SAANDPIFVV (TYRP2_HUMAN)
SLANDPIFVI

SEQ ID NO: 183257 - protein, 9 aa, Artificial Sequence
  Description of Artificial Sequence: Synthetic peptide
  Seed: LLGPGRPYR (TYRP2_HUMAN)
LVGPGRPYR

SEQ ID NO: 183258 - protein, 9 aa, Artificial Sequence
  Description of Artificial Sequence: Synthetic peptide
  Seed: RKFFHRTCK (TYRP2_HUMAN)
RIFFHRTCL

SEQ ID NO: 183259 - protein, 8 aa, Artificial Sequence
  Description of Artificial Sequence: Synthetic peptide
  Seed: ANDPIFVV (TYRP2_HUMAN)
AGDPIFVL

SEQ ID NO: 183260 - protein, 10 aa, Artificial Sequence
  Description of Artificial Sequence: Synthetic peptide
  Seed: RPDDPTLISR (TYRP2_HUMAN)
RPDDPTLISA

SEQ ID NO: 183261 - protein, 9 aa, Artificial Sequence
  Description of Artificial Sequence: Synthetic peptide
  Seed: FVLLAFLQY (TYRP2_HUMAN)
FRLLAFLQY

SEQ ID NO: 183262 - protein, 9 aa, Artificial Sequence
  Description of Artificial Sequence: Synthetic peptide
  Seed: SHQGPAFVT (TYRP2_HUMAN)
SRQGPAFVL

SEQ ID NO: 183263 - protein, 9 aa, Artificial Sequence
  Description of Artificial Sequence: Synthetic peptide
  Seed: SLHNLVHSF (TYRP2_HUMAN)
SYHNLVHSY

SEQ ID NO: 183264 - protein, 9 aa, Artificial Sequence
  Description of Artificial Sequence: Synthetic peptide
  Seed: FVWLHYYSV (TYRP2_HUMAN)
FIWLHYYSR

SEQ ID NO: 183265 - protein, 9 aa, Artificial Sequence
  Description of Artificial Sequence: Synthetic peptide
  Seed: RLRKGYTPL (TYRP2_HUMAN)
RSRKGYTPG

SEQ ID NO: 183266 - protein, 9 aa, Artificial Sequence
  Description of Artificial Sequence: Synthetic peptide
  Seed: VTWHRYHLL (TYRP2_HUMAN)
VIWHRYHLI

SEQ ID NO: 183267 - protein, 9 aa, Artificial Sequence
  Description of Artificial Sequence: Synthetic peptide
  Seed: STFSFRNAL (TYRP2_HUMAN)
SGFSFRNAW

SEQ ID NO: 183268 - protein, 10 aa, Artificial Sequence
  Description of Artificial Sequence: Synthetic peptide
  Seed: YNMVPFFPPV (TYRP2_HUMAN)
YLMVPFFPPC

SEQ ID NO: 183269 - protein, 9 aa, Artificial Sequence
  Description of Artificial Sequence: Synthetic peptide
  Seed: RQNIHSLSP (TYRP2_HUMAN)
RSNIHSLSF

SEQ ID NO: 183270 - protein, 9 aa, Artificial Sequence
  Description of Artificial Sequence: Synthetic peptide
  Seed: TSDQLGYSY (TYRP2_HUMAN)
TADQLGYSL

SEQ ID NO: 183271 - protein, 11 aa, Artificial Sequence
  Description of Artificial Sequence: Synthetic peptide
  Seed: YNMVPFFPPVT (TYRP2_HUMAN)
YMMVPFFPPVL

SEQ ID NO: 183272 - protein, 10 aa, Artificial Sequence
  Description of Artificial Sequence: Synthetic peptide
  Seed: RLRKGYTPLM (TYRP2_HUMAN)
RVRKGYTPLG

SEQ ID NO: 183273 - protein, 9 aa, Artificial Sequence
  Description of Artificial Sequence: Synthetic peptide
  Seed: YVITTQHWL (TYRP2_HUMAN)
YTITTQHWR

SEQ ID NO: 183274 - protein, 11 aa, Artificial Sequence
  Description of Artificial Sequence: Synthetic peptide
  Seed: YTPLMETHLSS (TYRP2_HUMAN)
YLPLMETHLSA

SEQ ID NO: 183275 - protein, 10 aa, Artificial Sequence
  Description of Artificial Sequence: Synthetic peptide
  Seed: SPLWWGFLLS (TYRP2_HUMAN)
SLLWWGFLLS

SEQ ID NO: 183276 - protein, 10 aa, Artificial Sequence
  Description of Artificial Sequence: Synthetic peptide
  Seed: ESANVCGSQQ (TYRP2_HUMAN)
EAANVCGSQK

SEQ ID NO: 183277 - protein, 9 aa, Artificial Sequence
  Description of Artificial Sequence: Synthetic peptide
  Seed: KDIRDCLSL (TYRP2_HUMAN)
KEIRDCLSI

SEQ ID NO: 183278 - protein, 9 aa, Artificial Sequence
  Description of Artificial Sequence: Synthetic peptide
  Seed: EQFLGALDL (TYRP2_HUMAN)
EEFLGALDI

SEQ ID NO: 183279 - protein, 9 aa, Artificial Sequence
  Description of Artificial Sequence: Synthetic peptide
  Seed: DDYNHLVTL (TYRP2_HUMAN)
DSYNHLVTI

SEQ ID NO: 183280 - protein, 11 aa, Artificial Sequence
  Description of Artificial Sequence: Synthetic peptide
  Seed: LPVSVEETPGW (TYRP2_HUMAN)
LSVSVEETPGW

SEQ ID NO: 183281 - protein, 10 aa, Artificial Sequence
  Description of Artificial Sequence: Synthetic peptide
  Seed: RNQMGRNSMK (TYRP2_HUMAN)
RIQMGRNSMK

SEQ ID NO: 183282 - protein, 10 aa, Artificial Sequence
  Description of Artificial Sequence: Synthetic peptide
  Seed: FTDAIFDEWM (TYRP2_HUMAN)
FLDAIFDEWI

SEQ ID NO: 183283 - protein, 9 aa, Artificial Sequence
  Description of Artificial Sequence: Synthetic peptide
  Seed: LHNLVHSFL (TYRP2_HUMAN)
LMNLVHSFF

SEQ ID NO: 183284 - protein, 10 aa, Artificial Sequence
  Description of Artificial Sequence: Synthetic peptide
  Seed: LAFLQYRRLR (TYRP2_HUMAN)
LFFLQYRRLR

SEQ ID NO: 183285 - protein, 10 aa, Artificial Sequence
  Description of Artificial Sequence: Synthetic peptide
  Seed: FQNSTFSFRN (TYRP2_HUMAN)
FNNSTFSFRR

SEQ ID NO: 183286 - protein, 10 aa, Artificial Sequence
  Description of Artificial Sequence: Synthetic peptide
  Seed: RRLRKGYTPL (TYRP2_HUMAN)
RALRKGYTPA

SEQ ID NO: 183287 - protein, 9 aa, Artificial Sequence
  Description of Artificial Sequence: Synthetic peptide
  Seed: TLDSQVMSL (TYRP2_HUMAN)
TCDSQVMSV

SEQ ID NO: 183288 - protein, 9 aa, Artificial Sequence
  Description of Artificial Sequence: Synthetic peptide
  Seed: RQNIHSLSP (TYRP2_HUMAN)
RMNIHSLSV

SEQ ID NO: 183289 - protein, 9 aa, Artificial Sequence
  Description of Artificial Sequence: Synthetic peptide
  Seed: RLRKGYTPL (TYRP2_HUMAN)
RVRKGYTPC

SEQ ID NO: 183290 - protein, 9 aa, Artificial Sequence
  Description of Artificial Sequence: Synthetic peptide
  Seed: TLDSQVMSL (TYRP2_HUMAN)
TLDSQVMSV

SEQ ID NO: 183291 - protein, 10 aa, Artificial Sequence
  Description of Artificial Sequence: Synthetic peptide
  Seed: GNESFALPYW (TYRP2_HUMAN)
GTESFALPYW

SEQ ID NO: 183292 - protein, 9 aa, Artificial Sequence
  Description of Artificial Sequence: Synthetic peptide
  Seed: ALVGLFVLL (TYRP2_HUMAN)
AAVGLFVLI

SEQ ID NO: 183293 - protein, 10 aa, Artificial Sequence
  Description of Artificial Sequence: Synthetic peptide
  Seed: QPQFANCSVY (TYRP2_HUMAN)
QEQFANCSVY

SEQ ID NO: 183294 - protein, 9 aa, Artificial Sequence
  Description of Artificial Sequence: Synthetic peptide
  Seed: DIRDCLSLQ (TYRP2_HUMAN)
DTRDCLSLR

SEQ ID NO: 183295 - protein, 10 aa, Artificial Sequence
  Description of Artificial Sequence: Synthetic peptide
  Seed: KRFNPPADAW (TYRP2_HUMAN)
KMFNPPADAY

SEQ ID NO: 183296 - protein, 9 aa, Artificial Sequence
  Description of Artificial Sequence: Synthetic peptide
  Seed: QVMSLHNLV (TYRP2_HUMAN)
QMMSLHNLV

SEQ ID NO: 183297 - protein, 9 aa, Artificial Sequence
  Description of Artificial Sequence: Synthetic peptide
  Seed: MTVDSLVNK (TYRP2_HUMAN)
MIVDSLVNR

SEQ ID NO: 183298 - protein, 10 aa, Artificial Sequence
  Description of Artificial Sequence: Synthetic peptide
  Seed: SLDDYNHLVT (TYRP2_HUMAN)
SVDDYNHLVL

SEQ ID NO: 183299 - protein, 9 aa, Artificial Sequence
  Description of Artificial Sequence: Synthetic peptide
  Seed: RLRKGYTPL (TYRP2_HUMAN)
RPRKGYTPQ

SEQ ID NO: 183300 - protein, 9 aa, Artificial Sequence
  Description of Artificial Sequence: Synthetic peptide
  Seed: YVITTQHWL (TYRP2_HUMAN)
YIITTQHWV

SEQ ID NO: 183301 - protein, 11 aa, Artificial Sequence
  Description of Artificial Sequence: Synthetic peptide
  Seed: SLSPQEREQFL (TYRP2_HUMAN)
SQSPQEREQFW

SEQ ID NO: 183302 - protein, 9 aa, Artificial Sequence
  Description of Artificial Sequence: Synthetic peptide
  Seed: FVWLHYYSV (TYRP2_HUMAN)
FVWLHYYSK

SEQ ID NO: 183303 - protein, 9 aa, Artificial Sequence
  Description of Artificial Sequence: Synthetic peptide
  Seed: AARPDDPTL (TYRP2_HUMAN)
AHRPDDPTY

SEQ ID NO: 183304 - protein, 10 aa, Artificial Sequence
  Description of Artificial Sequence: Synthetic peptide
  Seed: FLLSCLGCKI (TYRP2_HUMAN)
FKLSCLGCKV

SEQ ID NO: 183305 - protein, 10 aa, Artificial Sequence
  Description of Artificial Sequence: Synthetic peptide
  Seed: SPLWWGFLLS (TYRP2_HUMAN)
SRLWWGFLLL

SEQ ID NO: 183306 - protein, 9 aa, Artificial Sequence
  Description of Artificial Sequence: Synthetic peptide
  Seed: SQVMSLHNL (TYRP2_HUMAN)
SKVMSLHNF

SEQ ID NO: 183307 - protein, 9 aa, Artificial Sequence
  Description of Artificial Sequence: Synthetic peptide
  Seed: KCTGNFAGY (TYRP2_HUMAN)
KSTGNFAGY

SEQ ID NO: 183308 - protein, 10 aa, Artificial Sequence
  Description of Artificial Sequence: Synthetic peptide
  Seed: HNRMYNMVPF (TYRP2_HUMAN)
HPRMYNMVPL

SEQ ID NO: 183309 - protein, 11 aa, Artificial Sequence
  Description of Artificial Sequence: Synthetic peptide
  Seed: YTPLMETHLSS (TYRP2_HUMAN)
YTPLMETHLSA

SEQ ID NO: 183310 - protein, 9 aa, Artificial Sequence
  Description of Artificial Sequence: Synthetic peptide
  Seed: SLHNLVHSF (TYRP2_HUMAN)
SVHNLVHSH

SEQ ID NO: 183311 - protein, 11 aa, Artificial Sequence
  Description of Artificial Sequence: Synthetic peptide
  Seed: YTPLMETHLSS (TYRP2_HUMAN)
YSPLMETHLSA

SEQ ID NO: 183312 - protein, 9 aa, Artificial Sequence
  Description of Artificial Sequence: Synthetic peptide
  Seed: ANDPIFVVL (TYRP2_HUMAN)
AGDPIFVVV

SEQ ID NO: 183313 - protein, 10 aa, Artificial Sequence
  Description of Artificial Sequence: Synthetic peptide
  Seed: RVCMTVDSLV (TYRP2_HUMAN)
RMCMTVDSLI

SEQ ID NO: 183314 - protein, 10 aa, Artificial Sequence
  Description of Artificial Sequence: Synthetic peptide
  Seed: MSPLWWGFLL (TYRP2_HUMAN)
MGPLWWGFLV

SEQ ID NO: 183315 - protein, 11 aa, Artificial Sequence
  Description of Artificial Sequence: Synthetic peptide
  Seed: SLDDYNHLVTL (TYRP2_HUMAN)
SWDDYNHLVTF

SEQ ID NO: 183316 - protein, 9 aa, Artificial Sequence
  Description of Artificial Sequence: Synthetic peptide
  Seed: FSHQGPAFV (TYRP2_HUMAN)
FMHQGPAFY

SEQ ID NO: 183317 - protein, 9 aa, Artificial Sequence
  Description of Artificial Sequence: Synthetic peptide
  Seed: VIRQNIHSL (TYRP2_HUMAN)
VGRQNIHSK

SEQ ID NO: 183318 - protein, 9 aa, Artificial Sequence
  Description of Artificial Sequence: Synthetic peptide
  Seed: QVMSLHNLV (TYRP2_HUMAN)
QLMSLHNLV

SEQ ID NO: 183319 - protein, 9 aa, Artificial Sequence
  Description of Artificial Sequence: Synthetic peptide
  Seed: YAIDLPVSV (TYRP2_HUMAN)
YMIDLPVSW

SEQ ID NO: 183320 - protein, 9 aa, Artificial Sequence
  Description of Artificial Sequence: Synthetic peptide
  Seed: WMKRFNPPA (TYRP2_HUMAN)
WAKRFNPPK

SEQ ID NO: 183321 - protein, 10 aa, Artificial Sequence
  Description of Artificial Sequence: Synthetic peptide
  Seed: NSRFSSWETV (TYRP2_HUMAN)
NPRFSSWETL

SEQ ID NO: 183322 - protein, 10 aa, Artificial Sequence
  Description of Artificial Sequence: Synthetic peptide
  Seed: LTSDQLGYSY (TYRP2_HUMAN)
LASDQLGYSY

SEQ ID NO: 183323 - protein, 10 aa, Artificial Sequence
  Description of Artificial Sequence: Synthetic peptide
  Seed: VVMGTLVALV (TYRP2_HUMAN)
VIMGTLVALV

SEQ ID NO: 183324 - protein, 9 aa, Artificial Sequence
  Description of Artificial Sequence: Synthetic peptide
  Seed: TLDSQVMSL (TYRP2_HUMAN)
TVDSQVMSM

SEQ ID NO: 183325 - protein, 11 aa, Artificial Sequence
  Description of Artificial Sequence: Synthetic peptide
  Seed: MYNMVPFFPPV (TYRP2_HUMAN)
MLNMVPFFPPI

SEQ ID NO: 183326 - protein, 11 aa, Artificial Sequence
  Description of Artificial Sequence: Synthetic peptide
  Seed: YNMVPFFPPVT (TYRP2_HUMAN)
YMMVPFFPPVP

SEQ ID NO: 183327 - protein, 8 aa, Artificial Sequence
  Description of Artificial Sequence: Synthetic peptide
  Seed: IFVVLHSF (TYRP2_HUMAN)
IYVVLHSM

SEQ ID NO: 183328 - protein, 10 aa, Artificial Sequence
  Description of Artificial Sequence: Synthetic peptide
  Seed: LTSDQLGYSY (TYRP2_HUMAN)
LMSDQLGYSM

SEQ ID NO: 183329 - protein, 9 aa, Artificial Sequence
  Description of Artificial Sequence: Synthetic peptide
  Seed: GTYEGLLRR (TYRP2_HUMAN)
GAYEGLLRV

SEQ ID NO: 183330 - protein, 10 aa, Artificial Sequence
  Description of Artificial Sequence: Synthetic peptide
  Seed: VVLHSFTDAI (TYRP2_HUMAN)
VHLHSFTDAL

SEQ ID NO: 183331 - protein, 9 aa, Artificial Sequence
  Description of Artificial Sequence: Synthetic peptide
  Seed: AANDPIFVV (TYRP2_HUMAN)
AYNDPIFVF

SEQ ID NO: 183332 - protein, 10 aa, Artificial Sequence
  Description of Artificial Sequence: Synthetic peptide
  Seed: RELWPRKFFH (TYRP2_HUMAN)
RTLWPRKFFY

SEQ ID NO: 183333 - protein, 9 aa, Artificial Sequence
  Description of Artificial Sequence: Synthetic peptide
  Seed: APIGHNRMY (TYRP2_HUMAN)
AQIGHNRMM

SEQ ID NO: 183334 - protein, 11 aa, Artificial Sequence
  Description of Artificial Sequence: Synthetic peptide
  Seed: QFANCSVYDFF (TYRP2_HUMAN)
QWANCSVYDFF

SEQ ID NO: 183335 - protein, 9 aa, Artificial Sequence
  Description of Artificial Sequence: Synthetic peptide
  Seed: GTYEGLLRR (TYRP2_HUMAN)
GTYEGLLRK

SEQ ID NO: 183336 - protein, 11 aa, Artificial Sequence
  Description of Artificial Sequence: Synthetic peptide
  Seed: QPQFANCSVYD (TYRP2_HUMAN)
QMQFANCSVYF

SEQ ID NO: 183337 - protein, 9 aa, Artificial Sequence
  Description of Artificial Sequence: Synthetic peptide
  Seed: VMSLHNLVH (TYRP2_HUMAN)
VMSLHNLVY

SEQ ID NO: 183338 - protein, 11 aa, Artificial Sequence
  Description of Artificial Sequence: Synthetic peptide
  Seed: YNMVPFFPPVT (TYRP2_HUMAN)
YIMVPFFPPVV

SEQ ID NO: 183339 - protein, 9 aa, Artificial Sequence
  Description of Artificial Sequence: Synthetic peptide
  Seed: LRKGYTPLM (TYRP2_HUMAN)
LQKGYTPLM

SEQ ID NO: 183340 - protein, 10 aa, Artificial Sequence
  Description of Artificial Sequence: Synthetic peptide
  Seed: FLLSCLGCKI (TYRP2_HUMAN)
FQLSCLGCKV

SEQ ID NO: 183341 - protein, 10 aa, Artificial Sequence
  Description of Artificial Sequence: Synthetic peptide
  Seed: NMVPFFPPVT (TYRP2_HUMAN)
NTVPFFPPVV

SEQ ID NO: 183342 - protein, 9 aa, Artificial Sequence
  Description of Artificial Sequence: Synthetic peptide
  Seed: RLRKGYTPL (TYRP2_HUMAN)
RYRKGYTPG

SEQ ID NO: 183343 - protein, 10 aa, Artificial Sequence
  Description of Artificial Sequence: Synthetic peptide
  Seed: HPDYVITTQH (TYRP2_HUMAN)
HPDYVITTQY

SEQ ID NO: 183344 - protein, 10 aa, Artificial Sequence
  Description of Artificial Sequence: Synthetic peptide
  Seed: RLIGNESFAL (TYRP2_HUMAN)
RLIGNESFAR

SEQ ID NO: 183345 - protein, 10 aa, Artificial Sequence
  Description of Artificial Sequence: Synthetic peptide
  Seed: LGPNGTQPQF (TYRP2_HUMAN)
LGPNGTQPQW

SEQ ID NO: 183346 - protein, 10 aa, Artificial Sequence
  Description of Artificial Sequence: Synthetic peptide
  Seed: LVVMGTLVAL (TYRP2_HUMAN)
LHVMGTLVAA

SEQ ID NO: 183347 - protein, 9 aa, Artificial Sequence
  Description of Artificial Sequence: Synthetic peptide
  Seed: STFSFRNAL (TYRP2_HUMAN)
SKFSFRNAW

SEQ ID NO: 183348 - protein, 10 aa, Artificial Sequence
  Description of Artificial Sequence: Synthetic peptide
  Seed: FPPVTNEELF (TYRP2_HUMAN)
FWPVTNEELW

SEQ ID NO: 183349 - protein, 9 aa, Artificial Sequence
  Description of Artificial Sequence: Synthetic peptide
  Seed: SRNSRFSSW (TYRP2_HUMAN)
SQNSRFSSI

SEQ ID NO: 183350 - protein, 9 aa, Artificial Sequence
  Description of Artificial Sequence: Synthetic peptide
  Seed: AARPDDPTL (TYRP2_HUMAN)
AQRPDDPTM

SEQ ID NO: 183351 - protein, 10 aa, Artificial Sequence
  Description of Artificial Sequence: Synthetic peptide
  Seed: LWWGFLLSCL (TYRP2_HUMAN)
LYWGFLLSCF

SEQ ID NO: 183352 - protein, 8 aa, Artificial Sequence
  Description of Artificial Sequence: Synthetic peptide
  Seed: RPDDPTLI (TYRP2_HUMAN)
RSDDPTLL

SEQ ID NO: 183353 - protein, 9 aa, Artificial Sequence
  Description of Artificial Sequence: Synthetic peptide
  Seed: ARPDDPTLI (TYRP2_HUMAN)
ARPDDPTLF

SEQ ID NO: 183354 - protein, 10 aa, Artificial Sequence
  Description of Artificial Sequence: Synthetic peptide
  Seed: RNSRFSSWET (TYRP2_HUMAN)
RGSRFSSWEK

SEQ ID NO: 183355 - protein, 10 aa, Artificial Sequence
  Description of Artificial Sequence: Synthetic peptide
  Seed: HSAANDPIFV (TYRP2_HUMAN)
HVAANDPIFV

SEQ ID NO: 183356 - protein, 10 aa, Artificial Sequence
  Description of Artificial Sequence: Synthetic peptide
  Seed: LHYYSVRDTL (TYRP2_HUMAN)
LWYYSVRDTI

SEQ ID NO: 183357 - protein, 9 aa, Artificial Sequence
  Description of Artificial Sequence: Synthetic peptide
  Seed: YSYAIDLPV (TYRP2_HUMAN)
YPYAIDLPQ

SEQ ID NO: 183358 - protein, 9 aa, Artificial Sequence
  Description of Artificial Sequence: Synthetic peptide
  Seed: SVYDFFVWL (TYRP2_HUMAN)
SSYDFFVWV

SEQ ID NO: 183359 - protein, 9 aa, Artificial Sequence
  Description of Artificial Sequence: Synthetic peptide
  Seed: ALDLAKKRV (TYRP2_HUMAN)
AADLAKKRF

SEQ ID NO: 183360 - protein, 9 aa, Artificial Sequence
  Description of Artificial Sequence: Synthetic peptide
  Seed: NSMKLPTLK (TYRP2_HUMAN)
NFMKLPTLK

SEQ ID NO: 183361 - protein, 9 aa, Artificial Sequence
  Description of Artificial Sequence: Synthetic peptide
  Seed: FANCSVYDF (TYRP2_HUMAN)
FQNCSVYDL

SEQ ID NO: 183362 - protein, 10 aa, Artificial Sequence
  Description of Artificial Sequence: Synthetic peptide
  Seed: SLQKFDNPPF (TYRP2_HUMAN)
SMQKFDNPPM

SEQ ID NO: 183363 - protein, 10 aa, Artificial Sequence
  Description of Artificial Sequence: Synthetic peptide
  Seed: YDFFVWLHYY (TYRP2_HUMAN)
YFFFVWLHYR

SEQ ID NO: 183364 - protein, 10 aa, Artificial Sequence
  Description of Artificial Sequence: Synthetic peptide
  Seed: HNRMYNMVPF (TYRP2_HUMAN)
HIRMYNMVPY

SEQ ID NO: 183365 - protein, 9 aa, Artificial Sequence
  Description of Artificial Sequence: Synthetic peptide
  Seed: FPPVTNEEL (TYRP2_HUMAN)
FHPVTNEEI

SEQ ID NO: 183366 - protein, 10 aa, Artificial Sequence
  Description of Artificial Sequence: Synthetic peptide
  Seed: VLLAFLQYRR (TYRP2_HUMAN)
VMLAFLQYRK

SEQ ID NO: 183367 - protein, 10 aa, Artificial Sequence
  Description of Artificial Sequence: Synthetic peptide
  Seed: NGTYEGLLRR (TYRP2_HUMAN)
NGTYEGLLRK

SEQ ID NO: 183368 - protein, 9 aa, Artificial Sequence
  Description of Artificial Sequence: Synthetic peptide
  Seed: ETPGWPTTL (TYRP2_HUMAN)
EFPGWPTTF

SEQ ID NO: 183369 - protein, 9 aa, Artificial Sequence
  Description of Artificial Sequence: Synthetic peptide
  Seed: STFSFRNAL (TYRP2_HUMAN)
SHFSFRNAL

SEQ ID NO: 183370 - protein, 9 aa, Artificial Sequence
  Description of Artificial Sequence: Synthetic peptide
  Seed: ANDPIFVVL (TYRP2_HUMAN)
ARDPIFVVI

SEQ ID NO: 183371 - protein, 10 aa, Artificial Sequence
  Description of Artificial Sequence: Synthetic peptide
  Seed: MGRNSMKLPT (TYRP2_HUMAN)
MSRNSMKLPK

SEQ ID NO: 183372 - protein, 9 aa, Artificial Sequence
  Description of Artificial Sequence: Synthetic peptide
  Seed: RKFFHRTCK (TYRP2_HUMAN)
RMFFHRTCL

SEQ ID NO: 183373 - protein, 9 aa, Artificial Sequence
  Description of Artificial Sequence: Synthetic peptide
  Seed: SVYDFFVWL (TYRP2_HUMAN)
SIYDFFVWK

SEQ ID NO: 183374 - protein, 9 aa, Artificial Sequence
  Description of Artificial Sequence: Synthetic peptide
  Seed: YSVRDTLLG (TYRP2_HUMAN)
YSVRDTLLY

SEQ ID NO: 183375 - protein, 9 aa, Artificial Sequence
  Description of Artificial Sequence: Synthetic peptide
  Seed: FLNGTNALP (TYRP2_HUMAN)
FANGTNALV

SEQ ID NO: 183376 - protein, 10 aa, Artificial Sequence
  Description of Artificial Sequence: Synthetic peptide
  Seed: SLHNLVHSFL (TYRP2_HUMAN)
SLHNLVHSFI

SEQ ID NO: 183377 - protein, 10 aa, Artificial Sequence
  Description of Artificial Sequence: Synthetic peptide
  Seed: VALVGLFVLL (TYRP2_HUMAN)
VILVGLFVLV

SEQ ID NO: 183378 - protein, 9 aa, Artificial Sequence
  Description of Artificial Sequence: Synthetic peptide
  Seed: NESFALPYW (TYRP2_HUMAN)
NSSFALPYW

SEQ ID NO: 183379 - protein, 9 aa, Artificial Sequence
  Description of Artificial Sequence: Synthetic peptide
  Seed: YAIDLPVSV (TYRP2_HUMAN)
YTIDLPVSR

SEQ ID NO: 183380 - protein, 9 aa, Artificial Sequence
  Description of Artificial Sequence: Synthetic peptide
  Seed: QKFDNPPFF (TYRP2_HUMAN)
QMFDNPPFF

SEQ ID NO: 183381 - protein, 9 aa, Artificial Sequence
  Description of Artificial Sequence: Synthetic peptide
  Seed: SLDDYNHLV (TYRP2_HUMAN)
SVDDYNHLI

SEQ ID NO: 183382 - protein, 10 aa, Artificial Sequence
  Description of Artificial Sequence: Synthetic peptide
  Seed: FGWTGPNCER (TYRP2_HUMAN)
FTWTGPNCEK

SEQ ID NO: 183383 - protein, 9 aa, Artificial Sequence
  Description of Artificial Sequence: Synthetic peptide
  Seed: DDYNHLVTL (TYRP2_HUMAN)
DEYNHLVTW

SEQ ID NO: 183384 - protein, 10 aa, Artificial Sequence
  Description of Artificial Sequence: Synthetic peptide
  Seed: AGYNCGDCKF (TYRP2_HUMAN)
AWYNCGDCKF

SEQ ID NO: 183385 - protein, 10 aa, Artificial Sequence
  Description of Artificial Sequence: Synthetic peptide
  Seed: TRPWSGPYIL (TYRP2_HUMAN)
TLPWSGPYIY

SEQ ID NO: 183386 - protein, 8 aa, Artificial Sequence
  Description of Artificial Sequence: Synthetic peptide
  Seed: KFDNPPFF (TYRP2_HUMAN)
KSDNPPFM

SEQ ID NO: 183387 - protein, 9 aa, Artificial Sequence
  Description of Artificial Sequence: Synthetic peptide
  Seed: AARPDDPTL (TYRP2_HUMAN)
AQRPDDPTY

SEQ ID NO: 183388 - protein, 9 aa, Artificial Sequence
  Description of Artificial Sequence: Synthetic peptide
  Seed: RAIDFSHQG (TYRP2_HUMAN)
RSIDFSHQF

SEQ ID NO: 183389 - protein, 10 aa, Artificial Sequence
  Description of Artificial Sequence: Synthetic peptide
  Seed: FVLLAFLQYR (TYRP2_HUMAN)
FKLLAFLQYR

SEQ ID NO: 183390 - protein, 10 aa, Artificial Sequence
  Description of Artificial Sequence: Synthetic peptide
  Seed: RELWPRKFFH (TYRP2_HUMAN)
RVLWPRKFFR

SEQ ID NO: 183391 - protein, 10 aa, Artificial Sequence
  Description of Artificial Sequence: Synthetic peptide
  Seed: TQPQFANCSV (TYRP2_HUMAN)
TQPQFANCSL

SEQ ID NO: 183392 - protein, 10 aa, Artificial Sequence
  Description of Artificial Sequence: Synthetic peptide
  Seed: FPPVTNEELF (TYRP2_HUMAN)
FRPVTNEELF

SEQ ID NO: 183393 - protein, 9 aa, Artificial Sequence
  Description of Artificial Sequence: Synthetic peptide
  Seed: SFALPYWNF (TYRP2_HUMAN)
STALPYWNY

SEQ ID NO: 183394 - protein, 10 aa, Artificial Sequence
  Description of Artificial Sequence: Synthetic peptide
  Seed: SPLWWGFLLS (TYRP2_HUMAN)
SALWWGFLLA

SEQ ID NO: 183395 - protein, 9 aa, Artificial Sequence
  Description of Artificial Sequence: Synthetic peptide
  Seed: FSHQGPAFV (TYRP2_HUMAN)
FLHQGPAFV

SEQ ID NO: 183396 - protein, 9 aa, Artificial Sequence
  Description of Artificial Sequence: Synthetic peptide
  Seed: WHRYHLLCL (TYRP2_HUMAN)
WQRYHLLCM

SEQ ID NO: 183397 - protein, 10 aa, Artificial Sequence
  Description of Artificial Sequence: Synthetic peptide
  Seed: YSYAIDLPVS (TYRP2_HUMAN)
YTYAIDLPVV

SEQ ID NO: 183398 - protein, 11 aa, Artificial Sequence
  Description of Artificial Sequence: Synthetic peptide
  Seed: FFPPVTNEELF (TYRP2_HUMAN)
FLPPVTNEELW

SEQ ID NO: 183399 - protein, 10 aa, Artificial Sequence
  Description of Artificial Sequence: Synthetic peptide
  Seed: LTSDQLGYSY (TYRP2_HUMAN)
LLSDQLGYSW

SEQ ID NO: 183400 - protein, 10 aa, Artificial Sequence
  Description of Artificial Sequence: Synthetic peptide
  Seed: RNQMGRNSMK (TYRP2_HUMAN)
RYQMGRNSMK

SEQ ID NO: 183401 - protein, 9 aa, Artificial Sequence
  Description of Artificial Sequence: Synthetic peptide
  Seed: AARPDDPTL (TYRP2_HUMAN)
ALRPDDPTL

SEQ ID NO: 183402 - protein, 10 aa, Artificial Sequence
  Description of Artificial Sequence: Synthetic peptide
  Seed: TLVALVGLFV (TYRP2_HUMAN)
TTVALVGLFI

SEQ ID NO: 183403 - protein, 9 aa, Artificial Sequence
  Description of Artificial Sequence: Synthetic peptide
  Seed: RAIDFSHQG (TYRP2_HUMAN)
RSIDFSHQM

SEQ ID NO: 183404 - protein, 9 aa, Artificial Sequence
  Description of Artificial Sequence: Synthetic peptide
  Seed: IGHNRMYNM (TYRP2_HUMAN)
ISHNRMYNM

SEQ ID NO: 183405 - protein, 10 aa, Artificial Sequence
  Description of Artificial Sequence: Synthetic peptide
  Seed: AANDPIFVVL (TYRP2_HUMAN)
AANDPIFVVW

SEQ ID NO: 183406 - protein, 11 aa, Artificial Sequence
  Description of Artificial Sequence: Synthetic peptide
  Seed: PPFFQNSTFSF (TYRP2_HUMAN)
PYFFQNSTFSF

SEQ ID NO: 183407 - protein, 10 aa, Artificial Sequence
  Description of Artificial Sequence: Synthetic peptide
  Seed: SVYDFFVWLH (TYRP2_HUMAN)
SWYDFFVWLY

SEQ ID NO: 183408 - protein, 9 aa, Artificial Sequence
  Description of Artificial Sequence: Synthetic peptide
  Seed: AIFDEWMKR (TYRP2_HUMAN)
AWFDEWMKR

SEQ ID NO: 183409 - protein, 8 aa, Artificial Sequence
  Description of Artificial Sequence: Synthetic peptide
  Seed: RPDDPTLI (TYRP2_HUMAN)
RSDDPTLM

SEQ ID NO: 183410 - protein, 9 aa, Artificial Sequence
  Description of Artificial Sequence: Synthetic peptide
  Seed: FSHQGPAFV (TYRP2_HUMAN)
FGHQGPAFM

SEQ ID NO: 183411 - protein, 9 aa, Artificial Sequence
  Description of Artificial Sequence: Synthetic peptide
  Seed: NRMYNMVPF (TYRP2_HUMAN)
NRMYNMVPY

SEQ ID NO: 183412 - protein, 9 aa, Artificial Sequence
  Description of Artificial Sequence: Synthetic peptide
  Seed: AANDPIFVV (TYRP2_HUMAN)
AANDPIFVY

SEQ ID NO: 183413 - protein, 9 aa, Artificial Sequence
  Description of Artificial Sequence: Synthetic peptide
  Seed: FQNSTFSFR (TYRP2_HUMAN)
FQNSTFSFK

SEQ ID NO: 183414 - protein, 10 aa, Artificial Sequence
  Description of Artificial Sequence: Synthetic peptide
  Seed: RNSRFSSWET (TYRP2_HUMAN)
RDSRFSSWEA

SEQ ID NO: 183415 - protein, 10 aa, Artificial Sequence
  Description of Artificial Sequence: Synthetic peptide
  Seed: VLLAFLQYRR (TYRP2_HUMAN)
VKLAFLQYRK

SEQ ID NO: 183416 - protein, 10 aa, Artificial Sequence
  Description of Artificial Sequence: Synthetic peptide
  Seed: YNMVPFFPPV (TYRP2_HUMAN)
YAMVPFFPPM

SEQ ID NO: 183417 - protein, 9 aa, Artificial Sequence
  Description of Artificial Sequence: Synthetic peptide
  Seed: YAIDLPVSV (TYRP2_HUMAN)
YYIDLPVSY

SEQ ID NO: 183418 - protein, 9 aa, Artificial Sequence
  Description of Artificial Sequence: Synthetic peptide
  Seed: SLDDYNHLV (TYRP2_HUMAN)
SNDDYNHLL

SEQ ID NO: 183419 - protein, 9 aa, Artificial Sequence
  Description of Artificial Sequence: Synthetic peptide
  Seed: TPGWPTTLL (TYRP2_HUMAN)
TPGWPTTLA

SEQ ID NO: 183420 - protein, 10 aa, Artificial Sequence
  Description of Artificial Sequence: Synthetic peptide
  Seed: FPPVTNEELF (TYRP2_HUMAN)
FKPVTNEELY

SEQ ID NO: 183421 - protein, 10 aa, Artificial Sequence
  Description of Artificial Sequence: Synthetic peptide
  Seed: RLRKGYTPLM (TYRP2_HUMAN)
RWRKGYTPLK

SEQ ID NO: 183422 - protein, 9 aa, Artificial Sequence
  Description of Artificial Sequence: Synthetic peptide
  Seed: ALVGLFVLL (TYRP2_HUMAN)
ALVGLFVLF

SEQ ID NO: 183423 - protein, 9 aa, Artificial Sequence
  Description of Artificial Sequence: Synthetic peptide
  Seed: REQFLGALD (TYRP2_HUMAN)
REQFLGALI

SEQ ID NO: 183424 - protein, 9 aa, Artificial Sequence
  Description of Artificial Sequence: Synthetic peptide
  Seed: ISRNSRFSS (TYRP2_HUMAN)
IVRNSRFSV

SEQ ID NO: 183425 - protein, 11 aa, Artificial Sequence
  Description of Artificial Sequence: Synthetic peptide
  Seed: WLHYYSVRDTL (TYRP2_HUMAN)
WHHYYSVRDTF

SEQ ID NO: 183426 - protein, 9 aa, Artificial Sequence
  Description of Artificial Sequence: Synthetic peptide
  Seed: VDSLVNKEC (TYRP2_HUMAN)
VESLVNKEA

SEQ ID NO: 183427 - protein, 8 aa, Artificial Sequence
  Description of Artificial Sequence: Synthetic peptide
  Seed: YYSVRDTL (TYRP2_HUMAN)
YFSVRDTF

SEQ ID NO: 183428 - protein, 10 aa, Artificial Sequence
  Description of Artificial Sequence: Synthetic peptide
  Seed: HNRMYNMVPF (TYRP2_HUMAN)
HIRMYNMVPF

SEQ ID NO: 183429 - protein, 9 aa, Artificial Sequence
  Description of Artificial Sequence: Synthetic peptide
  Seed: LSPQEREQF (TYRP2_HUMAN)
LGPQEREQL

SEQ ID NO: 183430 - protein, 9 aa, Artificial Sequence
  Description of Artificial Sequence: Synthetic peptide
  Seed: GWPTTLLVV (TYRP2_HUMAN)
GFPTTLLVY

SEQ ID NO: 183431 - protein, 9 aa, Artificial Sequence
  Description of Artificial Sequence: Synthetic peptide
  Seed: SQVMSLHNL (TYRP2_HUMAN)
SEVMSLHNI

SEQ ID NO: 183432 - protein, 10 aa, Artificial Sequence
  Description of Artificial Sequence: Synthetic peptide
  Seed: FFPPVTNEEL (TYRP2_HUMAN)
FVPPVTNEEI

SEQ ID NO: 183433 - protein, 9 aa, Artificial Sequence
  Description of Artificial Sequence: Synthetic peptide
  Seed: YTPLMETHL (TYRP2_HUMAN)
YRPLMETHY

SEQ ID NO: 183434 - protein, 9 aa, Artificial Sequence
  Description of Artificial Sequence: Synthetic peptide
  Seed: MTVDSLVNK (TYRP2_HUMAN)
MMVDSLVNM

SEQ ID NO: 183435 - protein, 9 aa, Artificial Sequence
  Description of Artificial Sequence: Synthetic peptide
  Seed: FTDAIFDEW (TYRP2_HUMAN)
FQDAIFDEM

SEQ ID NO: 183436 - protein, 10 aa, Artificial Sequence
  Description of Artificial Sequence: Synthetic peptide
  Seed: RLIGNESFAL (TYRP2_HUMAN)
RIIGNESFAF

SEQ ID NO: 183437 - protein, 9 aa, Artificial Sequence
  Description of Artificial Sequence: Synthetic peptide
  Seed: GQFPRVCMT (TYRP2_HUMAN)
GVFPRVCML

SEQ ID NO: 183438 - protein, 9 aa, Artificial Sequence
  Description of Artificial Sequence: Synthetic peptide
  Seed: RLIGNESFA (TYRP2_HUMAN)
RVIGNESFI

SEQ ID NO: 183439 - protein, 9 aa, Artificial Sequence
  Description of Artificial Sequence: Synthetic peptide
  Seed: RQNIHSLSP (TYRP2_HUMAN)
RKNIHSLSV

SEQ ID NO: 183440 - protein, 10 aa, Artificial Sequence
  Description of Artificial Sequence: Synthetic peptide
  Seed: TQPQFANCSV (TYRP2_HUMAN)
TLPQFANCSI

SEQ ID NO: 183441 - protein, 9 aa, Artificial Sequence
  Description of Artificial Sequence: Synthetic peptide
  Seed: TSDQLGYSY (TYRP2_HUMAN)
TQDQLGYSM

SEQ ID NO: 183442 - protein, 9 aa, Artificial Sequence
  Description of Artificial Sequence: Synthetic peptide
  Seed: LRKGYTPLM (TYRP2_HUMAN)
LKKGYTPLF

SEQ ID NO: 183443 - protein, 10 aa, Artificial Sequence
  Description of Artificial Sequence: Synthetic peptide
  Seed: RTCKCTGNFA (TYRP2_HUMAN)
RQCKCTGNFK

SEQ ID NO: 183444 - protein, 8 aa, Artificial Sequence
  Description of Artificial Sequence: Synthetic peptide
  Seed: FQNSTFSF (TYRP2_HUMAN)
FQNSTFSL

SEQ ID NO: 183445 - protein, 9 aa, Artificial Sequence
  Description of Artificial Sequence: Synthetic peptide
  Seed: GFDKADGTL (TYRP2_HUMAN)
GSDKADGTL

SEQ ID NO: 183446 - protein, 9 aa, Artificial Sequence
  Description of Artificial Sequence: Synthetic peptide
  Seed: SFRNALEGF (TYRP2_HUMAN)
SIRNALEGY

SEQ ID NO: 183447 - protein, 11 aa, Artificial Sequence
  Description of Artificial Sequence: Synthetic peptide
  Seed: FVVLHSFTDAI (TYRP2_HUMAN)
FIVLHSFTDAI

SEQ ID NO: 183448 - protein, 10 aa, Artificial Sequence
  Description of Artificial Sequence: Synthetic peptide
  Seed: LHYYSVRDTL (TYRP2_HUMAN)
LAYYSVRDTL

SEQ ID NO: 183449 - protein, 9 aa, Artificial Sequence
  Description of Artificial Sequence: Synthetic peptide
  Seed: RKFFHRTCK (TYRP2_HUMAN)
RVFFHRTCV

SEQ ID NO: 183450 - protein, 10 aa, Artificial Sequence
  Description of Artificial Sequence: Synthetic peptide
  Seed: FVWLHYYSVR (TYRP2_HUMAN)
FWWLHYYSVR

SEQ ID NO: 183451 - protein, 9 aa, Artificial Sequence
  Description of Artificial Sequence: Synthetic peptide
  Seed: MTVDSLVNK (TYRP2_HUMAN)
MPVDSLVNR

SEQ ID NO: 183452 - protein, 9 aa, Artificial Sequence
  Description of Artificial Sequence: Synthetic peptide
  Seed: SQVMSLHNL (TYRP2_HUMAN)
SRVMSLHNF

SEQ ID NO: 183453 - protein, 8 aa, Artificial Sequence
  Description of Artificial Sequence: Synthetic peptide
  Seed: FSHQGPAF (TYRP2_HUMAN)
FTHQGPAY

SEQ ID NO: 183454 - protein, 9 aa, Artificial Sequence
  Description of Artificial Sequence: Synthetic peptide
  Seed: FLLSCLGCK (TYRP2_HUMAN)
FSLSCLGCR

SEQ ID NO: 183455 - protein, 10 aa, Artificial Sequence
  Description of Artificial Sequence: Synthetic peptide
  Seed: SPLWWGFLLS (TYRP2_HUMAN)
STLWWGFLLV

SEQ ID NO: 183456 - protein, 11 aa, Artificial Sequence
  Description of Artificial Sequence: Synthetic peptide
  Seed: YTPLMETHLSS (TYRP2_HUMAN)
YCPLMETHLSV

SEQ ID NO: 183457 - protein, 10 aa, Artificial Sequence
  Description of Artificial Sequence: Synthetic peptide
  Seed: ALVGLFVLLA (TYRP2_HUMAN)
ALVGLFVLLV

SEQ ID NO: 183458 - protein, 9 aa, Artificial Sequence
  Description of Artificial Sequence: Synthetic peptide
  Seed: TLISRNSRF (TYRP2_HUMAN)
TLISRNSRY

SEQ ID NO: 183459 - protein, 9 aa, Artificial Sequence
  Description of Artificial Sequence: Synthetic peptide
  Seed: VHPDYVITT (TYRP2_HUMAN)
VVPDYVITL

SEQ ID NO: 183460 - protein, 10 aa, Artificial Sequence
  Description of Artificial Sequence: Synthetic peptide
  Seed: GYTPLMETHL (TYRP2_HUMAN)
GWTPLMETHF

SEQ ID NO: 183461 - protein, 9 aa, Artificial Sequence
  Description of Artificial Sequence: Synthetic peptide
  Seed: FLTSDQLGY (TYRP2_HUMAN)
FPTSDQLGY

SEQ ID NO: 183462 - protein, 9 aa, Artificial Sequence
  Description of Artificial Sequence: Synthetic peptide
  Seed: TLLGPGRPY (TYRP2_HUMAN)
TKLGPGRPY

SEQ ID NO: 183463 - protein, 9 aa, Artificial Sequence
  Description of Artificial Sequence: Synthetic peptide
  Seed: DFFVWLHYY (TYRP2_HUMAN)
DQFVWLHYR

SEQ ID NO: 183464 - protein, 9 aa, Artificial Sequence
  Description of Artificial Sequence: Synthetic peptide
  Seed: FVWLHYYSV (TYRP2_HUMAN)
FGWLHYYSV

SEQ ID NO: 183465 - protein, 9 aa, Artificial Sequence
  Description of Artificial Sequence: Synthetic peptide
  Seed: AANDPIFVV (TYRP2_HUMAN)
AINDPIFVM

SEQ ID NO: 183466 - protein, 9 aa, Artificial Sequence
  Description of Artificial Sequence: Synthetic peptide
  Seed: NRMYNMVPF (TYRP2_HUMAN)
NFMYNMVPI

SEQ ID NO: 183467 - protein, 10 aa, Artificial Sequence
  Description of Artificial Sequence: Synthetic peptide
  Seed: IDFSHQGPAF (TYRP2_HUMAN)
IMFSHQGPAY

SEQ ID NO: 183468 - protein, 10 aa, Artificial Sequence
  Description of Artificial Sequence: Synthetic peptide
  Seed: ELAPIGHNRM (TYRP2_HUMAN)
ETAPIGHNRM

SEQ ID NO: 183469 - protein, 10 aa, Artificial Sequence
  Description of Artificial Sequence: Synthetic peptide
  Seed: MSPLWWGFLL (TYRP2_HUMAN)
MPPLWWGFLV

SEQ ID NO: 183470 - protein, 10 aa, Artificial Sequence
  Description of Artificial Sequence: Synthetic peptide
  Seed: SYAIDLPVSV (TYRP2_HUMAN)
SWAIDLPVSW

SEQ ID NO: 183471 - protein, 9 aa, Artificial Sequence
  Description of Artificial Sequence: Synthetic peptide
  Seed: LVHSFLNGT (TYRP2_HUMAN)
LLHSFLNGM

SEQ ID NO: 183472 - protein, 10 aa, Artificial Sequence
  Description of Artificial Sequence: Synthetic peptide
  Seed: HSAANDPIFV (TYRP2_HUMAN)
HLAANDPIFV

SEQ ID NO: 183473 - protein, 10 aa, Artificial Sequence
  Description of Artificial Sequence: Synthetic peptide
  Seed: KRFNPPADAW (TYRP2_HUMAN)
KVFNPPADAF

SEQ ID NO: 183474 - protein, 10 aa, Artificial Sequence
  Description of Artificial Sequence: Synthetic peptide
  Seed: KRFNPPADAW (TYRP2_HUMAN)
KQFNPPADAL

SEQ ID NO: 183475 - protein, 9 aa, Artificial Sequence
  Description of Artificial Sequence: Synthetic peptide
  Seed: VTWHRYHLL (TYRP2_HUMAN)
VWWHRYHLI

SEQ ID NO: 183476 - protein, 9 aa, Artificial Sequence
  Description of Artificial Sequence: Synthetic peptide
  Seed: MSPLWWGFL (TYRP2_HUMAN)
MWPLWWGFI

SEQ ID NO: 183477 - protein, 8 aa, Artificial Sequence
  Description of Artificial Sequence: Synthetic peptide
  Seed: ANDPIFVV (TYRP2_HUMAN)
ATDPIFVI

SEQ ID NO: 183478 - protein, 9 aa, Artificial Sequence
  Description of Artificial Sequence: Synthetic peptide
  Seed: SHQGPAFVT (TYRP2_HUMAN)
SRQGPAFVM

SEQ ID NO: 183479 - protein, 10 aa, Artificial Sequence
  Description of Artificial Sequence: Synthetic peptide
  Seed: SDQLGYSYAI (TYRP2_HUMAN)
SGQLGYSYAY

SEQ ID NO: 183480 - protein, 10 aa, Artificial Sequence
  Description of Artificial Sequence: Synthetic peptide
  Seed: YNMVPFFPPV (TYRP2_HUMAN)
YMMVPFFPPF

SEQ ID NO: 183481 - protein, 9 aa, Artificial Sequence
  Description of Artificial Sequence: Synthetic peptide
  Seed: GTNALPHSA (TYRP2_HUMAN)
GQNALPHSL

SEQ ID NO: 183482 - protein, 10 aa, Artificial Sequence
  Description of Artificial Sequence: Synthetic peptide
  Seed: PFFQNSTFSF (TYRP2_HUMAN)
PYFQNSTFSY

SEQ ID NO: 183483 - protein, 10 aa, Artificial Sequence
  Description of Artificial Sequence: Synthetic peptide
  Seed: FVWLHYYSVR (TYRP2_HUMAN)
FLWLHYYSVT

SEQ ID NO: 183484 - protein, 10 aa, Artificial Sequence
  Description of Artificial Sequence: Synthetic peptide
  Seed: DSLDDYNHLV (TYRP2_HUMAN)
DILDDYNHLV

SEQ ID NO: 183485 - protein, 10 aa, Artificial Sequence
  Description of Artificial Sequence: Synthetic peptide
  Seed: SPLWWGFLLS (TYRP2_HUMAN)
SMLWWGFLLV

SEQ ID NO: 183486 - protein, 10 aa, Artificial Sequence
  Description of Artificial Sequence: Synthetic peptide
  Seed: SSWETVCDSL (TYRP2_HUMAN)
SLWETVCDSI

SEQ ID NO: 183487 - protein, 10 aa, Artificial Sequence
  Description of Artificial Sequence: Synthetic peptide
  Seed: FQNSTFSFRN (TYRP2_HUMAN)
FFNSTFSFRR

SEQ ID NO: 183488 - protein, 11 aa, Artificial Sequence
  Description of Artificial Sequence: Synthetic peptide
  Seed: RRLRKGYTPLM (TYRP2_HUMAN)
RRLRKGYTPLF

SEQ ID NO: 183489 - protein, 11 aa, Artificial Sequence
  Description of Artificial Sequence: Synthetic peptide
  Seed: YSYAIDLPVSV (TYRP2_HUMAN)
YMYAIDLPVSV

SEQ ID NO: 183490 - protein, 9 aa, Artificial Sequence
  Description of Artificial Sequence: Synthetic peptide
  Seed: VLLAFLQYR (TYRP2_HUMAN)
VSLAFLQYK

SEQ ID NO: 183491 - protein, 10 aa, Artificial Sequence
  Description of Artificial Sequence: Synthetic peptide
  Seed: IDFSHQGPAF (TYRP2_HUMAN)
IEFSHQGPAI

SEQ ID NO: 183492 - protein, 10 aa, Artificial Sequence
  Description of Artificial Sequence: Synthetic peptide
  Seed: SLDDYNHLVT (TYRP2_HUMAN)
SNDDYNHLVM

SEQ ID NO: 183493 - protein, 9 aa, Artificial Sequence
  Description of Artificial Sequence: Synthetic peptide
  Seed: YTPLMETHL (TYRP2_HUMAN)
YTPLMETHM

SEQ ID NO: 183494 - protein, 10 aa, Artificial Sequence
  Description of Artificial Sequence: Synthetic peptide
  Seed: FVVLHSFTDA (TYRP2_HUMAN)
FRVLHSFTDV

SEQ ID NO: 183495 - protein, 10 aa, Artificial Sequence
  Description of Artificial Sequence: Synthetic peptide
  Seed: FVWLHYYSVR (TYRP2_HUMAN)
FLWLHYYSVG

SEQ ID NO: 183496 - protein, 11 aa, Artificial Sequence
  Description of Artificial Sequence: Synthetic peptide
  Seed: WLHYYSVRDTL (TYRP2_HUMAN)
WLHYYSVRDTF

SEQ ID NO: 183497 - protein, 9 aa, Artificial Sequence
  Description of Artificial Sequence: Synthetic peptide
  Seed: SVYDFFVWL (TYRP2_HUMAN)
SGYDFFVWY

SEQ ID NO: 183498 - protein, 9 aa, Artificial Sequence
  Description of Artificial Sequence: Synthetic peptide
  Seed: VVMGTLVAL (TYRP2_HUMAN)
VFMGTLVAF

SEQ ID NO: 183499 - protein, 10 aa, Artificial Sequence
  Description of Artificial Sequence: Synthetic peptide
  Seed: SDQLGYSYAI (TYRP2_HUMAN)
SGQLGYSYAL

SEQ ID NO: 183500 - protein, 9 aa, Artificial Sequence
  Description of Artificial Sequence: Synthetic peptide
  Seed: FPPVTNEEL (TYRP2_HUMAN)
FWPVTNEEM

SEQ ID NO: 183501 - protein, 9 aa, Artificial Sequence
  Description of Artificial Sequence: Synthetic peptide
  Seed: NSMKLPTLK (TYRP2_HUMAN)
NSMKLPTLR

SEQ ID NO: 183502 - protein, 9 aa, Artificial Sequence
  Description of Artificial Sequence: Synthetic peptide
  Seed: VLLAFLQYR (TYRP2_HUMAN)
VILAFLQYK

SEQ ID NO: 183503 - protein, 10 aa, Artificial Sequence
  Description of Artificial Sequence: Synthetic peptide
  Seed: AIFDEWMKRF (TYRP2_HUMAN)
AFFDEWMKRY

SEQ ID NO: 183504 - protein, 9 aa, Artificial Sequence
  Description of Artificial Sequence: Synthetic peptide
  Seed: ETPGWPTTL (TYRP2_HUMAN)
EAPGWPTTM

SEQ ID NO: 183505 - protein, 9 aa, Artificial Sequence
  Description of Artificial Sequence: Synthetic peptide
  Seed: VPFFPPVTN (TYRP2_HUMAN)
VPFFPPVTS

SEQ ID NO: 183506 - protein, 9 aa, Artificial Sequence
  Description of Artificial Sequence: Synthetic peptide
  Seed: RNQDDRELW (TYRP2_HUMAN)
RMQDDRELM

SEQ ID NO: 183507 - protein, 10 aa, Artificial Sequence
  Description of Artificial Sequence: Synthetic peptide
  Seed: HLVTLCNGTY (TYRP2_HUMAN)
HFVTLCNGTY

SEQ ID NO: 183508 - protein, 9 aa, Artificial Sequence
  Description of Artificial Sequence: Synthetic peptide
  Seed: RLRKGYTPL (TYRP2_HUMAN)
RGRKGYTPI

SEQ ID NO: 183509 - protein, 10 aa, Artificial Sequence
  Description of Artificial Sequence: Synthetic peptide
  Seed: FPPVTNEELF (TYRP2_HUMAN)
FQPVTNEELW

SEQ ID NO: 183510 - protein, 9 aa, Artificial Sequence
  Description of Artificial Sequence: Synthetic peptide
  Seed: HSFLNGTNA (TYRP2_HUMAN)
HHFLNGTNT

SEQ ID NO: 183511 - protein, 9 aa, Artificial Sequence
  Description of Artificial Sequence: Synthetic peptide
  Seed: LLAFLQYRR (TYRP2_HUMAN)
LIAFLQYRK

SEQ ID NO: 183512 - protein, 10 aa, Artificial Sequence
  Description of Artificial Sequence: Synthetic peptide
  Seed: LFLTSDQLGY (TYRP2_HUMAN)
LMLTSDQLGY

SEQ ID NO: 183513 - protein, 10 aa, Artificial Sequence
  Description of Artificial Sequence: Synthetic peptide
  Seed: HSFLNGTNAL (TYRP2_HUMAN)
HIFLNGTNAM

SEQ ID NO: 183514 - protein, 9 aa, Artificial Sequence
  Description of Artificial Sequence: Synthetic peptide
  Seed: YSVRDTLLG (TYRP2_HUMAN)
YAVRDTLLY

SEQ ID NO: 183515 - protein, 10 aa, Artificial Sequence
  Description of Artificial Sequence: Synthetic peptide
  Seed: HNRMYNMVPF (TYRP2_HUMAN)
HVRMYNMVPF

SEQ ID NO: 183516 - protein, 9 aa, Artificial Sequence
  Description of Artificial Sequence: Synthetic peptide
  Seed: VPFFPPVTN (TYRP2_HUMAN)
VPFFPPVTF

SEQ ID NO: 183517 - protein, 9 aa, Artificial Sequence
  Description of Artificial Sequence: Synthetic peptide
  Seed: IGHNRMYNM (TYRP2_HUMAN)
IPHNRMYNL

SEQ ID NO: 183518 - protein, 11 aa, Artificial Sequence
  Description of Artificial Sequence: Synthetic peptide
  Seed: RADTRPWSGPY (TYRP2_HUMAN)
RPDTRPWSGPA

SEQ ID NO: 183519 - protein, 9 aa, Artificial Sequence
  Description of Artificial Sequence: Synthetic peptide
  Seed: ILPGAQGQF (TYRP2_HUMAN)
IYPGAQGQI

SEQ ID NO: 183520 - protein, 9 aa, Artificial Sequence
  Description of Artificial Sequence: Synthetic peptide
  Seed: SLDDYNHLV (TYRP2_HUMAN)
SADDYNHLA

SEQ ID NO: 183521 - protein, 10 aa, Artificial Sequence
  Description of Artificial Sequence: Synthetic peptide
  Seed: ALVGLFVLLA (TYRP2_HUMAN)
AQVGLFVLLL

SEQ ID NO: 183522 - protein, 10 aa, Artificial Sequence
  Description of Artificial Sequence: Synthetic peptide
  Seed: TVDSLVNKEC (TYRP2_HUMAN)
TVDSLVNKEL

SEQ ID NO: 183523 - protein, 10 aa, Artificial Sequence
  Description of Artificial Sequence: Synthetic peptide
  Seed: QPQFANCSVY (TYRP2_HUMAN)
QMQFANCSVM

SEQ ID NO: 183524 - protein, 9 aa, Artificial Sequence
  Description of Artificial Sequence: Synthetic peptide
  Seed: LVGLFVLLA (TYRP2_HUMAN)
LQGLFVLLV

SEQ ID NO: 183525 - protein, 10 aa, Artificial Sequence
  Description of Artificial Sequence: Synthetic peptide
  Seed: YNMVPFFPPV (TYRP2_HUMAN)
YLMVPFFPPM

SEQ ID NO: 183526 - protein, 11 aa, Artificial Sequence
  Description of Artificial Sequence: Synthetic peptide
  Seed: YNMVPFFPPVT (TYRP2_HUMAN)
YIMVPFFPPVF

SEQ ID NO: 183527 - protein, 9 aa, Artificial Sequence
  Description of Artificial Sequence: Synthetic peptide
  Seed: FLNGTNALP (TYRP2_HUMAN)
FQNGTNALL

SEQ ID NO: 183528 - protein, 9 aa, Artificial Sequence
  Description of Artificial Sequence: Synthetic peptide
  Seed: STFSFRNAL (TYRP2_HUMAN)
SFFSFRNAI

SEQ ID NO: 183529 - protein, 9 aa, Artificial Sequence
  Description of Artificial Sequence: Synthetic peptide
  Seed: WMKRFNPPA (TYRP2_HUMAN)
WTKRFNPPA

SEQ ID NO: 183530 - protein, 11 aa, Artificial Sequence
  Description of Artificial Sequence: Synthetic peptide
  Seed: MYNMVPFFPPV (TYRP2_HUMAN)
MANMVPFFPPV

SEQ ID NO: 183531 - protein, 10 aa, Artificial Sequence
  Description of Artificial Sequence: Synthetic peptide
  Seed: RNSMKLPTLK (TYRP2_HUMAN)
RESMKLPTLR

SEQ ID NO: 183532 - protein, 10 aa, Artificial Sequence
  Description of Artificial Sequence: Synthetic peptide
  Seed: YNMVPFFPPV (TYRP2_HUMAN)
YLMVPFFPPV

SEQ ID NO: 183533 - protein, 10 aa, Artificial Sequence
  Description of Artificial Sequence: Synthetic peptide
  Seed: WPTTLLVVMG (TYRP2_HUMAN)
WPTTLLVVMM

SEQ ID NO: 183534 - protein, 11 aa, Artificial Sequence
  Description of Artificial Sequence: Synthetic peptide
  Seed: MSLHNLVHSFL (TYRP2_HUMAN)
MVLHNLVHSFV

SEQ ID NO: 183535 - protein, 9 aa, Artificial Sequence
  Description of Artificial Sequence: Synthetic peptide
  Seed: FSHQGPAFV (TYRP2_HUMAN)
FSHQGPAFM

SEQ ID NO: 183536 - protein, 9 aa, Artificial Sequence
  Description of Artificial Sequence: Synthetic peptide
  Seed: RNQDDRELW (TYRP2_HUMAN)
RVQDDRELM

SEQ ID NO: 183537 - protein, 11 aa, Artificial Sequence
  Description of Artificial Sequence: Synthetic peptide
  Seed: TQPQFANCSVY (TYRP2_HUMAN)
TTPQFANCSVM

SEQ ID NO: 183538 - protein, 10 aa, Artificial Sequence
  Description of Artificial Sequence: Synthetic peptide
  Seed: VALVGLFVLL (TYRP2_HUMAN)
VQLVGLFVLV

SEQ ID NO: 183539 - protein, 10 aa, Artificial Sequence
  Description of Artificial Sequence: Synthetic peptide
  Seed: DPTLISRNSR (TYRP2_HUMAN)
DMTLISRNSR

SEQ ID NO: 183540 - protein, 10 aa, Artificial Sequence
  Description of Artificial Sequence: Synthetic peptide
  Seed: AANDPIFVVL (TYRP2_HUMAN)
AQNDPIFVVF

SEQ ID NO: 183541 - protein, 10 aa, Artificial Sequence
  Description of Artificial Sequence: Synthetic peptide
  Seed: NSTFSFRNAL (TYRP2_HUMAN)
NCTFSFRNAL

SEQ ID NO: 183542 - protein, 9 aa, Artificial Sequence
  Description of Artificial Sequence: Synthetic peptide
  Seed: SRNSRFSSW (TYRP2_HUMAN)
SQNSRFSSL

SEQ ID NO: 183543 - protein, 10 aa, Artificial Sequence
  Description of Artificial Sequence: Synthetic peptide
  Seed: HNRMYNMVPF (TYRP2_HUMAN)
HWRMYNMVPL

SEQ ID NO: 183544 - protein, 9 aa, Artificial Sequence
  Description of Artificial Sequence: Synthetic peptide
  Seed: TQHWLGLLG (TYRP2_HUMAN)
TSHWLGLLF

SEQ ID NO: 183545 - protein, 10 aa, Artificial Sequence
  Description of Artificial Sequence: Synthetic peptide
  Seed: MSPLWWGFLL (TYRP2_HUMAN)
MIPLWWGFLI

SEQ ID NO: 183546 - protein, 10 aa, Artificial Sequence
  Description of Artificial Sequence: Synthetic peptide
  Seed: NSTFSFRNAL (TYRP2_HUMAN)
NYTFSFRNAV

SEQ ID NO: 183547 - protein, 10 aa, Artificial Sequence
  Description of Artificial Sequence: Synthetic peptide
  Seed: NSRFSSWETV (TYRP2_HUMAN)
NARFSSWETL

SEQ ID NO: 183548 - protein, 10 aa, Artificial Sequence
  Description of Artificial Sequence: Synthetic peptide
  Seed: AIFDEWMKRF (TYRP2_HUMAN)
AQFDEWMKRM

SEQ ID NO: 183549 - protein, 10 aa, Artificial Sequence
  Description of Artificial Sequence: Synthetic peptide
  Seed: HNRMYNMVPF (TYRP2_HUMAN)
HERMYNMVPF

SEQ ID NO: 183550 - protein, 9 aa, Artificial Sequence
  Description of Artificial Sequence: Synthetic peptide
  Seed: GTYEGLLRR (TYRP2_HUMAN)
GSYEGLLRY

SEQ ID NO: 183551 - protein, 9 aa, Artificial Sequence
  Description of Artificial Sequence: Synthetic peptide
  Seed: DFFVWLHYY (TYRP2_HUMAN)
DAFVWLHYR

SEQ ID NO: 183552 - protein, 10 aa, Artificial Sequence
  Description of Artificial Sequence: Synthetic peptide
  Seed: RMYNMVPFFP (TYRP2_HUMAN)
RSYNMVPFFV

SEQ ID NO: 183553 - protein, 10 aa, Artificial Sequence
  Description of Artificial Sequence: Synthetic peptide
  Seed: YDFFVWLHYY (TYRP2_HUMAN)
YEFFVWLHYF

SEQ ID NO: 183554 - protein, 9 aa, Artificial Sequence
  Description of Artificial Sequence: Synthetic peptide
  Seed: LGALDLAKK (TYRP2_HUMAN)
LTALDLAKK

SEQ ID NO: 183555 - protein, 9 aa, Artificial Sequence
  Description of Artificial Sequence: Synthetic peptide
  Seed: FSHQGPAFV (TYRP2_HUMAN)
FAHQGPAFM

SEQ ID NO: 183556 - protein, 9 aa, Artificial Sequence
  Description of Artificial Sequence: Synthetic peptide
  Seed: AESANVCGS (TYRP2_HUMAN)
AESANVCGA

SEQ ID NO: 183557 - protein, 9 aa, Artificial Sequence
  Description of Artificial Sequence: Synthetic peptide
  Seed: SFRNALEGF (TYRP2_HUMAN)
SVRNALEGF

SEQ ID NO: 183558 - protein, 9 aa, Artificial Sequence
  Description of Artificial Sequence: Synthetic peptide
  Seed: SLHNLVHSF (TYRP2_HUMAN)
SIHNLVHSW

SEQ ID NO: 183559 - protein, 9 aa, Artificial Sequence
  Description of Artificial Sequence: Synthetic peptide
  Seed: SLDDYNHLV (TYRP2_HUMAN)
STDDYNHLH

SEQ ID NO: 183560 - protein, 9 aa, Artificial Sequence
  Description of Artificial Sequence: Synthetic peptide
  Seed: RLRKGYTPL (TYRP2_HUMAN)
RVRKGYTPW

SEQ ID NO: 183561 - protein, 8 aa, Artificial Sequence
  Description of Artificial Sequence: Synthetic peptide
  Seed: QVMSLHNL (TYRP2_HUMAN)
QQMSLHNV

SEQ ID NO: 183562 - protein, 9 aa, Artificial Sequence
  Description of Artificial Sequence: Synthetic peptide
  Seed: LHNLVHSFL (TYRP2_HUMAN)
LRNLVHSFF

SEQ ID NO: 183563 - protein, 10 aa, Artificial Sequence
  Description of Artificial Sequence: Synthetic peptide
  Seed: AANDPIFVVL (TYRP2_HUMAN)
ATNDPIFVVY

SEQ ID NO: 183564 - protein, 10 aa, Artificial Sequence
  Description of Artificial Sequence: Synthetic peptide
  Seed: LISRNSRFSS (TYRP2_HUMAN)
LFSRNSRFSK

SEQ ID NO: 183565 - protein, 9 aa, Artificial Sequence
  Description of Artificial Sequence: Synthetic peptide
  Seed: YAIDLPVSV (TYRP2_HUMAN)
YPIDLPVSS

SEQ ID NO: 183566 - protein, 9 aa, Artificial Sequence
  Description of Artificial Sequence: Synthetic peptide
  Seed: NEELFLTSD (TYRP2_HUMAN)
NEELFLTSV

SEQ ID NO: 183567 - protein, 9 aa, Artificial Sequence
  Description of Artificial Sequence: Synthetic peptide
  Seed: RLRKGYTPL (TYRP2_HUMAN)
RARKGYTPR

SEQ ID NO: 183568 - protein, 10 aa, Artificial Sequence
  Description of Artificial Sequence: Synthetic peptide
  Seed: RTCKCTGNFA (TYRP2_HUMAN)
RGCKCTGNFK

SEQ ID NO: 183569 - protein, 10 aa, Artificial Sequence
  Description of Artificial Sequence: Synthetic peptide
  Seed: RMYNMVPFFP (TYRP2_HUMAN)
RMYNMVPFFM

SEQ ID NO: 183570 - protein, 11 aa, Artificial Sequence
  Description of Artificial Sequence: Synthetic peptide
  Seed: ESFALPYWNFA (TYRP2_HUMAN)
EIFALPYWNFV

SEQ ID NO: 183571 - protein, 10 aa, Artificial Sequence
  Description of Artificial Sequence: Synthetic peptide
  Seed: RMYNMVPFFP (TYRP2_HUMAN)
RLYNMVPFFM

SEQ ID NO: 183572 - protein, 11 aa, Artificial Sequence
  Description of Artificial Sequence: Synthetic peptide
  Seed: HSFTDAIFDEW (TYRP2_HUMAN)
HQFTDAIFDEW

SEQ ID NO: 183573 - protein, 10 aa, Artificial Sequence
  Description of Artificial Sequence: Synthetic peptide
  Seed: FVWLHYYSVR (TYRP2_HUMAN)
FMWLHYYSVI

SEQ ID NO: 183574 - protein, 8 aa, Artificial Sequence
  Description of Artificial Sequence: Synthetic peptide
  Seed: RMYNMVPF (TYRP2_HUMAN)
RMYNMVPW

SEQ ID NO: 183575 - protein, 9 aa, Artificial Sequence
  Description of Artificial Sequence: Synthetic peptide
  Seed: YTPLMETHL (TYRP2_HUMAN)
YMPLMETHI

SEQ ID NO: 183576 - protein, 10 aa, Artificial Sequence
  Description of Artificial Sequence: Synthetic peptide
  Seed: SPLWWGFLLS (TYRP2_HUMAN)
SLLWWGFLLT

SEQ ID NO: 183577 - protein, 9 aa, Artificial Sequence
  Description of Artificial Sequence: Synthetic peptide
  Seed: YAIDLPVSV (TYRP2_HUMAN)
YMIDLPVSV

SEQ ID NO: 183578 - protein, 8 aa, Artificial Sequence
  Description of Artificial Sequence: Synthetic peptide
  Seed: KFFHRTCK (TYRP2_HUMAN)
KVFHRTCR

SEQ ID NO: 183579 - protein, 10 aa, Artificial Sequence
  Description of Artificial Sequence: Synthetic peptide
  Seed: ELAPIGHNRM (TYRP2_HUMAN)
EVAPIGHNRY

SEQ ID NO: 183580 - protein, 10 aa, Artificial Sequence
  Description of Artificial Sequence: Synthetic peptide
  Seed: VVMGTLVALV (TYRP2_HUMAN)
VMMGTLVALS

SEQ ID NO: 183581 - protein, 9 aa, Artificial Sequence
  Description of Artificial Sequence: Synthetic peptide
  Seed: AARPDDPTL (TYRP2_HUMAN)
ALRPDDPTV

SEQ ID NO: 183582 - protein, 9 aa, Artificial Sequence
  Description of Artificial Sequence: Synthetic peptide
  Seed: TLDSQVMSL (TYRP2_HUMAN)
TADSQVMSY

SEQ ID NO: 183583 - protein, 8 aa, Artificial Sequence
  Description of Artificial Sequence: Synthetic peptide
  Seed: YYSVRDTL (TYRP2_HUMAN)
YASVRDTM

SEQ ID NO: 183584 - protein, 11 aa, Artificial Sequence
  Description of Artificial Sequence: Synthetic peptide
  Seed: DEWMKRFNPPA (TYRP2_HUMAN)
DEWMKRFNPPY

SEQ ID NO: 183585 - protein, 11 aa, Artificial Sequence
  Description of Artificial Sequence: Synthetic peptide
  Seed: FVVLHSFTDAI (TYRP2_HUMAN)
FWVLHSFTDAV

SEQ ID NO: 183586 - protein, 11 aa, Artificial Sequence
  Description of Artificial Sequence: Synthetic peptide
  Seed: HPDYVITTQHW (TYRP2_HUMAN)
HRDYVITTQHF

SEQ ID NO: 183587 - protein, 11 aa, Artificial Sequence
  Description of Artificial Sequence: Synthetic peptide
  Seed: YNMVPFFPPVT (TYRP2_HUMAN)
YIMVPFFPPVL

SEQ ID NO: 183588 - protein, 9 aa, Artificial Sequence
  Description of Artificial Sequence: Synthetic peptide
  Seed: SRFSSWETV (TYRP2_HUMAN)
SRFSSWETM

SEQ ID NO: 183589 - protein, 9 aa, Artificial Sequence
  Description of Artificial Sequence: Synthetic peptide
  Seed: LVTLCNGTY (TYRP2_HUMAN)
LATLCNGTF

SEQ ID NO: 183590 - protein, 9 aa, Artificial Sequence
  Description of Artificial Sequence: Synthetic peptide
  Seed: SLHNLVHSF (TYRP2_HUMAN)
SWHNLVHSW

SEQ ID NO: 183591 - protein, 10 aa, Artificial Sequence
  Description of Artificial Sequence: Synthetic peptide
  Seed: AANDPIFVVL (TYRP2_HUMAN)
ARNDPIFVVM

SEQ ID NO: 183592 - protein, 8 aa, Artificial Sequence
  Description of Artificial Sequence: Synthetic peptide
  Seed: LLGPGRPY (TYRP2_HUMAN)
LAGPGRPL

SEQ ID NO: 183593 - protein, 10 aa, Artificial Sequence
  Description of Artificial Sequence: Synthetic peptide
  Seed: GTLDSQVMSL (TYRP2_HUMAN)
GILDSQVMSL

SEQ ID NO: 183594 - protein, 9 aa, Artificial Sequence
  Description of Artificial Sequence: Synthetic peptide
  Seed: LLAFLQYRR (TYRP2_HUMAN)
LMAFLQYRR

SEQ ID NO: 183595 - protein, 9 aa, Artificial Sequence
  Description of Artificial Sequence: Synthetic peptide
  Seed: ELWPRKFFH (TYRP2_HUMAN)
EVWPRKFFK

SEQ ID NO: 183596 - protein, 10 aa, Artificial Sequence
  Description of Artificial Sequence: Synthetic peptide
  Seed: RLRKGYTPLM (TYRP2_HUMAN)
RFRKGYTPLM

SEQ ID NO: 183597 - protein, 10 aa, Artificial Sequence
  Description of Artificial Sequence: Synthetic peptide
  Seed: TRPWSGPYIL (TYRP2_HUMAN)
TTPWSGPYIY

SEQ ID NO: 183598 - protein, 9 aa, Artificial Sequence
  Description of Artificial Sequence: Synthetic peptide
  Seed: YSYAIDLPV (TYRP2_HUMAN)
YMYAIDLPL

SEQ ID NO: 183599 - protein, 11 aa, Artificial Sequence
  Description of Artificial Sequence: Synthetic peptide
  Seed: FTDAIFDEWMK (TYRP2_HUMAN)
FVDAIFDEWMY

SEQ ID NO: 183600 - protein, 10 aa, Artificial Sequence
  Description of Artificial Sequence: Synthetic peptide
  Seed: HYYSVRDTLL (TYRP2_HUMAN)
HRYSVRDTLM

SEQ ID NO: 183601 - protein, 9 aa, Artificial Sequence
  Description of Artificial Sequence: Synthetic peptide
  Seed: VMGTLVALV (TYRP2_HUMAN)
VVGTLVALL

SEQ ID NO: 183602 - protein, 9 aa, Artificial Sequence
  Description of Artificial Sequence: Synthetic peptide
  Seed: HQGPAFVTW (TYRP2_HUMAN)
HSGPAFVTI

SEQ ID NO: 183603 - protein, 10 aa, Artificial Sequence
  Description of Artificial Sequence: Synthetic peptide
  Seed: YAIDLPVSVE (TYRP2_HUMAN)
YQIDLPVSVF

SEQ ID NO: 183604 - protein, 10 aa, Artificial Sequence
  Description of Artificial Sequence: Synthetic peptide
  Seed: IDFSHQGPAF (TYRP2_HUMAN)
ILFSHQGPAF

SEQ ID NO: 183605 - protein, 9 aa, Artificial Sequence
  Description of Artificial Sequence: Synthetic peptide
  Seed: VVMGTLVAL (TYRP2_HUMAN)
VEMGTLVAF

SEQ ID NO: 183606 - protein, 11 aa, Artificial Sequence
  Description of Artificial Sequence: Synthetic peptide
  Seed: RADTRPWSGPY (TYRP2_HUMAN)
RLDTRPWSGPF

SEQ ID NO: 183607 - protein, 9 aa, Artificial Sequence
  Description of Artificial Sequence: Synthetic peptide
  Seed: FFPPVTNEE (TYRP2_HUMAN)
FVPPVTNEF

SEQ ID NO: 183608 - protein, 10 aa, Artificial Sequence
  Description of Artificial Sequence: Synthetic peptide
  Seed: ELAPIGHNRM (TYRP2_HUMAN)
ETAPIGHNRA

SEQ ID NO: 183609 - protein, 10 aa, Artificial Sequence
  Description of Artificial Sequence: Synthetic peptide
  Seed: HSFLNGTNAL (TYRP2_HUMAN)
HKFLNGTNAY

SEQ ID NO: 183610 - protein, 9 aa, Artificial Sequence
  Description of Artificial Sequence: Synthetic peptide
  Seed: SAANDPIFV (TYRP2_HUMAN)
SAANDPIFF

SEQ ID NO: 183611 - protein, 9 aa, Artificial Sequence
  Description of Artificial Sequence: Synthetic peptide
  Seed: RNQMGRNSM (TYRP2_HUMAN)
RHQMGRNSY

SEQ ID NO: 183612 - protein, 9 aa, Artificial Sequence
  Description of Artificial Sequence: Synthetic peptide
  Seed: RLRKGYTPL (TYRP2_HUMAN)
RSRKGYTPK

SEQ ID NO: 183613 - protein, 10 aa, Artificial Sequence
  Description of Artificial Sequence: Synthetic peptide
  Seed: LVVMGTLVAL (TYRP2_HUMAN)
LRVMGTLVAF

SEQ ID NO: 183614 - protein, 9 aa, Artificial Sequence
  Description of Artificial Sequence: Synthetic peptide
  Seed: VTWHRYHLL (TYRP2_HUMAN)
VQWHRYHLW

SEQ ID NO: 183615 - protein, 9 aa, Artificial Sequence
  Description of Artificial Sequence: Synthetic peptide
  Seed: ALPYWNFAT (TYRP2_HUMAN)
AIPYWNFAL

SEQ ID NO: 183616 - protein, 9 aa, Artificial Sequence
  Description of Artificial Sequence: Synthetic peptide
  Seed: VLHSFTDAI (TYRP2_HUMAN)
VQHSFTDAY

SEQ ID NO: 183617 - protein, 9 aa, Artificial Sequence
  Description of Artificial Sequence: Synthetic peptide
  Seed: REQFLGALD (TYRP2_HUMAN)
REQFLGALA

SEQ ID NO: 183618 - protein, 11 aa, Artificial Sequence
  Description of Artificial Sequence: Synthetic peptide
  Seed: FVVLHSFTDAI (TYRP2_HUMAN)
FMVLHSFTDAL

SEQ ID NO: 183619 - protein, 9 aa, Artificial Sequence
  Description of Artificial Sequence: Synthetic peptide
  Seed: HSFLNGTNA (TYRP2_HUMAN)
HHFLNGTNI

SEQ ID NO: 183620 - protein, 9 aa, Artificial Sequence
  Description of Artificial Sequence: Synthetic peptide
  Seed: TTQHWLGLL (TYRP2_HUMAN)
TMQHWLGLV

SEQ ID NO: 183621 - protein, 9 aa, Artificial Sequence
  Description of Artificial Sequence: Synthetic peptide
  Seed: YAIDLPVSV (TYRP2_HUMAN)
YHIDLPVSL

SEQ ID NO: 183622 - protein, 9 aa, Artificial Sequence
  Description of Artificial Sequence: Synthetic peptide
  Seed: EGLLRRNQM (TYRP2_HUMAN)
EMLLRRNQV

SEQ ID NO: 183623 - protein, 10 aa, Artificial Sequence
  Description of Artificial Sequence: Synthetic peptide
  Seed: SDQLGYSYAI (TYRP2_HUMAN)
STQLGYSYAL

SEQ ID NO: 183624 - protein, 10 aa, Artificial Sequence
  Description of Artificial Sequence: Synthetic peptide
  Seed: QPQFANCSVY (TYRP2_HUMAN)
QWQFANCSVF

SEQ ID NO: 183625 - protein, 9 aa, Artificial Sequence
  Description of Artificial Sequence: Synthetic peptide
  Seed: STFSFRNAL (TYRP2_HUMAN)
SLFSFRNAM

SEQ ID NO: 183626 - protein, 9 aa, Artificial Sequence
  Description of Artificial Sequence: Synthetic peptide
  Seed: VVMGTLVAL (TYRP2_HUMAN)
VMMGTLVAM

SEQ ID NO: 183627 - protein, 9 aa, Artificial Sequence
  Description of Artificial Sequence: Synthetic peptide
  Seed: TLLGPGRPY (TYRP2_HUMAN)
TILGPGRPY

SEQ ID NO: 183628 - protein, 10 aa, Artificial Sequence
  Description of Artificial Sequence: Synthetic peptide
  Seed: RNSRFSSWET (TYRP2_HUMAN)
RISRFSSWEL

SEQ ID NO: 183629 - protein, 11 aa, Artificial Sequence
  Description of Artificial Sequence: Synthetic peptide
  Seed: WLHYYSVRDTL (TYRP2_HUMAN)
WDHYYSVRDTW

SEQ ID NO: 183630 - protein, 10 aa, Artificial Sequence
  Description of Artificial Sequence: Synthetic peptide
  Seed: NRMYNMVPFF (TYRP2_HUMAN)
NQMYNMVPFY

SEQ ID NO: 183631 - protein, 11 aa, Artificial Sequence
  Description of Artificial Sequence: Synthetic peptide
  Seed: TLVALVGLFVL (TYRP2_HUMAN)
TMVALVGLFVV

SEQ ID NO: 183632 - protein, 11 aa, Artificial Sequence
  Description of Artificial Sequence: Synthetic peptide
  Seed: YNMVPFFPPVT (TYRP2_HUMAN)
YQMVPFFPPVL

SEQ ID NO: 183633 - protein, 9 aa, Artificial Sequence
  Description of Artificial Sequence: Synthetic peptide
  Seed: AIFDEWMKR (TYRP2_HUMAN)
ATFDEWMKM

SEQ ID NO: 183634 - protein, 10 aa, Artificial Sequence
  Description of Artificial Sequence: Synthetic peptide
  Seed: IDFSHQGPAF (TYRP2_HUMAN)
IYFSHQGPAY

SEQ ID NO: 183635 - protein, 10 aa, Artificial Sequence
  Description of Artificial Sequence: Synthetic peptide
  Seed: YNMVPFFPPV (TYRP2_HUMAN)
YIMVPFFPPT

SEQ ID NO: 183636 - protein, 10 aa, Artificial Sequence
  Description of Artificial Sequence: Synthetic peptide
  Seed: LQKFDNPPFF (TYRP2_HUMAN)
LLKFDNPPFY

SEQ ID NO: 183637 - protein, 10 aa, Artificial Sequence
  Description of Artificial Sequence: Synthetic peptide
  Seed: MSPLWWGFLL (TYRP2_HUMAN)
MNPLWWGFLY

SEQ ID NO: 183638 - protein, 10 aa, Artificial Sequence
  Description of Artificial Sequence: Synthetic peptide
  Seed: AIFDEWMKRF (TYRP2_HUMAN)
AIFDEWMKRY

SEQ ID NO: 183639 - protein, 11 aa, Artificial Sequence
  Description of Artificial Sequence: Synthetic peptide
  Seed: FVVLHSFTDAI (TYRP2_HUMAN)
FMVLHSFTDAI

SEQ ID NO: 183640 - protein, 9 aa, Artificial Sequence
  Description of Artificial Sequence: Synthetic peptide
  Seed: RLRKGYTPL (TYRP2_HUMAN)
RPRKGYTPC

SEQ ID NO: 183641 - protein, 9 aa, Artificial Sequence
  Description of Artificial Sequence: Synthetic peptide
  Seed: AANDPIFVV (TYRP2_HUMAN)
AINDPIFVF

SEQ ID NO: 183642 - protein, 9 aa, Artificial Sequence
  Description of Artificial Sequence: Synthetic peptide
  Seed: VVMGTLVAL (TYRP2_HUMAN)
VLMGTLVAS

SEQ ID NO: 183643 - protein, 10 aa, Artificial Sequence
  Description of Artificial Sequence: Synthetic peptide
  Seed: AANDPIFVVL (TYRP2_HUMAN)
AANDPIFVVF

SEQ ID NO: 183644 - protein, 10 aa, Artificial Sequence
  Description of Artificial Sequence: Synthetic peptide
  Seed: RNSMKLPTLK (TYRP2_HUMAN)
RESMKLPTLK

SEQ ID NO: 183645 - protein, 9 aa, Artificial Sequence
  Description of Artificial Sequence: Synthetic peptide
  Seed: VMGTLVALV (TYRP2_HUMAN)
VMGTLVALA

SEQ ID NO: 183646 - protein, 10 aa, Artificial Sequence
  Description of Artificial Sequence: Synthetic peptide
  Seed: HSFLNGTNAL (TYRP2_HUMAN)
HMFLNGTNAW

SEQ ID NO: 183647 - protein, 8 aa, Artificial Sequence
  Description of Artificial Sequence: Synthetic peptide
  Seed: HSFTDAIF (TYRP2_HUMAN)
HMFTDAIY

SEQ ID NO: 183648 - protein, 9 aa, Artificial Sequence
  Description of Artificial Sequence: Synthetic peptide
  Seed: DFFVWLHYY (TYRP2_HUMAN)
DWFVWLHYY

SEQ ID NO: 183649 - protein, 11 aa, Artificial Sequence
  Description of Artificial Sequence: Synthetic peptide
  Seed: SLDDYNHLVTL (TYRP2_HUMAN)
SGDDYNHLVTF

SEQ ID NO: 183650 - protein, 10 aa, Artificial Sequence
  Description of Artificial Sequence: Synthetic peptide
  Seed: SDQLGYSYAI (TYRP2_HUMAN)
SEQLGYSYAL

SEQ ID NO: 183651 - protein, 9 aa, Artificial Sequence
  Description of Artificial Sequence: Synthetic peptide
  Seed: VIRQNIHSL (TYRP2_HUMAN)
VMRQNIHSF

SEQ ID NO: 183652 - protein, 9 aa, Artificial Sequence
  Description of Artificial Sequence: Synthetic peptide
  Seed: VYDFFVWLH (TYRP2_HUMAN)
VIDFFVWLY

SEQ ID NO: 183653 - protein, 9 aa, Artificial Sequence
  Description of Artificial Sequence: Synthetic peptide
  Seed: YAIDLPVSV (TYRP2_HUMAN)
YLIDLPVSL

SEQ ID NO: 183654 - protein, 9 aa, Artificial Sequence
  Description of Artificial Sequence: Synthetic peptide
  Seed: IGHNRMYNM (TYRP2_HUMAN)
IAHNRMYNV

SEQ ID NO: 183655 - protein, 10 aa, Artificial Sequence
  Description of Artificial Sequence: Synthetic peptide
  Seed: FTDAIFDEWM (TYRP2_HUMAN)
FIDAIFDEWL

SEQ ID NO: 183656 - protein, 9 aa, Artificial Sequence
  Description of Artificial Sequence: Synthetic peptide
  Seed: SQVMSLHNL (TYRP2_HUMAN)
SAVMSLHNL

SEQ ID NO: 183657 - protein, 9 aa, Artificial Sequence
  Description of Artificial Sequence: Synthetic peptide
  Seed: YTPLMETHL (TYRP2_HUMAN)
YIPLMETHV

SEQ ID NO: 183658 - protein, 10 aa, Artificial Sequence
  Description of Artificial Sequence: Synthetic peptide
  Seed: SVYDFFVWLH (TYRP2_HUMAN)
SMYDFFVWLK

SEQ ID NO: 183659 - protein, 10 aa, Artificial Sequence
  Description of Artificial Sequence: Synthetic peptide
  Seed: RELWPRKFFH (TYRP2_HUMAN)
RRLWPRKFFR

SEQ ID NO: 183660 - protein, 9 aa, Artificial Sequence
  Description of Artificial Sequence: Synthetic peptide
  Seed: MSPLWWGFL (TYRP2_HUMAN)
MWPLWWGFL

SEQ ID NO: 183661 - protein, 11 aa, Artificial Sequence
  Description of Artificial Sequence: Synthetic peptide
  Seed: YTPLMETHLSS (TYRP2_HUMAN)
YRPLMETHLSA

SEQ ID NO: 183662 - protein, 9 aa, Artificial Sequence
  Description of Artificial Sequence: Synthetic peptide
  Seed: ALVGLFVLL (TYRP2_HUMAN)
AAVGLFVLL

SEQ ID NO: 183663 - protein, 9 aa, Artificial Sequence
  Description of Artificial Sequence: Synthetic peptide
  Seed: GQFPRVCMT (TYRP2_HUMAN)
GMFPRVCMA

SEQ ID NO: 183664 - protein, 10 aa, Artificial Sequence
  Description of Artificial Sequence: Synthetic peptide
  Seed: YNMVPFFPPV (TYRP2_HUMAN)
YDMVPFFPPA

SEQ ID NO: 183665 - protein, 9 aa, Artificial Sequence
  Description of Artificial Sequence: Synthetic peptide
  Seed: WHRYHLLCL (TYRP2_HUMAN)
WQRYHLLCY

SEQ ID NO: 183666 - protein, 9 aa, Artificial Sequence
  Description of Artificial Sequence: Synthetic peptide
  Seed: RAIDFSHQG (TYRP2_HUMAN)
RVIDFSHQL

SEQ ID NO: 183667 - protein, 10 aa, Artificial Sequence
  Description of Artificial Sequence: Synthetic peptide
  Seed: SLDDYNHLVT (TYRP2_HUMAN)
SLDDYNHLVM

SEQ ID NO: 183668 - protein, 10 aa, Artificial Sequence
  Description of Artificial Sequence: Synthetic peptide
  Seed: FLNGTNALPH (TYRP2_HUMAN)
FTNGTNALPY

SEQ ID NO: 183669 - protein, 9 aa, Artificial Sequence
  Description of Artificial Sequence: Synthetic peptide
  Seed: LSPQEREQF (TYRP2_HUMAN)
LAPQEREQW

SEQ ID NO: 183670 - protein, 10 aa, Artificial Sequence
  Description of Artificial Sequence: Synthetic peptide
  Seed: CMTVDSLVNK (TYRP2_HUMAN)
CQTVDSLVNR

SEQ ID NO: 183671 - protein, 10 aa, Artificial Sequence
  Description of Artificial Sequence: Synthetic peptide
  Seed: SLSPQEREQF (TYRP2_HUMAN)
SLSPQEREQY

SEQ ID NO: 183672 - protein, 9 aa, Artificial Sequence
  Description of Artificial Sequence: Synthetic peptide
  Seed: NALEGFDKA (TYRP2_HUMAN)
NLLEGFDKA

SEQ ID NO: 183673 - protein, 10 aa, Artificial Sequence
  Description of Artificial Sequence: Synthetic peptide
  Seed: YNMVPFFPPV (TYRP2_HUMAN)
YMMVPFFPPL

SEQ ID NO: 183674 - protein, 8 aa, Artificial Sequence
  Description of Artificial Sequence: Synthetic peptide
  Seed: RELWPRKF (TYRP2_HUMAN)
RQLWPRKY

SEQ ID NO: 183675 - protein, 9 aa, Artificial Sequence
  Description of Artificial Sequence: Synthetic peptide
  Seed: SFLNGTNAL (TYRP2_HUMAN)
SSLNGTNAY

SEQ ID NO: 183676 - protein, 8 aa, Artificial Sequence
  Description of Artificial Sequence: Synthetic peptide
  Seed: LDDYNHLV (TYRP2_HUMAN)
LMDYNHLL

SEQ ID NO: 183677 - protein, 10 aa, Artificial Sequence
  Description of Artificial Sequence: Synthetic peptide
  Seed: DSLDDYNHLV (TYRP2_HUMAN)
DMLDDYNHLV

SEQ ID NO: 183678 - protein, 10 aa, Artificial Sequence
  Description of Artificial Sequence: Synthetic peptide
  Seed: YNMVPFFPPV (TYRP2_HUMAN)
YQMVPFFPPI

SEQ ID NO: 183679 - protein, 11 aa, Artificial Sequence
  Description of Artificial Sequence: Synthetic peptide
  Seed: YTPLMETHLSS (TYRP2_HUMAN)
YSPLMETHLST

SEQ ID NO: 183680 - protein, 10 aa, Artificial Sequence
  Description of Artificial Sequence: Synthetic peptide
  Seed: GTLDSQVMSL (TYRP2_HUMAN)
GSLDSQVMSY

SEQ ID NO: 183681 - protein, 10 aa, Artificial Sequence
  Description of Artificial Sequence: Synthetic peptide
  Seed: TWHRYHLLCL (TYRP2_HUMAN)
TYHRYHLLCW

SEQ ID NO: 183682 - protein, 9 aa, Artificial Sequence
  Description of Artificial Sequence: Synthetic peptide
  Seed: MTVDSLVNK (TYRP2_HUMAN)
MFVDSLVNR

SEQ ID NO: 183683 - protein, 9 aa, Artificial Sequence
  Description of Artificial Sequence: Synthetic peptide
  Seed: TLDSQVMSL (TYRP2_HUMAN)
TSDSQVMSY

SEQ ID NO: 183684 - protein, 9 aa, Artificial Sequence
  Description of Artificial Sequence: Synthetic peptide
  Seed: TLVALVGLF (TYRP2_HUMAN)
TFVALVGLY

SEQ ID NO: 183685 - protein, 9 aa, Artificial Sequence
  Description of Artificial Sequence: Synthetic peptide
  Seed: ALVGLFVLL (TYRP2_HUMAN)
ATVGLFVLI

SEQ ID NO: 183686 - protein, 11 aa, Artificial Sequence
  Description of Artificial Sequence: Synthetic peptide
  Seed: TQPQFANCSVY (TYRP2_HUMAN)
TIPQFANCSVF

SEQ ID NO: 183687 - protein, 9 aa, Artificial Sequence
  Description of Artificial Sequence: Synthetic peptide
  Seed: VIRQNIHSL (TYRP2_HUMAN)
VTRQNIHSA

SEQ ID NO: 183688 - protein, 11 aa, Artificial Sequence
  Description of Artificial Sequence: Synthetic peptide
  Seed: RRNQMGRNSMK (TYRP2_HUMAN)
RINQMGRNSMK

SEQ ID NO: 183689 - protein, 9 aa, Artificial Sequence
  Description of Artificial Sequence: Synthetic peptide
  Seed: RRLRKGYTP (TYRP2_HUMAN)
RKLRKGYTL

SEQ ID NO: 183690 - protein, 11 aa, Artificial Sequence
  Description of Artificial Sequence: Synthetic peptide
  Seed: YTPLMETHLSS (TYRP2_HUMAN)
YKPLMETHLSM

SEQ ID NO: 183691 - protein, 10 aa, Artificial Sequence
  Description of Artificial Sequence: Synthetic peptide
  Seed: NCSVYDFFVW (TYRP2_HUMAN)
NASVYDFFVW

SEQ ID NO: 183692 - protein, 9 aa, Artificial Sequence
  Description of Artificial Sequence: Synthetic peptide
  Seed: IFDEWMKRF (TYRP2_HUMAN)
ISDEWMKRI

SEQ ID NO: 183693 - protein, 10 aa, Artificial Sequence
  Description of Artificial Sequence: Synthetic peptide
  Seed: SPLWWGFLLS (TYRP2_HUMAN)
SHLWWGFLLA

SEQ ID NO: 183694 - protein, 9 aa, Artificial Sequence
  Description of Artificial Sequence: Synthetic peptide
  Seed: DTRPWSGPY (TYRP2_HUMAN)
DTRPWSGPR

SEQ ID NO: 183695 - protein, 9 aa, Artificial Sequence
  Description of Artificial Sequence: Synthetic peptide
  Seed: YAIDLPVSV (TYRP2_HUMAN)
YTIDLPVSH

SEQ ID NO: 183696 - protein, 10 aa, Artificial Sequence
  Description of Artificial Sequence: Synthetic peptide
  Seed: HSFLNGTNAL (TYRP2_HUMAN)
HNFLNGTNAF

SEQ ID NO: 183697 - protein, 11 aa, Artificial Sequence
  Description of Artificial Sequence: Synthetic peptide
  Seed: LFVLLAFLQYR (TYRP2_HUMAN)
LRVLLAFLQYR

SEQ ID NO: 183698 - protein, 9 aa, Artificial Sequence
  Description of Artificial Sequence: Synthetic peptide
  Seed: YAIDLPVSV (TYRP2_HUMAN)
YCIDLPVSY

SEQ ID NO: 183699 - protein, 9 aa, Artificial Sequence
  Description of Artificial Sequence: Synthetic peptide
  Seed: FANCSVYDF (TYRP2_HUMAN)
FMNCSVYDM

SEQ ID NO: 183700 - protein, 8 aa, Artificial Sequence
  Description of Artificial Sequence: Synthetic peptide
  Seed: AIDLPVSV (TYRP2_HUMAN)
ALDLPVSM

SEQ ID NO: 183701 - protein, 10 aa, Artificial Sequence
  Description of Artificial Sequence: Synthetic peptide
  Seed: GTLDSQVMSL (TYRP2_HUMAN)
GQLDSQVMSI

SEQ ID NO: 183702 - protein, 10 aa, Artificial Sequence
  Description of Artificial Sequence: Synthetic peptide
  Seed: RELWPRKFFH (TYRP2_HUMAN)
RLLWPRKFFY

SEQ ID NO: 183703 - protein, 10 aa, Artificial Sequence
  Description of Artificial Sequence: Synthetic peptide
  Seed: RPWSGPYILR (TYRP2_HUMAN)
RQWSGPYILK

SEQ ID NO: 183704 - protein, 9 aa, Artificial Sequence
  Description of Artificial Sequence: Synthetic peptide
  Seed: VVMGTLVAL (TYRP2_HUMAN)
VSMGTLVAH

SEQ ID NO: 183705 - protein, 10 aa, Artificial Sequence
  Description of Artificial Sequence: Synthetic peptide
  Seed: FLTSDQLGYS (TYRP2_HUMAN)
FFTSDQLGYV

SEQ ID NO: 183706 - protein, 9 aa, Artificial Sequence
  Description of Artificial Sequence: Synthetic peptide
  Seed: GTNALPHSA (TYRP2_HUMAN)
GLNALPHSL

SEQ ID NO: 183707 - protein, 9 aa, Artificial Sequence
  Description of Artificial Sequence: Synthetic peptide
  Seed: KRFNPPADA (TYRP2_HUMAN)
KRFNPPADM

SEQ ID NO: 183708 - protein, 10 aa, Artificial Sequence
  Description of Artificial Sequence: Synthetic peptide
  Seed: SYAIDLPVSV (TYRP2_HUMAN)
SMAIDLPVSL

SEQ ID NO: 183709 - protein, 11 aa, Artificial Sequence
  Description of Artificial Sequence: Synthetic peptide
  Seed: VCDSLDDYNHL (TYRP2_HUMAN)
VIDSLDDYNHM

SEQ ID NO: 183710 - protein, 10 aa, Artificial Sequence
  Description of Artificial Sequence: Synthetic peptide
  Seed: FFVWLHYYSV (TYRP2_HUMAN)
FMVWLHYYSA

SEQ ID NO: 183711 - protein, 8 aa, Artificial Sequence
  Description of Artificial Sequence: Synthetic peptide
  Seed: FQNSTFSF (TYRP2_HUMAN)
FYNSTFSF

SEQ ID NO: 183712 - protein, 9 aa, Artificial Sequence
  Description of Artificial Sequence: Synthetic peptide
  Seed: FPPVTNEEL (TYRP2_HUMAN)
FIPVTNEEI

SEQ ID NO: 183713 - protein, 9 aa, Artificial Sequence
  Description of Artificial Sequence: Synthetic peptide
  Seed: RKFFHRTCK (TYRP2_HUMAN)
RMFFHRTCI

SEQ ID NO: 183714 - protein, 9 aa, Artificial Sequence
  Description of Artificial Sequence: Synthetic peptide
  Seed: VMSLHNLVH (TYRP2_HUMAN)
VHSLHNLVM

SEQ ID NO: 183715 - protein, 9 aa, Artificial Sequence
  Description of Artificial Sequence: Synthetic peptide
  Seed: STFSFRNAL (TYRP2_HUMAN)
SAFSFRNAL

SEQ ID NO: 183716 - protein, 9 aa, Artificial Sequence
  Description of Artificial Sequence: Synthetic peptide
  Seed: FTDAIFDEW (TYRP2_HUMAN)
FWDAIFDEL

SEQ ID NO: 183717 - protein, 9 aa, Artificial Sequence
  Description of Artificial Sequence: Synthetic peptide
  Seed: VGLFVLLAF (TYRP2_HUMAN)
VQLFVLLAY

SEQ ID NO: 183718 - protein, 10 aa, Artificial Sequence
  Description of Artificial Sequence: Synthetic peptide
  Seed: AFLQYRRLRK (TYRP2_HUMAN)
ATLQYRRLRR

SEQ ID NO: 183719 - protein, 9 aa, Artificial Sequence
  Description of Artificial Sequence: Synthetic peptide
  Seed: LVHSFLNGT (TYRP2_HUMAN)
LSHSFLNGV

SEQ ID NO: 183720 - protein, 9 aa, Artificial Sequence
  Description of Artificial Sequence: Synthetic peptide
  Seed: STFSFRNAL (TYRP2_HUMAN)
SGFSFRNAL

SEQ ID NO: 183721 - protein, 9 aa, Artificial Sequence
  Description of Artificial Sequence: Synthetic peptide
  Seed: WHRYHLLCL (TYRP2_HUMAN)
WYRYHLLCM

SEQ ID NO: 183722 - protein, 9 aa, Artificial Sequence
  Description of Artificial Sequence: Synthetic peptide
  Seed: AARPDDPTL (TYRP2_HUMAN)
AARPDDPTH

SEQ ID NO: 183723 - protein, 11 aa, Artificial Sequence
  Description of Artificial Sequence: Synthetic peptide
  Seed: FFPPVTNEELF (TYRP2_HUMAN)
FEPPVTNEELY

SEQ ID NO: 183724 - protein, 9 aa, Artificial Sequence
  Description of Artificial Sequence: Synthetic peptide
  Seed: NMVPFFPPV (TYRP2_HUMAN)
NAVPFFPPM

SEQ ID NO: 183725 - protein, 9 aa, Artificial Sequence
  Description of Artificial Sequence: Synthetic peptide
  Seed: TSDQLGYSY (TYRP2_HUMAN)
TSDQLGYSI

SEQ ID NO: 183726 - protein, 9 aa, Artificial Sequence
  Description of Artificial Sequence: Synthetic peptide
  Seed: IFDEWMKRF (TYRP2_HUMAN)
IADEWMKRV

SEQ ID NO: 183727 - protein, 9 aa, Artificial Sequence
  Description of Artificial Sequence: Synthetic peptide
  Seed: TLLGPGRPY (TYRP2_HUMAN)
TQLGPGRPI

SEQ ID NO: 183728 - protein, 9 aa, Artificial Sequence
  Description of Artificial Sequence: Synthetic peptide
  Seed: RFNPPADAW (TYRP2_HUMAN)
RYNPPADAI

SEQ ID NO: 183729 - protein, 9 aa, Artificial Sequence
  Description of Artificial Sequence: Synthetic peptide
  Seed: GTYEGLLRR (TYRP2_HUMAN)
GTYEGLLRF

SEQ ID NO: 183730 - protein, 9 aa, Artificial Sequence
  Description of Artificial Sequence: Synthetic peptide
  Seed: IFDEWMKRF (TYRP2_HUMAN)
INDEWMKRL

SEQ ID NO: 183731 - protein, 10 aa, Artificial Sequence
  Description of Artificial Sequence: Synthetic peptide
  Seed: FSFRNALEGF (TYRP2_HUMAN)
FIFRNALEGF

SEQ ID NO: 183732 - protein, 9 aa, Artificial Sequence
  Description of Artificial Sequence: Synthetic peptide
  Seed: RMYNMVPFF (TYRP2_HUMAN)
RTYNMVPFR

SEQ ID NO: 183733 - protein, 9 aa, Artificial Sequence
  Description of Artificial Sequence: Synthetic peptide
  Seed: SRNSRFSSW (TYRP2_HUMAN)
SKNSRFSSL

SEQ ID NO: 183734 - protein, 9 aa, Artificial Sequence
  Description of Artificial Sequence: Synthetic peptide
  Seed: HQGPAFVTW (TYRP2_HUMAN)
HMGPAFVTF

SEQ ID NO: 183735 - protein, 10 aa, Artificial Sequence
  Description of Artificial Sequence: Synthetic peptide
  Seed: RPDDPTLISR (TYRP2_HUMAN)
RVDDPTLISM

SEQ ID NO: 183736 - protein, 11 aa, Artificial Sequence
  Description of Artificial Sequence: Synthetic peptide
  Seed: TSDQLGYSYAI (TYRP2_HUMAN)
TMDQLGYSYAV

SEQ ID NO: 183737 - protein, 11 aa, Artificial Sequence
  Description of Artificial Sequence: Synthetic peptide
  Seed: YSYAIDLPVSV (TYRP2_HUMAN)
YLYAIDLPVSI

SEQ ID NO: 183738 - protein, 10 aa, Artificial Sequence
  Description of Artificial Sequence: Synthetic peptide
  Seed: FVLLAFLQYR (TYRP2_HUMAN)
FPLLAFLQYR

SEQ ID NO: 183739 - protein, 9 aa, Artificial Sequence
  Description of Artificial Sequence: Synthetic peptide
  Seed: ECDVCTDQL (TYRP2_HUMAN)
EWDVCTDQM

SEQ ID NO: 183740 - protein, 9 aa, Artificial Sequence
  Description of Artificial Sequence: Synthetic peptide
  Seed: FSHQGPAFV (TYRP2_HUMAN)
FIHQGPAFM

SEQ ID NO: 183741 - protein, 9 aa, Artificial Sequence
  Description of Artificial Sequence: Synthetic peptide
  Seed: MTVDSLVNK (TYRP2_HUMAN)
MIVDSLVNM

SEQ ID NO: 183742 - protein, 10 aa, Artificial Sequence
  Description of Artificial Sequence: Synthetic peptide
  Seed: GTLDSQVMSL (TYRP2_HUMAN)
GTLDSQVMSV

SEQ ID NO: 183743 - protein, 9 aa, Artificial Sequence
  Description of Artificial Sequence: Synthetic peptide
  Seed: FQNSTFSFR (TYRP2_HUMAN)
FMNSTFSFK

SEQ ID NO: 183744 - protein, 10 aa, Artificial Sequence
  Description of Artificial Sequence: Synthetic peptide
  Seed: SDQLGYSYAI (TYRP2_HUMAN)
SIQLGYSYAV

SEQ ID NO: 183745 - protein, 9 aa, Artificial Sequence
  Description of Artificial Sequence: Synthetic peptide
  Seed: RLRKGYTPL (TYRP2_HUMAN)
RHRKGYTPM

SEQ ID NO: 183746 - protein, 10 aa, Artificial Sequence
  Description of Artificial Sequence: Synthetic peptide
  Seed: RPDDPTLISR (TYRP2_HUMAN)
RMDDPTLISM

SEQ ID NO: 183747 - protein, 10 aa, Artificial Sequence
  Description of Artificial Sequence: Synthetic peptide
  Seed: RMYNMVPFFP (TYRP2_HUMAN)
RIYNMVPFFY

SEQ ID NO: 183748 - protein, 10 aa, Artificial Sequence
  Description of Artificial Sequence: Synthetic peptide
  Seed: MSPLWWGFLL (TYRP2_HUMAN)
MSPLWWGFLY

SEQ ID NO: 183749 - protein, 10 aa, Artificial Sequence
  Description of Artificial Sequence: Synthetic peptide
  Seed: FFPPVTNEEL (TYRP2_HUMAN)
FYPPVTNEEV

SEQ ID NO: 183750 - protein, 10 aa, Artificial Sequence
  Description of Artificial Sequence: Synthetic peptide
  Seed: GTLDSQVMSL (TYRP2_HUMAN)
GALDSQVMSW

SEQ ID NO: 183751 - protein, 9 aa, Artificial Sequence
  Description of Artificial Sequence: Synthetic peptide
  Seed: AARPDDPTL (TYRP2_HUMAN)
AIRPDDPTY

SEQ ID NO: 183752 - protein, 8 aa, Artificial Sequence
  Description of Artificial Sequence: Synthetic peptide
  Seed: SLDDYNHL (TYRP2_HUMAN)
SVDDYNHM

SEQ ID NO: 183753 - protein, 10 aa, Artificial Sequence
  Description of Artificial Sequence: Synthetic peptide
  Seed: ADTRPWSGPY (TYRP2_HUMAN)
ARTRPWSGPA

SEQ ID NO: 183754 - protein, 9 aa, Artificial Sequence
  Description of Artificial Sequence: Synthetic peptide
  Seed: ANDPIFVVL (TYRP2_HUMAN)
ANDPIFVVM

SEQ ID NO: 183755 - protein, 11 aa, Artificial Sequence
  Description of Artificial Sequence: Synthetic peptide
  Seed: RNSRFSSWETV (TYRP2_HUMAN)
RRSRFSSWETL

SEQ ID NO: 183756 - protein, 9 aa, Artificial Sequence
  Description of Artificial Sequence: Synthetic peptide
  Seed: FLNGTNALP (TYRP2_HUMAN)
FVNGTNALM

SEQ ID NO: 183757 - protein, 10 aa, Artificial Sequence
  Description of Artificial Sequence: Synthetic peptide
  Seed: RLIGNESFAL (TYRP2_HUMAN)
RHIGNESFAY

SEQ ID NO: 183758 - protein, 10 aa, Artificial Sequence
  Description of Artificial Sequence: Synthetic peptide
  Seed: GTLDSQVMSL (TYRP2_HUMAN)
GWLDSQVMSV

SEQ ID NO: 183759 - protein, 10 aa, Artificial Sequence
  Description of Artificial Sequence: Synthetic peptide
  Seed: FQNSTFSFRN (TYRP2_HUMAN)
FGNSTFSFRR

SEQ ID NO: 183760 - protein, 11 aa, Artificial Sequence
  Description of Artificial Sequence: Synthetic peptide
  Seed: LLVVMGTLVAL (TYRP2_HUMAN)
LHVVMGTLVAV

SEQ ID NO: 183761 - protein, 9 aa, Artificial Sequence
  Description of Artificial Sequence: Synthetic peptide
  Seed: RMYNMVPFF (TYRP2_HUMAN)
RIYNMVPFH

SEQ ID NO: 183762 - protein, 10 aa, Artificial Sequence
  Description of Artificial Sequence: Synthetic peptide
  Seed: ETPGWPTTLL (TYRP2_HUMAN)
ETPGWPTTLY

SEQ ID NO: 183763 - protein, 10 aa, Artificial Sequence
  Description of Artificial Sequence: Synthetic peptide
  Seed: ELAPIGHNRM (TYRP2_HUMAN)
EVAPIGHNRL

SEQ ID NO: 183764 - protein, 9 aa, Artificial Sequence
  Description of Artificial Sequence: Synthetic peptide
  Seed: TDQLFGAAR (TYRP2_HUMAN)
TLQLFGAAR

SEQ ID NO: 183765 - protein, 10 aa, Artificial Sequence
  Description of Artificial Sequence: Synthetic peptide
  Seed: FPPVTNEELF (TYRP2_HUMAN)
FAPVTNEELY

SEQ ID NO: 183766 - protein, 9 aa, Artificial Sequence
  Description of Artificial Sequence: Synthetic peptide
  Seed: SLHNLVHSF (TYRP2_HUMAN)
STHNLVHSM

SEQ ID NO: 183767 - protein, 9 aa, Artificial Sequence
  Description of Artificial Sequence: Synthetic peptide
  Seed: WHRYHLLCL (TYRP2_HUMAN)
WLRYHLLCV

SEQ ID NO: 183768 - protein, 10 aa, Artificial Sequence
  Description of Artificial Sequence: Synthetic peptide
  Seed: AANDPIFVVL (TYRP2_HUMAN)
ATNDPIFVVF

SEQ ID NO: 183769 - protein, 8 aa, Artificial Sequence
  Description of Artificial Sequence: Synthetic peptide
  Seed: MVPFFPPV (TYRP2_HUMAN)
MLPFFPPI

SEQ ID NO: 183770 - protein, 9 aa, Artificial Sequence
  Description of Artificial Sequence: Synthetic peptide
  Seed: TQHWLGLLG (TYRP2_HUMAN)
TQHWLGLLY

SEQ ID NO: 183771 - protein, 9 aa, Artificial Sequence
  Description of Artificial Sequence: Synthetic peptide
  Seed: YAIDLPVSV (TYRP2_HUMAN)
YHIDLPVSM

SEQ ID NO: 183772 - protein, 10 aa, Artificial Sequence
  Description of Artificial Sequence: Synthetic peptide
  Seed: FGWTGPNCER (TYRP2_HUMAN)
FTWTGPNCER

SEQ ID NO: 183773 - protein, 10 aa, Artificial Sequence
  Description of Artificial Sequence: Synthetic peptide
  Seed: YNMVPFFPPV (TYRP2_HUMAN)
YLMVPFFPPL

SEQ ID NO: 183774 - protein, 10 aa, Artificial Sequence
  Description of Artificial Sequence: Synthetic peptide
  Seed: NGTYEGLLRR (TYRP2_HUMAN)
NLTYEGLLRR

SEQ ID NO: 183775 - protein, 10 aa, Artificial Sequence
  Description of Artificial Sequence: Synthetic peptide
  Seed: ETPGWPTTLL (TYRP2_HUMAN)
ETPGWPTTLR

SEQ ID NO: 183776 - protein, 10 aa, Artificial Sequence
  Description of Artificial Sequence: Synthetic peptide
  Seed: FFPPVTNEEL (TYRP2_HUMAN)
FMPPVTNEEY

SEQ ID NO: 183777 - protein, 11 aa, Artificial Sequence
  Description of Artificial Sequence: Synthetic peptide
  Seed: FTDAIFDEWMK (TYRP2_HUMAN)
FTDAIFDEWMY

SEQ ID NO: 183778 - protein, 9 aa, Artificial Sequence
  Description of Artificial Sequence: Synthetic peptide
  Seed: QKFDNPPFF (TYRP2_HUMAN)
QMFDNPPFW

SEQ ID NO: 183779 - protein, 9 aa, Artificial Sequence
  Description of Artificial Sequence: Synthetic peptide
  Seed: TLDSQVMSL (TYRP2_HUMAN)
TRDSQVMSL

SEQ ID NO: 183780 - protein, 9 aa, Artificial Sequence
  Description of Artificial Sequence: Synthetic peptide
  Seed: TLVALVGLF (TYRP2_HUMAN)
TWVALVGLF

SEQ ID NO: 183781 - protein, 8 aa, Artificial Sequence
  Description of Artificial Sequence: Synthetic peptide
  Seed: RMYNMVPF (TYRP2_HUMAN)
RYYNMVPM

SEQ ID NO: 183782 - protein, 11 aa, Artificial Sequence
  Description of Artificial Sequence: Synthetic peptide
  Seed: PFFQNSTFSFR (TYRP2_HUMAN)
PAFQNSTFSFR

SEQ ID NO: 183783 - protein, 9 aa, Artificial Sequence
  Description of Artificial Sequence: Synthetic peptide
  Seed: DDRELWPRK (TYRP2_HUMAN)
DVRELWPRK

SEQ ID NO: 183784 - protein, 9 aa, Artificial Sequence
  Description of Artificial Sequence: Synthetic peptide
  Seed: IFDEWMKRF (TYRP2_HUMAN)
IIDEWMKRY

SEQ ID NO: 183785 - protein, 10 aa, Artificial Sequence
  Description of Artificial Sequence: Synthetic peptide
  Seed: VLLAFLQYRR (TYRP2_HUMAN)
VALAFLQYRR

SEQ ID NO: 183786 - protein, 10 aa, Artificial Sequence
  Description of Artificial Sequence: Synthetic peptide
  Seed: SQVMSLHNLV (TYRP2_HUMAN)
SVVMSLHNLV

SEQ ID NO: 183787 - protein, 10 aa, Artificial Sequence
  Description of Artificial Sequence: Synthetic peptide
  Seed: ITTQHWLGLL (TYRP2_HUMAN)
ITTQHWLGLW

SEQ ID NO: 183788 - protein, 9 aa, Artificial Sequence
  Description of Artificial Sequence: Synthetic peptide
  Seed: MTVDSLVNK (TYRP2_HUMAN)
MAVDSLVNI

SEQ ID NO: 183789 - protein, 10 aa, Artificial Sequence
  Description of Artificial Sequence: Synthetic peptide
  Seed: FTDAIFDEWM (TYRP2_HUMAN)
FLDAIFDEWY

SEQ ID NO: 183790 - protein, 10 aa, Artificial Sequence
  Description of Artificial Sequence: Synthetic peptide
  Seed: LVVMGTLVAL (TYRP2_HUMAN)
LKVMGTLVAI

SEQ ID NO: 183791 - protein, 9 aa, Artificial Sequence
  Description of Artificial Sequence: Synthetic peptide
  Seed: TLLGPGRPY (TYRP2_HUMAN)
TFLGPGRPL

SEQ ID NO: 183792 - protein, 10 aa, Artificial Sequence
  Description of Artificial Sequence: Synthetic peptide
  Seed: ALVGLFVLLA (TYRP2_HUMAN)
AVVGLFVLLV

SEQ ID NO: 183793 - protein, 11 aa, Artificial Sequence
  Description of Artificial Sequence: Synthetic peptide
  Seed: VCMTVDSLVNK (TYRP2_HUMAN)
VVMTVDSLVNK

SEQ ID NO: 183794 - protein, 9 aa, Artificial Sequence
  Description of Artificial Sequence: Synthetic peptide
  Seed: SQVMSLHNL (TYRP2_HUMAN)
SHVMSLHNM

SEQ ID NO: 183795 - protein, 10 aa, Artificial Sequence
  Description of Artificial Sequence: Synthetic peptide
  Seed: MGRNSMKLPT (TYRP2_HUMAN)
MTRNSMKLPA

SEQ ID NO: 183796 - protein, 11 aa, Artificial Sequence
  Description of Artificial Sequence: Synthetic peptide
  Seed: RELWPRKFFHR (TYRP2_HUMAN)
RFLWPRKFFHR

SEQ ID NO: 183797 - protein, 10 aa, Artificial Sequence
  Description of Artificial Sequence: Synthetic peptide
  Seed: SYAIDLPVSV (TYRP2_HUMAN)
STAIDLPVSV

SEQ ID NO: 183798 - protein, 9 aa, Artificial Sequence
  Description of Artificial Sequence: Synthetic peptide
  Seed: SVYDFFVWL (TYRP2_HUMAN)
SQYDFFVWC

SEQ ID NO: 183799 - protein, 10 aa, Artificial Sequence
  Description of Artificial Sequence: Synthetic peptide
  Seed: SDQLGYSYAI (TYRP2_HUMAN)
SAQLGYSYAI

SEQ ID NO: 183800 - protein, 10 aa, Artificial Sequence
  Description of Artificial Sequence: Synthetic peptide
  Seed: IGNESFALPY (TYRP2_HUMAN)
IVNESFALPY

SEQ ID NO: 183801 - protein, 11 aa, Artificial Sequence
  Description of Artificial Sequence: Synthetic peptide
  Seed: RNSRFSSWETV (TYRP2_HUMAN)
RWSRFSSWETL

SEQ ID NO: 183802 - protein, 11 aa, Artificial Sequence
  Description of Artificial Sequence: Synthetic peptide
  Seed: MYNMVPFFPPV (TYRP2_HUMAN)
MPNMVPFFPPI

SEQ ID NO: 183803 - protein, 9 aa, Artificial Sequence
  Description of Artificial Sequence: Synthetic peptide
  Seed: FPPVTNEEL (TYRP2_HUMAN)
FSPVTNEEL

SEQ ID NO: 183804 - protein, 10 aa, Artificial Sequence
  Description of Artificial Sequence: Synthetic peptide
  Seed: YAIDLPVSVE (TYRP2_HUMAN)
YMIDLPVSVD

SEQ ID NO: 183805 - protein, 9 aa, Artificial Sequence
  Description of Artificial Sequence: Synthetic peptide
  Seed: YVITTQHWL (TYRP2_HUMAN)
YLITTQHWT

SEQ ID NO: 183806 - protein, 11 aa, Artificial Sequence
  Description of Artificial Sequence: Synthetic peptide
  Seed: EQFLGALDLAK (TYRP2_HUMAN)
EVFLGALDLAK

SEQ ID NO: 183807 - protein, 9 aa, Artificial Sequence
  Description of Artificial Sequence: Synthetic peptide
  Seed: NMVPFFPPV (TYRP2_HUMAN)
NIVPFFPPK

SEQ ID NO: 183808 - protein, 10 aa, Artificial Sequence
  Description of Artificial Sequence: Synthetic peptide
  Seed: VVLHSFTDAI (TYRP2_HUMAN)
VKLHSFTDAV

SEQ ID NO: 183809 - protein, 9 aa, Artificial Sequence
  Description of Artificial Sequence: Synthetic peptide
  Seed: RLRKGYTPL (TYRP2_HUMAN)
RTRKGYTPE

SEQ ID NO: 183810 - protein, 10 aa, Artificial Sequence
  Description of Artificial Sequence: Synthetic peptide
  Seed: FQNSTFSFRN (TYRP2_HUMAN)
FYNSTFSFRK

SEQ ID NO: 183811 - protein, 10 aa, Artificial Sequence
  Description of Artificial Sequence: Synthetic peptide
  Seed: RNSRFSSWET (TYRP2_HUMAN)
RWSRFSSWEM

SEQ ID NO: 183812 - protein, 9 aa, Artificial Sequence
  Description of Artificial Sequence: Synthetic peptide
  Seed: SAANDPIFV (TYRP2_HUMAN)
SVANDPIFI

SEQ ID NO: 183813 - protein, 9 aa, Artificial Sequence
  Description of Artificial Sequence: Synthetic peptide
  Seed: LAPIGHNRM (TYRP2_HUMAN)
LFPIGHNRF

SEQ ID NO: 183814 - protein, 10 aa, Artificial Sequence
  Description of Artificial Sequence: Synthetic peptide
  Seed: FLLSCLGCKI (TYRP2_HUMAN)
FMLSCLGCKL

SEQ ID NO: 183815 - protein, 10 aa, Artificial Sequence
  Description of Artificial Sequence: Synthetic peptide
  Seed: CSVYDFFVWL (TYRP2_HUMAN)
CSVYDFFVWW

SEQ ID NO: 183816 - protein, 10 aa, Artificial Sequence
  Description of Artificial Sequence: Synthetic peptide
  Seed: REQFLGALDL (TYRP2_HUMAN)
RVQFLGALDM

SEQ ID NO: 183817 - protein, 10 aa, Artificial Sequence
  Description of Artificial Sequence: Synthetic peptide
  Seed: RLRKGYTPLM (TYRP2_HUMAN)
RVRKGYTPLC

SEQ ID NO: 183818 - protein, 10 aa, Artificial Sequence
  Description of Artificial Sequence: Synthetic peptide
  Seed: RNSRFSSWET (TYRP2_HUMAN)
RISRFSSWEK

SEQ ID NO: 183819 - protein, 9 aa, Artificial Sequence
  Description of Artificial Sequence: Synthetic peptide
  Seed: VVMGTLVAL (TYRP2_HUMAN)
VQMGTLVAW

SEQ ID NO: 183820 - protein, 9 aa, Artificial Sequence
  Description of Artificial Sequence: Synthetic peptide
  Seed: YYSVRDTLL (TYRP2_HUMAN)
YWSVRDTLW

SEQ ID NO: 183821 - protein, 11 aa, Artificial Sequence
  Description of Artificial Sequence: Synthetic peptide
  Seed: SVYDFFVWLHY (TYRP2_HUMAN)
SSYDFFVWLHK

SEQ ID NO: 183822 - protein, 10 aa, Artificial Sequence
  Description of Artificial Sequence: Synthetic peptide
  Seed: LVVMGTLVAL (TYRP2_HUMAN)
LGVMGTLVAF

SEQ ID NO: 183823 - protein, 9 aa, Artificial Sequence
  Description of Artificial Sequence: Synthetic peptide
  Seed: TTQHWLGLL (TYRP2_HUMAN)
TMQHWLGLA

SEQ ID NO: 183824 - protein, 10 aa, Artificial Sequence
  Description of Artificial Sequence: Synthetic peptide
  Seed: RLIGNESFAL (TYRP2_HUMAN)
RAIGNESFAF

SEQ ID NO: 183825 - protein, 9 aa, Artificial Sequence
  Description of Artificial Sequence: Synthetic peptide
  Seed: SVYDFFVWL (TYRP2_HUMAN)
SVYDFFVWK

SEQ ID NO: 183826 - protein, 9 aa, Artificial Sequence
  Description of Artificial Sequence: Synthetic peptide
  Seed: SVRDTLLGP (TYRP2_HUMAN)
STRDTLLGV

SEQ ID NO: 183827 - protein, 10 aa, Artificial Sequence
  Description of Artificial Sequence: Synthetic peptide
  Seed: VVMGTLVALV (TYRP2_HUMAN)
VLMGTLVALQ

SEQ ID NO: 183828 - protein, 10 aa, Artificial Sequence
  Description of Artificial Sequence: Synthetic peptide
  Seed: SSWETVCDSL (TYRP2_HUMAN)
SLWETVCDSL

SEQ ID NO: 183829 - protein, 9 aa, Artificial Sequence
  Description of Artificial Sequence: Synthetic peptide
  Seed: RKFFHRTCK (TYRP2_HUMAN)
RMFFHRTCK

SEQ ID NO: 183830 - protein, 9 aa, Artificial Sequence
  Description of Artificial Sequence: Synthetic peptide
  Seed: SFLNGTNAL (TYRP2_HUMAN)
SFLNGTNAM

SEQ ID NO: 183831 - protein, 10 aa, Artificial Sequence
  Description of Artificial Sequence: Synthetic peptide
  Seed: ADTRPWSGPY (TYRP2_HUMAN)
AHTRPWSGPK

SEQ ID NO: 183832 - protein, 10 aa, Artificial Sequence
  Description of Artificial Sequence: Synthetic peptide
  Seed: FFVWLHYYSV (TYRP2_HUMAN)
FSVWLHYYSI

SEQ ID NO: 183833 - protein, 9 aa, Artificial Sequence
  Description of Artificial Sequence: Synthetic peptide
  Seed: RKFFHRTCK (TYRP2_HUMAN)
RVFFHRTCT

SEQ ID NO: 183834 - protein, 9 aa, Artificial Sequence
  Description of Artificial Sequence: Synthetic peptide
  Seed: VMSLHNLVH (TYRP2_HUMAN)
VKSLHNLVL

SEQ ID NO: 183835 - protein, 10 aa, Artificial Sequence
  Description of Artificial Sequence: Synthetic peptide
  Seed: FFPPVTNEEL (TYRP2_HUMAN)
FGPPVTNEEM

SEQ ID NO: 183836 - protein, 9 aa, Artificial Sequence
  Description of Artificial Sequence: Synthetic peptide
  Seed: AANDPIFVV (TYRP2_HUMAN)
ARNDPIFVI

SEQ ID NO: 183837 - protein, 9 aa, Artificial Sequence
  Description of Artificial Sequence: Synthetic peptide
  Seed: ESANVCGSQ (TYRP2_HUMAN)
EQANVCGSR

SEQ ID NO: 183838 - protein, 9 aa, Artificial Sequence
  Description of Artificial Sequence: Synthetic peptide
  Seed: NRMYNMVPF (TYRP2_HUMAN)
NHMYNMVPF

SEQ ID NO: 183839 - protein, 9 aa, Artificial Sequence
  Description of Artificial Sequence: Synthetic peptide
  Seed: GWPTTLLVV (TYRP2_HUMAN)
GFPTTLLVL

SEQ ID NO: 183840 - protein, 9 aa, Artificial Sequence
  Description of Artificial Sequence: Synthetic peptide
  Seed: HQGPAFVTW (TYRP2_HUMAN)
HMGPAFVTI

SEQ ID NO: 183841 - protein, 10 aa, Artificial Sequence
  Description of Artificial Sequence: Synthetic peptide
  Seed: FVWLHYYSVR (TYRP2_HUMAN)
FIWLHYYSVL

SEQ ID NO: 183842 - protein, 11 aa, Artificial Sequence
  Description of Artificial Sequence: Synthetic peptide
  Seed: RADTRPWSGPY (TYRP2_HUMAN)
RWDTRPWSGPF

SEQ ID NO: 183843 - protein, 10 aa, Artificial Sequence
  Description of Artificial Sequence: Synthetic peptide
  Seed: RNSRFSSWET (TYRP2_HUMAN)
RQSRFSSWEV

SEQ ID NO: 183844 - protein, 10 aa, Artificial Sequence
  Description of Artificial Sequence: Synthetic peptide
  Seed: GQFPRVCMTV (TYRP2_HUMAN)
GKFPRVCMTF

SEQ ID NO: 183845 - protein, 10 aa, Artificial Sequence
  Description of Artificial Sequence: Synthetic peptide
  Seed: RRLRKGYTPL (TYRP2_HUMAN)
RILRKGYTPA

SEQ ID NO: 183846 - protein, 9 aa, Artificial Sequence
  Description of Artificial Sequence: Synthetic peptide
  Seed: RLRKGYTPL (TYRP2_HUMAN)
RCRKGYTPK

SEQ ID NO: 183847 - protein, 9 aa, Artificial Sequence
  Description of Artificial Sequence: Synthetic peptide
  Seed: RLRKGYTPL (TYRP2_HUMAN)
RIRKGYTPA

SEQ ID NO: 183848 - protein, 9 aa, Artificial Sequence
  Description of Artificial Sequence: Synthetic peptide
  Seed: VIRQNIHSL (TYRP2_HUMAN)
VTRQNIHSY

SEQ ID NO: 183849 - protein, 10 aa, Artificial Sequence
  Description of Artificial Sequence: Synthetic peptide
  Seed: LGPNGTQPQF (TYRP2_HUMAN)
LAPNGTQPQM

SEQ ID NO: 183850 - protein, 9 aa, Artificial Sequence
  Description of Artificial Sequence: Synthetic peptide
  Seed: NMVPFFPPV (TYRP2_HUMAN)
NPVPFFPPY

SEQ ID NO: 183851 - protein, 9 aa, Artificial Sequence
  Description of Artificial Sequence: Synthetic peptide
  Seed: VVMGTLVAL (TYRP2_HUMAN)
VFMGTLVAM

SEQ ID NO: 183852 - protein, 9 aa, Artificial Sequence
  Description of Artificial Sequence: Synthetic peptide
  Seed: SAANDPIFV (TYRP2_HUMAN)
STANDPIFL

SEQ ID NO: 183853 - protein, 9 aa, Artificial Sequence
  Description of Artificial Sequence: Synthetic peptide
  Seed: VDSLVNKEC (TYRP2_HUMAN)
VESLVNKEI

SEQ ID NO: 183854 - protein, 9 aa, Artificial Sequence
  Description of Artificial Sequence: Synthetic peptide
  Seed: SLDDYNHLV (TYRP2_HUMAN)
SYDDYNHLL

SEQ ID NO: 183855 - protein, 9 aa, Artificial Sequence
  Description of Artificial Sequence: Synthetic peptide
  Seed: VTWHRYHLL (TYRP2_HUMAN)
VFWHRYHLM

SEQ ID NO: 183856 - protein, 8 aa, Artificial Sequence
  Description of Artificial Sequence: Synthetic peptide
  Seed: QNSTFSFR (TYRP2_HUMAN)
QMSTFSFR

SEQ ID NO: 183857 - protein, 10 aa, Artificial Sequence
  Description of Artificial Sequence: Synthetic peptide
  Seed: GPAFVTWHRY (TYRP2_HUMAN)
GYAFVTWHRY

SEQ ID NO: 183858 - protein, 11 aa, Artificial Sequence
  Description of Artificial Sequence: Synthetic peptide
  Seed: RADTRPWSGPY (TYRP2_HUMAN)
RFDTRPWSGPA

SEQ ID NO: 183859 - protein, 10 aa, Artificial Sequence
  Description of Artificial Sequence: Synthetic peptide
  Seed: RELWPRKFFH (TYRP2_HUMAN)
RHLWPRKFFR

SEQ ID NO: 183860 - protein, 9 aa, Artificial Sequence
  Description of Artificial Sequence: Synthetic peptide
  Seed: FLLSCLGCK (TYRP2_HUMAN)
FYLSCLGCR

SEQ ID NO: 183861 - protein, 9 aa, Artificial Sequence
  Description of Artificial Sequence: Synthetic peptide
  Seed: GLFVLLAFL (TYRP2_HUMAN)
GQFVLLAFV

SEQ ID NO: 183862 - protein, 9 aa, Artificial Sequence
  Description of Artificial Sequence: Synthetic peptide
  Seed: ERKKPPVIR (TYRP2_HUMAN)
ETKKPPVIR

SEQ ID NO: 183863 - protein, 9 aa, Artificial Sequence
  Description of Artificial Sequence: Synthetic peptide
  Seed: RLRKGYTPL (TYRP2_HUMAN)
RNRKGYTPY

SEQ ID NO: 183864 - protein, 9 aa, Artificial Sequence
  Description of Artificial Sequence: Synthetic peptide
  Seed: IFDEWMKRF (TYRP2_HUMAN)
IADEWMKRI

SEQ ID NO: 183865 - protein, 9 aa, Artificial Sequence
  Description of Artificial Sequence: Synthetic peptide
  Seed: RLRKGYTPL (TYRP2_HUMAN)
RSRKGYTPA

SEQ ID NO: 183866 - protein, 9 aa, Artificial Sequence
  Description of Artificial Sequence: Synthetic peptide
  Seed: STFSFRNAL (TYRP2_HUMAN)
STFSFRNAR

SEQ ID NO: 183867 - protein, 10 aa, Artificial Sequence
  Description of Artificial Sequence: Synthetic peptide
  Seed: SLQKFDNPPF (TYRP2_HUMAN)
SCQKFDNPPY

SEQ ID NO: 183868 - protein, 10 aa, Artificial Sequence
  Description of Artificial Sequence: Synthetic peptide
  Seed: FFVWLHYYSV (TYRP2_HUMAN)
FAVWLHYYSV

SEQ ID NO: 183869 - protein, 11 aa, Artificial Sequence
  Description of Artificial Sequence: Synthetic peptide
  Seed: FQNSTFSFRNA (TYRP2_HUMAN)
FINSTFSFRNV

SEQ ID NO: 183870 - protein, 9 aa, Artificial Sequence
  Description of Artificial Sequence: Synthetic peptide
  Seed: SLDDYNHLV (TYRP2_HUMAN)
SGDDYNHLV

SEQ ID NO: 183871 - protein, 11 aa, Artificial Sequence
  Description of Artificial Sequence: Synthetic peptide
  Seed: YNMVPFFPPVT (TYRP2_HUMAN)
YLMVPFFPPVC

SEQ ID NO: 183872 - protein, 11 aa, Artificial Sequence
  Description of Artificial Sequence: Synthetic peptide
  Seed: YTPLMETHLSS (TYRP2_HUMAN)
YCPLMETHLST

SEQ ID NO: 183873 - protein, 9 aa, Artificial Sequence
  Description of Artificial Sequence: Synthetic peptide
  Seed: LCLERDLQR (TYRP2_HUMAN)
LTLERDLQR

SEQ ID NO: 183874 - protein, 10 aa, Artificial Sequence
  Description of Artificial Sequence: Synthetic peptide
  Seed: RLRKGYTPLM (TYRP2_HUMAN)
RERKGYTPLY

SEQ ID NO: 183875 - protein, 10 aa, Artificial Sequence
  Description of Artificial Sequence: Synthetic peptide
  Seed: IDFSHQGPAF (TYRP2_HUMAN)
IFFSHQGPAF

SEQ ID NO: 183876 - protein, 10 aa, Artificial Sequence
  Description of Artificial Sequence: Synthetic peptide
  Seed: AANDPIFVVL (TYRP2_HUMAN)
AQNDPIFVVM

SEQ ID NO: 183877 - protein, 10 aa, Artificial Sequence
  Description of Artificial Sequence: Synthetic peptide
  Seed: ADTRPWSGPY (TYRP2_HUMAN)
AATRPWSGPY

SEQ ID NO: 183878 - protein, 8 aa, Artificial Sequence
  Description of Artificial Sequence: Synthetic peptide
  Seed: AIDLPVSV (TYRP2_HUMAN)
ATDLPVSL

SEQ ID NO: 183879 - protein, 10 aa, Artificial Sequence
  Description of Artificial Sequence: Synthetic peptide
  Seed: FVWLHYYSVR (TYRP2_HUMAN)
FYWLHYYSVR

SEQ ID NO: 183880 - protein, 9 aa, Artificial Sequence
  Description of Artificial Sequence: Synthetic peptide
  Seed: YSYAIDLPV (TYRP2_HUMAN)
YYYAIDLPF

SEQ ID NO: 183881 - protein, 10 aa, Artificial Sequence
  Description of Artificial Sequence: Synthetic peptide
  Seed: AIFDEWMKRF (TYRP2_HUMAN)
AYFDEWMKRF

SEQ ID NO: 183882 - protein, 10 aa, Artificial Sequence
  Description of Artificial Sequence: Synthetic peptide
  Seed: YAIDLPVSVE (TYRP2_HUMAN)
YMIDLPVSVS

SEQ ID NO: 183883 - protein, 9 aa, Artificial Sequence
  Description of Artificial Sequence: Synthetic peptide
  Seed: ANDPIFVVL (TYRP2_HUMAN)
AGDPIFVVL

SEQ ID NO: 183884 - protein, 10 aa, Artificial Sequence
  Description of Artificial Sequence: Synthetic peptide
  Seed: HNRMYNMVPF (TYRP2_HUMAN)
HFRMYNMVPM

SEQ ID NO: 183885 - protein, 10 aa, Artificial Sequence
  Description of Artificial Sequence: Synthetic peptide
  Seed: VVMGTLVALV (TYRP2_HUMAN)
VMMGTLVALD

SEQ ID NO: 183886 - protein, 9 aa, Artificial Sequence
  Description of Artificial Sequence: Synthetic peptide
  Seed: ARPDDPTLI (TYRP2_HUMAN)
ALPDDPTLL

SEQ ID NO: 183887 - protein, 10 aa, Artificial Sequence
  Description of Artificial Sequence: Synthetic peptide
  Seed: LHYYSVRDTL (TYRP2_HUMAN)
LPYYSVRDTL

SEQ ID NO: 183888 - protein, 9 aa, Artificial Sequence
  Description of Artificial Sequence: Synthetic peptide
  Seed: ISRNSRFSS (TYRP2_HUMAN)
ITRNSRFSA

SEQ ID NO: 183889 - protein, 9 aa, Artificial Sequence
  Description of Artificial Sequence: Synthetic peptide
  Seed: VMSLHNLVH (TYRP2_HUMAN)
VNSLHNLVY

SEQ ID NO: 183890 - protein, 10 aa, Artificial Sequence
  Description of Artificial Sequence: Synthetic peptide
  Seed: SLQKFDNPPF (TYRP2_HUMAN)
SYQKFDNPPY

SEQ ID NO: 183891 - protein, 10 aa, Artificial Sequence
  Description of Artificial Sequence: Synthetic peptide
  Seed: NSTFSFRNAL (TYRP2_HUMAN)
NLTFSFRNAV

SEQ ID NO: 183892 - protein, 10 aa, Artificial Sequence
  Description of Artificial Sequence: Synthetic peptide
  Seed: LGPNGTQPQF (TYRP2_HUMAN)
LIPNGTQPQL

SEQ ID NO: 183893 - protein, 10 aa, Artificial Sequence
  Description of Artificial Sequence: Synthetic peptide
  Seed: QVMSLHNLVH (TYRP2_HUMAN)
QVMSLHNLVK

SEQ ID NO: 183894 - protein, 9 aa, Artificial Sequence
  Description of Artificial Sequence: Synthetic peptide
  Seed: DDYNHLVTL (TYRP2_HUMAN)
DTYNHLVTI

SEQ ID NO: 183895 - protein, 9 aa, Artificial Sequence
  Description of Artificial Sequence: Synthetic peptide
  Seed: ANDPIFVVL (TYRP2_HUMAN)
AADPIFVVA

SEQ ID NO: 183896 - protein, 10 aa, Artificial Sequence
  Description of Artificial Sequence: Synthetic peptide
  Seed: ISRNSRFSSW (TYRP2_HUMAN)
ITRNSRFSSF

SEQ ID NO: 183897 - protein, 10 aa, Artificial Sequence
  Description of Artificial Sequence: Synthetic peptide
  Seed: RNSMKLPTLK (TYRP2_HUMAN)
RGSMKLPTLK

SEQ ID NO: 183898 - protein, 9 aa, Artificial Sequence
  Description of Artificial Sequence: Synthetic peptide
  Seed: DSLDDYNHL (TYRP2_HUMAN)
DILDDYNHW

SEQ ID NO: 183899 - protein, 9 aa, Artificial Sequence
  Description of Artificial Sequence: Synthetic peptide
  Seed: FFPPVTNEE (TYRP2_HUMAN)
FGPPVTNEM

SEQ ID NO: 183900 - protein, 8 aa, Artificial Sequence
  Description of Artificial Sequence: Synthetic peptide
  Seed: FSHQGPAF (TYRP2_HUMAN)
FFHQGPAY

SEQ ID NO: 183901 - protein, 9 aa, Artificial Sequence
  Description of Artificial Sequence: Synthetic peptide
  Seed: GFDKADGTL (TYRP2_HUMAN)
GFDKADGTI

SEQ ID NO: 183902 - protein, 9 aa, Artificial Sequence
  Description of Artificial Sequence: Synthetic peptide
  Seed: SRFSSWETV (TYRP2_HUMAN)
SHFSSWETT

SEQ ID NO: 183903 - protein, 9 aa, Artificial Sequence
  Description of Artificial Sequence: Synthetic peptide
  Seed: SLHNLVHSF (TYRP2_HUMAN)
SNHNLVHSY

SEQ ID NO: 183904 - protein, 9 aa, Artificial Sequence
  Description of Artificial Sequence: Synthetic peptide
  Seed: AANDPIFVV (TYRP2_HUMAN)
APNDPIFVT

SEQ ID NO: 183905 - protein, 10 aa, Artificial Sequence
  Description of Artificial Sequence: Synthetic peptide
  Seed: SDQLGYSYAI (TYRP2_HUMAN)
SGQLGYSYAF

SEQ ID NO: 183906 - protein, 10 aa, Artificial Sequence
  Description of Artificial Sequence: Synthetic peptide
  Seed: RRLRKGYTPL (TYRP2_HUMAN)
RELRKGYTPF

SEQ ID NO: 183907 - protein, 11 aa, Artificial Sequence
  Description of Artificial Sequence: Synthetic peptide
  Seed: RRNQMGRNSMK (TYRP2_HUMAN)
RINQMGRNSMR

SEQ ID NO: 183908 - protein, 10 aa, Artificial Sequence
  Description of Artificial Sequence: Synthetic peptide
  Seed: FLTSDQLGYS (TYRP2_HUMAN)
FQTSDQLGYV

SEQ ID NO: 183909 - protein, 9 aa, Artificial Sequence
  Description of Artificial Sequence: Synthetic peptide
  Seed: VVMGTLVAL (TYRP2_HUMAN)
VVMGTLVAK

SEQ ID NO: 183910 - protein, 10 aa, Artificial Sequence
  Description of Artificial Sequence: Synthetic peptide
  Seed: NSTFSFRNAL (TYRP2_HUMAN)
NSTFSFRNAV

SEQ ID NO: 183911 - protein, 9 aa, Artificial Sequence
  Description of Artificial Sequence: Synthetic peptide
  Seed: RAIDFSHQG (TYRP2_HUMAN)
RAIDFSHQI

SEQ ID NO: 183912 - protein, 9 aa, Artificial Sequence
  Description of Artificial Sequence: Synthetic peptide
  Seed: SVYDFFVWL (TYRP2_HUMAN)
SLYDFFVWS

SEQ ID NO: 183913 - protein, 10 aa, Artificial Sequence
  Description of Artificial Sequence: Synthetic peptide
  Seed: AANDPIFVVL (TYRP2_HUMAN)
ARNDPIFVVY

SEQ ID NO: 183914 - protein, 10 aa, Artificial Sequence
  Description of Artificial Sequence: Synthetic peptide
  Seed: AANDPIFVVL (TYRP2_HUMAN)
AVNDPIFVVM

SEQ ID NO: 183915 - protein, 10 aa, Artificial Sequence
  Description of Artificial Sequence: Synthetic peptide
  Seed: FTDAIFDEWM (TYRP2_HUMAN)
FMDAIFDEWI

SEQ ID NO: 183916 - protein, 10 aa, Artificial Sequence
  Description of Artificial Sequence: Synthetic peptide
  Seed: SLDDYNHLVT (TYRP2_HUMAN)
STDDYNHLVF

SEQ ID NO: 183917 - protein, 9 aa, Artificial Sequence
  Description of Artificial Sequence: Synthetic peptide
  Seed: YSYAIDLPV (TYRP2_HUMAN)
YQYAIDLPH

SEQ ID NO: 183918 - protein, 11 aa, Artificial Sequence
  Description of Artificial Sequence: Synthetic peptide
  Seed: SLDDYNHLVTL (TYRP2_HUMAN)
SADDYNHLVTI

SEQ ID NO: 183919 - protein, 9 aa, Artificial Sequence
  Description of Artificial Sequence: Synthetic peptide
  Seed: ISRNSRFSS (TYRP2_HUMAN)
IMRNSRFSM

SEQ ID NO: 183920 - protein, 9 aa, Artificial Sequence
  Description of Artificial Sequence: Synthetic peptide
  Seed: VTWHRYHLL (TYRP2_HUMAN)
VMWHRYHLC

SEQ ID NO: 183921 - protein, 9 aa, Artificial Sequence
  Description of Artificial Sequence: Synthetic peptide
  Seed: DSLDDYNHL (TYRP2_HUMAN)
DILDDYNHY

SEQ ID NO: 183922 - protein, 9 aa, Artificial Sequence
  Description of Artificial Sequence: Synthetic peptide
  Seed: SQVMSLHNL (TYRP2_HUMAN)
SEVMSLHNV

SEQ ID NO: 183923 - protein, 8 aa, Artificial Sequence
  Description of Artificial Sequence: Synthetic peptide
  Seed: ANDPIFVV (TYRP2_HUMAN)
AADPIFVM

SEQ ID NO: 183924 - protein, 10 aa, Artificial Sequence
  Description of Artificial Sequence: Synthetic peptide
  Seed: LLGPGRPYRA (TYRP2_HUMAN)
LMGPGRPYRV

SEQ ID NO: 183925 - protein, 9 aa, Artificial Sequence
  Description of Artificial Sequence: Synthetic peptide
  Seed: LSCLGCKIL (TYRP2_HUMAN)
LSCLGCKIW

SEQ ID NO: 183926 - protein, 9 aa, Artificial Sequence
  Description of Artificial Sequence: Synthetic peptide
  Seed: SHQGPAFVT (TYRP2_HUMAN)
SHQGPAFVM

SEQ ID NO: 183927 - protein, 10 aa, Artificial Sequence
  Description of Artificial Sequence: Synthetic peptide
  Seed: SLDDYNHLVT (TYRP2_HUMAN)
SMDDYNHLVP

SEQ ID NO: 183928 - protein, 10 aa, Artificial Sequence
  Description of Artificial Sequence: Synthetic peptide
  Seed: SVYDFFVWLH (TYRP2_HUMAN)
SDYDFFVWLR

SEQ ID NO: 183929 - protein, 9 aa, Artificial Sequence
  Description of Artificial Sequence: Synthetic peptide
  Seed: LLSCLGCKI (TYRP2_HUMAN)
LISCLGCKL

SEQ ID NO: 183930 - protein, 10 aa, Artificial Sequence
  Description of Artificial Sequence: Synthetic peptide
  Seed: YDFFVWLHYY (TYRP2_HUMAN)
YMFFVWLHYV

SEQ ID NO: 183931 - protein, 11 aa, Artificial Sequence
  Description of Artificial Sequence: Synthetic peptide
  Seed: RNSRFSSWETV (TYRP2_HUMAN)
RGSRFSSWETI

SEQ ID NO: 183932 - protein, 9 aa, Artificial Sequence
  Description of Artificial Sequence: Synthetic peptide
  Seed: RNQMGRNSM (TYRP2_HUMAN)
RKQMGRNSY

SEQ ID NO: 183933 - protein, 9 aa, Artificial Sequence
  Description of Artificial Sequence: Synthetic peptide
  Seed: AARPDDPTL (TYRP2_HUMAN)
ATRPDDPTF

SEQ ID NO: 183934 - protein, 10 aa, Artificial Sequence
  Description of Artificial Sequence: Synthetic peptide
  Seed: RLRKGYTPLM (TYRP2_HUMAN)
RTRKGYTPLP

SEQ ID NO: 183935 - protein, 10 aa, Artificial Sequence
  Description of Artificial Sequence: Synthetic peptide
  Seed: ALVGLFVLLA (TYRP2_HUMAN)
ALVGLFVLLL

SEQ ID NO: 183936 - protein, 9 aa, Artificial Sequence
  Description of Artificial Sequence: Synthetic peptide
  Seed: SRFSSWETV (TYRP2_HUMAN)
SRFSSWETA

SEQ ID NO: 183937 - protein, 9 aa, Artificial Sequence
  Description of Artificial Sequence: Synthetic peptide
  Seed: HQGPAFVTW (TYRP2_HUMAN)
HAGPAFVTA

SEQ ID NO: 183938 - protein, 10 aa, Artificial Sequence
  Description of Artificial Sequence: Synthetic peptide
  Seed: HSFLNGTNAL (TYRP2_HUMAN)
HEFLNGTNAF

SEQ ID NO: 183939 - protein, 9 aa, Artificial Sequence
  Description of Artificial Sequence: Synthetic peptide
  Seed: FPPVTNEEL (TYRP2_HUMAN)
FAPVTNEEY

SEQ ID NO: 183940 - protein, 9 aa, Artificial Sequence
  Description of Artificial Sequence: Synthetic peptide
  Seed: NALEGFDKA (TYRP2_HUMAN)
NLLEGFDKL

SEQ ID NO: 183941 - protein, 10 aa, Artificial Sequence
  Description of Artificial Sequence: Synthetic peptide
  Seed: MGRNSMKLPT (TYRP2_HUMAN)
MLRNSMKLPK

SEQ ID NO: 183942 - protein, 9 aa, Artificial Sequence
  Description of Artificial Sequence: Synthetic peptide
  Seed: VVMGTLVAL (TYRP2_HUMAN)
VYMGTLVAY

SEQ ID NO: 183943 - protein, 9 aa, Artificial Sequence
  Description of Artificial Sequence: Synthetic peptide
  Seed: VIRQNIHSL (TYRP2_HUMAN)
VARQNIHSY

SEQ ID NO: 183944 - protein, 9 aa, Artificial Sequence
  Description of Artificial Sequence: Synthetic peptide
  Seed: QKFDNPPFF (TYRP2_HUMAN)
QRFDNPPFV

SEQ ID NO: 183945 - protein, 10 aa, Artificial Sequence
  Description of Artificial Sequence: Synthetic peptide
  Seed: SLDDYNHLVT (TYRP2_HUMAN)
SWDDYNHLVL

SEQ ID NO: 183946 - protein, 9 aa, Artificial Sequence
  Description of Artificial Sequence: Synthetic peptide
  Seed: TLDSQVMSL (TYRP2_HUMAN)
TQDSQVMSI

SEQ ID NO: 183947 - protein, 9 aa, Artificial Sequence
  Description of Artificial Sequence: Synthetic peptide
  Seed: SSKRYTEEA (TYRP2_HUMAN)
SYKRYTEEK

SEQ ID NO: 183948 - protein, 11 aa, Artificial Sequence
  Description of Artificial Sequence: Synthetic peptide
  Seed: YTPLMETHLSS (TYRP2_HUMAN)
YLPLMETHLSL

SEQ ID NO: 183949 - protein, 10 aa, Artificial Sequence
  Description of Artificial Sequence: Synthetic peptide
  Seed: SLDDYNHLVT (TYRP2_HUMAN)
SMDDYNHLVR

SEQ ID NO: 183950 - protein, 10 aa, Artificial Sequence
  Description of Artificial Sequence: Synthetic peptide
  Seed: CCPRLGAESA (TYRP2_HUMAN)
CNPRLGAESL

SEQ ID NO: 183951 - protein, 9 aa, Artificial Sequence
  Description of Artificial Sequence: Synthetic peptide
  Seed: VVMGTLVAL (TYRP2_HUMAN)
VIMGTLVAL

SEQ ID NO: 183952 - protein, 9 aa, Artificial Sequence
  Description of Artificial Sequence: Synthetic peptide
  Seed: STFSFRNAL (TYRP2_HUMAN)
SSFSFRNAY

SEQ ID NO: 183953 - protein, 10 aa, Artificial Sequence
  Description of Artificial Sequence: Synthetic peptide
  Seed: VVMGTLVALV (TYRP2_HUMAN)
VMMGTLVALT

SEQ ID NO: 183954 - protein, 9 aa, Artificial Sequence
  Description of Artificial Sequence: Synthetic peptide
  Seed: YDFFVWLHY (TYRP2_HUMAN)
YSFFVWLHY

SEQ ID NO: 183955 - protein, 9 aa, Artificial Sequence
  Description of Artificial Sequence: Synthetic peptide
  Seed: FSHQGPAFV (TYRP2_HUMAN)
FAHQGPAFI

SEQ ID NO: 183956 - protein, 10 aa, Artificial Sequence
  Description of Artificial Sequence: Synthetic peptide
  Seed: SHQGPAFVTW (TYRP2_HUMAN)
SHQGPAFVTL

SEQ ID NO: 183957 - protein, 9 aa, Artificial Sequence
  Description of Artificial Sequence: Synthetic peptide
  Seed: RQNIHSLSP (TYRP2_HUMAN)
RINIHSLSF

SEQ ID NO: 183958 - protein, 10 aa, Artificial Sequence
  Description of Artificial Sequence: Synthetic peptide
  Seed: MSLHNLVHSF (TYRP2_HUMAN)
MYLHNLVHSI

SEQ ID NO: 183959 - protein, 9 aa, Artificial Sequence
  Description of Artificial Sequence: Synthetic peptide
  Seed: QVMSLHNLV (TYRP2_HUMAN)
QAMSLHNLR

SEQ ID NO: 183960 - protein, 9 aa, Artificial Sequence
  Description of Artificial Sequence: Synthetic peptide
  Seed: YAIDLPVSV (TYRP2_HUMAN)
YYIDLPVSL

SEQ ID NO: 183961 - protein, 10 aa, Artificial Sequence
  Description of Artificial Sequence: Synthetic peptide
  Seed: FLLSCLGCKI (TYRP2_HUMAN)
FRLSCLGCKL

SEQ ID NO: 183962 - protein, 9 aa, Artificial Sequence
  Description of Artificial Sequence: Synthetic peptide
  Seed: YSVRDTLLG (TYRP2_HUMAN)
YQVRDTLLW

SEQ ID NO: 183963 - protein, 9 aa, Artificial Sequence
  Description of Artificial Sequence: Synthetic peptide
  Seed: WHRYHLLCL (TYRP2_HUMAN)
WPRYHLLCI

SEQ ID NO: 183964 - protein, 10 aa, Artificial Sequence
  Description of Artificial Sequence: Synthetic peptide
  Seed: RMYNMVPFFP (TYRP2_HUMAN)
RLYNMVPFFK

SEQ ID NO: 183965 - protein, 9 aa, Artificial Sequence
  Description of Artificial Sequence: Synthetic peptide
  Seed: LCLERDLQR (TYRP2_HUMAN)
LVLERDLQR

SEQ ID NO: 183966 - protein, 9 aa, Artificial Sequence
  Description of Artificial Sequence: Synthetic peptide
  Seed: CERKKPPVI (TYRP2_HUMAN)
CLRKKPPVM

SEQ ID NO: 183967 - protein, 8 aa, Artificial Sequence
  Description of Artificial Sequence: Synthetic peptide
  Seed: AIDLPVSV (TYRP2_HUMAN)
AWDLPVSL

SEQ ID NO: 183968 - protein, 10 aa, Artificial Sequence
  Description of Artificial Sequence: Synthetic peptide
  Seed: CMTVDSLVNK (TYRP2_HUMAN)
CHTVDSLVNR

SEQ ID NO: 183969 - protein, 9 aa, Artificial Sequence
  Description of Artificial Sequence: Synthetic peptide
  Seed: SLDDYNHLV (TYRP2_HUMAN)
SYDDYNHLM

SEQ ID NO: 183970 - protein, 9 aa, Artificial Sequence
  Description of Artificial Sequence: Synthetic peptide
  Seed: FANCSVYDF (TYRP2_HUMAN)
FYNCSVYDY

SEQ ID NO: 183971 - protein, 10 aa, Artificial Sequence
  Description of Artificial Sequence: Synthetic peptide
  Seed: LTSDQLGYSY (TYRP2_HUMAN)
LPSDQLGYSF

SEQ ID NO: 183972 - protein, 9 aa, Artificial Sequence
  Description of Artificial Sequence: Synthetic peptide
  Seed: TLLGPGRPY (TYRP2_HUMAN)
TWLGPGRPY

SEQ ID NO: 183973 - protein, 10 aa, Artificial Sequence
  Description of Artificial Sequence: Synthetic peptide
  Seed: IGNESFALPY (TYRP2_HUMAN)
ILNESFALPF

SEQ ID NO: 183974 - protein, 9 aa, Artificial Sequence
  Description of Artificial Sequence: Synthetic peptide
  Seed: ELWPRKFFH (TYRP2_HUMAN)
ECWPRKFFR

SEQ ID NO: 183975 - protein, 11 aa, Artificial Sequence
  Description of Artificial Sequence: Synthetic peptide
  Seed: YNMVPFFPPVT (TYRP2_HUMAN)
YMMVPFFPPVY

SEQ ID NO: 183976 - protein, 10 aa, Artificial Sequence
  Description of Artificial Sequence: Synthetic peptide
  Seed: LGPGRPYRAI (TYRP2_HUMAN)
LNPGRPYRAL

SEQ ID NO: 183977 - protein, 9 aa, Artificial Sequence
  Description of Artificial Sequence: Synthetic peptide
  Seed: AANDPIFVV (TYRP2_HUMAN)
AQNDPIFVA

SEQ ID NO: 183978 - protein, 9 aa, Artificial Sequence
  Description of Artificial Sequence: Synthetic peptide
  Seed: YAIDLPVSV (TYRP2_HUMAN)
YWIDLPVSF

SEQ ID NO: 183979 - protein, 11 aa, Artificial Sequence
  Description of Artificial Sequence: Synthetic peptide
  Seed: FFPPVTNEELF (TYRP2_HUMAN)
FDPPVTNEELW

SEQ ID NO: 183980 - protein, 11 aa, Artificial Sequence
  Description of Artificial Sequence: Synthetic peptide
  Seed: RLIGNESFALP (TYRP2_HUMAN)
RLIGNESFALM

SEQ ID NO: 183981 - protein, 9 aa, Artificial Sequence
  Description of Artificial Sequence: Synthetic peptide
  Seed: VVMGTLVAL (TYRP2_HUMAN)
VFMGTLVAL

SEQ ID NO: 183982 - protein, 9 aa, Artificial Sequence
  Description of Artificial Sequence: Synthetic peptide
  Seed: RNQDDRELW (TYRP2_HUMAN)
RMQDDRELV

SEQ ID NO: 183983 - protein, 9 aa, Artificial Sequence
  Description of Artificial Sequence: Synthetic peptide
  Seed: AESANVCGS (TYRP2_HUMAN)
AESANVCGV

SEQ ID NO: 183984 - protein, 9 aa, Artificial Sequence
  Description of Artificial Sequence: Synthetic peptide
  Seed: YYSVRDTLL (TYRP2_HUMAN)
YTSVRDTLL

SEQ ID NO: 183985 - protein, 11 aa, Artificial Sequence
  Description of Artificial Sequence: Synthetic peptide
  Seed: VCDSLDDYNHL (TYRP2_HUMAN)
VVDSLDDYNHM

SEQ ID NO: 183986 - protein, 9 aa, Artificial Sequence
  Description of Artificial Sequence: Synthetic peptide
  Seed: YVITTQHWL (TYRP2_HUMAN)
YVITTQHWA

SEQ ID NO: 183987 - protein, 9 aa, Artificial Sequence
  Description of Artificial Sequence: Synthetic peptide
  Seed: SQVMSLHNL (TYRP2_HUMAN)
SQVMSLHNF

SEQ ID NO: 183988 - protein, 9 aa, Artificial Sequence
  Description of Artificial Sequence: Synthetic peptide
  Seed: FSHQGPAFV (TYRP2_HUMAN)
FMHQGPAFS

SEQ ID NO: 183989 - protein, 9 aa, Artificial Sequence
  Description of Artificial Sequence: Synthetic peptide
  Seed: VTWHRYHLL (TYRP2_HUMAN)
VMWHRYHLA

SEQ ID NO: 183990 - protein, 10 aa, Artificial Sequence
  Description of Artificial Sequence: Synthetic peptide
  Seed: LGPGRPYRAI (TYRP2_HUMAN)
LHPGRPYRAL

SEQ ID NO: 183991 - protein, 10 aa, Artificial Sequence
  Description of Artificial Sequence: Synthetic peptide
  Seed: CCPRLGAESA (TYRP2_HUMAN)
CGPRLGAESL

SEQ ID NO: 183992 - protein, 9 aa, Artificial Sequence
  Description of Artificial Sequence: Synthetic peptide
  Seed: RLRKGYTPL (TYRP2_HUMAN)
RNRKGYTPM

SEQ ID NO: 183993 - protein, 11 aa, Artificial Sequence
  Description of Artificial Sequence: Synthetic peptide
  Seed: FLTSDQLGYSY (TYRP2_HUMAN)
FMTSDQLGYSY

SEQ ID NO: 183994 - protein, 10 aa, Artificial Sequence
  Description of Artificial Sequence: Synthetic peptide
  Seed: VVMGTLVALV (TYRP2_HUMAN)
VLMGTLVALP

SEQ ID NO: 183995 - protein, 11 aa, Artificial Sequence
  Description of Artificial Sequence: Synthetic peptide
  Seed: RADTRPWSGPY (TYRP2_HUMAN)
RSDTRPWSGPF

SEQ ID NO: 183996 - protein, 10 aa, Artificial Sequence
  Description of Artificial Sequence: Synthetic peptide
  Seed: DAIFDEWMKR (TYRP2_HUMAN)
DYIFDEWMKR

SEQ ID NO: 183997 - protein, 10 aa, Artificial Sequence
  Description of Artificial Sequence: Synthetic peptide
  Seed: REQFLGALDL (TYRP2_HUMAN)
RAQFLGALDM

SEQ ID NO: 183998 - protein, 10 aa, Artificial Sequence
  Description of Artificial Sequence: Synthetic peptide
  Seed: RPWSGPYILR (TYRP2_HUMAN)
RLWSGPYILR

SEQ ID NO: 183999 - protein, 11 aa, Artificial Sequence
  Description of Artificial Sequence: Synthetic peptide
  Seed: YNMVPFFPPVT (TYRP2_HUMAN)
YMMVPFFPPVS

SEQ ID NO: 184000 - protein, 10 aa, Artificial Sequence
  Description of Artificial Sequence: Synthetic peptide
  Seed: MSPLWWGFLL (TYRP2_HUMAN)
MFPLWWGFLL

SEQ ID NO: 184001 - protein, 9 aa, Artificial Sequence
  Description of Artificial Sequence: Synthetic peptide
  Seed: RVCMTVDSL (TYRP2_HUMAN)
RLCMTVDSL

SEQ ID NO: 184002 - protein, 10 aa, Artificial Sequence
  Description of Artificial Sequence: Synthetic peptide
  Seed: KILPGAQGQF (TYRP2_HUMAN)
KALPGAQGQY

SEQ ID NO: 184003 - protein, 9 aa, Artificial Sequence
  Description of Artificial Sequence: Synthetic peptide
  Seed: RNQMGRNSM (TYRP2_HUMAN)
RMQMGRNSM

SEQ ID NO: 184004 - protein, 9 aa, Artificial Sequence
  Description of Artificial Sequence: Synthetic peptide
  Seed: STFSFRNAL (TYRP2_HUMAN)
SLFSFRNAL

SEQ ID NO: 184005 - protein, 10 aa, Artificial Sequence
  Description of Artificial Sequence: Synthetic peptide
  Seed: YSYAIDLPVS (TYRP2_HUMAN)
YLYAIDLPVI

SEQ ID NO: 184006 - protein, 10 aa, Artificial Sequence
  Description of Artificial Sequence: Synthetic peptide
  Seed: RNSRFSSWET (TYRP2_HUMAN)
RISRFSSWES

SEQ ID NO: 184007 - protein, 11 aa, Artificial Sequence
  Description of Artificial Sequence: Synthetic peptide
  Seed: RMYNMVPFFPP (TYRP2_HUMAN)
RQYNMVPFFPV

SEQ ID NO: 184008 - protein, 9 aa, Artificial Sequence
  Description of Artificial Sequence: Synthetic peptide
  Seed: ALVGLFVLL (TYRP2_HUMAN)
AQVGLFVLY

SEQ ID NO: 184009 - protein, 10 aa, Artificial Sequence
  Description of Artificial Sequence: Synthetic peptide
  Seed: RNSRFSSWET (TYRP2_HUMAN)
RCSRFSSWEK

SEQ ID NO: 184010 - protein, 10 aa, Artificial Sequence
  Description of Artificial Sequence: Synthetic peptide
  Seed: DIRDCLSLQK (TYRP2_HUMAN)
DARDCLSLQK

SEQ ID NO: 184011 - protein, 9 aa, Artificial Sequence
  Description of Artificial Sequence: Synthetic peptide
  Seed: MTVDSLVNK (TYRP2_HUMAN)
MTVDSLVNF

SEQ ID NO: 184012 - protein, 9 aa, Artificial Sequence
  Description of Artificial Sequence: Synthetic peptide
  Seed: FVLLAFLQY (TYRP2_HUMAN)
FMLLAFLQY

SEQ ID NO: 184013 - protein, 10 aa, Artificial Sequence
  Description of Artificial Sequence: Synthetic peptide
  Seed: RNSRFSSWET (TYRP2_HUMAN)
RWSRFSSWEL

SEQ ID NO: 184014 - protein, 10 aa, Artificial Sequence
  Description of Artificial Sequence: Synthetic peptide
  Seed: LVVMGTLVAL (TYRP2_HUMAN)
LYVMGTLVAY

SEQ ID NO: 184015 - protein, 10 aa, Artificial Sequence
  Description of Artificial Sequence: Synthetic peptide
  Seed: RRLRKGYTPL (TYRP2_HUMAN)
RGLRKGYTPK

SEQ ID NO: 184016 - protein, 10 aa, Artificial Sequence
  Description of Artificial Sequence: Synthetic peptide
  Seed: TRPWSGPYIL (TYRP2_HUMAN)
TCPWSGPYIF

SEQ ID NO: 184017 - protein, 9 aa, Artificial Sequence
  Description of Artificial Sequence: Synthetic peptide
  Seed: SVYDFFVWL (TYRP2_HUMAN)
STYDFFVWT

SEQ ID NO: 184018 - protein, 10 aa, Artificial Sequence
  Description of Artificial Sequence: Synthetic peptide
  Seed: HSFLNGTNAL (TYRP2_HUMAN)
HAFLNGTNAW

SEQ ID NO: 184019 - protein, 9 aa, Artificial Sequence
  Description of Artificial Sequence: Synthetic peptide
  Seed: YTPLMETHL (TYRP2_HUMAN)
YLPLMETHL

SEQ ID NO: 184020 - protein, 10 aa, Artificial Sequence
  Description of Artificial Sequence: Synthetic peptide
  Seed: SLDDYNHLVT (TYRP2_HUMAN)
SFDDYNHLVF

SEQ ID NO: 184021 - protein, 9 aa, Artificial Sequence
  Description of Artificial Sequence: Synthetic peptide
  Seed: QKFDNPPFF (TYRP2_HUMAN)
QHFDNPPFL

SEQ ID NO: 184022 - protein, 9 aa, Artificial Sequence
  Description of Artificial Sequence: Synthetic peptide
  Seed: SVYDFFVWL (TYRP2_HUMAN)
SIYDFFVWA

SEQ ID NO: 184023 - protein, 11 aa, Artificial Sequence
  Description of Artificial Sequence: Synthetic peptide
  Seed: RDTLLGPGRPY (TYRP2_HUMAN)
RQTLLGPGRPF

SEQ ID NO: 184024 - protein, 10 aa, Artificial Sequence
  Description of Artificial Sequence: Synthetic peptide
  Seed: RLRKGYTPLM (TYRP2_HUMAN)
RQRKGYTPLL

SEQ ID NO: 184025 - protein, 9 aa, Artificial Sequence
  Description of Artificial Sequence: Synthetic peptide
  Seed: GAQGQFPRV (TYRP2_HUMAN)
GMQGQFPRL

SEQ ID NO: 184026 - protein, 10 aa, Artificial Sequence
  Description of Artificial Sequence: Synthetic peptide
  Seed: FSFRNALEGF (TYRP2_HUMAN)
FSFRNALEGM

SEQ ID NO: 184027 - protein, 9 aa, Artificial Sequence
  Description of Artificial Sequence: Synthetic peptide
  Seed: RLGAESANV (TYRP2_HUMAN)
RMGAESANI

SEQ ID NO: 184028 - protein, 10 aa, Artificial Sequence
  Description of Artificial Sequence: Synthetic peptide
  Seed: HLVTLCNGTY (TYRP2_HUMAN)
HYVTLCNGTY

SEQ ID NO: 184029 - protein, 9 aa, Artificial Sequence
  Description of Artificial Sequence: Synthetic peptide
  Seed: YSVRDTLLG (TYRP2_HUMAN)
YIVRDTLLW

SEQ ID NO: 184030 - protein, 10 aa, Artificial Sequence
  Description of Artificial Sequence: Synthetic peptide
  Seed: FSFRNALEGF (TYRP2_HUMAN)
FGFRNALEGW

SEQ ID NO: 184031 - protein, 9 aa, Artificial Sequence
  Description of Artificial Sequence: Synthetic peptide
  Seed: VTWHRYHLL (TYRP2_HUMAN)
VSWHRYHLM

SEQ ID NO: 184032 - protein, 9 aa, Artificial Sequence
  Description of Artificial Sequence: Synthetic peptide
  Seed: DIRDCLSLQ (TYRP2_HUMAN)
DARDCLSLK

SEQ ID NO: 184033 - protein, 8 aa, Artificial Sequence
  Description of Artificial Sequence: Synthetic peptide
  Seed: AIDLPVSV (TYRP2_HUMAN)
ASDLPVSI

SEQ ID NO: 184034 - protein, 9 aa, Artificial Sequence
  Description of Artificial Sequence: Synthetic peptide
  Seed: FFQNSTFSF (TYRP2_HUMAN)
FFQNSTFSV

SEQ ID NO: 184035 - protein, 9 aa, Artificial Sequence
  Description of Artificial Sequence: Synthetic peptide
  Seed: VIRQNIHSL (TYRP2_HUMAN)
VFRQNIHSI

SEQ ID NO: 184036 - protein, 11 aa, Artificial Sequence
  Description of Artificial Sequence: Synthetic peptide
  Seed: HSLSPQEREQF (TYRP2_HUMAN)
HSLSPQEREQW

SEQ ID NO: 184037 - protein, 9 aa, Artificial Sequence
  Description of Artificial Sequence: Synthetic peptide
  Seed: VLHSFTDAI (TYRP2_HUMAN)
VVHSFTDAI

SEQ ID NO: 184038 - protein, 9 aa, Artificial Sequence
  Description of Artificial Sequence: Synthetic peptide
  Seed: HQGPAFVTW (TYRP2_HUMAN)
HIGPAFVTF

SEQ ID NO: 184039 - protein, 10 aa, Artificial Sequence
  Description of Artificial Sequence: Synthetic peptide
  Seed: SPLWWGFLLS (TYRP2_HUMAN)
SMLWWGFLLC

SEQ ID NO: 184040 - protein, 10 aa, Artificial Sequence
  Description of Artificial Sequence: Synthetic peptide
  Seed: TDAIFDEWMK (TYRP2_HUMAN)
TPAIFDEWMR

SEQ ID NO: 184041 - protein, 9 aa, Artificial Sequence
  Description of Artificial Sequence: Synthetic peptide
  Seed: HSFLNGTNA (TYRP2_HUMAN)
HRFLNGTNA

SEQ ID NO: 184042 - protein, 9 aa, Artificial Sequence
  Description of Artificial Sequence: Synthetic peptide
  Seed: SAANDPIFV (TYRP2_HUMAN)
SMANDPIFM

SEQ ID NO: 184043 - protein, 9 aa, Artificial Sequence
  Description of Artificial Sequence: Synthetic peptide
  Seed: SLDDYNHLV (TYRP2_HUMAN)
SWDDYNHLV

SEQ ID NO: 184044 - protein, 11 aa, Artificial Sequence
  Description of Artificial Sequence: Synthetic peptide
  Seed: LSLQKFDNPPF (TYRP2_HUMAN)
LTLQKFDNPPW

SEQ ID NO: 184045 - protein, 9 aa, Artificial Sequence
  Description of Artificial Sequence: Synthetic peptide
  Seed: VVMGTLVAL (TYRP2_HUMAN)
VLMGTLVAV

SEQ ID NO: 184046 - protein, 9 aa, Artificial Sequence
  Description of Artificial Sequence: Synthetic peptide
  Seed: AARPDDPTL (TYRP2_HUMAN)
AKRPDDPTY

SEQ ID NO: 184047 - protein, 9 aa, Artificial Sequence
  Description of Artificial Sequence: Synthetic peptide
  Seed: LWPRKFFHR (TYRP2_HUMAN)
LAPRKFFHR

SEQ ID NO: 184048 - protein, 10 aa, Artificial Sequence
  Description of Artificial Sequence: Synthetic peptide
  Seed: QELAPIGHNR (TYRP2_HUMAN)
QELAPIGHNW

SEQ ID NO: 184049 - protein, 9 aa, Artificial Sequence
  Description of Artificial Sequence: Synthetic peptide
  Seed: TTQHWLGLL (TYRP2_HUMAN)
TMQHWLGLL

SEQ ID NO: 184050 - protein, 10 aa, Artificial Sequence
  Description of Artificial Sequence: Synthetic peptide
  Seed: NGTYEGLLRR (TYRP2_HUMAN)
NDTYEGLLRR

SEQ ID NO: 184051 - protein, 9 aa, Artificial Sequence
  Description of Artificial Sequence: Synthetic peptide
  Seed: YSYAIDLPV (TYRP2_HUMAN)
YYYAIDLPT

SEQ ID NO: 184052 - protein, 10 aa, Artificial Sequence
  Description of Artificial Sequence: Synthetic peptide
  Seed: LHYYSVRDTL (TYRP2_HUMAN)
LWYYSVRDTL

SEQ ID NO: 184053 - protein, 9 aa, Artificial Sequence
  Description of Artificial Sequence: Synthetic peptide
  Seed: KRVHPDYVI (TYRP2_HUMAN)
KRVHPDYVV

SEQ ID NO: 184054 - protein, 9 aa, Artificial Sequence
  Description of Artificial Sequence: Synthetic peptide
  Seed: SHQGPAFVT (TYRP2_HUMAN)
SHQGPAFVA

SEQ ID NO: 184055 - protein, 9 aa, Artificial Sequence
  Description of Artificial Sequence: Synthetic peptide
  Seed: GTYEGLLRR (TYRP2_HUMAN)
GLYEGLLRY

SEQ ID NO: 184056 - protein, 9 aa, Artificial Sequence
  Description of Artificial Sequence: Synthetic peptide
  Seed: SVYDFFVWL (TYRP2_HUMAN)
SFYDFFVWY

SEQ ID NO: 184057 - protein, 9 aa, Artificial Sequence
  Description of Artificial Sequence: Synthetic peptide
  Seed: APIGHNRMY (TYRP2_HUMAN)
ATIGHNRMF

SEQ ID NO: 184058 - protein, 9 aa, Artificial Sequence
  Description of Artificial Sequence: Synthetic peptide
  Seed: ARPDDPTLI (TYRP2_HUMAN)
AYPDDPTLM

SEQ ID NO: 184059 - protein, 9 aa, Artificial Sequence
  Description of Artificial Sequence: Synthetic peptide
  Seed: RNSMKLPTL (TYRP2_HUMAN)
RRSMKLPTM

SEQ ID NO: 184060 - protein, 9 aa, Artificial Sequence
  Description of Artificial Sequence: Synthetic peptide
  Seed: VMSLHNLVH (TYRP2_HUMAN)
VASLHNLVH

SEQ ID NO: 184061 - protein, 9 aa, Artificial Sequence
  Description of Artificial Sequence: Synthetic peptide
  Seed: VGLFVLLAF (TYRP2_HUMAN)
VALFVLLAF

SEQ ID NO: 184062 - protein, 10 aa, Artificial Sequence
  Description of Artificial Sequence: Synthetic peptide
  Seed: FFPPVTNEEL (TYRP2_HUMAN)
FAPPVTNEEL

SEQ ID NO: 184063 - protein, 11 aa, Artificial Sequence
  Description of Artificial Sequence: Synthetic peptide
  Seed: LPHSAANDPIF (TYRP2_HUMAN)
LPHSAANDPIW

SEQ ID NO: 184064 - protein, 10 aa, Artificial Sequence
  Description of Artificial Sequence: Synthetic peptide
  Seed: RPDDPTLISR (TYRP2_HUMAN)
RPDDPTLISM

SEQ ID NO: 184065 - protein, 10 aa, Artificial Sequence
  Description of Artificial Sequence: Synthetic peptide
  Seed: CCPRLGAESA (TYRP2_HUMAN)
CDPRLGAESL

SEQ ID NO: 184066 - protein, 10 aa, Artificial Sequence
  Description of Artificial Sequence: Synthetic peptide
  Seed: RTCKCTGNFA (TYRP2_HUMAN)
RVCKCTGNFK

SEQ ID NO: 184067 - protein, 9 aa, Artificial Sequence
  Description of Artificial Sequence: Synthetic peptide
  Seed: VVMGTLVAL (TYRP2_HUMAN)
VIMGTLVAI

SEQ ID NO: 184068 - protein, 9 aa, Artificial Sequence
  Description of Artificial Sequence: Synthetic peptide
  Seed: VIRQNIHSL (TYRP2_HUMAN)
VPRQNIHSF

SEQ ID NO: 184069 - protein, 11 aa, Artificial Sequence
  Description of Artificial Sequence: Synthetic peptide
  Seed: RADTRPWSGPY (TYRP2_HUMAN)
RLDTRPWSGPW

SEQ ID NO: 184070 - protein, 9 aa, Artificial Sequence
  Description of Artificial Sequence: Synthetic peptide
  Seed: LLRRNQMGR (TYRP2_HUMAN)
LFRRNQMGR

SEQ ID NO: 184071 - protein, 9 aa, Artificial Sequence
  Description of Artificial Sequence: Synthetic peptide
  Seed: ANDPIFVVL (TYRP2_HUMAN)
ASDPIFVVW

SEQ ID NO: 184072 - protein, 10 aa, Artificial Sequence
  Description of Artificial Sequence: Synthetic peptide
  Seed: RPDDPTLISR (TYRP2_HUMAN)
RTDDPTLISL

SEQ ID NO: 184073 - protein, 9 aa, Artificial Sequence
  Description of Artificial Sequence: Synthetic peptide
  Seed: MSPLWWGFL (TYRP2_HUMAN)
MVPLWWGFA

SEQ ID NO: 184074 - protein, 10 aa, Artificial Sequence
  Description of Artificial Sequence: Synthetic peptide
  Seed: SHQGPAFVTW (TYRP2_HUMAN)
SYQGPAFVTV

SEQ ID NO: 184075 - protein, 9 aa, Artificial Sequence
  Description of Artificial Sequence: Synthetic peptide
  Seed: STFSFRNAL (TYRP2_HUMAN)
SVFSFRNAI

SEQ ID NO: 184076 - protein, 10 aa, Artificial Sequence
  Description of Artificial Sequence: Synthetic peptide
  Seed: LISRNSRFSS (TYRP2_HUMAN)
LGSRNSRFSK

SEQ ID NO: 184077 - protein, 10 aa, Artificial Sequence
  Description of Artificial Sequence: Synthetic peptide
  Seed: RELWPRKFFH (TYRP2_HUMAN)
RILWPRKFFH

SEQ ID NO: 184078 - protein, 9 aa, Artificial Sequence
  Description of Artificial Sequence: Synthetic peptide
  Seed: VTWHRYHLL (TYRP2_HUMAN)
VIWHRYHLV

SEQ ID NO: 184079 - protein, 11 aa, Artificial Sequence
  Description of Artificial Sequence: Synthetic peptide
  Seed: SLDDYNHLVTL (TYRP2_HUMAN)
SADDYNHLVTF

SEQ ID NO: 184080 - protein, 9 aa, Artificial Sequence
  Description of Artificial Sequence: Synthetic peptide
  Seed: FVWLHYYSV (TYRP2_HUMAN)
FTWLHYYSI

SEQ ID NO: 184081 - protein, 9 aa, Artificial Sequence
  Description of Artificial Sequence: Synthetic peptide
  Seed: STFSFRNAL (TYRP2_HUMAN)
SQFSFRNAI

SEQ ID NO: 184082 - protein, 10 aa, Artificial Sequence
  Description of Artificial Sequence: Synthetic peptide
  Seed: KRFNPPADAW (TYRP2_HUMAN)
KMFNPPADAW

SEQ ID NO: 184083 - protein, 9 aa, Artificial Sequence
  Description of Artificial Sequence: Synthetic peptide
  Seed: AFLQYRRLR (TYRP2_HUMAN)
AVLQYRRLR

SEQ ID NO: 184084 - protein, 10 aa, Artificial Sequence
  Description of Artificial Sequence: Synthetic peptide
  Seed: SLSPQEREQF (TYRP2_HUMAN)
SMSPQEREQL

SEQ ID NO: 184085 - protein, 9 aa, Artificial Sequence
  Description of Artificial Sequence: Synthetic peptide
  Seed: FVWLHYYSV (TYRP2_HUMAN)
FLWLHYYSF

SEQ ID NO: 184086 - protein, 9 aa, Artificial Sequence
  Description of Artificial Sequence: Synthetic peptide
  Seed: VTNEELFLT (TYRP2_HUMAN)
VVNEELFLV

SEQ ID NO: 184087 - protein, 10 aa, Artificial Sequence
  Description of Artificial Sequence: Synthetic peptide
  Seed: AARPDDPTLI (TYRP2_HUMAN)
AQRPDDPTLF

SEQ ID NO: 184088 - protein, 10 aa, Artificial Sequence
  Description of Artificial Sequence: Synthetic peptide
  Seed: RMYNMVPFFP (TYRP2_HUMAN)
RQYNMVPFFY

SEQ ID NO: 184089 - protein, 9 aa, Artificial Sequence
  Description of Artificial Sequence: Synthetic peptide
  Seed: RKFFHRTCK (TYRP2_HUMAN)
RSFFHRTCY

SEQ ID NO: 184090 - protein, 11 aa, Artificial Sequence
  Description of Artificial Sequence: Synthetic peptide
  Seed: YNMVPFFPPVT (TYRP2_HUMAN)
YQMVPFFPPVK

SEQ ID NO: 184091 - protein, 9 aa, Artificial Sequence
  Description of Artificial Sequence: Synthetic peptide
  Seed: SLDDYNHLV (TYRP2_HUMAN)
STDDYNHLY

SEQ ID NO: 184092 - protein, 10 aa, Artificial Sequence
  Description of Artificial Sequence: Synthetic peptide
  Seed: FLLSCLGCKI (TYRP2_HUMAN)
FWLSCLGCKL

SEQ ID NO: 184093 - protein, 9 aa, Artificial Sequence
  Description of Artificial Sequence: Synthetic peptide
  Seed: SLHNLVHSF (TYRP2_HUMAN)
SAHNLVHSY

SEQ ID NO: 184094 - protein, 9 aa, Artificial Sequence
  Description of Artificial Sequence: Synthetic peptide
  Seed: NMVPFFPPV (TYRP2_HUMAN)
NSVPFFPPV

SEQ ID NO: 184095 - protein, 9 aa, Artificial Sequence
  Description of Artificial Sequence: Synthetic peptide
  Seed: FPPVTNEEL (TYRP2_HUMAN)
FTPVTNEEI

SEQ ID NO: 184096 - protein, 11 aa, Artificial Sequence
  Description of Artificial Sequence: Synthetic peptide
  Seed: FVVLHSFTDAI (TYRP2_HUMAN)
FEVLHSFTDAV

SEQ ID NO: 184097 - protein, 9 aa, Artificial Sequence
  Description of Artificial Sequence: Synthetic peptide
  Seed: TLDSQVMSL (TYRP2_HUMAN)
TVDSQVMSV

SEQ ID NO: 184098 - protein, 9 aa, Artificial Sequence
  Description of Artificial Sequence: Synthetic peptide
  Seed: VLHSFTDAI (TYRP2_HUMAN)
VSHSFTDAM

SEQ ID NO: 184099 - protein, 9 aa, Artificial Sequence
  Description of Artificial Sequence: Synthetic peptide
  Seed: ANDPIFVVL (TYRP2_HUMAN)
ATDPIFVVW

SEQ ID NO: 184100 - protein, 10 aa, Artificial Sequence
  Description of Artificial Sequence: Synthetic peptide
  Seed: KADGTLDSQV (TYRP2_HUMAN)
KTDGTLDSQL

SEQ ID NO: 184101 - protein, 9 aa, Artificial Sequence
  Description of Artificial Sequence: Synthetic peptide
  Seed: RAIDFSHQG (TYRP2_HUMAN)
RIIDFSHQY

SEQ ID NO: 184102 - protein, 10 aa, Artificial Sequence
  Description of Artificial Sequence: Synthetic peptide
  Seed: DAIFDEWMKR (TYRP2_HUMAN)
DTIFDEWMKK

SEQ ID NO: 184103 - protein, 10 aa, Artificial Sequence
  Description of Artificial Sequence: Synthetic peptide
  Seed: LHYYSVRDTL (TYRP2_HUMAN)
LVYYSVRDTL

SEQ ID NO: 184104 - protein, 9 aa, Artificial Sequence
  Description of Artificial Sequence: Synthetic peptide
  Seed: SPLWWGFLL (TYRP2_HUMAN)
SPLWWGFLW

SEQ ID NO: 184105 - protein, 9 aa, Artificial Sequence
  Description of Artificial Sequence: Synthetic peptide
  Seed: HYYSVRDTL (TYRP2_HUMAN)
HYYSVRDTY

SEQ ID NO: 184106 - protein, 9 aa, Artificial Sequence
  Description of Artificial Sequence: Synthetic peptide
  Seed: YVITTQHWL (TYRP2_HUMAN)
YLITTQHWM

SEQ ID NO: 184107 - protein, 10 aa, Artificial Sequence
  Description of Artificial Sequence: Synthetic peptide
  Seed: FFQNSTFSFR (TYRP2_HUMAN)
FYQNSTFSFP

SEQ ID NO: 184108 - protein, 9 aa, Artificial Sequence
  Description of Artificial Sequence: Synthetic peptide
  Seed: FTDAIFDEW (TYRP2_HUMAN)
FLDAIFDEL

SEQ ID NO: 184109 - protein, 9 aa, Artificial Sequence
  Description of Artificial Sequence: Synthetic peptide
  Seed: CPRLGAESA (TYRP2_HUMAN)
CPRLGAESV

SEQ ID NO: 184110 - protein, 9 aa, Artificial Sequence
  Description of Artificial Sequence: Synthetic peptide
  Seed: VVMGTLVAL (TYRP2_HUMAN)
VWMGTLVAY

SEQ ID NO: 184111 - protein, 10 aa, Artificial Sequence
  Description of Artificial Sequence: Synthetic peptide
  Seed: IGNESFALPY (TYRP2_HUMAN)
IKNESFALPL

SEQ ID NO: 184112 - protein, 9 aa, Artificial Sequence
  Description of Artificial Sequence: Synthetic peptide
  Seed: LVHSFLNGT (TYRP2_HUMAN)
LMHSFLNGI

SEQ ID NO: 184113 - protein, 9 aa, Artificial Sequence
  Description of Artificial Sequence: Synthetic peptide
  Seed: MSPLWWGFL (TYRP2_HUMAN)
MYPLWWGFW

SEQ ID NO: 184114 - protein, 11 aa, Artificial Sequence
  Description of Artificial Sequence: Synthetic peptide
  Seed: RNSRFSSWETV (TYRP2_HUMAN)
RGSRFSSWETV

SEQ ID NO: 184115 - protein, 9 aa, Artificial Sequence
  Description of Artificial Sequence: Synthetic peptide
  Seed: NRMYNMVPF (TYRP2_HUMAN)
NHMYNMVPA

SEQ ID NO: 184116 - protein, 9 aa, Artificial Sequence
  Description of Artificial Sequence: Synthetic peptide
  Seed: SLHNLVHSF (TYRP2_HUMAN)
SRHNLVHSV

SEQ ID NO: 184117 - protein, 9 aa, Artificial Sequence
  Description of Artificial Sequence: Synthetic peptide
  Seed: APIGHNRMY (TYRP2_HUMAN)
ASIGHNRMM

SEQ ID NO: 184118 - protein, 9 aa, Artificial Sequence
  Description of Artificial Sequence: Synthetic peptide
  Seed: NMVPFFPPV (TYRP2_HUMAN)
NLVPFFPPA

SEQ ID NO: 184119 - protein, 9 aa, Artificial Sequence
  Description of Artificial Sequence: Synthetic peptide
  Seed: TTQHWLGLL (TYRP2_HUMAN)
TAQHWLGLW

SEQ ID NO: 184120 - protein, 10 aa, Artificial Sequence
  Description of Artificial Sequence: Synthetic peptide
  Seed: DSLDDYNHLV (TYRP2_HUMAN)
DVLDDYNHLL

SEQ ID NO: 184121 - protein, 10 aa, Artificial Sequence
  Description of Artificial Sequence: Synthetic peptide
  Seed: RLRKGYTPLM (TYRP2_HUMAN)
RIRKGYTPLI

SEQ ID NO: 184122 - protein, 9 aa, Artificial Sequence
  Description of Artificial Sequence: Synthetic peptide
  Seed: WPTTLLVVM (TYRP2_HUMAN)
WHTTLLVVV

SEQ ID NO: 184123 - protein, 9 aa, Artificial Sequence
  Description of Artificial Sequence: Synthetic peptide
  Seed: ETPGWPTTL (TYRP2_HUMAN)
EAPGWPTTL

SEQ ID NO: 184124 - protein, 10 aa, Artificial Sequence
  Description of Artificial Sequence: Synthetic peptide
  Seed: FGWTGPNCER (TYRP2_HUMAN)
FVWTGPNCEL

SEQ ID NO: 184125 - protein, 9 aa, Artificial Sequence
  Description of Artificial Sequence: Synthetic peptide
  Seed: ETPGWPTTL (TYRP2_HUMAN)
ESPGWPTTR

SEQ ID NO: 184126 - protein, 8 aa, Artificial Sequence
  Description of Artificial Sequence: Synthetic peptide
  Seed: QVMSLHNL (TYRP2_HUMAN)
QQMSLHNL

SEQ ID NO: 184127 - protein, 10 aa, Artificial Sequence
  Description of Artificial Sequence: Synthetic peptide
  Seed: TRPWSGPYIL (TYRP2_HUMAN)
TYPWSGPYIM

SEQ ID NO: 184128 - protein, 9 aa, Artificial Sequence
  Description of Artificial Sequence: Synthetic peptide
  Seed: VVMGTLVAL (TYRP2_HUMAN)
VTMGTLVAL

SEQ ID NO: 184129 - protein, 9 aa, Artificial Sequence
  Description of Artificial Sequence: Synthetic peptide
  Seed: GTLVALVGL (TYRP2_HUMAN)
GMLVALVGV

SEQ ID NO: 184130 - protein, 9 aa, Artificial Sequence
  Description of Artificial Sequence: Synthetic peptide
  Seed: SFLNGTNAL (TYRP2_HUMAN)
STLNGTNAY

SEQ ID NO: 184131 - protein, 9 aa, Artificial Sequence
  Description of Artificial Sequence: Synthetic peptide
  Seed: RNQDDRELW (TYRP2_HUMAN)
RMQDDRELF

SEQ ID NO: 184132 - protein, 9 aa, Artificial Sequence
  Description of Artificial Sequence: Synthetic peptide
  Seed: HQGPAFVTW (TYRP2_HUMAN)
HRGPAFVTV

SEQ ID NO: 184133 - protein, 9 aa, Artificial Sequence
  Description of Artificial Sequence: Synthetic peptide
  Seed: SAANDPIFV (TYRP2_HUMAN)
SIANDPIFV

SEQ ID NO: 184134 - protein, 10 aa, Artificial Sequence
  Description of Artificial Sequence: Synthetic peptide
  Seed: RMYNMVPFFP (TYRP2_HUMAN)
RLYNMVPFFS

SEQ ID NO: 184135 - protein, 9 aa, Artificial Sequence
  Description of Artificial Sequence: Synthetic peptide
  Seed: TSDQLGYSY (TYRP2_HUMAN)
TVDQLGYSW

SEQ ID NO: 184136 - protein, 10 aa, Artificial Sequence
  Description of Artificial Sequence: Synthetic peptide
  Seed: TQPQFANCSV (TYRP2_HUMAN)
TVPQFANCSV

SEQ ID NO: 184137 - protein, 9 aa, Artificial Sequence
  Description of Artificial Sequence: Synthetic peptide
  Seed: VMSLHNLVH (TYRP2_HUMAN)
VASLHNLVY

SEQ ID NO: 184138 - protein, 9 aa, Artificial Sequence
  Description of Artificial Sequence: Synthetic peptide
  Seed: LVALVGLFV (TYRP2_HUMAN)
LTALVGLFL

SEQ ID NO: 184139 - protein, 9 aa, Artificial Sequence
  Description of Artificial Sequence: Synthetic peptide
  Seed: DDYNHLVTL (TYRP2_HUMAN)
DVYNHLVTF

SEQ ID NO: 184140 - protein, 9 aa, Artificial Sequence
  Description of Artificial Sequence: Synthetic peptide
  Seed: YAIDLPVSV (TYRP2_HUMAN)
YTIDLPVSK

SEQ ID NO: 184141 - protein, 11 aa, Artificial Sequence
  Description of Artificial Sequence: Synthetic peptide
  Seed: HSLSPQEREQF (TYRP2_HUMAN)
HQLSPQEREQY

SEQ ID NO: 184142 - protein, 9 aa, Artificial Sequence
  Description of Artificial Sequence: Synthetic peptide
  Seed: VMSLHNLVH (TYRP2_HUMAN)
VESLHNLVM

SEQ ID NO: 184143 - protein, 9 aa, Artificial Sequence
  Description of Artificial Sequence: Synthetic peptide
  Seed: RQNIHSLSP (TYRP2_HUMAN)
RANIHSLSY

SEQ ID NO: 184144 - protein, 10 aa, Artificial Sequence
  Description of Artificial Sequence: Synthetic peptide
  Seed: SFTDAIFDEW (TYRP2_HUMAN)
SATDAIFDEW

SEQ ID NO: 184145 - protein, 10 aa, Artificial Sequence
  Description of Artificial Sequence: Synthetic peptide
  Seed: CCPRLGAESA (TYRP2_HUMAN)
CRPRLGAESM

SEQ ID NO: 184146 - protein, 9 aa, Artificial Sequence
  Description of Artificial Sequence: Synthetic peptide
  Seed: YSYAIDLPV (TYRP2_HUMAN)
YSYAIDLPY

SEQ ID NO: 184147 - protein, 9 aa, Artificial Sequence
  Description of Artificial Sequence: Synthetic peptide
  Seed: WMKRFNPPA (TYRP2_HUMAN)
WKKRFNPPM

SEQ ID NO: 184148 - protein, 9 aa, Artificial Sequence
  Description of Artificial Sequence: Synthetic peptide
  Seed: SQVMSLHNL (TYRP2_HUMAN)
SAVMSLHNV

SEQ ID NO: 184149 - protein, 9 aa, Artificial Sequence
  Description of Artificial Sequence: Synthetic peptide
  Seed: EETPGWPTT (TYRP2_HUMAN)
EETPGWPTA

SEQ ID NO: 184150 - protein, 10 aa, Artificial Sequence
  Description of Artificial Sequence: Synthetic peptide
  Seed: RLRKGYTPLM (TYRP2_HUMAN)
RQRKGYTPLK

SEQ ID NO: 184151 - protein, 11 aa, Artificial Sequence
  Description of Artificial Sequence: Synthetic peptide
  Seed: RMYNMVPFFPP (TYRP2_HUMAN)
RIYNMVPFFPI

SEQ ID NO: 184152 - protein, 10 aa, Artificial Sequence
  Description of Artificial Sequence: Synthetic peptide
  Seed: RNSRFSSWET (TYRP2_HUMAN)
RESRFSSWEM

SEQ ID NO: 184153 - protein, 10 aa, Artificial Sequence
  Description of Artificial Sequence: Synthetic peptide
  Seed: SQVMSLHNLV (TYRP2_HUMAN)
SRVMSLHNLV

SEQ ID NO: 184154 - protein, 10 aa, Artificial Sequence
  Description of Artificial Sequence: Synthetic peptide
  Seed: MSPLWWGFLL (TYRP2_HUMAN)
MFPLWWGFLF

SEQ ID NO: 184155 - protein, 10 aa, Artificial Sequence
  Description of Artificial Sequence: Synthetic peptide
  Seed: RRNQMGRNSM (TYRP2_HUMAN)
RRNQMGRNSL

SEQ ID NO: 184156 - protein, 9 aa, Artificial Sequence
  Description of Artificial Sequence: Synthetic peptide
  Seed: STFSFRNAL (TYRP2_HUMAN)
SLFSFRNAR

SEQ ID NO: 184157 - protein, 11 aa, Artificial Sequence
  Description of Artificial Sequence: Synthetic peptide
  Seed: LPVSVEETPGW (TYRP2_HUMAN)
LCVSVEETPGW

SEQ ID NO: 184158 - protein, 10 aa, Artificial Sequence
  Description of Artificial Sequence: Synthetic peptide
  Seed: RNQMGRNSMK (TYRP2_HUMAN)
RSQMGRNSMR

SEQ ID NO: 184159 - protein, 10 aa, Artificial Sequence
  Description of Artificial Sequence: Synthetic peptide
  Seed: SPLWWGFLLS (TYRP2_HUMAN)
SMLWWGFLLA

SEQ ID NO: 184160 - protein, 11 aa, Artificial Sequence
  Description of Artificial Sequence: Synthetic peptide
  Seed: QELAPIGHNRM (TYRP2_HUMAN)
QELAPIGHNRW

SEQ ID NO: 184161 - protein, 10 aa, Artificial Sequence
  Description of Artificial Sequence: Synthetic peptide
  Seed: IGNESFALPY (TYRP2_HUMAN)
ILNESFALPM

SEQ ID NO: 184162 - protein, 10 aa, Artificial Sequence
  Description of Artificial Sequence: Synthetic peptide
  Seed: YAIDLPVSVE (TYRP2_HUMAN)
YTIDLPVSVV

SEQ ID NO: 184163 - protein, 10 aa, Artificial Sequence
  Description of Artificial Sequence: Synthetic peptide
  Seed: IDFSHQGPAF (TYRP2_HUMAN)
IAFSHQGPAM

SEQ ID NO: 184164 - protein, 8 aa, Artificial Sequence
  Description of Artificial Sequence: Synthetic peptide
  Seed: GQFPRVCM (TYRP2_HUMAN)
GQFPRVCY

SEQ ID NO: 184165 - protein, 9 aa, Artificial Sequence
  Description of Artificial Sequence: Synthetic peptide
  Seed: LAFLQYRRL (TYRP2_HUMAN)
LTFLQYRRY

SEQ ID NO: 184166 - protein, 9 aa, Artificial Sequence
  Description of Artificial Sequence: Synthetic peptide
  Seed: MTVDSLVNK (TYRP2_HUMAN)
MNVDSLVNK

SEQ ID NO: 184167 - protein, 9 aa, Artificial Sequence
  Description of Artificial Sequence: Synthetic peptide
  Seed: VIRQNIHSL (TYRP2_HUMAN)
VSRQNIHSM

SEQ ID NO: 184168 - protein, 9 aa, Artificial Sequence
  Description of Artificial Sequence: Synthetic peptide
  Seed: KRFNPPADA (TYRP2_HUMAN)
KYFNPPADY

SEQ ID NO: 184169 - protein, 9 aa, Artificial Sequence
  Description of Artificial Sequence: Synthetic peptide
  Seed: SVYDFFVWL (TYRP2_HUMAN)
SMYDFFVWK

SEQ ID NO: 184170 - protein, 10 aa, Artificial Sequence
  Description of Artificial Sequence: Synthetic peptide
  Seed: RTCKCTGNFA (TYRP2_HUMAN)
RACKCTGNFK

SEQ ID NO: 184171 - protein, 11 aa, Artificial Sequence
  Description of Artificial Sequence: Synthetic peptide
  Seed: RELWPRKFFHR (TYRP2_HUMAN)
RKLWPRKFFHR

SEQ ID NO: 184172 - protein, 9 aa, Artificial Sequence
  Description of Artificial Sequence: Synthetic peptide
  Seed: ISRNSRFSS (TYRP2_HUMAN)
IIRNSRFSA

SEQ ID NO: 184173 - protein, 9 aa, Artificial Sequence
  Description of Artificial Sequence: Synthetic peptide
  Seed: RQNIHSLSP (TYRP2_HUMAN)
RLNIHSLSY

SEQ ID NO: 184174 - protein, 9 aa, Artificial Sequence
  Description of Artificial Sequence: Synthetic peptide
  Seed: SFLNGTNAL (TYRP2_HUMAN)
SYLNGTNAI

SEQ ID NO: 184175 - protein, 10 aa, Artificial Sequence
  Description of Artificial Sequence: Synthetic peptide
  Seed: YAIDLPVSVE (TYRP2_HUMAN)
YMIDLPVSVE

SEQ ID NO: 184176 - protein, 9 aa, Artificial Sequence
  Description of Artificial Sequence: Synthetic peptide
  Seed: DFFVWLHYY (TYRP2_HUMAN)
DYFVWLHYY

SEQ ID NO: 184177 - protein, 11 aa, Artificial Sequence
  Description of Artificial Sequence: Synthetic peptide
  Seed: YTPLMETHLSS (TYRP2_HUMAN)
YDPLMETHLST

SEQ ID NO: 184178 - protein, 10 aa, Artificial Sequence
  Description of Artificial Sequence: Synthetic peptide
  Seed: LVVMGTLVAL (TYRP2_HUMAN)
LYVMGTLVAA

SEQ ID NO: 184179 - protein, 10 aa, Artificial Sequence
  Description of Artificial Sequence: Synthetic peptide
  Seed: SAANDPIFVV (TYRP2_HUMAN)
SIANDPIFVV

SEQ ID NO: 184180 - protein, 9 aa, Artificial Sequence
  Description of Artificial Sequence: Synthetic peptide
  Seed: STFSFRNAL (TYRP2_HUMAN)
SLFSFRNAV

SEQ ID NO: 184181 - protein, 10 aa, Artificial Sequence
  Description of Artificial Sequence: Synthetic peptide
  Seed: HNRMYNMVPF (TYRP2_HUMAN)
HGRMYNMVPL

SEQ ID NO: 184182 - protein, 10 aa, Artificial Sequence
  Description of Artificial Sequence: Synthetic peptide
  Seed: SDQLGYSYAI (TYRP2_HUMAN)
SIQLGYSYAY

SEQ ID NO: 184183 - protein, 11 aa, Artificial Sequence
  Description of Artificial Sequence: Synthetic peptide
  Seed: YNMVPFFPPVT (TYRP2_HUMAN)
YTMVPFFPPVH

SEQ ID NO: 184184 - protein, 9 aa, Artificial Sequence
  Description of Artificial Sequence: Synthetic peptide
  Seed: QVMSLHNLV (TYRP2_HUMAN)
QSMSLHNLV

SEQ ID NO: 184185 - protein, 10 aa, Artificial Sequence
  Description of Artificial Sequence: Synthetic peptide
  Seed: SDQLGYSYAI (TYRP2_HUMAN)
SAQLGYSYAY

SEQ ID NO: 184186 - protein, 9 aa, Artificial Sequence
  Description of Artificial Sequence: Synthetic peptide
  Seed: WPTTLLVVM (TYRP2_HUMAN)
WPTTLLVVL

SEQ ID NO: 184187 - protein, 10 aa, Artificial Sequence
  Description of Artificial Sequence: Synthetic peptide
  Seed: SFTDAIFDEW (TYRP2_HUMAN)
SSTDAIFDEW

SEQ ID NO: 184188 - protein, 9 aa, Artificial Sequence
  Description of Artificial Sequence: Synthetic peptide
  Seed: RAIDFSHQG (TYRP2_HUMAN)
RSIDFSHQY

SEQ ID NO: 184189 - protein, 11 aa, Artificial Sequence
  Description of Artificial Sequence: Synthetic peptide
  Seed: FVVLHSFTDAI (TYRP2_HUMAN)
FEVLHSFTDAL

SEQ ID NO: 184190 - protein, 9 aa, Artificial Sequence
  Description of Artificial Sequence: Synthetic peptide
  Seed: VWLHYYSVR (TYRP2_HUMAN)
VQLHYYSVR

SEQ ID NO: 184191 - protein, 10 aa, Artificial Sequence
  Description of Artificial Sequence: Synthetic peptide
  Seed: CMTVDSLVNK (TYRP2_HUMAN)
CFTVDSLVNR

SEQ ID NO: 184192 - protein, 10 aa, Artificial Sequence
  Description of Artificial Sequence: Synthetic peptide
  Seed: FFPPVTNEEL (TYRP2_HUMAN)
FSPPVTNEEF

SEQ ID NO: 184193 - protein, 9 aa, Artificial Sequence
  Description of Artificial Sequence: Synthetic peptide
  Seed: STFSFRNAL (TYRP2_HUMAN)
SKFSFRNAV

SEQ ID NO: 184194 - protein, 11 aa, Artificial Sequence
  Description of Artificial Sequence: Synthetic peptide
  Seed: YTPLMETHLSS (TYRP2_HUMAN)
YIPLMETHLSI

SEQ ID NO: 184195 - protein, 10 aa, Artificial Sequence
  Description of Artificial Sequence: Synthetic peptide
  Seed: FFPPVTNEEL (TYRP2_HUMAN)
FQPPVTNEEL

SEQ ID NO: 184196 - protein, 9 aa, Artificial Sequence
  Description of Artificial Sequence: Synthetic peptide
  Seed: LRKGYTPLM (TYRP2_HUMAN)
LQKGYTPLF

SEQ ID NO: 184197 - protein, 11 aa, Artificial Sequence
  Description of Artificial Sequence: Synthetic peptide
  Seed: MYNMVPFFPPV (TYRP2_HUMAN)
MQNMVPFFPPL

SEQ ID NO: 184198 - protein, 10 aa, Artificial Sequence
  Description of Artificial Sequence: Synthetic peptide
  Seed: FPPVTNEELF (TYRP2_HUMAN)
FSPVTNEELY

SEQ ID NO: 184199 - protein, 10 aa, Artificial Sequence
  Description of Artificial Sequence: Synthetic peptide
  Seed: VGLFVLLAFL (TYRP2_HUMAN)
VNLFVLLAFV

SEQ ID NO: 184200 - protein, 9 aa, Artificial Sequence
  Description of Artificial Sequence: Synthetic peptide
  Seed: RFNPPADAW (TYRP2_HUMAN)
RFNPPADAM

SEQ ID NO: 184201 - protein, 10 aa, Artificial Sequence
  Description of Artificial Sequence: Synthetic peptide
  Seed: IDFSHQGPAF (TYRP2_HUMAN)
ITFSHQGPAY

SEQ ID NO: 184202 - protein, 9 aa, Artificial Sequence
  Description of Artificial Sequence: Synthetic peptide
  Seed: QPQFANCSV (TYRP2_HUMAN)
QPQFANCSA

SEQ ID NO: 184203 - protein, 10 aa, Artificial Sequence
  Description of Artificial Sequence: Synthetic peptide
  Seed: ELAPIGHNRM (TYRP2_HUMAN)
ETAPIGHNRD

SEQ ID NO: 184204 - protein, 9 aa, Artificial Sequence
  Description of Artificial Sequence: Synthetic peptide
  Seed: QRLIGNESF (TYRP2_HUMAN)
QQLIGNESL

SEQ ID NO: 184205 - protein, 9 aa, Artificial Sequence
  Description of Artificial Sequence: Synthetic peptide
  Seed: TSDQLGYSY (TYRP2_HUMAN)
TQDQLGYSL

SEQ ID NO: 184206 - protein, 9 aa, Artificial Sequence
  Description of Artificial Sequence: Synthetic peptide
  Seed: LAFLQYRRL (TYRP2_HUMAN)
LSFLQYRRM

SEQ ID NO: 184207 - protein, 9 aa, Artificial Sequence
  Description of Artificial Sequence: Synthetic peptide
  Seed: DDYNHLVTL (TYRP2_HUMAN)
DAYNHLVTI

SEQ ID NO: 184208 - protein, 9 aa, Artificial Sequence
  Description of Artificial Sequence: Synthetic peptide
  Seed: RLRKGYTPL (TYRP2_HUMAN)
RWRKGYTPA

SEQ ID NO: 184209 - protein, 10 aa, Artificial Sequence
  Description of Artificial Sequence: Synthetic peptide
  Seed: GTLDSQVMSL (TYRP2_HUMAN)
GTLDSQVMSI

SEQ ID NO: 184210 - protein, 9 aa, Artificial Sequence
  Description of Artificial Sequence: Synthetic peptide
  Seed: GQFPRVCMT (TYRP2_HUMAN)
GLFPRVCMV

SEQ ID NO: 184211 - protein, 9 aa, Artificial Sequence
  Description of Artificial Sequence: Synthetic peptide
  Seed: IFDEWMKRF (TYRP2_HUMAN)
IIDEWMKRF

SEQ ID NO: 184212 - protein, 9 aa, Artificial Sequence
  Description of Artificial Sequence: Synthetic peptide
  Seed: RQNIHSLSP (TYRP2_HUMAN)
RMNIHSLSM

SEQ ID NO: 184213 - protein, 9 aa, Artificial Sequence
  Description of Artificial Sequence: Synthetic peptide
  Seed: HYYSVRDTL (TYRP2_HUMAN)
HAYSVRDTM

SEQ ID NO: 184214 - protein, 10 aa, Artificial Sequence
  Description of Artificial Sequence: Synthetic peptide
  Seed: RPDDPTLISR (TYRP2_HUMAN)
RADDPTLISY

SEQ ID NO: 184215 - protein, 9 aa, Artificial Sequence
  Description of Artificial Sequence: Synthetic peptide
  Seed: SRNSRFSSW (TYRP2_HUMAN)
SYNSRFSSY

SEQ ID NO: 184216 - protein, 10 aa, Artificial Sequence
  Description of Artificial Sequence: Synthetic peptide
  Seed: YDFFVWLHYY (TYRP2_HUMAN)
YFFFVWLHYK

SEQ ID NO: 184217 - protein, 10 aa, Artificial Sequence
  Description of Artificial Sequence: Synthetic peptide
  Seed: AANDPIFVVL (TYRP2_HUMAN)
ASNDPIFVVW

SEQ ID NO: 184218 - protein, 9 aa, Artificial Sequence
  Description of Artificial Sequence: Synthetic peptide
  Seed: RNQDDRELW (TYRP2_HUMAN)
RVQDDRELL

SEQ ID NO: 184219 - protein, 10 aa, Artificial Sequence
  Description of Artificial Sequence: Synthetic peptide
  Seed: RNSRFSSWET (TYRP2_HUMAN)
RASRFSSWEA

SEQ ID NO: 184220 - protein, 9 aa, Artificial Sequence
  Description of Artificial Sequence: Synthetic peptide
  Seed: VSVEETPGW (TYRP2_HUMAN)
VVVEETPGW

SEQ ID NO: 184221 - protein, 9 aa, Artificial Sequence
  Description of Artificial Sequence: Synthetic peptide
  Seed: RKFFHRTCK (TYRP2_HUMAN)
RFFFHRTCK

SEQ ID NO: 184222 - protein, 10 aa, Artificial Sequence
  Description of Artificial Sequence: Synthetic peptide
  Seed: TLLGPGRPYR (TYRP2_HUMAN)
TRLGPGRPYR

SEQ ID NO: 184223 - protein, 11 aa, Artificial Sequence
  Description of Artificial Sequence: Synthetic peptide
  Seed: WLHYYSVRDTL (TYRP2_HUMAN)
WRHYYSVRDTF

SEQ ID NO: 184224 - protein, 9 aa, Artificial Sequence
  Description of Artificial Sequence: Synthetic peptide
  Seed: VHPDYVITT (TYRP2_HUMAN)
VAPDYVITM

SEQ ID NO: 184225 - protein, 10 aa, Artificial Sequence
  Description of Artificial Sequence: Synthetic peptide
  Seed: NMVPFFPPVT (TYRP2_HUMAN)
NLVPFFPPVI

SEQ ID NO: 184226 - protein, 10 aa, Artificial Sequence
  Description of Artificial Sequence: Synthetic peptide
  Seed: QPQFANCSVY (TYRP2_HUMAN)
QDQFANCSVY

SEQ ID NO: 184227 - protein, 11 aa, Artificial Sequence
  Description of Artificial Sequence: Synthetic peptide
  Seed: RNQDDRELWPR (TYRP2_HUMAN)
RFQDDRELWPR

SEQ ID NO: 184228 - protein, 9 aa, Artificial Sequence
  Description of Artificial Sequence: Synthetic peptide
  Seed: FVWLHYYSV (TYRP2_HUMAN)
FFWLHYYSV

SEQ ID NO: 184229 - protein, 10 aa, Artificial Sequence
  Description of Artificial Sequence: Synthetic peptide
  Seed: FSFRNALEGF (TYRP2_HUMAN)
FPFRNALEGF

SEQ ID NO: 184230 - protein, 9 aa, Artificial Sequence
  Description of Artificial Sequence: Synthetic peptide
  Seed: RKFFHRTCK (TYRP2_HUMAN)
RYFFHRTCI

SEQ ID NO: 184231 - protein, 10 aa, Artificial Sequence
  Description of Artificial Sequence: Synthetic peptide
  Seed: LVVMGTLVAL (TYRP2_HUMAN)
LYVMGTLVAM

SEQ ID NO: 184232 - protein, 10 aa, Artificial Sequence
  Description of Artificial Sequence: Synthetic peptide
  Seed: RLRKGYTPLM (TYRP2_HUMAN)
RPRKGYTPLI

SEQ ID NO: 184233 - protein, 10 aa, Artificial Sequence
  Description of Artificial Sequence: Synthetic peptide
  Seed: FVLLAFLQYR (TYRP2_HUMAN)
FYLLAFLQYR

SEQ ID NO: 184234 - protein, 9 aa, Artificial Sequence
  Description of Artificial Sequence: Synthetic peptide
  Seed: LAPIGHNRM (TYRP2_HUMAN)
LAPIGHNRL

SEQ ID NO: 184235 - protein, 10 aa, Artificial Sequence
  Description of Artificial Sequence: Synthetic peptide
  Seed: FVWLHYYSVR (TYRP2_HUMAN)
FLWLHYYSVC

SEQ ID NO: 184236 - protein, 9 aa, Artificial Sequence
  Description of Artificial Sequence: Synthetic peptide
  Seed: SRNSRFSSW (TYRP2_HUMAN)
SQNSRFSSW

SEQ ID NO: 184237 - protein, 9 aa, Artificial Sequence
  Description of Artificial Sequence: Synthetic peptide
  Seed: AANDPIFVV (TYRP2_HUMAN)
AQNDPIFVW

SEQ ID NO: 184238 - protein, 11 aa, Artificial Sequence
  Description of Artificial Sequence: Synthetic peptide
  Seed: ARPDDPTLISR (TYRP2_HUMAN)
ARPDDPTLISF

SEQ ID NO: 184239 - protein, 11 aa, Artificial Sequence
  Description of Artificial Sequence: Synthetic peptide
  Seed: KADGTLDSQVM (TYRP2_HUMAN)
KLDGTLDSQVF

SEQ ID NO: 184240 - protein, 9 aa, Artificial Sequence
  Description of Artificial Sequence: Synthetic peptide
  Seed: TLDSQVMSL (TYRP2_HUMAN)
TADSQVMSA

SEQ ID NO: 184241 - protein, 11 aa, Artificial Sequence
  Description of Artificial Sequence: Synthetic peptide
  Seed: YTPLMETHLSS (TYRP2_HUMAN)
YHPLMETHLSV

SEQ ID NO: 184242 - protein, 8 aa, Artificial Sequence
  Description of Artificial Sequence: Synthetic peptide
  Seed: NSMKLPTL (TYRP2_HUMAN)
NQMKLPTL

SEQ ID NO: 184243 - protein, 9 aa, Artificial Sequence
  Description of Artificial Sequence: Synthetic peptide
  Seed: QRLIGNESF (TYRP2_HUMAN)
QQLIGNESM

SEQ ID NO: 184244 - protein, 9 aa, Artificial Sequence
  Description of Artificial Sequence: Synthetic peptide
  Seed: TSDQLGYSY (TYRP2_HUMAN)
TQDQLGYSY

SEQ ID NO: 184245 - protein, 9 aa, Artificial Sequence
  Description of Artificial Sequence: Synthetic peptide
  Seed: YTPLMETHL (TYRP2_HUMAN)
YTPLMETHW

SEQ ID NO: 184246 - protein, 11 aa, Artificial Sequence
  Description of Artificial Sequence: Synthetic peptide
  Seed: RADTRPWSGPY (TYRP2_HUMAN)
RLDTRPWSGPA

SEQ ID NO: 184247 - protein, 10 aa, Artificial Sequence
  Description of Artificial Sequence: Synthetic peptide
  Seed: RLRKGYTPLM (TYRP2_HUMAN)
RPRKGYTPLE

SEQ ID NO: 184248 - protein, 9 aa, Artificial Sequence
  Description of Artificial Sequence: Synthetic peptide
  Seed: IGHNRMYNM (TYRP2_HUMAN)
ISHNRMYNF

SEQ ID NO: 184249 - protein, 10 aa, Artificial Sequence
  Description of Artificial Sequence: Synthetic peptide
  Seed: YNMVPFFPPV (TYRP2_HUMAN)
YQMVPFFPPM

SEQ ID NO: 184250 - protein, 9 aa, Artificial Sequence
  Description of Artificial Sequence: Synthetic peptide
  Seed: ANDPIFVVL (TYRP2_HUMAN)
AFDPIFVVI

SEQ ID NO: 184251 - protein, 11 aa, Artificial Sequence
  Description of Artificial Sequence: Synthetic peptide
  Seed: FVVLHSFTDAI (TYRP2_HUMAN)
FHVLHSFTDAI

SEQ ID NO: 184252 - protein, 10 aa, Artificial Sequence
  Description of Artificial Sequence: Synthetic peptide
  Seed: FLTSDQLGYS (TYRP2_HUMAN)
FQTSDQLGYI

SEQ ID NO: 184253 - protein, 9 aa, Artificial Sequence
  Description of Artificial Sequence: Synthetic peptide
  Seed: NMVPFFPPV (TYRP2_HUMAN)
NFVPFFPPL

SEQ ID NO: 184254 - protein, 10 aa, Artificial Sequence
  Description of Artificial Sequence: Synthetic peptide
  Seed: RRNQMGRNSM (TYRP2_HUMAN)
RMNQMGRNSM

SEQ ID NO: 184255 - protein, 10 aa, Artificial Sequence
  Description of Artificial Sequence: Synthetic peptide
  Seed: GNESFALPYW (TYRP2_HUMAN)
GRESFALPYW

SEQ ID NO: 184256 - protein, 9 aa, Artificial Sequence
  Description of Artificial Sequence: Synthetic peptide
  Seed: SLDDYNHLV (TYRP2_HUMAN)
SSDDYNHLF

SEQ ID NO: 184257 - protein, 9 aa, Artificial Sequence
  Description of Artificial Sequence: Synthetic peptide
  Seed: NMVPFFPPV (TYRP2_HUMAN)
NKVPFFPPF

SEQ ID NO: 184258 - protein, 10 aa, Artificial Sequence
  Description of Artificial Sequence: Synthetic peptide
  Seed: YNMVPFFPPV (TYRP2_HUMAN)
YLMVPFFPPF

SEQ ID NO: 184259 - protein, 10 aa, Artificial Sequence
  Description of Artificial Sequence: Synthetic peptide
  Seed: AIFDEWMKRF (TYRP2_HUMAN)
AVFDEWMKRR

SEQ ID NO: 184260 - protein, 10 aa, Artificial Sequence
  Description of Artificial Sequence: Synthetic peptide
  Seed: RELWPRKFFH (TYRP2_HUMAN)
RGLWPRKFFH

SEQ ID NO: 184261 - protein, 9 aa, Artificial Sequence
  Description of Artificial Sequence: Synthetic peptide
  Seed: SQVMSLHNL (TYRP2_HUMAN)
SVVMSLHNV

SEQ ID NO: 184262 - protein, 11 aa, Artificial Sequence
  Description of Artificial Sequence: Synthetic peptide
  Seed: FFPPVTNEELF (TYRP2_HUMAN)
FSPPVTNEELY

SEQ ID NO: 184263 - protein, 9 aa, Artificial Sequence
  Description of Artificial Sequence: Synthetic peptide
  Seed: HSFLNGTNA (TYRP2_HUMAN)
HIFLNGTNY

SEQ ID NO: 184264 - protein, 9 aa, Artificial Sequence
  Description of Artificial Sequence: Synthetic peptide
  Seed: NMVPFFPPV (TYRP2_HUMAN)
NLVPFFPPL

SEQ ID NO: 184265 - protein, 9 aa, Artificial Sequence
  Description of Artificial Sequence: Synthetic peptide
  Seed: MSPLWWGFL (TYRP2_HUMAN)
MAPLWWGFV

SEQ ID NO: 184266 - protein, 10 aa, Artificial Sequence
  Description of Artificial Sequence: Synthetic peptide
  Seed: MSPLWWGFLL (TYRP2_HUMAN)
MNPLWWGFLV

SEQ ID NO: 184267 - protein, 9 aa, Artificial Sequence
  Description of Artificial Sequence: Synthetic peptide
  Seed: GTYEGLLRR (TYRP2_HUMAN)
GMYEGLLRR

SEQ ID NO: 184268 - protein, 10 aa, Artificial Sequence
  Description of Artificial Sequence: Synthetic peptide
  Seed: AANDPIFVVL (TYRP2_HUMAN)
AMNDPIFVVV

SEQ ID NO: 184269 - protein, 9 aa, Artificial Sequence
  Description of Artificial Sequence: Synthetic peptide
  Seed: APIGHNRMY (TYRP2_HUMAN)
AVIGHNRMY

SEQ ID NO: 184270 - protein, 9 aa, Artificial Sequence
  Description of Artificial Sequence: Synthetic peptide
  Seed: YAIDLPVSV (TYRP2_HUMAN)
YVIDLPVSH

SEQ ID NO: 184271 - protein, 9 aa, Artificial Sequence
  Description of Artificial Sequence: Synthetic peptide
  Seed: SFLNGTNAL (TYRP2_HUMAN)
SILNGTNAL

SEQ ID NO: 184272 - protein, 10 aa, Artificial Sequence
  Description of Artificial Sequence: Synthetic peptide
  Seed: RNSRFSSWET (TYRP2_HUMAN)
RRSRFSSWEK

SEQ ID NO: 184273 - protein, 9 aa, Artificial Sequence
  Description of Artificial Sequence: Synthetic peptide
  Seed: FPPVTNEEL (TYRP2_HUMAN)
FYPVTNEEV

SEQ ID NO: 184274 - protein, 9 aa, Artificial Sequence
  Description of Artificial Sequence: Synthetic peptide
  Seed: YYSVRDTLL (TYRP2_HUMAN)
YASVRDTLF

SEQ ID NO: 184275 - protein, 9 aa, Artificial Sequence
  Description of Artificial Sequence: Synthetic peptide
  Seed: FPPVTNEEL (TYRP2_HUMAN)
FHPVTNEEM

SEQ ID NO: 184276 - protein, 9 aa, Artificial Sequence
  Description of Artificial Sequence: Synthetic peptide
  Seed: DDYNHLVTL (TYRP2_HUMAN)
DQYNHLVTV

SEQ ID NO: 184277 - protein, 10 aa, Artificial Sequence
  Description of Artificial Sequence: Synthetic peptide
  Seed: KILPGAQGQF (TYRP2_HUMAN)
KLLPGAQGQF

SEQ ID NO: 184278 - protein, 10 aa, Artificial Sequence
  Description of Artificial Sequence: Synthetic peptide
  Seed: LTSDQLGYSY (TYRP2_HUMAN)
LRSDQLGYSY

SEQ ID NO: 184279 - protein, 11 aa, Artificial Sequence
  Description of Artificial Sequence: Synthetic peptide
  Seed: YNMVPFFPPVT (TYRP2_HUMAN)
YLMVPFFPPVS

SEQ ID NO: 184280 - protein, 9 aa, Artificial Sequence
  Description of Artificial Sequence: Synthetic peptide
  Seed: SVYDFFVWL (TYRP2_HUMAN)
SMYDFFVWW

SEQ ID NO: 184281 - protein, 9 aa, Artificial Sequence
  Description of Artificial Sequence: Synthetic peptide
  Seed: SRFSSWETV (TYRP2_HUMAN)
SYFSSWETM

SEQ ID NO: 184282 - protein, 11 aa, Artificial Sequence
  Description of Artificial Sequence: Synthetic peptide
  Seed: YTPLMETHLSS (TYRP2_HUMAN)
YNPLMETHLST

SEQ ID NO: 184283 - protein, 9 aa, Artificial Sequence
  Description of Artificial Sequence: Synthetic peptide
  Seed: DQLGYSYAI (TYRP2_HUMAN)
DQLGYSYAF

SEQ ID NO: 184284 - protein, 9 aa, Artificial Sequence
  Description of Artificial Sequence: Synthetic peptide
  Seed: HSAANDPIF (TYRP2_HUMAN)
HGAANDPIW

SEQ ID NO: 184285 - protein, 10 aa, Artificial Sequence
  Description of Artificial Sequence: Synthetic peptide
  Seed: RPDDPTLISR (TYRP2_HUMAN)
RADDPTLISF

SEQ ID NO: 184286 - protein, 9 aa, Artificial Sequence
  Description of Artificial Sequence: Synthetic peptide
  Seed: TQHWLGLLG (TYRP2_HUMAN)
TAHWLGLLF

SEQ ID NO: 184287 - protein, 10 aa, Artificial Sequence
  Description of Artificial Sequence: Synthetic peptide
  Seed: DAIFDEWMKR (TYRP2_HUMAN)
DMIFDEWMKR

SEQ ID NO: 184288 - protein, 10 aa, Artificial Sequence
  Description of Artificial Sequence: Synthetic peptide
  Seed: MSPLWWGFLL (TYRP2_HUMAN)
MDPLWWGFLM

SEQ ID NO: 184289 - protein, 9 aa, Artificial Sequence
  Description of Artificial Sequence: Synthetic peptide
  Seed: VPFFPPVTN (TYRP2_HUMAN)
VPFFPPVTM

SEQ ID NO: 184290 - protein, 10 aa, Artificial Sequence
  Description of Artificial Sequence: Synthetic peptide
  Seed: LVVMGTLVAL (TYRP2_HUMAN)
LYVMGTLVAL

SEQ ID NO: 184291 - protein, 10 aa, Artificial Sequence
  Description of Artificial Sequence: Synthetic peptide
  Seed: SYAIDLPVSV (TYRP2_HUMAN)
SYAIDLPVSL

SEQ ID NO: 184292 - protein, 9 aa, Artificial Sequence
  Description of Artificial Sequence: Synthetic peptide
  Seed: LVTLCNGTY (TYRP2_HUMAN)
LVTLCNGTW

SEQ ID NO: 184293 - protein, 9 aa, Artificial Sequence
  Description of Artificial Sequence: Synthetic peptide
  Seed: NCGDCKFGW (TYRP2_HUMAN)
NSGDCKFGW

SEQ ID NO: 184294 - protein, 9 aa, Artificial Sequence
  Description of Artificial Sequence: Synthetic peptide
  Seed: LERDLQRLI (TYRP2_HUMAN)
LERDLQRLM

SEQ ID NO: 184295 - protein, 10 aa, Artificial Sequence
  Description of Artificial Sequence: Synthetic peptide
  Seed: HSFLNGTNAL (TYRP2_HUMAN)
HYFLNGTNAV

SEQ ID NO: 184296 - protein, 9 aa, Artificial Sequence
  Description of Artificial Sequence: Synthetic peptide
  Seed: RLIGNESFA (TYRP2_HUMAN)
RVIGNESFV

SEQ ID NO: 184297 - protein, 9 aa, Artificial Sequence
  Description of Artificial Sequence: Synthetic peptide
  Seed: RKFFHRTCK (TYRP2_HUMAN)
RTFFHRTCH

SEQ ID NO: 184298 - protein, 9 aa, Artificial Sequence
  Description of Artificial Sequence: Synthetic peptide
  Seed: ALPYWNFAT (TYRP2_HUMAN)
AMPYWNFAL

SEQ ID NO: 184299 - protein, 10 aa, Artificial Sequence
  Description of Artificial Sequence: Synthetic peptide
  Seed: FVLLAFLQYR (TYRP2_HUMAN)
FMLLAFLQYK

SEQ ID NO: 184300 - protein, 9 aa, Artificial Sequence
  Description of Artificial Sequence: Synthetic peptide
  Seed: STFSFRNAL (TYRP2_HUMAN)
SSFSFRNAW

SEQ ID NO: 184301 - protein, 9 aa, Artificial Sequence
  Description of Artificial Sequence: Synthetic peptide
  Seed: GFDKADGTL (TYRP2_HUMAN)
GSDKADGTM

SEQ ID NO: 184302 - protein, 10 aa, Artificial Sequence
  Description of Artificial Sequence: Synthetic peptide
  Seed: HNRMYNMVPF (TYRP2_HUMAN)
HCRMYNMVPF

SEQ ID NO: 184303 - protein, 10 aa, Artificial Sequence
  Description of Artificial Sequence: Synthetic peptide
  Seed: SLDDYNHLVT (TYRP2_HUMAN)
SVDDYNHLVV

SEQ ID NO: 184304 - protein, 10 aa, Artificial Sequence
  Description of Artificial Sequence: Synthetic peptide
  Seed: RNSRFSSWET (TYRP2_HUMAN)
RNSRFSSWEM

SEQ ID NO: 184305 - protein, 11 aa, Artificial Sequence
  Description of Artificial Sequence: Synthetic peptide
  Seed: YTPLMETHLSS (TYRP2_HUMAN)
YMPLMETHLSM

SEQ ID NO: 184306 - protein, 11 aa, Artificial Sequence
  Description of Artificial Sequence: Synthetic peptide
  Seed: RMYNMVPFFPP (TYRP2_HUMAN)
RMYNMVPFFPI

SEQ ID NO: 184307 - protein, 10 aa, Artificial Sequence
  Description of Artificial Sequence: Synthetic peptide
  Seed: AANDPIFVVL (TYRP2_HUMAN)
ATNDPIFVVI

SEQ ID NO: 184308 - protein, 11 aa, Artificial Sequence
  Description of Artificial Sequence: Synthetic peptide
  Seed: HSFTDAIFDEW (TYRP2_HUMAN)
HPFTDAIFDEF

SEQ ID NO: 184309 - protein, 10 aa, Artificial Sequence
  Description of Artificial Sequence: Synthetic peptide
  Seed: SDQLGYSYAI (TYRP2_HUMAN)
SDQLGYSYAY

SEQ ID NO: 184310 - protein, 9 aa, Artificial Sequence
  Description of Artificial Sequence: Synthetic peptide
  Seed: RYHLLCLER (TYRP2_HUMAN)
RVHLLCLEK

SEQ ID NO: 184311 - protein, 10 aa, Artificial Sequence
  Description of Artificial Sequence: Synthetic peptide
  Seed: NGTYEGLLRR (TYRP2_HUMAN)
NCTYEGLLRK

SEQ ID NO: 184312 - protein, 10 aa, Artificial Sequence
  Description of Artificial Sequence: Synthetic peptide
  Seed: LKDIRDCLSL (TYRP2_HUMAN)
LKDIRDCLSF

SEQ ID NO: 184313 - protein, 10 aa, Artificial Sequence
  Description of Artificial Sequence: Synthetic peptide
  Seed: FSFRNALEGF (TYRP2_HUMAN)
FLFRNALEGF

SEQ ID NO: 184314 - protein, 10 aa, Artificial Sequence
  Description of Artificial Sequence: Synthetic peptide
  Seed: CMTVDSLVNK (TYRP2_HUMAN)
CFTVDSLVNK

SEQ ID NO: 184315 - protein, 9 aa, Artificial Sequence
  Description of Artificial Sequence: Synthetic peptide
  Seed: RVCMTVDSL (TYRP2_HUMAN)
RMCMTVDSW

SEQ ID NO: 184316 - protein, 9 aa, Artificial Sequence
  Description of Artificial Sequence: Synthetic peptide
  Seed: DDYNHLVTL (TYRP2_HUMAN)
DRYNHLVTM

SEQ ID NO: 184317 - protein, 9 aa, Artificial Sequence
  Description of Artificial Sequence: Synthetic peptide
  Seed: LSPQEREQF (TYRP2_HUMAN)
LQPQEREQY

SEQ ID NO: 184318 - protein, 9 aa, Artificial Sequence
  Description of Artificial Sequence: Synthetic peptide
  Seed: MTVDSLVNK (TYRP2_HUMAN)
MSVDSLVNM

SEQ ID NO: 184319 - protein, 9 aa, Artificial Sequence
  Description of Artificial Sequence: Synthetic peptide
  Seed: VLHSFTDAI (TYRP2_HUMAN)
VGHSFTDAF

SEQ ID NO: 184320 - protein, 9 aa, Artificial Sequence
  Description of Artificial Sequence: Synthetic peptide
  Seed: APIGHNRMY (TYRP2_HUMAN)
AAIGHNRMV

SEQ ID NO: 184321 - protein, 9 aa, Artificial Sequence
  Description of Artificial Sequence: Synthetic peptide
  Seed: SLHNLVHSF (TYRP2_HUMAN)
SVHNLVHSM

SEQ ID NO: 184322 - protein, 9 aa, Artificial Sequence
  Description of Artificial Sequence: Synthetic peptide
  Seed: METHLSSKR (TYRP2_HUMAN)
MVTHLSSKR

SEQ ID NO: 184323 - protein, 9 aa, Artificial Sequence
  Description of Artificial Sequence: Synthetic peptide
  Seed: STFSFRNAL (TYRP2_HUMAN)
SQFSFRNAY

SEQ ID NO: 184324 - protein, 9 aa, Artificial Sequence
  Description of Artificial Sequence: Synthetic peptide
  Seed: SLDDYNHLV (TYRP2_HUMAN)
SYDDYNHLA

SEQ ID NO: 184325 - protein, 9 aa, Artificial Sequence
  Description of Artificial Sequence: Synthetic peptide
  Seed: RKFFHRTCK (TYRP2_HUMAN)
RHFFHRTCK

SEQ ID NO: 184326 - protein, 9 aa, Artificial Sequence
  Description of Artificial Sequence: Synthetic peptide
  Seed: YDFFVWLHY (TYRP2_HUMAN)
YKFFVWLHY

SEQ ID NO: 184327 - protein, 9 aa, Artificial Sequence
  Description of Artificial Sequence: Synthetic peptide
  Seed: TLKDIRDCL (TYRP2_HUMAN)
TQKDIRDCY

SEQ ID NO: 184328 - protein, 9 aa, Artificial Sequence
  Description of Artificial Sequence: Synthetic peptide
  Seed: VLLAFLQYR (TYRP2_HUMAN)
VVLAFLQYR

SEQ ID NO: 184329 - protein, 9 aa, Artificial Sequence
  Description of Artificial Sequence: Synthetic peptide
  Seed: VHPDYVITT (TYRP2_HUMAN)
VAPDYVITL

SEQ ID NO: 184330 - protein, 9 aa, Artificial Sequence
  Description of Artificial Sequence: Synthetic peptide
  Seed: LAFLQYRRL (TYRP2_HUMAN)
LTFLQYRRW

SEQ ID NO: 184331 - protein, 10 aa, Artificial Sequence
  Description of Artificial Sequence: Synthetic peptide
  Seed: FLLSCLGCKI (TYRP2_HUMAN)
FFLSCLGCKL

SEQ ID NO: 184332 - protein, 9 aa, Artificial Sequence
  Description of Artificial Sequence: Synthetic peptide
  Seed: YSYAIDLPV (TYRP2_HUMAN)
YFYAIDLPW

SEQ ID NO: 184333 - protein, 9 aa, Artificial Sequence
  Description of Artificial Sequence: Synthetic peptide
  Seed: HQGPAFVTW (TYRP2_HUMAN)
HWGPAFVTF

SEQ ID NO: 184334 - protein, 10 aa, Artificial Sequence
  Description of Artificial Sequence: Synthetic peptide
  Seed: DIRDCLSLQK (TYRP2_HUMAN)
DSRDCLSLQR

SEQ ID NO: 184335 - protein, 10 aa, Artificial Sequence
  Description of Artificial Sequence: Synthetic peptide
  Seed: SLDDYNHLVT (TYRP2_HUMAN)
SSDDYNHLVM

SEQ ID NO: 184336 - protein, 10 aa, Artificial Sequence
  Description of Artificial Sequence: Synthetic peptide
  Seed: VALVGLFVLL (TYRP2_HUMAN)
VGLVGLFVLV

SEQ ID NO: 184337 - protein, 9 aa, Artificial Sequence
  Description of Artificial Sequence: Synthetic peptide
  Seed: RNQMGRNSM (TYRP2_HUMAN)
RQQMGRNSH

SEQ ID NO: 184338 - protein, 9 aa, Artificial Sequence
  Description of Artificial Sequence: Synthetic peptide
  Seed: HYYSVRDTL (TYRP2_HUMAN)
HSYSVRDTL

SEQ ID NO: 184339 - protein, 9 aa, Artificial Sequence
  Description of Artificial Sequence: Synthetic peptide
  Seed: VVMGTLVAL (TYRP2_HUMAN)
VQMGTLVAY

SEQ ID NO: 184340 - protein, 9 aa, Artificial Sequence
  Description of Artificial Sequence: Synthetic peptide
  Seed: FTDAIFDEW (TYRP2_HUMAN)
FMDAIFDEI

SEQ ID NO: 184341 - protein, 10 aa, Artificial Sequence
  Description of Artificial Sequence: Synthetic peptide
  Seed: FVLLAFLQYR (TYRP2_HUMAN)
FALLAFLQYR

SEQ ID NO: 184342 - protein, 10 aa, Artificial Sequence
  Description of Artificial Sequence: Synthetic peptide
  Seed: GYSYAIDLPV (TYRP2_HUMAN)
GLSYAIDLPI

SEQ ID NO: 184343 - protein, 8 aa, Artificial Sequence
  Description of Artificial Sequence: Synthetic peptide
  Seed: LDDYNHLV (TYRP2_HUMAN)
LVDYNHLL

SEQ ID NO: 184344 - protein, 9 aa, Artificial Sequence
  Description of Artificial Sequence: Synthetic peptide
  Seed: FFQNSTFSF (TYRP2_HUMAN)
FQQNSTFSI

SEQ ID NO: 184345 - protein, 10 aa, Artificial Sequence
  Description of Artificial Sequence: Synthetic peptide
  Seed: AGYNCGDCKF (TYRP2_HUMAN)
AYYNCGDCKF

SEQ ID NO: 184346 - protein, 9 aa, Artificial Sequence
  Description of Artificial Sequence: Synthetic peptide
  Seed: GNESFALPY (TYRP2_HUMAN)
GQESFALPL

SEQ ID NO: 184347 - protein, 10 aa, Artificial Sequence
  Description of Artificial Sequence: Synthetic peptide
  Seed: CCPRLGAESA (TYRP2_HUMAN)
CLPRLGAESL

SEQ ID NO: 184348 - protein, 9 aa, Artificial Sequence
  Description of Artificial Sequence: Synthetic peptide
  Seed: YAIDLPVSV (TYRP2_HUMAN)
YCIDLPVSF

SEQ ID NO: 184349 - protein, 11 aa, Artificial Sequence
  Description of Artificial Sequence: Synthetic peptide
  Seed: SVYDFFVWLHY (TYRP2_HUMAN)
STYDFFVWLHR

SEQ ID NO: 184350 - protein, 10 aa, Artificial Sequence
  Description of Artificial Sequence: Synthetic peptide
  Seed: VVMGTLVALV (TYRP2_HUMAN)
VMMGTLVALF

SEQ ID NO: 184351 - protein, 10 aa, Artificial Sequence
  Description of Artificial Sequence: Synthetic peptide
  Seed: YNMVPFFPPV (TYRP2_HUMAN)
YQMVPFFPPA

SEQ ID NO: 184352 - protein, 10 aa, Artificial Sequence
  Description of Artificial Sequence: Synthetic peptide
  Seed: YNMVPFFPPV (TYRP2_HUMAN)
YLMVPFFPPA

SEQ ID NO: 184353 - protein, 9 aa, Artificial Sequence
  Description of Artificial Sequence: Synthetic peptide
  Seed: RDCLSLQKF (TYRP2_HUMAN)
RECLSLQKI

SEQ ID NO: 184354 - protein, 9 aa, Artificial Sequence
  Description of Artificial Sequence: Synthetic peptide
  Seed: FTDAIFDEW (TYRP2_HUMAN)
FDDAIFDEL

SEQ ID NO: 184355 - protein, 9 aa, Artificial Sequence
  Description of Artificial Sequence: Synthetic peptide
  Seed: ITTQHWLGL (TYRP2_HUMAN)
IMTQHWLGV

SEQ ID NO: 184356 - protein, 10 aa, Artificial Sequence
  Description of Artificial Sequence: Synthetic peptide
  Seed: FSFRNALEGF (TYRP2_HUMAN)
FAFRNALEGY

SEQ ID NO: 184357 - protein, 9 aa, Artificial Sequence
  Description of Artificial Sequence: Synthetic peptide
  Seed: TLLGPGRPY (TYRP2_HUMAN)
TILGPGRPL

SEQ ID NO: 184358 - protein, 10 aa, Artificial Sequence
  Description of Artificial Sequence: Synthetic peptide
  Seed: RLRKGYTPLM (TYRP2_HUMAN)
RTRKGYTPLM

SEQ ID NO: 184359 - protein, 9 aa, Artificial Sequence
  Description of Artificial Sequence: Synthetic peptide
  Seed: LLSCLGCKI (TYRP2_HUMAN)
LVSCLGCKI

SEQ ID NO: 184360 - protein, 9 aa, Artificial Sequence
  Description of Artificial Sequence: Synthetic peptide
  Seed: VTWHRYHLL (TYRP2_HUMAN)
VMWHRYHLY

SEQ ID NO: 184361 - protein, 9 aa, Artificial Sequence
  Description of Artificial Sequence: Synthetic peptide
  Seed: AANDPIFVV (TYRP2_HUMAN)
AMNDPIFVW

SEQ ID NO: 184362 - protein, 9 aa, Artificial Sequence
  Description of Artificial Sequence: Synthetic peptide
  Seed: YVITTQHWL (TYRP2_HUMAN)
YVITTQHWF

SEQ ID NO: 184363 - protein, 11 aa, Artificial Sequence
  Description of Artificial Sequence: Synthetic peptide
  Seed: QRLIGNESFAL (TYRP2_HUMAN)
QHLIGNESFAI

SEQ ID NO: 184364 - protein, 11 aa, Artificial Sequence
  Description of Artificial Sequence: Synthetic peptide
  Seed: YNMVPFFPPVT (TYRP2_HUMAN)
YVMVPFFPPVG

SEQ ID NO: 184365 - protein, 11 aa, Artificial Sequence
  Description of Artificial Sequence: Synthetic peptide
  Seed: AIDFSHQGPAF (TYRP2_HUMAN)
ATDFSHQGPAY

SEQ ID NO: 184366 - protein, 9 aa, Artificial Sequence
  Description of Artificial Sequence: Synthetic peptide
  Seed: FLNGTNALP (TYRP2_HUMAN)
FVNGTNALL

SEQ ID NO: 184367 - protein, 9 aa, Artificial Sequence
  Description of Artificial Sequence: Synthetic peptide
  Seed: NMVPFFPPV (TYRP2_HUMAN)
NHVPFFPPY

SEQ ID NO: 184368 - protein, 9 aa, Artificial Sequence
  Description of Artificial Sequence: Synthetic peptide
  Seed: SFLNGTNAL (TYRP2_HUMAN)
SVLNGTNAF

SEQ ID NO: 184369 - protein, 9 aa, Artificial Sequence
  Description of Artificial Sequence: Synthetic peptide
  Seed: NRMYNMVPF (TYRP2_HUMAN)
NWMYNMVPF

SEQ ID NO: 184370 - protein, 11 aa, Artificial Sequence
  Description of Artificial Sequence: Synthetic peptide
  Seed: YTPLMETHLSS (TYRP2_HUMAN)
YFPLMETHLST

SEQ ID NO: 184371 - protein, 9 aa, Artificial Sequence
  Description of Artificial Sequence: Synthetic peptide
  Seed: RLRKGYTPL (TYRP2_HUMAN)
RIRKGYTPE

SEQ ID NO: 184372 - protein, 9 aa, Artificial Sequence
  Description of Artificial Sequence: Synthetic peptide
  Seed: FFPPVTNEE (TYRP2_HUMAN)
FLPPVTNEM

SEQ ID NO: 184373 - protein, 9 aa, Artificial Sequence
  Description of Artificial Sequence: Synthetic peptide
  Seed: RMYNMVPFF (TYRP2_HUMAN)
RMYNMVPFS

SEQ ID NO: 184374 - protein, 9 aa, Artificial Sequence
  Description of Artificial Sequence: Synthetic peptide
  Seed: ELWPRKFFH (TYRP2_HUMAN)
EIWPRKFFR

SEQ ID NO: 184375 - protein, 10 aa, Artificial Sequence
  Description of Artificial Sequence: Synthetic peptide
  Seed: RRLRKGYTPL (TYRP2_HUMAN)
RMLRKGYTPI

SEQ ID NO: 184376 - protein, 8 aa, Artificial Sequence
  Description of Artificial Sequence: Synthetic peptide
  Seed: FQNSTFSF (TYRP2_HUMAN)
FKNSTFSF

SEQ ID NO: 184377 - protein, 9 aa, Artificial Sequence
  Description of Artificial Sequence: Synthetic peptide
  Seed: SRNSRFSSW (TYRP2_HUMAN)
SMNSRFSSW

SEQ ID NO: 184378 - protein, 8 aa, Artificial Sequence
  Description of Artificial Sequence: Synthetic peptide
  Seed: FSHQGPAF (TYRP2_HUMAN)
FPHQGPAY

SEQ ID NO: 184379 - protein, 9 aa, Artificial Sequence
  Description of Artificial Sequence: Synthetic peptide
  Seed: RVHPDYVIT (TYRP2_HUMAN)
RVHPDYVIK

SEQ ID NO: 184380 - protein, 8 aa, Artificial Sequence
  Description of Artificial Sequence: Synthetic peptide
  Seed: LAPIGHNR (TYRP2_HUMAN)
LAPIGHNM

SEQ ID NO: 184381 - protein, 9 aa, Artificial Sequence
  Description of Artificial Sequence: Synthetic peptide
  Seed: FTDAIFDEW (TYRP2_HUMAN)
FVDAIFDEV

SEQ ID NO: 184382 - protein, 9 aa, Artificial Sequence
  Description of Artificial Sequence: Synthetic peptide
  Seed: ALVGLFVLL (TYRP2_HUMAN)
AQVGLFVLA

SEQ ID NO: 184383 - protein, 11 aa, Artificial Sequence
  Description of Artificial Sequence: Synthetic peptide
  Seed: FFPPVTNEELF (TYRP2_HUMAN)
FMPPVTNEELY

SEQ ID NO: 184384 - protein, 9 aa, Artificial Sequence
  Description of Artificial Sequence: Synthetic peptide
  Seed: STFSFRNAL (TYRP2_HUMAN)
SEFSFRNAF

SEQ ID NO: 184385 - protein, 10 aa, Artificial Sequence
  Description of Artificial Sequence: Synthetic peptide
  Seed: LHYYSVRDTL (TYRP2_HUMAN)
LQYYSVRDTI

SEQ ID NO: 184386 - protein, 9 aa, Artificial Sequence
  Description of Artificial Sequence: Synthetic peptide
  Seed: YAIDLPVSV (TYRP2_HUMAN)
YAIDLPVSM

SEQ ID NO: 184387 - protein, 11 aa, Artificial Sequence
  Description of Artificial Sequence: Synthetic peptide
  Seed: MYNMVPFFPPV (TYRP2_HUMAN)
MRNMVPFFPPL

SEQ ID NO: 184388 - protein, 9 aa, Artificial Sequence
  Description of Artificial Sequence: Synthetic peptide
  Seed: DDYNHLVTL (TYRP2_HUMAN)
DLYNHLVTF

SEQ ID NO: 184389 - protein, 9 aa, Artificial Sequence
  Description of Artificial Sequence: Synthetic peptide
  Seed: RVHPDYVIT (TYRP2_HUMAN)
RIHPDYVIK

SEQ ID NO: 184390 - protein, 10 aa, Artificial Sequence
  Description of Artificial Sequence: Synthetic peptide
  Seed: GTLDSQVMSL (TYRP2_HUMAN)
GPLDSQVMSV

SEQ ID NO: 184391 - protein, 10 aa, Artificial Sequence
  Description of Artificial Sequence: Synthetic peptide
  Seed: CTDQLFGAAR (TYRP2_HUMAN)
CSDQLFGAAY

SEQ ID NO: 184392 - protein, 10 aa, Artificial Sequence
  Description of Artificial Sequence: Synthetic peptide
  Seed: YAIDLPVSVE (TYRP2_HUMAN)
YMIDLPVSVL

SEQ ID NO: 184393 - protein, 11 aa, Artificial Sequence
  Description of Artificial Sequence: Synthetic peptide
  Seed: MYNMVPFFPPV (TYRP2_HUMAN)
MDNMVPFFPPL

SEQ ID NO: 184394 - protein, 10 aa, Artificial Sequence
  Description of Artificial Sequence: Synthetic peptide
  Seed: QPQFANCSVY (TYRP2_HUMAN)
QTQFANCSVM

SEQ ID NO: 184395 - protein, 9 aa, Artificial Sequence
  Description of Artificial Sequence: Synthetic peptide
  Seed: GLFVLLAFL (TYRP2_HUMAN)
GLFVLLAFI

SEQ ID NO: 184396 - protein, 9 aa, Artificial Sequence
  Description of Artificial Sequence: Synthetic peptide
  Seed: ARPDDPTLI (TYRP2_HUMAN)
ASPDDPTLL

SEQ ID NO: 184397 - protein, 10 aa, Artificial Sequence
  Description of Artificial Sequence: Synthetic peptide
  Seed: RNSRFSSWET (TYRP2_HUMAN)
RTSRFSSWEL

SEQ ID NO: 184398 - protein, 10 aa, Artificial Sequence
  Description of Artificial Sequence: Synthetic peptide
  Seed: QPQFANCSVY (TYRP2_HUMAN)
QSQFANCSVF

SEQ ID NO: 184399 - protein, 9 aa, Artificial Sequence
  Description of Artificial Sequence: Synthetic peptide
  Seed: YAIDLPVSV (TYRP2_HUMAN)
YMIDLPVSY

SEQ ID NO: 184400 - protein, 10 aa, Artificial Sequence
  Description of Artificial Sequence: Synthetic peptide
  Seed: RNSMKLPTLK (TYRP2_HUMAN)
RYSMKLPTLR

SEQ ID NO: 184401 - protein, 10 aa, Artificial Sequence
  Description of Artificial Sequence: Synthetic peptide
  Seed: FLLSCLGCKI (TYRP2_HUMAN)
FALSCLGCKI

SEQ ID NO: 184402 - protein, 9 aa, Artificial Sequence
  Description of Artificial Sequence: Synthetic peptide
  Seed: RLRKGYTPL (TYRP2_HUMAN)
RIRKGYTPT

SEQ ID NO: 184403 - protein, 10 aa, Artificial Sequence
  Description of Artificial Sequence: Synthetic peptide
  Seed: YNMVPFFPPV (TYRP2_HUMAN)
YFMVPFFPPI

SEQ ID NO: 184404 - protein, 9 aa, Artificial Sequence
  Description of Artificial Sequence: Synthetic peptide
  Seed: SWETVCDSL (TYRP2_HUMAN)
SYETVCDSF

SEQ ID NO: 184405 - protein, 8 aa, Artificial Sequence
  Description of Artificial Sequence: Synthetic peptide
  Seed: KFDNPPFF (TYRP2_HUMAN)
KADNPPFV

SEQ ID NO: 184406 - protein, 10 aa, Artificial Sequence
  Description of Artificial Sequence: Synthetic peptide
  Seed: RLRKGYTPLM (TYRP2_HUMAN)
RQRKGYTPLV

SEQ ID NO: 184407 - protein, 10 aa, Artificial Sequence
  Description of Artificial Sequence: Synthetic peptide
  Seed: FPPVTNEELF (TYRP2_HUMAN)
FPPVTNEELY

SEQ ID NO: 184408 - protein, 10 aa, Artificial Sequence
  Description of Artificial Sequence: Synthetic peptide
  Seed: NSTFSFRNAL (TYRP2_HUMAN)
NPTFSFRNAI

SEQ ID NO: 184409 - protein, 10 aa, Artificial Sequence
  Description of Artificial Sequence: Synthetic peptide
  Seed: AIFDEWMKRF (TYRP2_HUMAN)
ASFDEWMKRW

SEQ ID NO: 184410 - protein, 9 aa, Artificial Sequence
  Description of Artificial Sequence: Synthetic peptide
  Seed: ILPGAQGQF (TYRP2_HUMAN)
ITPGAQGQM

SEQ ID NO: 184411 - protein, 11 aa, Artificial Sequence
  Description of Artificial Sequence: Synthetic peptide
  Seed: LPVSVEETPGW (TYRP2_HUMAN)
LDVSVEETPGW

SEQ ID NO: 184412 - protein, 9 aa, Artificial Sequence
  Description of Artificial Sequence: Synthetic peptide
  Seed: DQLGYSYAI (TYRP2_HUMAN)
DRLGYSYAM

SEQ ID NO: 184413 - protein, 10 aa, Artificial Sequence
  Description of Artificial Sequence: Synthetic peptide
  Seed: RNSRFSSWET (TYRP2_HUMAN)
RMSRFSSWEL

SEQ ID NO: 184414 - protein, 9 aa, Artificial Sequence
  Description of Artificial Sequence: Synthetic peptide
  Seed: KDIRDCLSL (TYRP2_HUMAN)
KQIRDCLSF

SEQ ID NO: 184415 - protein, 9 aa, Artificial Sequence
  Description of Artificial Sequence: Synthetic peptide
  Seed: VYDFFVWLH (TYRP2_HUMAN)
VVDFFVWLY

SEQ ID NO: 184416 - protein, 9 aa, Artificial Sequence
  Description of Artificial Sequence: Synthetic peptide
  Seed: HPDYVITTQ (TYRP2_HUMAN)
HPDYVITTY

SEQ ID NO: 184417 - protein, 9 aa, Artificial Sequence
  Description of Artificial Sequence: Synthetic peptide
  Seed: ETPGWPTTL (TYRP2_HUMAN)
ERPGWPTTL

SEQ ID NO: 184418 - protein, 10 aa, Artificial Sequence
  Description of Artificial Sequence: Synthetic peptide
  Seed: LHYYSVRDTL (TYRP2_HUMAN)
LEYYSVRDTW

SEQ ID NO: 184419 - protein, 9 aa, Artificial Sequence
  Description of Artificial Sequence: Synthetic peptide
  Seed: ILPGAQGQF (TYRP2_HUMAN)
IQPGAQGQY

SEQ ID NO: 184420 - protein, 10 aa, Artificial Sequence
  Description of Artificial Sequence: Synthetic peptide
  Seed: RLRKGYTPLM (TYRP2_HUMAN)
RYRKGYTPLY

SEQ ID NO: 184421 - protein, 10 aa, Artificial Sequence
  Description of Artificial Sequence: Synthetic peptide
  Seed: YDFFVWLHYY (TYRP2_HUMAN)
YYFFVWLHYL

SEQ ID NO: 184422 - protein, 9 aa, Artificial Sequence
  Description of Artificial Sequence: Synthetic peptide
  Seed: METHLSSKR (TYRP2_HUMAN)
MYTHLSSKR

SEQ ID NO: 184423 - protein, 9 aa, Artificial Sequence
  Description of Artificial Sequence: Synthetic peptide
  Seed: FSHQGPAFV (TYRP2_HUMAN)
FMHQGPAFM

SEQ ID NO: 184424 - protein, 10 aa, Artificial Sequence
  Description of Artificial Sequence: Synthetic peptide
  Seed: FFQNSTFSFR (TYRP2_HUMAN)
FSQNSTFSFK

SEQ ID NO: 184425 - protein, 10 aa, Artificial Sequence
  Description of Artificial Sequence: Synthetic peptide
  Seed: FSFRNALEGF (TYRP2_HUMAN)
FYFRNALEGM

SEQ ID NO: 184426 - protein, 10 aa, Artificial Sequence
  Description of Artificial Sequence: Synthetic peptide
  Seed: SLVNKECCPR (TYRP2_HUMAN)
SYVNKECCPR

SEQ ID NO: 184427 - protein, 9 aa, Artificial Sequence
  Description of Artificial Sequence: Synthetic peptide
  Seed: HSAANDPIF (TYRP2_HUMAN)
HMAANDPIY

SEQ ID NO: 184428 - protein, 9 aa, Artificial Sequence
  Description of Artificial Sequence: Synthetic peptide
  Seed: YSYAIDLPV (TYRP2_HUMAN)
YRYAIDLPY

SEQ ID NO: 184429 - protein, 10 aa, Artificial Sequence
  Description of Artificial Sequence: Synthetic peptide
  Seed: NPPFFQNSTF (TYRP2_HUMAN)
NSPFFQNSTY

SEQ ID NO: 184430 - protein, 9 aa, Artificial Sequence
  Description of Artificial Sequence: Synthetic peptide
  Seed: DDYNHLVTL (TYRP2_HUMAN)
DKYNHLVTL

SEQ ID NO: 184431 - protein, 10 aa, Artificial Sequence
  Description of Artificial Sequence: Synthetic peptide
  Seed: MSLHNLVHSF (TYRP2_HUMAN)
MVLHNLVHSW

SEQ ID NO: 184432 - protein, 10 aa, Artificial Sequence
  Description of Artificial Sequence: Synthetic peptide
  Seed: FFVWLHYYSV (TYRP2_HUMAN)
FQVWLHYYSL

SEQ ID NO: 184433 - protein, 10 aa, Artificial Sequence
  Description of Artificial Sequence: Synthetic peptide
  Seed: QPQFANCSVY (TYRP2_HUMAN)
QLQFANCSVL

SEQ ID NO: 184434 - protein, 10 aa, Artificial Sequence
  Description of Artificial Sequence: Synthetic peptide
  Seed: TDAIFDEWMK (TYRP2_HUMAN)
TFAIFDEWMR

SEQ ID NO: 184435 - protein, 9 aa, Artificial Sequence
  Description of Artificial Sequence: Synthetic peptide
  Seed: SLHNLVHSF (TYRP2_HUMAN)
SYHNLVHSW

SEQ ID NO: 184436 - protein, 10 aa, Artificial Sequence
  Description of Artificial Sequence: Synthetic peptide
  Seed: VLLAFLQYRR (TYRP2_HUMAN)
VILAFLQYRR

SEQ ID NO: 184437 - protein, 9 aa, Artificial Sequence
  Description of Artificial Sequence: Synthetic peptide
  Seed: YAIDLPVSV (TYRP2_HUMAN)
YQIDLPVSC

SEQ ID NO: 184438 - protein, 9 aa, Artificial Sequence
  Description of Artificial Sequence: Synthetic peptide
  Seed: YAIDLPVSV (TYRP2_HUMAN)
YRIDLPVSY

SEQ ID NO: 184439 - protein, 9 aa, Artificial Sequence
  Description of Artificial Sequence: Synthetic peptide
  Seed: TLDSQVMSL (TYRP2_HUMAN)
TWDSQVMSF

SEQ ID NO: 184440 - protein, 9 aa, Artificial Sequence
  Description of Artificial Sequence: Synthetic peptide
  Seed: STFSFRNAL (TYRP2_HUMAN)
SRFSFRNAF

SEQ ID NO: 184441 - protein, 9 aa, Artificial Sequence
  Description of Artificial Sequence: Synthetic peptide
  Seed: WPTTLLVVM (TYRP2_HUMAN)
WPTTLLVVF

SEQ ID NO: 184442 - protein, 9 aa, Artificial Sequence
  Description of Artificial Sequence: Synthetic peptide
  Seed: ALVGLFVLL (TYRP2_HUMAN)
AIVGLFVLA

SEQ ID NO: 184443 - protein, 10 aa, Artificial Sequence
  Description of Artificial Sequence: Synthetic peptide
  Seed: DSLDDYNHLV (TYRP2_HUMAN)
DTLDDYNHLI

SEQ ID NO: 184444 - protein, 9 aa, Artificial Sequence
  Description of Artificial Sequence: Synthetic peptide
  Seed: GPNGTQPQF (TYRP2_HUMAN)
GQNGTQPQY

SEQ ID NO: 184445 - protein, 9 aa, Artificial Sequence
  Description of Artificial Sequence: Synthetic peptide
  Seed: TLLGPGRPY (TYRP2_HUMAN)
TWLGPGRPF

SEQ ID NO: 184446 - protein, 10 aa, Artificial Sequence
  Description of Artificial Sequence: Synthetic peptide
  Seed: FPPVTNEELF (TYRP2_HUMAN)
FWPVTNEELF

SEQ ID NO: 184447 - protein, 8 aa, Artificial Sequence
  Description of Artificial Sequence: Synthetic peptide
  Seed: AIDLPVSV (TYRP2_HUMAN)
AIDLPVSF

SEQ ID NO: 184448 - protein, 9 aa, Artificial Sequence
  Description of Artificial Sequence: Synthetic peptide
  Seed: ETPGWPTTL (TYRP2_HUMAN)
ETPGWPTTM

SEQ ID NO: 184449 - protein, 9 aa, Artificial Sequence
  Description of Artificial Sequence: Synthetic peptide
  Seed: RPWSGPYIL (TYRP2_HUMAN)
RTWSGPYIL

SEQ ID NO: 184450 - protein, 9 aa, Artificial Sequence
  Description of Artificial Sequence: Synthetic peptide
  Seed: SLHNLVHSF (TYRP2_HUMAN)
SAHNLVHSR

SEQ ID NO: 184451 - protein, 10 aa, Artificial Sequence
  Description of Artificial Sequence: Synthetic peptide
  Seed: SDQLGYSYAI (TYRP2_HUMAN)
SDQLGYSYAV

SEQ ID NO: 184452 - protein, 9 aa, Artificial Sequence
  Description of Artificial Sequence: Synthetic peptide
  Seed: VTWHRYHLL (TYRP2_HUMAN)
VQWHRYHLK

SEQ ID NO: 184453 - protein, 9 aa, Artificial Sequence
  Description of Artificial Sequence: Synthetic peptide
  Seed: REQFLGALD (TYRP2_HUMAN)
REQFLGALP

SEQ ID NO: 184454 - protein, 9 aa, Artificial Sequence
  Description of Artificial Sequence: Synthetic peptide
  Seed: SLDDYNHLV (TYRP2_HUMAN)
SNDDYNHLY

SEQ ID NO: 184455 - protein, 10 aa, Artificial Sequence
  Description of Artificial Sequence: Synthetic peptide
  Seed: SPLWWGFLLS (TYRP2_HUMAN)
SLLWWGFLLV

SEQ ID NO: 184456 - protein, 11 aa, Artificial Sequence
  Description of Artificial Sequence: Synthetic peptide
  Seed: SLDDYNHLVTL (TYRP2_HUMAN)
SIDDYNHLVTM

SEQ ID NO: 184457 - protein, 11 aa, Artificial Sequence
  Description of Artificial Sequence: Synthetic peptide
  Seed: SVYDFFVWLHY (TYRP2_HUMAN)
SQYDFFVWLHF

SEQ ID NO: 184458 - protein, 10 aa, Artificial Sequence
  Description of Artificial Sequence: Synthetic peptide
  Seed: YDFFVWLHYY (TYRP2_HUMAN)
YFFFVWLHYD

SEQ ID NO: 184459 - protein, 10 aa, Artificial Sequence
  Description of Artificial Sequence: Synthetic peptide
  Seed: RELWPRKFFH (TYRP2_HUMAN)
RALWPRKFFK

SEQ ID NO: 184460 - protein, 9 aa, Artificial Sequence
  Description of Artificial Sequence: Synthetic peptide
  Seed: RKFFHRTCK (TYRP2_HUMAN)
RYFFHRTCV

SEQ ID NO: 184461 - protein, 10 aa, Artificial Sequence
  Description of Artificial Sequence: Synthetic peptide
  Seed: HSFLNGTNAL (TYRP2_HUMAN)
HTFLNGTNAA

SEQ ID NO: 184462 - protein, 9 aa, Artificial Sequence
  Description of Artificial Sequence: Synthetic peptide
  Seed: VVMGTLVAL (TYRP2_HUMAN)
VLMGTLVAR

SEQ ID NO: 184463 - protein, 10 aa, Artificial Sequence
  Description of Artificial Sequence: Synthetic peptide
  Seed: RLRKGYTPLM (TYRP2_HUMAN)
RVRKGYTPLY

SEQ ID NO: 184464 - protein, 9 aa, Artificial Sequence
  Description of Artificial Sequence: Synthetic peptide
  Seed: FLNGTNALP (TYRP2_HUMAN)
FVNGTNALI

SEQ ID NO: 184465 - protein, 9 aa, Artificial Sequence
  Description of Artificial Sequence: Synthetic peptide
  Seed: GTLVALVGL (TYRP2_HUMAN)
GTLVALVGV

SEQ ID NO: 184466 - protein, 11 aa, Artificial Sequence
  Description of Artificial Sequence: Synthetic peptide
  Seed: HPDYVITTQHW (TYRP2_HUMAN)
HSDYVITTQHF

SEQ ID NO: 184467 - protein, 8 aa, Artificial Sequence
  Description of Artificial Sequence: Synthetic peptide
  Seed: FSHQGPAF (TYRP2_HUMAN)
FYHQGPAI

SEQ ID NO: 184468 - protein, 9 aa, Artificial Sequence
  Description of Artificial Sequence: Synthetic peptide
  Seed: GTYEGLLRR (TYRP2_HUMAN)
GQYEGLLRK

SEQ ID NO: 184469 - protein, 9 aa, Artificial Sequence
  Description of Artificial Sequence: Synthetic peptide
  Seed: VTNEELFLT (TYRP2_HUMAN)
VANEELFLV

SEQ ID NO: 184470 - protein, 10 aa, Artificial Sequence
  Description of Artificial Sequence: Synthetic peptide
  Seed: HRYHLLCLER (TYRP2_HUMAN)
HRYHLLCLEI

SEQ ID NO: 184471 - protein, 9 aa, Artificial Sequence
  Description of Artificial Sequence: Synthetic peptide
  Seed: ILPGAQGQF (TYRP2_HUMAN)
IMPGAQGQY

SEQ ID NO: 184472 - protein, 10 aa, Artificial Sequence
  Description of Artificial Sequence: Synthetic peptide
  Seed: DSLDDYNHLV (TYRP2_HUMAN)
DVLDDYNHLV

SEQ ID NO: 184473 - protein, 10 aa, Artificial Sequence
  Description of Artificial Sequence: Synthetic peptide
  Seed: FLLSCLGCKI (TYRP2_HUMAN)
FQLSCLGCKL

SEQ ID NO: 184474 - protein, 9 aa, Artificial Sequence
  Description of Artificial Sequence: Synthetic peptide
  Seed: RLRKGYTPL (TYRP2_HUMAN)
RTRKGYTPG

SEQ ID NO: 184475 - protein, 10 aa, Artificial Sequence
  Description of Artificial Sequence: Synthetic peptide
  Seed: RLIGNESFAL (TYRP2_HUMAN)
RQIGNESFAL

SEQ ID NO: 184476 - protein, 10 aa, Artificial Sequence
  Description of Artificial Sequence: Synthetic peptide
  Seed: HYYSVRDTLL (TYRP2_HUMAN)
HRYSVRDTLY

SEQ ID NO: 184477 - protein, 9 aa, Artificial Sequence
  Description of Artificial Sequence: Synthetic peptide
  Seed: SFRNALEGF (TYRP2_HUMAN)
SQRNALEGY

SEQ ID NO: 184478 - protein, 10 aa, Artificial Sequence
  Description of Artificial Sequence: Synthetic peptide
  Seed: SQVMSLHNLV (TYRP2_HUMAN)
SHVMSLHNLV

SEQ ID NO: 184479 - protein, 10 aa, Artificial Sequence
  Description of Artificial Sequence: Synthetic peptide
  Seed: FSFRNALEGF (TYRP2_HUMAN)
FYFRNALEGL

SEQ ID NO: 184480 - protein, 10 aa, Artificial Sequence
  Description of Artificial Sequence: Synthetic peptide
  Seed: QPQFANCSVY (TYRP2_HUMAN)
QHQFANCSVM

SEQ ID NO: 184481 - protein, 10 aa, Artificial Sequence
  Description of Artificial Sequence: Synthetic peptide
  Seed: SPLWWGFLLS (TYRP2_HUMAN)
SYLWWGFLLV

SEQ ID NO: 184482 - protein, 10 aa, Artificial Sequence
  Description of Artificial Sequence: Synthetic peptide
  Seed: NSTFSFRNAL (TYRP2_HUMAN)
NTTFSFRNAI

SEQ ID NO: 184483 - protein, 10 aa, Artificial Sequence
  Description of Artificial Sequence: Synthetic peptide
  Seed: FPPVTNEELF (TYRP2_HUMAN)
FTPVTNEELW

SEQ ID NO: 184484 - protein, 9 aa, Artificial Sequence
  Description of Artificial Sequence: Synthetic peptide
  Seed: WHRYHLLCL (TYRP2_HUMAN)
WARYHLLCY

SEQ ID NO: 184485 - protein, 9 aa, Artificial Sequence
  Description of Artificial Sequence: Synthetic peptide
  Seed: YVITTQHWL (TYRP2_HUMAN)
YAITTQHWV

SEQ ID NO: 184486 - protein, 10 aa, Artificial Sequence
  Description of Artificial Sequence: Synthetic peptide
  Seed: RNSRFSSWET (TYRP2_HUMAN)
RTSRFSSWEK

SEQ ID NO: 184487 - protein, 10 aa, Artificial Sequence
  Description of Artificial Sequence: Synthetic peptide
  Seed: HSFLNGTNAL (TYRP2_HUMAN)
HFFLNGTNAL

SEQ ID NO: 184488 - protein, 10 aa, Artificial Sequence
  Description of Artificial Sequence: Synthetic peptide
  Seed: SDQLGYSYAI (TYRP2_HUMAN)
SEQLGYSYAI

SEQ ID NO: 184489 - protein, 8 aa, Artificial Sequence
  Description of Artificial Sequence: Synthetic peptide
  Seed: RPDDPTLI (TYRP2_HUMAN)
RSDDPTLV

SEQ ID NO: 184490 - protein, 9 aa, Artificial Sequence
  Description of Artificial Sequence: Synthetic peptide
  Seed: DDYNHLVTL (TYRP2_HUMAN)
DEYNHLVTF

SEQ ID NO: 184491 - protein, 10 aa, Artificial Sequence
  Description of Artificial Sequence: Synthetic peptide
  Seed: LHYYSVRDTL (TYRP2_HUMAN)
LGYYSVRDTI

SEQ ID NO: 184492 - protein, 9 aa, Artificial Sequence
  Description of Artificial Sequence: Synthetic peptide
  Seed: YTPLMETHL (TYRP2_HUMAN)
YAPLMETHW

SEQ ID NO: 184493 - protein, 11 aa, Artificial Sequence
  Description of Artificial Sequence: Synthetic peptide
  Seed: YNMVPFFPPVT (TYRP2_HUMAN)
YLMVPFFPPVD

SEQ ID NO: 184494 - protein, 11 aa, Artificial Sequence
  Description of Artificial Sequence: Synthetic peptide
  Seed: RNQDDRELWPR (TYRP2_HUMAN)
RYQDDRELWPR

SEQ ID NO: 184495 - protein, 9 aa, Artificial Sequence
  Description of Artificial Sequence: Synthetic peptide
  Seed: NQMGRNSMK (TYRP2_HUMAN)
NIMGRNSMK

SEQ ID NO: 184496 - protein, 11 aa, Artificial Sequence
  Description of Artificial Sequence: Synthetic peptide
  Seed: RRNQMGRNSMK (TYRP2_HUMAN)
RRNQMGRNSMF

SEQ ID NO: 184497 - protein, 9 aa, Artificial Sequence
  Description of Artificial Sequence: Synthetic peptide
  Seed: FFQNSTFSF (TYRP2_HUMAN)
FFQNSTFSL

SEQ ID NO: 184498 - protein, 9 aa, Artificial Sequence
  Description of Artificial Sequence: Synthetic peptide
  Seed: VVMGTLVAL (TYRP2_HUMAN)
VHMGTLVAM

SEQ ID NO: 184499 - protein, 9 aa, Artificial Sequence
  Description of Artificial Sequence: Synthetic peptide
  Seed: GWPTTLLVV (TYRP2_HUMAN)
GYPTTLLVM

SEQ ID NO: 184500 - protein, 10 aa, Artificial Sequence
  Description of Artificial Sequence: Synthetic peptide
  Seed: QPQFANCSVY (TYRP2_HUMAN)
QTQFANCSVY

SEQ ID NO: 184501 - protein, 9 aa, Artificial Sequence
  Description of Artificial Sequence: Synthetic peptide
  Seed: VALVGLFVL (TYRP2_HUMAN)
VLLVGLFVV

SEQ ID NO: 184502 - protein, 10 aa, Artificial Sequence
  Description of Artificial Sequence: Synthetic peptide
  Seed: MGTLVALVGL (TYRP2_HUMAN)
MHTLVALVGV

SEQ ID NO: 184503 - protein, 10 aa, Artificial Sequence
  Description of Artificial Sequence: Synthetic peptide
  Seed: RMYNMVPFFP (TYRP2_HUMAN)
RMYNMVPFFS

SEQ ID NO: 184504 - protein, 9 aa, Artificial Sequence
  Description of Artificial Sequence: Synthetic peptide
  Seed: LHSFTDAIF (TYRP2_HUMAN)
LQSFTDAIY

SEQ ID NO: 184505 - protein, 9 aa, Artificial Sequence
  Description of Artificial Sequence: Synthetic peptide
  Seed: IFDEWMKRF (TYRP2_HUMAN)
IYDEWMKRI

SEQ ID NO: 184506 - protein, 9 aa, Artificial Sequence
  Description of Artificial Sequence: Synthetic peptide
  Seed: VLHSFTDAI (TYRP2_HUMAN)
VLHSFTDAV

SEQ ID NO: 184507 - protein, 10 aa, Artificial Sequence
  Description of Artificial Sequence: Synthetic peptide
  Seed: SPLWWGFLLS (TYRP2_HUMAN)
SHLWWGFLLL

SEQ ID NO: 184508 - protein, 9 aa, Artificial Sequence
  Description of Artificial Sequence: Synthetic peptide
  Seed: ITTQHWLGL (TYRP2_HUMAN)
ILTQHWLGV

SEQ ID NO: 184509 - protein, 9 aa, Artificial Sequence
  Description of Artificial Sequence: Synthetic peptide
  Seed: YAIDLPVSV (TYRP2_HUMAN)
YPIDLPVSV

SEQ ID NO: 184510 - protein, 11 aa, Artificial Sequence
  Description of Artificial Sequence: Synthetic peptide
  Seed: MYNMVPFFPPV (TYRP2_HUMAN)
MRNMVPFFPPV

SEQ ID NO: 184511 - protein, 10 aa, Artificial Sequence
  Description of Artificial Sequence: Synthetic peptide
  Seed: RELWPRKFFH (TYRP2_HUMAN)
RDLWPRKFFK

SEQ ID NO: 184512 - protein, 11 aa, Artificial Sequence
  Description of Artificial Sequence: Synthetic peptide
  Seed: LLVVMGTLVAL (TYRP2_HUMAN)
LVVVMGTLVAV

SEQ ID NO: 184513 - protein, 9 aa, Artificial Sequence
  Description of Artificial Sequence: Synthetic peptide
  Seed: TLLGPGRPY (TYRP2_HUMAN)
TLLGPGRPM

SEQ ID NO: 184514 - protein, 9 aa, Artificial Sequence
  Description of Artificial Sequence: Synthetic peptide
  Seed: SRFSSWETV (TYRP2_HUMAN)
SLFSSWETI

SEQ ID NO: 184515 - protein, 9 aa, Artificial Sequence
  Description of Artificial Sequence: Synthetic peptide
  Seed: RAIDFSHQG (TYRP2_HUMAN)
RIIDFSHQF

SEQ ID NO: 184516 - protein, 9 aa, Artificial Sequence
  Description of Artificial Sequence: Synthetic peptide
  Seed: SVYDFFVWL (TYRP2_HUMAN)
SMYDFFVWI

SEQ ID NO: 184517 - protein, 9 aa, Artificial Sequence
  Description of Artificial Sequence: Synthetic peptide
  Seed: VHPDYVITT (TYRP2_HUMAN)
VGPDYVITM

SEQ ID NO: 184518 - protein, 9 aa, Artificial Sequence
  Description of Artificial Sequence: Synthetic peptide
  Seed: FFQNSTFSF (TYRP2_HUMAN)
FGQNSTFSM

SEQ ID NO: 184519 - protein, 10 aa, Artificial Sequence
  Description of Artificial Sequence: Synthetic peptide
  Seed: LHYYSVRDTL (TYRP2_HUMAN)
LTYYSVRDTF

SEQ ID NO: 184520 - protein, 10 aa, Artificial Sequence
  Description of Artificial Sequence: Synthetic peptide
  Seed: SPLWWGFLLS (TYRP2_HUMAN)
SPLWWGFLLA

SEQ ID NO: 184521 - protein, 9 aa, Artificial Sequence
  Description of Artificial Sequence: Synthetic peptide
  Seed: ESANVCGSQ (TYRP2_HUMAN)
EIANVCGSR

SEQ ID NO: 184522 - protein, 10 aa, Artificial Sequence
  Description of Artificial Sequence: Synthetic peptide
  Seed: GQFPRVCMTV (TYRP2_HUMAN)
GIFPRVCMTI

SEQ ID NO: 184523 - protein, 9 aa, Artificial Sequence
  Description of Artificial Sequence: Synthetic peptide
  Seed: VHPDYVITT (TYRP2_HUMAN)
VHPDYVITM

SEQ ID NO: 184524 - protein, 11 aa, Artificial Sequence
  Description of Artificial Sequence: Synthetic peptide
  Seed: FANCSVYDFFV (TYRP2_HUMAN)
FVNCSVYDFFV

SEQ ID NO: 184525 - protein, 11 aa, Artificial Sequence
  Description of Artificial Sequence: Synthetic peptide
  Seed: ALPYWNFATGR (TYRP2_HUMAN)
AMPYWNFATGR

SEQ ID NO: 184526 - protein, 10 aa, Artificial Sequence
  Description of Artificial Sequence: Synthetic peptide
  Seed: FVWLHYYSVR (TYRP2_HUMAN)
FIWLHYYSVI

SEQ ID NO: 184527 - protein, 9 aa, Artificial Sequence
  Description of Artificial Sequence: Synthetic peptide
  Seed: VTNEELFLT (TYRP2_HUMAN)
VTNEELFLL

SEQ ID NO: 184528 - protein, 10 aa, Artificial Sequence
  Description of Artificial Sequence: Synthetic peptide
  Seed: FVVLHSFTDA (TYRP2_HUMAN)
FTVLHSFTDV

SEQ ID NO: 184529 - protein, 9 aa, Artificial Sequence
  Description of Artificial Sequence: Synthetic peptide
  Seed: PADAWPQEL (TYRP2_HUMAN)
PADAWPQEM

SEQ ID NO: 184530 - protein, 10 aa, Artificial Sequence
  Description of Artificial Sequence: Synthetic peptide
  Seed: GTLDSQVMSL (TYRP2_HUMAN)
GTLDSQVMSW

SEQ ID NO: 184531 - protein, 11 aa, Artificial Sequence
  Description of Artificial Sequence: Synthetic peptide
  Seed: YSYAIDLPVSV (TYRP2_HUMAN)
YAYAIDLPVSY

SEQ ID NO: 184532 - protein, 10 aa, Artificial Sequence
  Description of Artificial Sequence: Synthetic peptide
  Seed: QPQFANCSVY (TYRP2_HUMAN)
QIQFANCSVY

SEQ ID NO: 184533 - protein, 11 aa, Artificial Sequence
  Description of Artificial Sequence: Synthetic peptide
  Seed: YTPLMETHLSS (TYRP2_HUMAN)
YIPLMETHLSA

SEQ ID NO: 184534 - protein, 9 aa, Artificial Sequence
  Description of Artificial Sequence: Synthetic peptide
  Seed: FPPVTNEEL (TYRP2_HUMAN)
FFPVTNEEM

SEQ ID NO: 184535 - protein, 9 aa, Artificial Sequence
  Description of Artificial Sequence: Synthetic peptide
  Seed: IGHNRMYNM (TYRP2_HUMAN)
ISHNRMYNY

SEQ ID NO: 184536 - protein, 9 aa, Artificial Sequence
  Description of Artificial Sequence: Synthetic peptide
  Seed: YSYAIDLPV (TYRP2_HUMAN)
YSYAIDLPI

SEQ ID NO: 184537 - protein, 9 aa, Artificial Sequence
  Description of Artificial Sequence: Synthetic peptide
  Seed: SRNSRFSSW (TYRP2_HUMAN)
SINSRFSSY

SEQ ID NO: 184538 - protein, 11 aa, Artificial Sequence
  Description of Artificial Sequence: Synthetic peptide
  Seed: LSLQKFDNPPF (TYRP2_HUMAN)
LMLQKFDNPPY

SEQ ID NO: 184539 - protein, 9 aa, Artificial Sequence
  Description of Artificial Sequence: Synthetic peptide
  Seed: FTDAIFDEW (TYRP2_HUMAN)
FCDAIFDEM

SEQ ID NO: 184540 - protein, 10 aa, Artificial Sequence
  Description of Artificial Sequence: Synthetic peptide
  Seed: MGRNSMKLPT (TYRP2_HUMAN)
MSRNSMKLPS

SEQ ID NO: 184541 - protein, 9 aa, Artificial Sequence
  Description of Artificial Sequence: Synthetic peptide
  Seed: PADAWPQEL (TYRP2_HUMAN)
PWDAWPQEM

SEQ ID NO: 184542 - protein, 9 aa, Artificial Sequence
  Description of Artificial Sequence: Synthetic peptide
  Seed: VWLHYYSVR (TYRP2_HUMAN)
VALHYYSVR

SEQ ID NO: 184543 - protein, 10 aa, Artificial Sequence
  Description of Artificial Sequence: Synthetic peptide
  Seed: SLDDYNHLVT (TYRP2_HUMAN)
SFDDYNHLVM

SEQ ID NO: 184544 - protein, 9 aa, Artificial Sequence
  Description of Artificial Sequence: Synthetic peptide
  Seed: FVLLAFLQY (TYRP2_HUMAN)
FALLAFLQY

SEQ ID NO: 184545 - protein, 11 aa, Artificial Sequence
  Description of Artificial Sequence: Synthetic peptide
  Seed: LLVVMGTLVAL (TYRP2_HUMAN)
LCVVMGTLVAV

SEQ ID NO: 184546 - protein, 11 aa, Artificial Sequence
  Description of Artificial Sequence: Synthetic peptide
  Seed: RADTRPWSGPY (TYRP2_HUMAN)
RTDTRPWSGPA

SEQ ID NO: 184547 - protein, 9 aa, Artificial Sequence
  Description of Artificial Sequence: Synthetic peptide
  Seed: VVMGTLVAL (TYRP2_HUMAN)
VQMGTLVAH

SEQ ID NO: 184548 - protein, 9 aa, Artificial Sequence
  Description of Artificial Sequence: Synthetic peptide
  Seed: YAIDLPVSV (TYRP2_HUMAN)
YMIDLPVSC

SEQ ID NO: 184549 - protein, 10 aa, Artificial Sequence
  Description of Artificial Sequence: Synthetic peptide
  Seed: MSPLWWGFLL (TYRP2_HUMAN)
MAPLWWGFLM

SEQ ID NO: 184550 - protein, 9 aa, Artificial Sequence
  Description of Artificial Sequence: Synthetic peptide
  Seed: VMSLHNLVH (TYRP2_HUMAN)
VESLHNLVY

SEQ ID NO: 184551 - protein, 9 aa, Artificial Sequence
  Description of Artificial Sequence: Synthetic peptide
  Seed: REQFLGALD (TYRP2_HUMAN)
REQFLGALV

SEQ ID NO: 184552 - protein, 10 aa, Artificial Sequence
  Description of Artificial Sequence: Synthetic peptide
  Seed: CMTVDSLVNK (TYRP2_HUMAN)
CCTVDSLVNK

SEQ ID NO: 184553 - protein, 10 aa, Artificial Sequence
  Description of Artificial Sequence: Synthetic peptide
  Seed: FLLSCLGCKI (TYRP2_HUMAN)
FVLSCLGCKI

SEQ ID NO: 184554 - protein, 10 aa, Artificial Sequence
  Description of Artificial Sequence: Synthetic peptide
  Seed: SPLWWGFLLS (TYRP2_HUMAN)
SDLWWGFLLA

SEQ ID NO: 184555 - protein, 9 aa, Artificial Sequence
  Description of Artificial Sequence: Synthetic peptide
  Seed: STFSFRNAL (TYRP2_HUMAN)
SYFSFRNAI

SEQ ID NO: 184556 - protein, 9 aa, Artificial Sequence
  Description of Artificial Sequence: Synthetic peptide
  Seed: LSPQEREQF (TYRP2_HUMAN)
LFPQEREQL

SEQ ID NO: 184557 - protein, 10 aa, Artificial Sequence
  Description of Artificial Sequence: Synthetic peptide
  Seed: RRLRKGYTPL (TYRP2_HUMAN)
RILRKGYTPK

SEQ ID NO: 184558 - protein, 9 aa, Artificial Sequence
  Description of Artificial Sequence: Synthetic peptide
  Seed: VTWHRYHLL (TYRP2_HUMAN)
VLWHRYHLA

SEQ ID NO: 184559 - protein, 10 aa, Artificial Sequence
  Description of Artificial Sequence: Synthetic peptide
  Seed: YNMVPFFPPV (TYRP2_HUMAN)
YWMVPFFPPT

SEQ ID NO: 184560 - protein, 10 aa, Artificial Sequence
  Description of Artificial Sequence: Synthetic peptide
  Seed: SQVMSLHNLV (TYRP2_HUMAN)
SWVMSLHNLV

SEQ ID NO: 184561 - protein, 9 aa, Artificial Sequence
  Description of Artificial Sequence: Synthetic peptide
  Seed: NALEGFDKA (TYRP2_HUMAN)
NLLEGFDKI

SEQ ID NO: 184562 - protein, 10 aa, Artificial Sequence
  Description of Artificial Sequence: Synthetic peptide
  Seed: RRLRKGYTPL (TYRP2_HUMAN)
RTLRKGYTPL

SEQ ID NO: 184563 - protein, 9 aa, Artificial Sequence
  Description of Artificial Sequence: Synthetic peptide
  Seed: ERKKPPVIR (TYRP2_HUMAN)
EVKKPPVIR

SEQ ID NO: 184564 - protein, 9 aa, Artificial Sequence
  Description of Artificial Sequence: Synthetic peptide
  Seed: VTWHRYHLL (TYRP2_HUMAN)
VYWHRYHLY

SEQ ID NO: 184565 - protein, 10 aa, Artificial Sequence
  Description of Artificial Sequence: Synthetic peptide
  Seed: SDQLGYSYAI (TYRP2_HUMAN)
SMQLGYSYAA

SEQ ID NO: 184566 - protein, 9 aa, Artificial Sequence
  Description of Artificial Sequence: Synthetic peptide
  Seed: GPAFVTWHR (TYRP2_HUMAN)
GIAFVTWHR

SEQ ID NO: 184567 - protein, 9 aa, Artificial Sequence
  Description of Artificial Sequence: Synthetic peptide
  Seed: LRKGYTPLM (TYRP2_HUMAN)
LQKGYTPLL

SEQ ID NO: 184568 - protein, 10 aa, Artificial Sequence
  Description of Artificial Sequence: Synthetic peptide
  Seed: RLRKGYTPLM (TYRP2_HUMAN)
RMRKGYTPLF

SEQ ID NO: 184569 - protein, 9 aa, Artificial Sequence
  Description of Artificial Sequence: Synthetic peptide
  Seed: HRYHLLCLE (TYRP2_HUMAN)
HRYHLLCLF

SEQ ID NO: 184570 - protein, 11 aa, Artificial Sequence
  Description of Artificial Sequence: Synthetic peptide
  Seed: HQGPAFVTWHR (TYRP2_HUMAN)
HAGPAFVTWHR

SEQ ID NO: 184571 - protein, 10 aa, Artificial Sequence
  Description of Artificial Sequence: Synthetic peptide
  Seed: HSFLNGTNAL (TYRP2_HUMAN)
HVFLNGTNAM

SEQ ID NO: 184572 - protein, 10 aa, Artificial Sequence
  Description of Artificial Sequence: Synthetic peptide
  Seed: ALVGLFVLLA (TYRP2_HUMAN)
AQVGLFVLLI

SEQ ID NO: 184573 - protein, 9 aa, Artificial Sequence
  Description of Artificial Sequence: Synthetic peptide
  Seed: SLHNLVHSF (TYRP2_HUMAN)
SQHNLVHSL

SEQ ID NO: 184574 - protein, 9 aa, Artificial Sequence
  Description of Artificial Sequence: Synthetic peptide
  Seed: DTRPWSGPY (TYRP2_HUMAN)
DSRPWSGPK

SEQ ID NO: 184575 - protein, 9 aa, Artificial Sequence
  Description of Artificial Sequence: Synthetic peptide
  Seed: GAQGQFPRV (TYRP2_HUMAN)
GQQGQFPRV

SEQ ID NO: 184576 - protein, 9 aa, Artificial Sequence
  Description of Artificial Sequence: Synthetic peptide
  Seed: TLDSQVMSL (TYRP2_HUMAN)
TPDSQVMSM

SEQ ID NO: 184577 - protein, 9 aa, Artificial Sequence
  Description of Artificial Sequence: Synthetic peptide
  Seed: HQGPAFVTW (TYRP2_HUMAN)
HHGPAFVTF

SEQ ID NO: 184578 - protein, 10 aa, Artificial Sequence
  Description of Artificial Sequence: Synthetic peptide
  Seed: RLRKGYTPLM (TYRP2_HUMAN)
RLRKGYTPLF

SEQ ID NO: 184579 - protein, 9 aa, Artificial Sequence
  Description of Artificial Sequence: Synthetic peptide
  Seed: RNQDDRELW (TYRP2_HUMAN)
RQQDDRELF

SEQ ID NO: 184580 - protein, 10 aa, Artificial Sequence
  Description of Artificial Sequence: Synthetic peptide
  Seed: ISRNSRFSSW (TYRP2_HUMAN)
ITRNSRFSSW

SEQ ID NO: 184581 - protein, 10 aa, Artificial Sequence
  Description of Artificial Sequence: Synthetic peptide
  Seed: CMTVDSLVNK (TYRP2_HUMAN)
CWTVDSLVNR

SEQ ID NO: 184582 - protein, 9 aa, Artificial Sequence
  Description of Artificial Sequence: Synthetic peptide
  Seed: SVYDFFVWL (TYRP2_HUMAN)
SIYDFFVWM

SEQ ID NO: 184583 - protein, 11 aa, Artificial Sequence
  Description of Artificial Sequence: Synthetic peptide
  Seed: TQPQFANCSVY (TYRP2_HUMAN)
TTPQFANCSVF

SEQ ID NO: 184584 - protein, 9 aa, Artificial Sequence
  Description of Artificial Sequence: Synthetic peptide
  Seed: TLLGPGRPY (TYRP2_HUMAN)
TQLGPGRPL

SEQ ID NO: 184585 - protein, 8 aa, Artificial Sequence
  Description of Artificial Sequence: Synthetic peptide
  Seed: FSHQGPAF (TYRP2_HUMAN)
FSHQGPAM

SEQ ID NO: 184586 - protein, 9 aa, Artificial Sequence
  Description of Artificial Sequence: Synthetic peptide
  Seed: LVHSFLNGT (TYRP2_HUMAN)
LLHSFLNGA

SEQ ID NO: 184587 - protein, 9 aa, Artificial Sequence
  Description of Artificial Sequence: Synthetic peptide
  Seed: VTNEELFLT (TYRP2_HUMAN)
VVNEELFLM

SEQ ID NO: 184588 - protein, 10 aa, Artificial Sequence
  Description of Artificial Sequence: Synthetic peptide
  Seed: HLVTLCNGTY (TYRP2_HUMAN)
HMVTLCNGTY

SEQ ID NO: 184589 - protein, 9 aa, Artificial Sequence
  Description of Artificial Sequence: Synthetic peptide
  Seed: RLRKGYTPL (TYRP2_HUMAN)
RMRKGYTPE

SEQ ID NO: 184590 - protein, 10 aa, Artificial Sequence
  Description of Artificial Sequence: Synthetic peptide
  Seed: FSFRNALEGF (TYRP2_HUMAN)
FPFRNALEGY

SEQ ID NO: 184591 - protein, 9 aa, Artificial Sequence
  Description of Artificial Sequence: Synthetic peptide
  Seed: YVITTQHWL (TYRP2_HUMAN)
YIITTQHWA

SEQ ID NO: 184592 - protein, 10 aa, Artificial Sequence
  Description of Artificial Sequence: Synthetic peptide
  Seed: RRNQMGRNSM (TYRP2_HUMAN)
RKNQMGRNSF

SEQ ID NO: 184593 - protein, 10 aa, Artificial Sequence
  Description of Artificial Sequence: Synthetic peptide
  Seed: IGNESFALPY (TYRP2_HUMAN)
IKNESFALPM

SEQ ID NO: 184594 - protein, 10 aa, Artificial Sequence
  Description of Artificial Sequence: Synthetic peptide
  Seed: FLNGTNALPH (TYRP2_HUMAN)
FANGTNALPF

SEQ ID NO: 184595 - protein, 9 aa, Artificial Sequence
  Description of Artificial Sequence: Synthetic peptide
  Seed: FTDAIFDEW (TYRP2_HUMAN)
FMDAIFDEW

SEQ ID NO: 184596 - protein, 9 aa, Artificial Sequence
  Description of Artificial Sequence: Synthetic peptide
  Seed: WMKRFNPPA (TYRP2_HUMAN)
WSKRFNPPY

SEQ ID NO: 184597 - protein, 9 aa, Artificial Sequence
  Description of Artificial Sequence: Synthetic peptide
  Seed: RDCLSLQKF (TYRP2_HUMAN)
RSCLSLQKW

SEQ ID NO: 184598 - protein, 10 aa, Artificial Sequence
  Description of Artificial Sequence: Synthetic peptide
  Seed: RVCMTVDSLV (TYRP2_HUMAN)
RMCMTVDSLV

SEQ ID NO: 184599 - protein, 9 aa, Artificial Sequence
  Description of Artificial Sequence: Synthetic peptide
  Seed: ANDPIFVVL (TYRP2_HUMAN)
ALDPIFVVL

SEQ ID NO: 184600 - protein, 9 aa, Artificial Sequence
  Description of Artificial Sequence: Synthetic peptide
  Seed: SQVMSLHNL (TYRP2_HUMAN)
STVMSLHNI

SEQ ID NO: 184601 - protein, 9 aa, Artificial Sequence
  Description of Artificial Sequence: Synthetic peptide
  Seed: YSYAIDLPV (TYRP2_HUMAN)
YFYAIDLPY

SEQ ID NO: 184602 - protein, 10 aa, Artificial Sequence
  Description of Artificial Sequence: Synthetic peptide
  Seed: RMYNMVPFFP (TYRP2_HUMAN)
RQYNMVPFFK

SEQ ID NO: 184603 - protein, 9 aa, Artificial Sequence
  Description of Artificial Sequence: Synthetic peptide
  Seed: YVITTQHWL (TYRP2_HUMAN)
YMITTQHWV

SEQ ID NO: 184604 - protein, 10 aa, Artificial Sequence
  Description of Artificial Sequence: Synthetic peptide
  Seed: ESANVCGSQQ (TYRP2_HUMAN)
ETANVCGSQL

SEQ ID NO: 184605 - protein, 9 aa, Artificial Sequence
  Description of Artificial Sequence: Synthetic peptide
  Seed: LVHSFLNGT (TYRP2_HUMAN)
LMHSFLNGL

SEQ ID NO: 184606 - protein, 10 aa, Artificial Sequence
  Description of Artificial Sequence: Synthetic peptide
  Seed: LAFLQYRRLR (TYRP2_HUMAN)
LIFLQYRRLR

SEQ ID NO: 184607 - protein, 10 aa, Artificial Sequence
  Description of Artificial Sequence: Synthetic peptide
  Seed: RNSRFSSWET (TYRP2_HUMAN)
RVSRFSSWEV

SEQ ID NO: 184608 - protein, 10 aa, Artificial Sequence
  Description of Artificial Sequence: Synthetic peptide
  Seed: FFVWLHYYSV (TYRP2_HUMAN)
FKVWLHYYSV

SEQ ID NO: 184609 - protein, 9 aa, Artificial Sequence
  Description of Artificial Sequence: Synthetic peptide
  Seed: QFPRVCMTV (TYRP2_HUMAN)
QYPRVCMTI

SEQ ID NO: 184610 - protein, 9 aa, Artificial Sequence
  Description of Artificial Sequence: Synthetic peptide
  Seed: RDCLSLQKF (TYRP2_HUMAN)
RQCLSLQKV

SEQ ID NO: 184611 - protein, 10 aa, Artificial Sequence
  Description of Artificial Sequence: Synthetic peptide
  Seed: QPQFANCSVY (TYRP2_HUMAN)
QYQFANCSVW

SEQ ID NO: 184612 - protein, 10 aa, Artificial Sequence
  Description of Artificial Sequence: Synthetic peptide
  Seed: SPLWWGFLLS (TYRP2_HUMAN)
SVLWWGFLLA

SEQ ID NO: 184613 - protein, 10 aa, Artificial Sequence
  Description of Artificial Sequence: Synthetic peptide
  Seed: FSFRNALEGF (TYRP2_HUMAN)
FKFRNALEGY

SEQ ID NO: 184614 - protein, 11 aa, Artificial Sequence
  Description of Artificial Sequence: Synthetic peptide
  Seed: RADTRPWSGPY (TYRP2_HUMAN)
RCDTRPWSGPW

SEQ ID NO: 184615 - protein, 10 aa, Artificial Sequence
  Description of Artificial Sequence: Synthetic peptide
  Seed: FLTSDQLGYS (TYRP2_HUMAN)
FDTSDQLGYV

SEQ ID NO: 184616 - protein, 9 aa, Artificial Sequence
  Description of Artificial Sequence: Synthetic peptide
  Seed: FVWLHYYSV (TYRP2_HUMAN)
FSWLHYYSA

SEQ ID NO: 184617 - protein, 9 aa, Artificial Sequence
  Description of Artificial Sequence: Synthetic peptide
  Seed: DDYNHLVTL (TYRP2_HUMAN)
DSYNHLVTV

SEQ ID NO: 184618 - protein, 9 aa, Artificial Sequence
  Description of Artificial Sequence: Synthetic peptide
  Seed: ADAWPQELA (TYRP2_HUMAN)
AEAWPQELM

SEQ ID NO: 184619 - protein, 9 aa, Artificial Sequence
  Description of Artificial Sequence: Synthetic peptide
  Seed: SVYDFFVWL (TYRP2_HUMAN)
SMYDFFVWV

SEQ ID NO: 184620 - protein, 10 aa, Artificial Sequence
  Description of Artificial Sequence: Synthetic peptide
  Seed: LTSDQLGYSY (TYRP2_HUMAN)
LQSDQLGYSF

SEQ ID NO: 184621 - protein, 9 aa, Artificial Sequence
  Description of Artificial Sequence: Synthetic peptide
  Seed: VVMGTLVAL (TYRP2_HUMAN)
VLMGTLVAA

SEQ ID NO: 184622 - protein, 9 aa, Artificial Sequence
  Description of Artificial Sequence: Synthetic peptide
  Seed: RKFFHRTCK (TYRP2_HUMAN)
RGFFHRTCK

SEQ ID NO: 184623 - protein, 8 aa, Artificial Sequence
  Description of Artificial Sequence: Synthetic peptide
  Seed: AIDLPVSV (TYRP2_HUMAN)
AGDLPVSI

SEQ ID NO: 184624 - protein, 9 aa, Artificial Sequence
  Description of Artificial Sequence: Synthetic peptide
  Seed: VALVGLFVL (TYRP2_HUMAN)
VILVGLFVV

SEQ ID NO: 184625 - protein, 10 aa, Artificial Sequence
  Description of Artificial Sequence: Synthetic peptide
  Seed: LHYYSVRDTL (TYRP2_HUMAN)
LHYYSVRDTF

SEQ ID NO: 184626 - protein, 10 aa, Artificial Sequence
  Description of Artificial Sequence: Synthetic peptide
  Seed: ADTRPWSGPY (TYRP2_HUMAN)
ATTRPWSGPY

SEQ ID NO: 184627 - protein, 9 aa, Artificial Sequence
  Description of Artificial Sequence: Synthetic peptide
  Seed: TLDSQVMSL (TYRP2_HUMAN)
THDSQVMSM

SEQ ID NO: 184628 - protein, 9 aa, Artificial Sequence
  Description of Artificial Sequence: Synthetic peptide
  Seed: AIFDEWMKR (TYRP2_HUMAN)
AQFDEWMKR

SEQ ID NO: 184629 - protein, 9 aa, Artificial Sequence
  Description of Artificial Sequence: Synthetic peptide
  Seed: DAIFDEWMK (TYRP2_HUMAN)
DSIFDEWMK

SEQ ID NO: 184630 - protein, 9 aa, Artificial Sequence
  Description of Artificial Sequence: Synthetic peptide
  Seed: RKFFHRTCK (TYRP2_HUMAN)
RVFFHRTCL

SEQ ID NO: 184631 - protein, 9 aa, Artificial Sequence
  Description of Artificial Sequence: Synthetic peptide
  Seed: ECDVCTDQL (TYRP2_HUMAN)
EFDVCTDQL

SEQ ID NO: 184632 - protein, 9 aa, Artificial Sequence
  Description of Artificial Sequence: Synthetic peptide
  Seed: KDIRDCLSL (TYRP2_HUMAN)
KEIRDCLSA

SEQ ID NO: 184633 - protein, 9 aa, Artificial Sequence
  Description of Artificial Sequence: Synthetic peptide
  Seed: FSHQGPAFV (TYRP2_HUMAN)
FMHQGPAFT

SEQ ID NO: 184634 - protein, 11 aa, Artificial Sequence
  Description of Artificial Sequence: Synthetic peptide
  Seed: ANCSVYDFFVW (TYRP2_HUMAN)
AECSVYDFFVW

SEQ ID NO: 184635 - protein, 10 aa, Artificial Sequence
  Description of Artificial Sequence: Synthetic peptide
  Seed: SLQKFDNPPF (TYRP2_HUMAN)
SVQKFDNPPY

SEQ ID NO: 184636 - protein, 9 aa, Artificial Sequence
  Description of Artificial Sequence: Synthetic peptide
  Seed: RLRKGYTPL (TYRP2_HUMAN)
RSRKGYTPC

SEQ ID NO: 184637 - protein, 9 aa, Artificial Sequence
  Description of Artificial Sequence: Synthetic peptide
  Seed: VLLAFLQYR (TYRP2_HUMAN)
VWLAFLQYR

SEQ ID NO: 184638 - protein, 9 aa, Artificial Sequence
  Description of Artificial Sequence: Synthetic peptide
  Seed: FTDAIFDEW (TYRP2_HUMAN)
FMDAIFDEM

SEQ ID NO: 184639 - protein, 10 aa, Artificial Sequence
  Description of Artificial Sequence: Synthetic peptide
  Seed: RELWPRKFFH (TYRP2_HUMAN)
RFLWPRKFFK

SEQ ID NO: 184640 - protein, 10 aa, Artificial Sequence
  Description of Artificial Sequence: Synthetic peptide
  Seed: SLSPQEREQF (TYRP2_HUMAN)
SSSPQEREQW

SEQ ID NO: 184641 - protein, 11 aa, Artificial Sequence
  Description of Artificial Sequence: Synthetic peptide
  Seed: FSHQGPAFVTW (TYRP2_HUMAN)
FAHQGPAFVTL

SEQ ID NO: 184642 - protein, 10 aa, Artificial Sequence
  Description of Artificial Sequence: Synthetic peptide
  Seed: FSFRNALEGF (TYRP2_HUMAN)
FVFRNALEGW

SEQ ID NO: 184643 - protein, 10 aa, Artificial Sequence
  Description of Artificial Sequence: Synthetic peptide
  Seed: KRFNPPADAW (TYRP2_HUMAN)
KEFNPPADAY

SEQ ID NO: 184644 - protein, 9 aa, Artificial Sequence
  Description of Artificial Sequence: Synthetic peptide
  Seed: VSVEETPGW (TYRP2_HUMAN)
VTVEETPGY

SEQ ID NO: 184645 - protein, 9 aa, Artificial Sequence
  Description of Artificial Sequence: Synthetic peptide
  Seed: YSYAIDLPV (TYRP2_HUMAN)
YQYAIDLPF

SEQ ID NO: 184646 - protein, 9 aa, Artificial Sequence
  Description of Artificial Sequence: Synthetic peptide
  Seed: ETPGWPTTL (TYRP2_HUMAN)
ELPGWPTTL

SEQ ID NO: 184647 - protein, 9 aa, Artificial Sequence
  Description of Artificial Sequence: Synthetic peptide
  Seed: RNSMKLPTL (TYRP2_HUMAN)
RASMKLPTY

SEQ ID NO: 184648 - protein, 9 aa, Artificial Sequence
  Description of Artificial Sequence: Synthetic peptide
  Seed: ALPYWNFAT (TYRP2_HUMAN)
ALPYWNFAA

SEQ ID NO: 184649 - protein, 9 aa, Artificial Sequence
  Description of Artificial Sequence: Synthetic peptide
  Seed: HRYHLLCLE (TYRP2_HUMAN)
HRYHLLCLY

SEQ ID NO: 184650 - protein, 10 aa, Artificial Sequence
  Description of Artificial Sequence: Synthetic peptide
  Seed: SHQGPAFVTW (TYRP2_HUMAN)
SWQGPAFVTM

SEQ ID NO: 184651 - protein, 9 aa, Artificial Sequence
  Description of Artificial Sequence: Synthetic peptide
  Seed: LQKFDNPPF (TYRP2_HUMAN)
LEKFDNPPF

SEQ ID NO: 184652 - protein, 9 aa, Artificial Sequence
  Description of Artificial Sequence: Synthetic peptide
  Seed: SLHNLVHSF (TYRP2_HUMAN)
SPHNLVHSF

SEQ ID NO: 184653 - protein, 10 aa, Artificial Sequence
  Description of Artificial Sequence: Synthetic peptide
  Seed: HRYHLLCLER (TYRP2_HUMAN)
HTYHLLCLER

SEQ ID NO: 184654 - protein, 10 aa, Artificial Sequence
  Description of Artificial Sequence: Synthetic peptide
  Seed: FPPVTNEELF (TYRP2_HUMAN)
FRPVTNEELW

SEQ ID NO: 184655 - protein, 9 aa, Artificial Sequence
  Description of Artificial Sequence: Synthetic peptide
  Seed: LVTLCNGTY (TYRP2_HUMAN)
LSTLCNGTF

SEQ ID NO: 184656 - protein, 8 aa, Artificial Sequence
  Description of Artificial Sequence: Synthetic peptide
  Seed: QFANCSVY (TYRP2_HUMAN)
QMANCSVY

SEQ ID NO: 184657 - protein, 10 aa, Artificial Sequence
  Description of Artificial Sequence: Synthetic peptide
  Seed: TQPQFANCSV (TYRP2_HUMAN)
TEPQFANCSL

SEQ ID NO: 184658 - protein, 9 aa, Artificial Sequence
  Description of Artificial Sequence: Synthetic peptide
  Seed: VLLAFLQYR (TYRP2_HUMAN)
VVLAFLQYK

SEQ ID NO: 184659 - protein, 10 aa, Artificial Sequence
  Description of Artificial Sequence: Synthetic peptide
  Seed: NSTFSFRNAL (TYRP2_HUMAN)
NNTFSFRNAL

SEQ ID NO: 184660 - protein, 9 aa, Artificial Sequence
  Description of Artificial Sequence: Synthetic peptide
  Seed: TSDQLGYSY (TYRP2_HUMAN)
TIDQLGYSV

SEQ ID NO: 184661 - protein, 9 aa, Artificial Sequence
  Description of Artificial Sequence: Synthetic peptide
  Seed: ANCSVYDFF (TYRP2_HUMAN)
AQCSVYDFF

SEQ ID NO: 184662 - protein, 9 aa, Artificial Sequence
  Description of Artificial Sequence: Synthetic peptide
  Seed: VVMGTLVAL (TYRP2_HUMAN)
VAMGTLVAY

SEQ ID NO: 184663 - protein, 9 aa, Artificial Sequence
  Description of Artificial Sequence: Synthetic peptide
  Seed: AARPDDPTL (TYRP2_HUMAN)
AMRPDDPTV

SEQ ID NO: 184664 - protein, 9 aa, Artificial Sequence
  Description of Artificial Sequence: Synthetic peptide
  Seed: RKFFHRTCK (TYRP2_HUMAN)
RIFFHRTCK

SEQ ID NO: 184665 - protein, 10 aa, Artificial Sequence
  Description of Artificial Sequence: Synthetic peptide
  Seed: DVCTDQLFGA (TYRP2_HUMAN)
DTCTDQLFGV

SEQ ID NO: 184666 - protein, 10 aa, Artificial Sequence
  Description of Artificial Sequence: Synthetic peptide
  Seed: YAIDLPVSVE (TYRP2_HUMAN)
YLIDLPVSVC

SEQ ID NO: 184667 - protein, 10 aa, Artificial Sequence
  Description of Artificial Sequence: Synthetic peptide
  Seed: YNMVPFFPPV (TYRP2_HUMAN)
YSMVPFFPPT

SEQ ID NO: 184668 - protein, 10 aa, Artificial Sequence
  Description of Artificial Sequence: Synthetic peptide
  Seed: TRPWSGPYIL (TYRP2_HUMAN)
TYPWSGPYIF

SEQ ID NO: 184669 - protein, 9 aa, Artificial Sequence
  Description of Artificial Sequence: Synthetic peptide
  Seed: YSVRDTLLG (TYRP2_HUMAN)
YCVRDTLLW

SEQ ID NO: 184670 - protein, 10 aa, Artificial Sequence
  Description of Artificial Sequence: Synthetic peptide
  Seed: LPHSAANDPI (TYRP2_HUMAN)
LPHSAANDPA

SEQ ID NO: 184671 - protein, 10 aa, Artificial Sequence
  Description of Artificial Sequence: Synthetic peptide
  Seed: RLRKGYTPLM (TYRP2_HUMAN)
RPRKGYTPLP

SEQ ID NO: 184672 - protein, 9 aa, Artificial Sequence
  Description of Artificial Sequence: Synthetic peptide
  Seed: STFSFRNAL (TYRP2_HUMAN)
SLFSFRNAA

SEQ ID NO: 184673 - protein, 9 aa, Artificial Sequence
  Description of Artificial Sequence: Synthetic peptide
  Seed: TLLGPGRPY (TYRP2_HUMAN)
TALGPGRPF

SEQ ID NO: 184674 - protein, 8 aa, Artificial Sequence
  Description of Artificial Sequence: Synthetic peptide
  Seed: KFDNPPFF (TYRP2_HUMAN)
KVDNPPFV

SEQ ID NO: 184675 - protein, 9 aa, Artificial Sequence
  Description of Artificial Sequence: Synthetic peptide
  Seed: RYHLLCLER (TYRP2_HUMAN)
RFHLLCLER

SEQ ID NO: 184676 - protein, 9 aa, Artificial Sequence
  Description of Artificial Sequence: Synthetic peptide
  Seed: FFQNSTFSF (TYRP2_HUMAN)
FAQNSTFSH

SEQ ID NO: 184677 - protein, 9 aa, Artificial Sequence
  Description of Artificial Sequence: Synthetic peptide
  Seed: ILPGAQGQF (TYRP2_HUMAN)
ISPGAQGQL

SEQ ID NO: 184678 - protein, 10 aa, Artificial Sequence
  Description of Artificial Sequence: Synthetic peptide
  Seed: ELAPIGHNRM (TYRP2_HUMAN)
EIAPIGHNRR

SEQ ID NO: 184679 - protein, 10 aa, Artificial Sequence
  Description of Artificial Sequence: Synthetic peptide
  Seed: LHYYSVRDTL (TYRP2_HUMAN)
LYYYSVRDTF

SEQ ID NO: 184680 - protein, 9 aa, Artificial Sequence
  Description of Artificial Sequence: Synthetic peptide
  Seed: YDFFVWLHY (TYRP2_HUMAN)
YIFFVWLHY

SEQ ID NO: 184681 - protein, 9 aa, Artificial Sequence
  Description of Artificial Sequence: Synthetic peptide
  Seed: YAIDLPVSV (TYRP2_HUMAN)
YPIDLPVSI

SEQ ID NO: 184682 - protein, 10 aa, Artificial Sequence
  Description of Artificial Sequence: Synthetic peptide
  Seed: SSWETVCDSL (TYRP2_HUMAN)
SMWETVCDSV

SEQ ID NO: 184683 - protein, 10 aa, Artificial Sequence
  Description of Artificial Sequence: Synthetic peptide
  Seed: LPGAQGQFPR (TYRP2_HUMAN)
LYGAQGQFPR

SEQ ID NO: 184684 - protein, 9 aa, Artificial Sequence
  Description of Artificial Sequence: Synthetic peptide
  Seed: GNESFALPY (TYRP2_HUMAN)
GKESFALPM

SEQ ID NO: 184685 - protein, 9 aa, Artificial Sequence
  Description of Artificial Sequence: Synthetic peptide
  Seed: VIRQNIHSL (TYRP2_HUMAN)
VWRQNIHSF

SEQ ID NO: 184686 - protein, 10 aa, Artificial Sequence
  Description of Artificial Sequence: Synthetic peptide
  Seed: QEREQFLGAL (TYRP2_HUMAN)
QEREQFLGAW

SEQ ID NO: 184687 - protein, 11 aa, Artificial Sequence
  Description of Artificial Sequence: Synthetic peptide
  Seed: RELWPRKFFHR (TYRP2_HUMAN)
RALWPRKFFHK

SEQ ID NO: 184688 - protein, 10 aa, Artificial Sequence
  Description of Artificial Sequence: Synthetic peptide
  Seed: YDFFVWLHYY (TYRP2_HUMAN)
YMFFVWLHYT

SEQ ID NO: 184689 - protein, 11 aa, Artificial Sequence
  Description of Artificial Sequence: Synthetic peptide
  Seed: QPQFANCSVYD (TYRP2_HUMAN)
QHQFANCSVYY

SEQ ID NO: 184690 - protein, 10 aa, Artificial Sequence
  Description of Artificial Sequence: Synthetic peptide
  Seed: SAANDPIFVV (TYRP2_HUMAN)
SVANDPIFVL

SEQ ID NO: 184691 - protein, 10 aa, Artificial Sequence
  Description of Artificial Sequence: Synthetic peptide
  Seed: FLLSCLGCKI (TYRP2_HUMAN)
FDLSCLGCKL

SEQ ID NO: 184692 - protein, 11 aa, Artificial Sequence
  Description of Artificial Sequence: Synthetic peptide
  Seed: SVYDFFVWLHY (TYRP2_HUMAN)
SSYDFFVWLHY

SEQ ID NO: 184693 - protein, 9 aa, Artificial Sequence
  Description of Artificial Sequence: Synthetic peptide
  Seed: RLRKGYTPL (TYRP2_HUMAN)
RTRKGYTPD

SEQ ID NO: 184694 - protein, 9 aa, Artificial Sequence
  Description of Artificial Sequence: Synthetic peptide
  Seed: YSYAIDLPV (TYRP2_HUMAN)
YYYAIDLPA

SEQ ID NO: 184695 - protein, 9 aa, Artificial Sequence
  Description of Artificial Sequence: Synthetic peptide
  Seed: GTYEGLLRR (TYRP2_HUMAN)
GLYEGLLRK

SEQ ID NO: 184696 - protein, 9 aa, Artificial Sequence
  Description of Artificial Sequence: Synthetic peptide
  Seed: QVMSLHNLV (TYRP2_HUMAN)
QVMSLHNLK

SEQ ID NO: 184697 - protein, 9 aa, Artificial Sequence
  Description of Artificial Sequence: Synthetic peptide
  Seed: YDFFVWLHY (TYRP2_HUMAN)
YFFFVWLHY

SEQ ID NO: 184698 - protein, 10 aa, Artificial Sequence
  Description of Artificial Sequence: Synthetic peptide
  Seed: AANDPIFVVL (TYRP2_HUMAN)
AQNDPIFVVL

SEQ ID NO: 184699 - protein, 11 aa, Artificial Sequence
  Description of Artificial Sequence: Synthetic peptide
  Seed: HPDYVITTQHW (TYRP2_HUMAN)
HDDYVITTQHF

SEQ ID NO: 184700 - protein, 11 aa, Artificial Sequence
  Description of Artificial Sequence: Synthetic peptide
  Seed: WLHYYSVRDTL (TYRP2_HUMAN)
WPHYYSVRDTW

SEQ ID NO: 184701 - protein, 9 aa, Artificial Sequence
  Description of Artificial Sequence: Synthetic peptide
  Seed: NMVPFFPPV (TYRP2_HUMAN)
NTVPFFPPY

SEQ ID NO: 184702 - protein, 9 aa, Artificial Sequence
  Description of Artificial Sequence: Synthetic peptide
  Seed: TLDSQVMSL (TYRP2_HUMAN)
THDSQVMSF

SEQ ID NO: 184703 - protein, 9 aa, Artificial Sequence
  Description of Artificial Sequence: Synthetic peptide
  Seed: SLHNLVHSF (TYRP2_HUMAN)
SWHNLVHSF

SEQ ID NO: 184704 - protein, 9 aa, Artificial Sequence
  Description of Artificial Sequence: Synthetic peptide
  Seed: KRFNPPADA (TYRP2_HUMAN)
KYFNPPADF

SEQ ID NO: 184705 - protein, 11 aa, Artificial Sequence
  Description of Artificial Sequence: Synthetic peptide
  Seed: YRRLRKGYTPL (TYRP2_HUMAN)
YVRLRKGYTPL

SEQ ID NO: 184706 - protein, 10 aa, Artificial Sequence
  Description of Artificial Sequence: Synthetic peptide
  Seed: LHYYSVRDTL (TYRP2_HUMAN)
LQYYSVRDTW

SEQ ID NO: 184707 - protein, 9 aa, Artificial Sequence
  Description of Artificial Sequence: Synthetic peptide
  Seed: AQGQFPRVC (TYRP2_HUMAN)
AEGQFPRVV

SEQ ID NO: 184708 - protein, 9 aa, Artificial Sequence
  Description of Artificial Sequence: Synthetic peptide
  Seed: DAWPQELAP (TYRP2_HUMAN)
DAWPQELAI

SEQ ID NO: 184709 - protein, 10 aa, Artificial Sequence
  Description of Artificial Sequence: Synthetic peptide
  Seed: HNRMYNMVPF (TYRP2_HUMAN)
HDRMYNMVPL

SEQ ID NO: 184710 - protein, 11 aa, Artificial Sequence
  Description of Artificial Sequence: Synthetic peptide
  Seed: WLHYYSVRDTL (TYRP2_HUMAN)
WVHYYSVRDTW

SEQ ID NO: 184711 - protein, 10 aa, Artificial Sequence
  Description of Artificial Sequence: Synthetic peptide
  Seed: FPPVTNEELF (TYRP2_HUMAN)
FVPVTNEELY

SEQ ID NO: 184712 - protein, 9 aa, Artificial Sequence
  Description of Artificial Sequence: Synthetic peptide
  Seed: FFPPVTNEE (TYRP2_HUMAN)
FFPPVTNEM

SEQ ID NO: 184713 - protein, 9 aa, Artificial Sequence
  Description of Artificial Sequence: Synthetic peptide
  Seed: DDYNHLVTL (TYRP2_HUMAN)
DRYNHLVTC

SEQ ID NO: 184714 - protein, 11 aa, Artificial Sequence
  Description of Artificial Sequence: Synthetic peptide
  Seed: HPDYVITTQHW (TYRP2_HUMAN)
HQDYVITTQHF

SEQ ID NO: 184715 - protein, 9 aa, Artificial Sequence
  Description of Artificial Sequence: Synthetic peptide
  Seed: GTYEGLLRR (TYRP2_HUMAN)
GMYEGLLRK

SEQ ID NO: 184716 - protein, 11 aa, Artificial Sequence
  Description of Artificial Sequence: Synthetic peptide
  Seed: QPQFANCSVYD (TYRP2_HUMAN)
QMQFANCSVYY

SEQ ID NO: 184717 - protein, 9 aa, Artificial Sequence
  Description of Artificial Sequence: Synthetic peptide
  Seed: FTDAIFDEW (TYRP2_HUMAN)
FMDAIFDEY

SEQ ID NO: 184718 - protein, 9 aa, Artificial Sequence
  Description of Artificial Sequence: Synthetic peptide
  Seed: RLRKGYTPL (TYRP2_HUMAN)
RVRKGYTPA

SEQ ID NO: 184719 - protein, 11 aa, Artificial Sequence
  Description of Artificial Sequence: Synthetic peptide
  Seed: RRNQMGRNSMK (TYRP2_HUMAN)
RYNQMGRNSMR

SEQ ID NO: 184720 - protein, 9 aa, Artificial Sequence
  Description of Artificial Sequence: Synthetic peptide
  Seed: GFDKADGTL (TYRP2_HUMAN)
GWDKADGTL

SEQ ID NO: 184721 - protein, 9 aa, Artificial Sequence
  Description of Artificial Sequence: Synthetic peptide
  Seed: AIFDEWMKR (TYRP2_HUMAN)
ASFDEWMKR

SEQ ID NO: 184722 - protein, 10 aa, Artificial Sequence
  Description of Artificial Sequence: Synthetic peptide
  Seed: KRFNPPADAW (TYRP2_HUMAN)
KLFNPPADAF

SEQ ID NO: 184723 - protein, 10 aa, Artificial Sequence
  Description of Artificial Sequence: Synthetic peptide
  Seed: MSPLWWGFLL (TYRP2_HUMAN)
MQPLWWGFLY

SEQ ID NO: 184724 - protein, 11 aa, Artificial Sequence
  Description of Artificial Sequence: Synthetic peptide
  Seed: MYNMVPFFPPV (TYRP2_HUMAN)
MINMVPFFPPL

SEQ ID NO: 184725 - protein, 10 aa, Artificial Sequence
  Description of Artificial Sequence: Synthetic peptide
  Seed: QPQFANCSVY (TYRP2_HUMAN)
QYQFANCSVL

SEQ ID NO: 184726 - protein, 10 aa, Artificial Sequence
  Description of Artificial Sequence: Synthetic peptide
  Seed: SDQLGYSYAI (TYRP2_HUMAN)
SCQLGYSYAY

SEQ ID NO: 184727 - protein, 9 aa, Artificial Sequence
  Description of Artificial Sequence: Synthetic peptide
  Seed: SRNSRFSSW (TYRP2_HUMAN)
SENSRFSSF

SEQ ID NO: 184728 - protein, 10 aa, Artificial Sequence
  Description of Artificial Sequence: Synthetic peptide
  Seed: HYYSVRDTLL (TYRP2_HUMAN)
HWYSVRDTLF

SEQ ID NO: 184729 - protein, 9 aa, Artificial Sequence
  Description of Artificial Sequence: Synthetic peptide
  Seed: STFSFRNAL (TYRP2_HUMAN)
SYFSFRNAL

SEQ ID NO: 184730 - protein, 11 aa, Artificial Sequence
  Description of Artificial Sequence: Synthetic peptide
  Seed: SLDDYNHLVTL (TYRP2_HUMAN)
STDDYNHLVTV

SEQ ID NO: 184731 - protein, 9 aa, Artificial Sequence
  Description of Artificial Sequence: Synthetic peptide
  Seed: NMVPFFPPV (TYRP2_HUMAN)
NTVPFFPPT

SEQ ID NO: 184732 - protein, 10 aa, Artificial Sequence
  Description of Artificial Sequence: Synthetic peptide
  Seed: HLVTLCNGTY (TYRP2_HUMAN)
HKVTLCNGTF

SEQ ID NO: 184733 - protein, 9 aa, Artificial Sequence
  Description of Artificial Sequence: Synthetic peptide
  Seed: SLHNLVHSF (TYRP2_HUMAN)
SLHNLVHSY

SEQ ID NO: 184734 - protein, 10 aa, Artificial Sequence
  Description of Artificial Sequence: Synthetic peptide
  Seed: RPWSGPYILR (TYRP2_HUMAN)
RSWSGPYILR

SEQ ID NO: 184735 - protein, 10 aa, Artificial Sequence
  Description of Artificial Sequence: Synthetic peptide
  Seed: RRLRKGYTPL (TYRP2_HUMAN)
RTLRKGYTPM

SEQ ID NO: 184736 - protein, 10 aa, Artificial Sequence
  Description of Artificial Sequence: Synthetic peptide
  Seed: NPPFFQNSTF (TYRP2_HUMAN)
NFPFFQNSTW

SEQ ID NO: 184737 - protein, 10 aa, Artificial Sequence
  Description of Artificial Sequence: Synthetic peptide
  Seed: SLQKFDNPPF (TYRP2_HUMAN)
SLQKFDNPPY

SEQ ID NO: 184738 - protein, 11 aa, Artificial Sequence
  Description of Artificial Sequence: Synthetic peptide
  Seed: YTPLMETHLSS (TYRP2_HUMAN)
YVPLMETHLSM

SEQ ID NO: 184739 - protein, 11 aa, Artificial Sequence
  Description of Artificial Sequence: Synthetic peptide
  Seed: FFPPVTNEELF (TYRP2_HUMAN)
FRPPVTNEELW

SEQ ID NO: 184740 - protein, 9 aa, Artificial Sequence
  Description of Artificial Sequence: Synthetic peptide
  Seed: TLLGPGRPY (TYRP2_HUMAN)
TWLGPGRPL

SEQ ID NO: 184741 - protein, 9 aa, Artificial Sequence
  Description of Artificial Sequence: Synthetic peptide
  Seed: FFQNSTFSF (TYRP2_HUMAN)
FLQNSTFSM

SEQ ID NO: 184742 - protein, 11 aa, Artificial Sequence
  Description of Artificial Sequence: Synthetic peptide
  Seed: YTPLMETHLSS (TYRP2_HUMAN)
YMPLMETHLSL

SEQ ID NO: 184743 - protein, 10 aa, Artificial Sequence
  Description of Artificial Sequence: Synthetic peptide
  Seed: IDFSHQGPAF (TYRP2_HUMAN)
ISFSHQGPAY

SEQ ID NO: 184744 - protein, 9 aa, Artificial Sequence
  Description of Artificial Sequence: Synthetic peptide
  Seed: WMKRFNPPA (TYRP2_HUMAN)
WVKRFNPPY

SEQ ID NO: 184745 - protein, 9 aa, Artificial Sequence
  Description of Artificial Sequence: Synthetic peptide
  Seed: RAIDFSHQG (TYRP2_HUMAN)
RGIDFSHQY

SEQ ID NO: 184746 - protein, 10 aa, Artificial Sequence
  Description of Artificial Sequence: Synthetic peptide
  Seed: TPGWPTTLLV (TYRP2_HUMAN)
TPGWPTTLLA

SEQ ID NO: 184747 - protein, 9 aa, Artificial Sequence
  Description of Artificial Sequence: Synthetic peptide
  Seed: AWPQELAPI (TYRP2_HUMAN)
AYPQELAPI

SEQ ID NO: 184748 - protein, 9 aa, Artificial Sequence
  Description of Artificial Sequence: Synthetic peptide
  Seed: DDYNHLVTL (TYRP2_HUMAN)
DFYNHLVTY

SEQ ID NO: 184749 - protein, 10 aa, Artificial Sequence
  Description of Artificial Sequence: Synthetic peptide
  Seed: FLLSCLGCKI (TYRP2_HUMAN)
FMLSCLGCKM

SEQ ID NO: 184750 - protein, 11 aa, Artificial Sequence
  Description of Artificial Sequence: Synthetic peptide
  Seed: RNSRFSSWETV (TYRP2_HUMAN)
RRSRFSSWETR

SEQ ID NO: 184751 - protein, 11 aa, Artificial Sequence
  Description of Artificial Sequence: Synthetic peptide
  Seed: YNMVPFFPPVT (TYRP2_HUMAN)
YVMVPFFPPVE

SEQ ID NO: 184752 - protein, 9 aa, Artificial Sequence
  Description of Artificial Sequence: Synthetic peptide
  Seed: FFQNSTFSF (TYRP2_HUMAN)
FPQNSTFSM

SEQ ID NO: 184753 - protein, 10 aa, Artificial Sequence
  Description of Artificial Sequence: Synthetic peptide
  Seed: SPLWWGFLLS (TYRP2_HUMAN)
SELWWGFLLI

SEQ ID NO: 184754 - protein, 9 aa, Artificial Sequence
  Description of Artificial Sequence: Synthetic peptide
  Seed: AIFDEWMKR (TYRP2_HUMAN)
ALFDEWMKR

SEQ ID NO: 184755 - protein, 9 aa, Artificial Sequence
  Description of Artificial Sequence: Synthetic peptide
  Seed: SLHNLVHSF (TYRP2_HUMAN)
SAHNLVHSW

SEQ ID NO: 184756 - protein, 9 aa, Artificial Sequence
  Description of Artificial Sequence: Synthetic peptide
  Seed: LWPRKFFHR (TYRP2_HUMAN)
LLPRKFFHR

SEQ ID NO: 184757 - protein, 9 aa, Artificial Sequence
  Description of Artificial Sequence: Synthetic peptide
  Seed: LLSCLGCKI (TYRP2_HUMAN)
LLSCLGCKV

SEQ ID NO: 184758 - protein, 9 aa, Artificial Sequence
  Description of Artificial Sequence: Synthetic peptide
  Seed: AARPDDPTL (TYRP2_HUMAN)
AVRPDDPTY

SEQ ID NO: 184759 - protein, 10 aa, Artificial Sequence
  Description of Artificial Sequence: Synthetic peptide
  Seed: FLLSCLGCKI (TYRP2_HUMAN)
FYLSCLGCKV

SEQ ID NO: 184760 - protein, 11 aa, Artificial Sequence
  Description of Artificial Sequence: Synthetic peptide
  Seed: VCMTVDSLVNK (TYRP2_HUMAN)
VVMTVDSLVNR

SEQ ID NO: 184761 - protein, 9 aa, Artificial Sequence
  Description of Artificial Sequence: Synthetic peptide
  Seed: SFRNALEGF (TYRP2_HUMAN)
SSRNALEGY

SEQ ID NO: 184762 - protein, 10 aa, Artificial Sequence
  Description of Artificial Sequence: Synthetic peptide
  Seed: FPPVTNEELF (TYRP2_HUMAN)
FNPVTNEELF

SEQ ID NO: 184763 - protein, 10 aa, Artificial Sequence
  Description of Artificial Sequence: Synthetic peptide
  Seed: SDQLGYSYAI (TYRP2_HUMAN)
SRQLGYSYAM

SEQ ID NO: 184764 - protein, 11 aa, Artificial Sequence
  Description of Artificial Sequence: Synthetic peptide
  Seed: YTPLMETHLSS (TYRP2_HUMAN)
YVPLMETHLSA

SEQ ID NO: 184765 - protein, 9 aa, Artificial Sequence
  Description of Artificial Sequence: Synthetic peptide
  Seed: SFLNGTNAL (TYRP2_HUMAN)
SLLNGTNAY

SEQ ID NO: 184766 - protein, 8 aa, Artificial Sequence
  Description of Artificial Sequence: Synthetic peptide
  Seed: LHNLVHSF (TYRP2_HUMAN)
LQNLVHSY

SEQ ID NO: 184767 - protein, 9 aa, Artificial Sequence
  Description of Artificial Sequence: Synthetic peptide
  Seed: YAIDLPVSV (TYRP2_HUMAN)
YNIDLPVSI

SEQ ID NO: 184768 - protein, 10 aa, Artificial Sequence
  Description of Artificial Sequence: Synthetic peptide
  Seed: RLRKGYTPLM (TYRP2_HUMAN)
RQRKGYTPLF

SEQ ID NO: 184769 - protein, 10 aa, Artificial Sequence
  Description of Artificial Sequence: Synthetic peptide
  Seed: RNSMKLPTLK (TYRP2_HUMAN)
RISMKLPTLR

SEQ ID NO: 184770 - protein, 11 aa, Artificial Sequence
  Description of Artificial Sequence: Synthetic peptide
  Seed: RELWPRKFFHR (TYRP2_HUMAN)
RRLWPRKFFHR

SEQ ID NO: 184771 - protein, 11 aa, Artificial Sequence
  Description of Artificial Sequence: Synthetic peptide
  Seed: YSYAIDLPVSV (TYRP2_HUMAN)
YMYAIDLPVSI

SEQ ID NO: 184772 - protein, 9 aa, Artificial Sequence
  Description of Artificial Sequence: Synthetic peptide
  Seed: AARPDDPTL (TYRP2_HUMAN)
AFRPDDPTF

SEQ ID NO: 184773 - protein, 9 aa, Artificial Sequence
  Description of Artificial Sequence: Synthetic peptide
  Seed: RLRKGYTPL (TYRP2_HUMAN)
RFRKGYTPF

SEQ ID NO: 184774 - protein, 10 aa, Artificial Sequence
  Description of Artificial Sequence: Synthetic peptide
  Seed: MSPLWWGFLL (TYRP2_HUMAN)
MLPLWWGFLV

SEQ ID NO: 184775 - protein, 9 aa, Artificial Sequence
  Description of Artificial Sequence: Synthetic peptide
  Seed: PADAWPQEL (TYRP2_HUMAN)
PTDAWPQEM

SEQ ID NO: 184776 - protein, 8 aa, Artificial Sequence
  Description of Artificial Sequence: Synthetic peptide
  Seed: MGTLVALV (TYRP2_HUMAN)
MQTLVALI

SEQ ID NO: 184777 - protein, 9 aa, Artificial Sequence
  Description of Artificial Sequence: Synthetic peptide
  Seed: NVCGSQQGR (TYRP2_HUMAN)
NTCGSQQGR

SEQ ID NO: 184778 - protein, 9 aa, Artificial Sequence
  Description of Artificial Sequence: Synthetic peptide
  Seed: GFDKADGTL (TYRP2_HUMAN)
GFDKADGTV

SEQ ID NO: 184779 - protein, 9 aa, Artificial Sequence
  Description of Artificial Sequence: Synthetic peptide
  Seed: DIRDCLSLQ (TYRP2_HUMAN)
DLRDCLSLK

SEQ ID NO: 184780 - protein, 9 aa, Artificial Sequence
  Description of Artificial Sequence: Synthetic peptide
  Seed: YAIDLPVSV (TYRP2_HUMAN)
YRIDLPVSW

SEQ ID NO: 184781 - protein, 10 aa, Artificial Sequence
  Description of Artificial Sequence: Synthetic peptide
  Seed: QPQFANCSVY (TYRP2_HUMAN)
QQQFANCSVF

SEQ ID NO: 184782 - protein, 9 aa, Artificial Sequence
  Description of Artificial Sequence: Synthetic peptide
  Seed: HSAANDPIF (TYRP2_HUMAN)
HVAANDPIW

SEQ ID NO: 184783 - protein, 9 aa, Artificial Sequence
  Description of Artificial Sequence: Synthetic peptide
  Seed: YSYAIDLPV (TYRP2_HUMAN)
YEYAIDLPH

SEQ ID NO: 184784 - protein, 9 aa, Artificial Sequence
  Description of Artificial Sequence: Synthetic peptide
  Seed: YVITTQHWL (TYRP2_HUMAN)
YLITTQHWV

SEQ ID NO: 184785 - protein, 11 aa, Artificial Sequence
  Description of Artificial Sequence: Synthetic peptide
  Seed: ELAPIGHNRMY (TYRP2_HUMAN)
EVAPIGHNRMF

SEQ ID NO: 184786 - protein, 10 aa, Artificial Sequence
  Description of Artificial Sequence: Synthetic peptide
  Seed: SLHNLVHSFL (TYRP2_HUMAN)
SVHNLVHSFI

SEQ ID NO: 184787 - protein, 10 aa, Artificial Sequence
  Description of Artificial Sequence: Synthetic peptide
  Seed: RLRKGYTPLM (TYRP2_HUMAN)
RVRKGYTPLT

SEQ ID NO: 184788 - protein, 9 aa, Artificial Sequence
  Description of Artificial Sequence: Synthetic peptide
  Seed: FVWLHYYSV (TYRP2_HUMAN)
FMWLHYYSC

SEQ ID NO: 184789 - protein, 9 aa, Artificial Sequence
  Description of Artificial Sequence: Synthetic peptide
  Seed: RAIDFSHQG (TYRP2_HUMAN)
RAIDFSHQV

SEQ ID NO: 184790 - protein, 9 aa, Artificial Sequence
  Description of Artificial Sequence: Synthetic peptide
  Seed: FFQNSTFSF (TYRP2_HUMAN)
FIQNSTFSY

SEQ ID NO: 184791 - protein, 10 aa, Artificial Sequence
  Description of Artificial Sequence: Synthetic peptide
  Seed: LLAFLQYRRL (TYRP2_HUMAN)
LMAFLQYRRL

SEQ ID NO: 184792 - protein, 8 aa, Artificial Sequence
  Description of Artificial Sequence: Synthetic peptide
  Seed: FPRVCMTV (TYRP2_HUMAN)
FPRVCMTA

SEQ ID NO: 184793 - protein, 10 aa, Artificial Sequence
  Description of Artificial Sequence: Synthetic peptide
  Seed: ELWPRKFFHR (TYRP2_HUMAN)
ETWPRKFFHK

SEQ ID NO: 184794 - protein, 10 aa, Artificial Sequence
  Description of Artificial Sequence: Synthetic peptide
  Seed: QGPAFVTWHR (TYRP2_HUMAN)
QLPAFVTWHK

SEQ ID NO: 184795 - protein, 9 aa, Artificial Sequence
  Description of Artificial Sequence: Synthetic peptide
  Seed: MTVDSLVNK (TYRP2_HUMAN)
MMVDSLVNK

SEQ ID NO: 184796 - protein, 10 aa, Artificial Sequence
  Description of Artificial Sequence: Synthetic peptide
  Seed: GNESFALPYW (TYRP2_HUMAN)
GSESFALPYW

SEQ ID NO: 184797 - protein, 10 aa, Artificial Sequence
  Description of Artificial Sequence: Synthetic peptide
  Seed: GNESFALPYW (TYRP2_HUMAN)
GVESFALPYW

SEQ ID NO: 184798 - protein, 10 aa, Artificial Sequence
  Description of Artificial Sequence: Synthetic peptide
  Seed: FFQNSTFSFR (TYRP2_HUMAN)
FQQNSTFSFK

SEQ ID NO: 184799 - protein, 10 aa, Artificial Sequence
  Description of Artificial Sequence: Synthetic peptide
  Seed: IGNESFALPY (TYRP2_HUMAN)
ILNESFALPY

SEQ ID NO: 184800 - protein, 8 aa, Artificial Sequence
  Description of Artificial Sequence: Synthetic peptide
  Seed: RPDDPTLI (TYRP2_HUMAN)
RFDDPTLM

SEQ ID NO: 184801 - protein, 10 aa, Artificial Sequence
  Description of Artificial Sequence: Synthetic peptide
  Seed: RELWPRKFFH (TYRP2_HUMAN)
RWLWPRKFFR

SEQ ID NO: 184802 - protein, 9 aa, Artificial Sequence
  Description of Artificial Sequence: Synthetic peptide
  Seed: VGLFVLLAF (TYRP2_HUMAN)
VSLFVLLAL

SEQ ID NO: 184803 - protein, 9 aa, Artificial Sequence
  Description of Artificial Sequence: Synthetic peptide
  Seed: PADAWPQEL (TYRP2_HUMAN)
PLDAWPQEL

SEQ ID NO: 184804 - protein, 9 aa, Artificial Sequence
  Description of Artificial Sequence: Synthetic peptide
  Seed: FTDAIFDEW (TYRP2_HUMAN)
FADAIFDEM

SEQ ID NO: 184805 - protein, 10 aa, Artificial Sequence
  Description of Artificial Sequence: Synthetic peptide
  Seed: NCSVYDFFVW (TYRP2_HUMAN)
NRSVYDFFVW

SEQ ID NO: 184806 - protein, 11 aa, Artificial Sequence
  Description of Artificial Sequence: Synthetic peptide
  Seed: ESFALPYWNFA (TYRP2_HUMAN)
ETFALPYWNFV

SEQ ID NO: 184807 - protein, 9 aa, Artificial Sequence
  Description of Artificial Sequence: Synthetic peptide
  Seed: FSHQGPAFV (TYRP2_HUMAN)
FVHQGPAFF

SEQ ID NO: 184808 - protein, 9 aa, Artificial Sequence
  Description of Artificial Sequence: Synthetic peptide
  Seed: PADAWPQEL (TYRP2_HUMAN)
PFDAWPQEL

SEQ ID NO: 184809 - protein, 10 aa, Artificial Sequence
  Description of Artificial Sequence: Synthetic peptide
  Seed: FVVLHSFTDA (TYRP2_HUMAN)
FKVLHSFTDV

SEQ ID NO: 184810 - protein, 9 aa, Artificial Sequence
  Description of Artificial Sequence: Synthetic peptide
  Seed: ELWPRKFFH (TYRP2_HUMAN)
EWWPRKFFR

SEQ ID NO: 184811 - protein, 9 aa, Artificial Sequence
  Description of Artificial Sequence: Synthetic peptide
  Seed: VMSLHNLVH (TYRP2_HUMAN)
VHSLHNLVY

SEQ ID NO: 184812 - protein, 9 aa, Artificial Sequence
  Description of Artificial Sequence: Synthetic peptide
  Seed: RLRKGYTPL (TYRP2_HUMAN)
RARKGYTPH

SEQ ID NO: 184813 - protein, 11 aa, Artificial Sequence
  Description of Artificial Sequence: Synthetic peptide
  Seed: TQPQFANCSVY (TYRP2_HUMAN)
TNPQFANCSVF

SEQ ID NO: 184814 - protein, 11 aa, Artificial Sequence
  Description of Artificial Sequence: Synthetic peptide
  Seed: FVVLHSFTDAI (TYRP2_HUMAN)
FAVLHSFTDAL

SEQ ID NO: 184815 - protein, 9 aa, Artificial Sequence
  Description of Artificial Sequence: Synthetic peptide
  Seed: RLRKGYTPL (TYRP2_HUMAN)
RGRKGYTPM

SEQ ID NO: 184816 - protein, 8 aa, Artificial Sequence
  Description of Artificial Sequence: Synthetic peptide
  Seed: ANDPIFVV (TYRP2_HUMAN)
ASDPIFVM

SEQ ID NO: 184817 - protein, 9 aa, Artificial Sequence
  Description of Artificial Sequence: Synthetic peptide
  Seed: ETPGWPTTL (TYRP2_HUMAN)
ELPGWPTTM

SEQ ID NO: 184818 - protein, 10 aa, Artificial Sequence
  Description of Artificial Sequence: Synthetic peptide
  Seed: NMVPFFPPVT (TYRP2_HUMAN)
NLVPFFPPVV

SEQ ID NO: 184819 - protein, 9 aa, Artificial Sequence
  Description of Artificial Sequence: Synthetic peptide
  Seed: VTWHRYHLL (TYRP2_HUMAN)
VTWHRYHLV

SEQ ID NO: 184820 - protein, 10 aa, Artificial Sequence
  Description of Artificial Sequence: Synthetic peptide
  Seed: YDFFVWLHYY (TYRP2_HUMAN)
YGFFVWLHYY

SEQ ID NO: 184821 - protein, 10 aa, Artificial Sequence
  Description of Artificial Sequence: Synthetic peptide
  Seed: LGPNGTQPQF (TYRP2_HUMAN)
LSPNGTQPQL

SEQ ID NO: 184822 - protein, 11 aa, Artificial Sequence
  Description of Artificial Sequence: Synthetic peptide
  Seed: RNQDDRELWPR (TYRP2_HUMAN)
RMQDDRELWPK

SEQ ID NO: 184823 - protein, 9 aa, Artificial Sequence
  Description of Artificial Sequence: Synthetic peptide
  Seed: AFLQYRRLR (TYRP2_HUMAN)
AMLQYRRLK

SEQ ID NO: 184824 - protein, 11 aa, Artificial Sequence
  Description of Artificial Sequence: Synthetic peptide
  Seed: FANCSVYDFFV (TYRP2_HUMAN)
FINCSVYDFFL

SEQ ID NO: 184825 - protein, 9 aa, Artificial Sequence
  Description of Artificial Sequence: Synthetic peptide
  Seed: HSAANDPIF (TYRP2_HUMAN)
HKAANDPIY

SEQ ID NO: 184826 - protein, 9 aa, Artificial Sequence
  Description of Artificial Sequence: Synthetic peptide
  Seed: MTVDSLVNK (TYRP2_HUMAN)
MAVDSLVNH

SEQ ID NO: 184827 - protein, 9 aa, Artificial Sequence
  Description of Artificial Sequence: Synthetic peptide
  Seed: SQVMSLHNL (TYRP2_HUMAN)
SMVMSLHNV

SEQ ID NO: 184828 - protein, 9 aa, Artificial Sequence
  Description of Artificial Sequence: Synthetic peptide
  Seed: ANDPIFVVL (TYRP2_HUMAN)
AYDPIFVVI

SEQ ID NO: 184829 - protein, 9 aa, Artificial Sequence
  Description of Artificial Sequence: Synthetic peptide
  Seed: RDCLSLQKF (TYRP2_HUMAN)
RMCLSLQKY

SEQ ID NO: 184830 - protein, 10 aa, Artificial Sequence
  Description of Artificial Sequence: Synthetic peptide
  Seed: RLRKGYTPLM (TYRP2_HUMAN)
RYRKGYTPLK

SEQ ID NO: 184831 - protein, 8 aa, Artificial Sequence
  Description of Artificial Sequence: Synthetic peptide
  Seed: AIDLPVSV (TYRP2_HUMAN)
AGDLPVSL

SEQ ID NO: 184832 - protein, 9 aa, Artificial Sequence
  Description of Artificial Sequence: Synthetic peptide
  Seed: FPPVTNEEL (TYRP2_HUMAN)
FAPVTNEEV

SEQ ID NO: 184833 - protein, 9 aa, Artificial Sequence
  Description of Artificial Sequence: Synthetic peptide
  Seed: NMVPFFPPV (TYRP2_HUMAN)
NIVPFFPPY

SEQ ID NO: 184834 - protein, 9 aa, Artificial Sequence
  Description of Artificial Sequence: Synthetic peptide
  Seed: YTPLMETHL (TYRP2_HUMAN)
YRPLMETHL

SEQ ID NO: 184835 - protein, 9 aa, Artificial Sequence
  Description of Artificial Sequence: Synthetic peptide
  Seed: FVWLHYYSV (TYRP2_HUMAN)
FTWLHYYSM

SEQ ID NO: 184836 - protein, 10 aa, Artificial Sequence
  Description of Artificial Sequence: Synthetic peptide
  Seed: NSRFSSWETV (TYRP2_HUMAN)
NHRFSSWETL

SEQ ID NO: 184837 - protein, 10 aa, Artificial Sequence
  Description of Artificial Sequence: Synthetic peptide
  Seed: REQFLGALDL (TYRP2_HUMAN)
RQQFLGALDF

SEQ ID NO: 184838 - protein, 9 aa, Artificial Sequence
  Description of Artificial Sequence: Synthetic peptide
  Seed: VTNEELFLT (TYRP2_HUMAN)
VLNEELFLT

SEQ ID NO: 184839 - protein, 11 aa, Artificial Sequence
  Description of Artificial Sequence: Synthetic peptide
  Seed: VCMTVDSLVNK (TYRP2_HUMAN)
VIMTVDSLVNK

SEQ ID NO: 184840 - protein, 10 aa, Artificial Sequence
  Description of Artificial Sequence: Synthetic peptide
  Seed: SAANDPIFVV (TYRP2_HUMAN)
SLANDPIFVA

SEQ ID NO: 184841 - protein, 9 aa, Artificial Sequence
  Description of Artificial Sequence: Synthetic peptide
  Seed: RKFFHRTCK (TYRP2_HUMAN)
RSFFHRTCT

SEQ ID NO: 184842 - protein, 10 aa, Artificial Sequence
  Description of Artificial Sequence: Synthetic peptide
  Seed: VALVGLFVLL (TYRP2_HUMAN)
VKLVGLFVLV

SEQ ID NO: 184843 - protein, 9 aa, Artificial Sequence
  Description of Artificial Sequence: Synthetic peptide
  Seed: SLHNLVHSF (TYRP2_HUMAN)
SHHNLVHSM

SEQ ID NO: 184844 - protein, 10 aa, Artificial Sequence
  Description of Artificial Sequence: Synthetic peptide
  Seed: MSPLWWGFLL (TYRP2_HUMAN)
MMPLWWGFLF

SEQ ID NO: 184845 - protein, 9 aa, Artificial Sequence
  Description of Artificial Sequence: Synthetic peptide
  Seed: SQVMSLHNL (TYRP2_HUMAN)
SRVMSLHNM

SEQ ID NO: 184846 - protein, 9 aa, Artificial Sequence
  Description of Artificial Sequence: Synthetic peptide
  Seed: SLHNLVHSF (TYRP2_HUMAN)
SAHNLVHSM

SEQ ID NO: 184847 - protein, 10 aa, Artificial Sequence
  Description of Artificial Sequence: Synthetic peptide
  Seed: FANCSVYDFF (TYRP2_HUMAN)
FVNCSVYDFW

SEQ ID NO: 184848 - protein, 9 aa, Artificial Sequence
  Description of Artificial Sequence: Synthetic peptide
  Seed: VMSLHNLVH (TYRP2_HUMAN)
VQSLHNLVW

SEQ ID NO: 184849 - protein, 10 aa, Artificial Sequence
  Description of Artificial Sequence: Synthetic peptide
  Seed: VLHSFTDAIF (TYRP2_HUMAN)
VKHSFTDAIF

SEQ ID NO: 184850 - protein, 9 aa, Artificial Sequence
  Description of Artificial Sequence: Synthetic peptide
  Seed: DSLDDYNHL (TYRP2_HUMAN)
DVLDDYNHW

SEQ ID NO: 184851 - protein, 9 aa, Artificial Sequence
  Description of Artificial Sequence: Synthetic peptide
  Seed: VIRQNIHSL (TYRP2_HUMAN)
VMRQNIHSR

SEQ ID NO: 184852 - protein, 9 aa, Artificial Sequence
  Description of Artificial Sequence: Synthetic peptide
  Seed: RLRKGYTPL (TYRP2_HUMAN)
RMRKGYTPK

SEQ ID NO: 184853 - protein, 9 aa, Artificial Sequence
  Description of Artificial Sequence: Synthetic peptide
  Seed: STFSFRNAL (TYRP2_HUMAN)
SYFSFRNAF

SEQ ID NO: 184854 - protein, 10 aa, Artificial Sequence
  Description of Artificial Sequence: Synthetic peptide
  Seed: CCPRLGAESA (TYRP2_HUMAN)
CYPRLGAESL

SEQ ID NO: 184855 - protein, 9 aa, Artificial Sequence
  Description of Artificial Sequence: Synthetic peptide
  Seed: ISRNSRFSS (TYRP2_HUMAN)
ITRNSRFSY

SEQ ID NO: 184856 - protein, 9 aa, Artificial Sequence
  Description of Artificial Sequence: Synthetic peptide
  Seed: FTDAIFDEW (TYRP2_HUMAN)
FPDAIFDEM

SEQ ID NO: 184857 - protein, 11 aa, Artificial Sequence
  Description of Artificial Sequence: Synthetic peptide
  Seed: TQPQFANCSVY (TYRP2_HUMAN)
TIPQFANCSVY

SEQ ID NO: 184858 - protein, 9 aa, Artificial Sequence
  Description of Artificial Sequence: Synthetic peptide
  Seed: TLLGPGRPY (TYRP2_HUMAN)
TFLGPGRPY

SEQ ID NO: 184859 - protein, 11 aa, Artificial Sequence
  Description of Artificial Sequence: Synthetic peptide
  Seed: SLDDYNHLVTL (TYRP2_HUMAN)
SSDDYNHLVTI

SEQ ID NO: 184860 - protein, 9 aa, Artificial Sequence
  Description of Artificial Sequence: Synthetic peptide
  Seed: TTLLVVMGT (TYRP2_HUMAN)
TSLLVVMGV

SEQ ID NO: 184861 - protein, 9 aa, Artificial Sequence
  Description of Artificial Sequence: Synthetic peptide
  Seed: STFSFRNAL (TYRP2_HUMAN)
SSFSFRNAI

SEQ ID NO: 184862 - protein, 9 aa, Artificial Sequence
  Description of Artificial Sequence: Synthetic peptide
  Seed: SFRNALEGF (TYRP2_HUMAN)
SMRNALEGF

SEQ ID NO: 184863 - protein, 9 aa, Artificial Sequence
  Description of Artificial Sequence: Synthetic peptide
  Seed: ELWPRKFFH (TYRP2_HUMAN)
EGWPRKFFR

SEQ ID NO: 184864 - protein, 9 aa, Artificial Sequence
  Description of Artificial Sequence: Synthetic peptide
  Seed: LAFLQYRRL (TYRP2_HUMAN)
LVFLQYRRW

SEQ ID NO: 184865 - protein, 9 aa, Artificial Sequence
  Description of Artificial Sequence: Synthetic peptide
  Seed: LIGNESFAL (TYRP2_HUMAN)
LMGNESFAV

SEQ ID NO: 184866 - protein, 11 aa, Artificial Sequence
  Description of Artificial Sequence: Synthetic peptide
  Seed: HPDYVITTQHW (TYRP2_HUMAN)
HMDYVITTQHF

SEQ ID NO: 184867 - protein, 10 aa, Artificial Sequence
  Description of Artificial Sequence: Synthetic peptide
  Seed: HSFLNGTNAL (TYRP2_HUMAN)
HWFLNGTNAM

SEQ ID NO: 184868 - protein, 10 aa, Artificial Sequence
  Description of Artificial Sequence: Synthetic peptide
  Seed: RMYNMVPFFP (TYRP2_HUMAN)
RSYNMVPFFF

SEQ ID NO: 184869 - protein, 11 aa, Artificial Sequence
  Description of Artificial Sequence: Synthetic peptide
  Seed: RELWPRKFFHR (TYRP2_HUMAN)
RTLWPRKFFHR

SEQ ID NO: 184870 - protein, 10 aa, Artificial Sequence
  Description of Artificial Sequence: Synthetic peptide
  Seed: SVYDFFVWLH (TYRP2_HUMAN)
SFYDFFVWLF

SEQ ID NO: 184871 - protein, 10 aa, Artificial Sequence
  Description of Artificial Sequence: Synthetic peptide
  Seed: FLLSCLGCKI (TYRP2_HUMAN)
FALSCLGCKL

SEQ ID NO: 184872 - protein, 10 aa, Artificial Sequence
  Description of Artificial Sequence: Synthetic peptide
  Seed: FLLSCLGCKI (TYRP2_HUMAN)
FNLSCLGCKV

SEQ ID NO: 184873 - protein, 9 aa, Artificial Sequence
  Description of Artificial Sequence: Synthetic peptide
  Seed: HQGPAFVTW (TYRP2_HUMAN)
HLGPAFVTF

SEQ ID NO: 184874 - protein, 10 aa, Artificial Sequence
  Description of Artificial Sequence: Synthetic peptide
  Seed: SQVMSLHNLV (TYRP2_HUMAN)
SLVMSLHNLA

SEQ ID NO: 184875 - protein, 9 aa, Artificial Sequence
  Description of Artificial Sequence: Synthetic peptide
  Seed: SRNSRFSSW (TYRP2_HUMAN)
SMNSRFSSF

SEQ ID NO: 184876 - protein, 10 aa, Artificial Sequence
  Description of Artificial Sequence: Synthetic peptide
  Seed: LGPGRPYRAI (TYRP2_HUMAN)
LIPGRPYRAL

SEQ ID NO: 184877 - protein, 10 aa, Artificial Sequence
  Description of Artificial Sequence: Synthetic peptide
  Seed: QPQFANCSVY (TYRP2_HUMAN)
QVQFANCSVF

SEQ ID NO: 184878 - protein, 9 aa, Artificial Sequence
  Description of Artificial Sequence: Synthetic peptide
  Seed: YSYAIDLPV (TYRP2_HUMAN)
YPYAIDLPF

SEQ ID NO: 184879 - protein, 11 aa, Artificial Sequence
  Description of Artificial Sequence: Synthetic peptide
  Seed: YTPLMETHLSS (TYRP2_HUMAN)
YRPLMETHLSM

SEQ ID NO: 184880 - protein, 11 aa, Artificial Sequence
  Description of Artificial Sequence: Synthetic peptide
  Seed: KADGTLDSQVM (TYRP2_HUMAN)
KMDGTLDSQVF

SEQ ID NO: 184881 - protein, 9 aa, Artificial Sequence
  Description of Artificial Sequence: Synthetic peptide
  Seed: FFPPVTNEE (TYRP2_HUMAN)
FAPPVTNEF

SEQ ID NO: 184882 - protein, 9 aa, Artificial Sequence
  Description of Artificial Sequence: Synthetic peptide
  Seed: FLTSDQLGY (TYRP2_HUMAN)
FPTSDQLGF

SEQ ID NO: 184883 - protein, 9 aa, Artificial Sequence
  Description of Artificial Sequence: Synthetic peptide
  Seed: QRLIGNESF (TYRP2_HUMAN)
QRLIGNESL

SEQ ID NO: 184884 - protein, 9 aa, Artificial Sequence
  Description of Artificial Sequence: Synthetic peptide
  Seed: RLIGNESFA (TYRP2_HUMAN)
RMIGNESFL

SEQ ID NO: 184885 - protein, 11 aa, Artificial Sequence
  Description of Artificial Sequence: Synthetic peptide
  Seed: RADTRPWSGPY (TYRP2_HUMAN)
RYDTRPWSGPW

SEQ ID NO: 184886 - protein, 9 aa, Artificial Sequence
  Description of Artificial Sequence: Synthetic peptide
  Seed: SVYDFFVWL (TYRP2_HUMAN)
SAYDFFVWV

SEQ ID NO: 184887 - protein, 9 aa, Artificial Sequence
  Description of Artificial Sequence: Synthetic peptide
  Seed: RAIDFSHQG (TYRP2_HUMAN)
RIIDFSHQL

SEQ ID NO: 184888 - protein, 9 aa, Artificial Sequence
  Description of Artificial Sequence: Synthetic peptide
  Seed: YTPLMETHL (TYRP2_HUMAN)
YIPLMETHL

SEQ ID NO: 184889 - protein, 10 aa, Artificial Sequence
  Description of Artificial Sequence: Synthetic peptide
  Seed: YNMVPFFPPV (TYRP2_HUMAN)
YGMVPFFPPM

SEQ ID NO: 184890 - protein, 10 aa, Artificial Sequence
  Description of Artificial Sequence: Synthetic peptide
  Seed: LHYYSVRDTL (TYRP2_HUMAN)
LVYYSVRDTF

SEQ ID NO: 184891 - protein, 9 aa, Artificial Sequence
  Description of Artificial Sequence: Synthetic peptide
  Seed: VTWHRYHLL (TYRP2_HUMAN)
VAWHRYHLL

SEQ ID NO: 184892 - protein, 10 aa, Artificial Sequence
  Description of Artificial Sequence: Synthetic peptide
  Seed: SLQKFDNPPF (TYRP2_HUMAN)
SHQKFDNPPY

SEQ ID NO: 184893 - protein, 10 aa, Artificial Sequence
  Description of Artificial Sequence: Synthetic peptide
  Seed: VALVGLFVLL (TYRP2_HUMAN)
VLLVGLFVLV

SEQ ID NO: 184894 - protein, 9 aa, Artificial Sequence
  Description of Artificial Sequence: Synthetic peptide
  Seed: NGTYEGLLR (TYRP2_HUMAN)
NTTYEGLLR

SEQ ID NO: 184895 - protein, 9 aa, Artificial Sequence
  Description of Artificial Sequence: Synthetic peptide
  Seed: FFQNSTFSF (TYRP2_HUMAN)
FKQNSTFSF

SEQ ID NO: 184896 - protein, 9 aa, Artificial Sequence
  Description of Artificial Sequence: Synthetic peptide
  Seed: STFSFRNAL (TYRP2_HUMAN)
SVFSFRNAR

SEQ ID NO: 184897 - protein, 10 aa, Artificial Sequence
  Description of Artificial Sequence: Synthetic peptide
  Seed: GQFPRVCMTV (TYRP2_HUMAN)
GMFPRVCMTV

SEQ ID NO: 184898 - protein, 9 aa, Artificial Sequence
  Description of Artificial Sequence: Synthetic peptide
  Seed: RRLRKGYTP (TYRP2_HUMAN)
RRLRKGYTM

SEQ ID NO: 184899 - protein, 11 aa, Artificial Sequence
  Description of Artificial Sequence: Synthetic peptide
  Seed: RNQDDRELWPR (TYRP2_HUMAN)
RSQDDRELWPR

SEQ ID NO: 184900 - protein, 9 aa, Artificial Sequence
  Description of Artificial Sequence: Synthetic peptide
  Seed: AANDPIFVV (TYRP2_HUMAN)
ARNDPIFVV

SEQ ID NO: 184901 - protein, 9 aa, Artificial Sequence
  Description of Artificial Sequence: Synthetic peptide
  Seed: VVLHSFTDA (TYRP2_HUMAN)
VMLHSFTDI

SEQ ID NO: 184902 - protein, 9 aa, Artificial Sequence
  Description of Artificial Sequence: Synthetic peptide
  Seed: NRMYNMVPF (TYRP2_HUMAN)
NQMYNMVPL

SEQ ID NO: 184903 - protein, 9 aa, Artificial Sequence
  Description of Artificial Sequence: Synthetic peptide
  Seed: TPGWPTTLL (TYRP2_HUMAN)
TAGWPTTLM

SEQ ID NO: 184904 - protein, 9 aa, Artificial Sequence
  Description of Artificial Sequence: Synthetic peptide
  Seed: TTQHWLGLL (TYRP2_HUMAN)
TSQHWLGLY

SEQ ID NO: 184905 - protein, 9 aa, Artificial Sequence
  Description of Artificial Sequence: Synthetic peptide
  Seed: SRFSSWETV (TYRP2_HUMAN)
SLFSSWETF

SEQ ID NO: 184906 - protein, 9 aa, Artificial Sequence
  Description of Artificial Sequence: Synthetic peptide
  Seed: SVYDFFVWL (TYRP2_HUMAN)
SRYDFFVWL

SEQ ID NO: 184907 - protein, 10 aa, Artificial Sequence
  Description of Artificial Sequence: Synthetic peptide
  Seed: RLRKGYTPLM (TYRP2_HUMAN)
RARKGYTPLA

SEQ ID NO: 184908 - protein, 9 aa, Artificial Sequence
  Description of Artificial Sequence: Synthetic peptide
  Seed: RLRKGYTPL (TYRP2_HUMAN)
RARKGYTPT

SEQ ID NO: 184909 - protein, 10 aa, Artificial Sequence
  Description of Artificial Sequence: Synthetic peptide
  Seed: TLVALVGLFV (TYRP2_HUMAN)
TMVALVGLFL

SEQ ID NO: 184910 - protein, 10 aa, Artificial Sequence
  Description of Artificial Sequence: Synthetic peptide
  Seed: CMTVDSLVNK (TYRP2_HUMAN)
CSTVDSLVNR

SEQ ID NO: 184911 - protein, 10 aa, Artificial Sequence
  Description of Artificial Sequence: Synthetic peptide
  Seed: RLIGNESFAL (TYRP2_HUMAN)
RVIGNESFAI

SEQ ID NO: 184912 - protein, 9 aa, Artificial Sequence
  Description of Artificial Sequence: Synthetic peptide
  Seed: ELWPRKFFH (TYRP2_HUMAN)
EFWPRKFFK

SEQ ID NO: 184913 - protein, 9 aa, Artificial Sequence
  Description of Artificial Sequence: Synthetic peptide
  Seed: LAFLQYRRL (TYRP2_HUMAN)
LAFLQYRRF

SEQ ID NO: 184914 - protein, 9 aa, Artificial Sequence
  Description of Artificial Sequence: Synthetic peptide
  Seed: PQFANCSVY (TYRP2_HUMAN)
PMFANCSVY

SEQ ID NO: 184915 - protein, 11 aa, Artificial Sequence
  Description of Artificial Sequence: Synthetic peptide
  Seed: CDSLDDYNHLV (TYRP2_HUMAN)
CESLDDYNHLV

SEQ ID NO: 184916 - protein, 10 aa, Artificial Sequence
  Description of Artificial Sequence: Synthetic peptide
  Seed: SDQLGYSYAI (TYRP2_HUMAN)
SFQLGYSYAV

SEQ ID NO: 184917 - protein, 9 aa, Artificial Sequence
  Description of Artificial Sequence: Synthetic peptide
  Seed: RMYNMVPFF (TYRP2_HUMAN)
RTYNMVPFS

SEQ ID NO: 184918 - protein, 10 aa, Artificial Sequence
  Description of Artificial Sequence: Synthetic peptide
  Seed: FVLLAFLQYR (TYRP2_HUMAN)
FCLLAFLQYR

SEQ ID NO: 184919 - protein, 10 aa, Artificial Sequence
  Description of Artificial Sequence: Synthetic peptide
  Seed: FLTSDQLGYS (TYRP2_HUMAN)
FYTSDQLGYV

SEQ ID NO: 184920 - protein, 10 aa, Artificial Sequence
  Description of Artificial Sequence: Synthetic peptide
  Seed: GTLDSQVMSL (TYRP2_HUMAN)
GMLDSQVMSA

SEQ ID NO: 184921 - protein, 9 aa, Artificial Sequence
  Description of Artificial Sequence: Synthetic peptide
  Seed: SVRDTLLGP (TYRP2_HUMAN)
STRDTLLGG

SEQ ID NO: 184922 - protein, 9 aa, Artificial Sequence
  Description of Artificial Sequence: Synthetic peptide
  Seed: APIGHNRMY (TYRP2_HUMAN)
ASIGHNRMF

SEQ ID NO: 184923 - protein, 9 aa, Artificial Sequence
  Description of Artificial Sequence: Synthetic peptide
  Seed: LIGNESFAL (TYRP2_HUMAN)
LLGNESFAI

SEQ ID NO: 184924 - protein, 10 aa, Artificial Sequence
  Description of Artificial Sequence: Synthetic peptide
  Seed: RMYNMVPFFP (TYRP2_HUMAN)
RYYNMVPFFA

SEQ ID NO: 184925 - protein, 8 aa, Artificial Sequence
  Description of Artificial Sequence: Synthetic peptide
  Seed: LDDYNHLV (TYRP2_HUMAN)
LADYNHLM

SEQ ID NO: 184926 - protein, 9 aa, Artificial Sequence
  Description of Artificial Sequence: Synthetic peptide
  Seed: SPLWWGFLL (TYRP2_HUMAN)
SPLWWGFLF

SEQ ID NO: 184927 - protein, 10 aa, Artificial Sequence
  Description of Artificial Sequence: Synthetic peptide
  Seed: FTDAIFDEWM (TYRP2_HUMAN)
FLDAIFDEWM

SEQ ID NO: 184928 - protein, 9 aa, Artificial Sequence
  Description of Artificial Sequence: Synthetic peptide
  Seed: VLLAFLQYR (TYRP2_HUMAN)
VNLAFLQYR

SEQ ID NO: 184929 - protein, 9 aa, Artificial Sequence
  Description of Artificial Sequence: Synthetic peptide
  Seed: FFQNSTFSF (TYRP2_HUMAN)
FWQNSTFSY

SEQ ID NO: 184930 - protein, 9 aa, Artificial Sequence
  Description of Artificial Sequence: Synthetic peptide
  Seed: ISRNSRFSS (TYRP2_HUMAN)
ISRNSRFSY

SEQ ID NO: 184931 - protein, 10 aa, Artificial Sequence
  Description of Artificial Sequence: Synthetic peptide
  Seed: ELAPIGHNRM (TYRP2_HUMAN)
ETAPIGHNRL

SEQ ID NO: 184932 - protein, 9 aa, Artificial Sequence
  Description of Artificial Sequence: Synthetic peptide
  Seed: YAIDLPVSV (TYRP2_HUMAN)
YPIDLPVSP

SEQ ID NO: 184933 - protein, 9 aa, Artificial Sequence
  Description of Artificial Sequence: Synthetic peptide
  Seed: VLHSFTDAI (TYRP2_HUMAN)
VVHSFTDAY

SEQ ID NO: 184934 - protein, 11 aa, Artificial Sequence
  Description of Artificial Sequence: Synthetic peptide
  Seed: FFPPVTNEELF (TYRP2_HUMAN)
FGPPVTNEELY

SEQ ID NO: 184935 - protein, 9 aa, Artificial Sequence
  Description of Artificial Sequence: Synthetic peptide
  Seed: NMVPFFPPV (TYRP2_HUMAN)
NKVPFFPPM

SEQ ID NO: 184936 - protein, 9 aa, Artificial Sequence
  Description of Artificial Sequence: Synthetic peptide
  Seed: SLDDYNHLV (TYRP2_HUMAN)
SGDDYNHLF

SEQ ID NO: 184937 - protein, 9 aa, Artificial Sequence
  Description of Artificial Sequence: Synthetic peptide
  Seed: IFDEWMKRF (TYRP2_HUMAN)
ISDEWMKRM

SEQ ID NO: 184938 - protein, 11 aa, Artificial Sequence
  Description of Artificial Sequence: Synthetic peptide
  Seed: MYNMVPFFPPV (TYRP2_HUMAN)
MKNMVPFFPPI

SEQ ID NO: 184939 - protein, 10 aa, Artificial Sequence
  Description of Artificial Sequence: Synthetic peptide
  Seed: SPLWWGFLLS (TYRP2_HUMAN)
SQLWWGFLLA

SEQ ID NO: 184940 - protein, 9 aa, Artificial Sequence
  Description of Artificial Sequence: Synthetic peptide
  Seed: YSYAIDLPV (TYRP2_HUMAN)
YMYAIDLPV

SEQ ID NO: 184941 - protein, 9 aa, Artificial Sequence
  Description of Artificial Sequence: Synthetic peptide
  Seed: DAIFDEWMK (TYRP2_HUMAN)
DTIFDEWMR

SEQ ID NO: 184942 - protein, 10 aa, Artificial Sequence
  Description of Artificial Sequence: Synthetic peptide
  Seed: KRFNPPADAW (TYRP2_HUMAN)
KHFNPPADAY

SEQ ID NO: 184943 - protein, 11 aa, Artificial Sequence
  Description of Artificial Sequence: Synthetic peptide
  Seed: MYNMVPFFPPV (TYRP2_HUMAN)
MFNMVPFFPPF

SEQ ID NO: 184944 - protein, 9 aa, Artificial Sequence
  Description of Artificial Sequence: Synthetic peptide
  Seed: NMVPFFPPV (TYRP2_HUMAN)
NIVPFFPPM

SEQ ID NO: 184945 - protein, 9 aa, Artificial Sequence
  Description of Artificial Sequence: Synthetic peptide
  Seed: DSLDDYNHL (TYRP2_HUMAN)
DILDDYNHF

SEQ ID NO: 184946 - protein, 9 aa, Artificial Sequence
  Description of Artificial Sequence: Synthetic peptide
  Seed: FVLLAFLQY (TYRP2_HUMAN)
FMLLAFLQM

SEQ ID NO: 184947 - protein, 9 aa, Artificial Sequence
  Description of Artificial Sequence: Synthetic peptide
  Seed: TLDSQVMSL (TYRP2_HUMAN)
TWDSQVMSL

SEQ ID NO: 184948 - protein, 10 aa, Artificial Sequence
  Description of Artificial Sequence: Synthetic peptide
  Seed: LPHSAANDPI (TYRP2_HUMAN)
LPHSAANDPL

SEQ ID NO: 184949 - protein, 10 aa, Artificial Sequence
  Description of Artificial Sequence: Synthetic peptide
  Seed: SPLWWGFLLS (TYRP2_HUMAN)
STLWWGFLLI

SEQ ID NO: 184950 - protein, 10 aa, Artificial Sequence
  Description of Artificial Sequence: Synthetic peptide
  Seed: VALVGLFVLL (TYRP2_HUMAN)
VYLVGLFVLL

SEQ ID NO: 184951 - protein, 10 aa, Artificial Sequence
  Description of Artificial Sequence: Synthetic peptide
  Seed: DTLLGPGRPY (TYRP2_HUMAN)
DSLLGPGRPK

SEQ ID NO: 184952 - protein, 10 aa, Artificial Sequence
  Description of Artificial Sequence: Synthetic peptide
  Seed: TLVALVGLFV (TYRP2_HUMAN)
TQVALVGLFV

SEQ ID NO: 184953 - protein, 8 aa, Artificial Sequence
  Description of Artificial Sequence: Synthetic peptide
  Seed: ANDPIFVV (TYRP2_HUMAN)
ASDPIFVL

SEQ ID NO: 184954 - protein, 9 aa, Artificial Sequence
  Description of Artificial Sequence: Synthetic peptide
  Seed: DDYNHLVTL (TYRP2_HUMAN)
DSYNHLVTY

SEQ ID NO: 184955 - protein, 10 aa, Artificial Sequence
  Description of Artificial Sequence: Synthetic peptide
  Seed: FLLSCLGCKI (TYRP2_HUMAN)
FVLSCLGCKA

SEQ ID NO: 184956 - protein, 9 aa, Artificial Sequence
  Description of Artificial Sequence: Synthetic peptide
  Seed: VMSLHNLVH (TYRP2_HUMAN)
VRSLHNLVF

SEQ ID NO: 184957 - protein, 10 aa, Artificial Sequence
  Description of Artificial Sequence: Synthetic peptide
  Seed: MSPLWWGFLL (TYRP2_HUMAN)
MYPLWWGFLV

SEQ ID NO: 184958 - protein, 10 aa, Artificial Sequence
  Description of Artificial Sequence: Synthetic peptide
  Seed: FTDAIFDEWM (TYRP2_HUMAN)
FMDAIFDEWL

SEQ ID NO: 184959 - protein, 9 aa, Artificial Sequence
  Description of Artificial Sequence: Synthetic peptide
  Seed: RFNPPADAW (TYRP2_HUMAN)
RLNPPADAI

SEQ ID NO: 184960 - protein, 10 aa, Artificial Sequence
  Description of Artificial Sequence: Synthetic peptide
  Seed: TDAIFDEWMK (TYRP2_HUMAN)
TGAIFDEWMR

SEQ ID NO: 184961 - protein, 11 aa, Artificial Sequence
  Description of Artificial Sequence: Synthetic peptide
  Seed: ELAPIGHNRMY (TYRP2_HUMAN)
EVAPIGHNRMY

SEQ ID NO: 184962 - protein, 8 aa, Artificial Sequence
  Description of Artificial Sequence: Synthetic peptide
  Seed: LDDYNHLV (TYRP2_HUMAN)
LADYNHLI

SEQ ID NO: 184963 - protein, 9 aa, Artificial Sequence
  Description of Artificial Sequence: Synthetic peptide
  Seed: RLRKGYTPL (TYRP2_HUMAN)
RQRKGYTPL

SEQ ID NO: 184964 - protein, 10 aa, Artificial Sequence
  Description of Artificial Sequence: Synthetic peptide
  Seed: ELWPRKFFHR (TYRP2_HUMAN)
ESWPRKFFHR

SEQ ID NO: 184965 - protein, 9 aa, Artificial Sequence
  Description of Artificial Sequence: Synthetic peptide
  Seed: FSHQGPAFV (TYRP2_HUMAN)
FYHQGPAFL

SEQ ID NO: 184966 - protein, 11 aa, Artificial Sequence
  Description of Artificial Sequence: Synthetic peptide
  Seed: YNMVPFFPPVT (TYRP2_HUMAN)
YVMVPFFPPVD

SEQ ID NO: 184967 - protein, 9 aa, Artificial Sequence
  Description of Artificial Sequence: Synthetic peptide
  Seed: AIFDEWMKR (TYRP2_HUMAN)
AMFDEWMKK

SEQ ID NO: 184968 - protein, 8 aa, Artificial Sequence
  Description of Artificial Sequence: Synthetic peptide
  Seed: FSHQGPAF (TYRP2_HUMAN)
FAHQGPAY

SEQ ID NO: 184969 - protein, 11 aa, Artificial Sequence
  Description of Artificial Sequence: Synthetic peptide
  Seed: FFPPVTNEELF (TYRP2_HUMAN)
FLPPVTNEELY

SEQ ID NO: 184970 - protein, 10 aa, Artificial Sequence
  Description of Artificial Sequence: Synthetic peptide
  Seed: RPWSGPYILR (TYRP2_HUMAN)
RVWSGPYILR

SEQ ID NO: 184971 - protein, 9 aa, Artificial Sequence
  Description of Artificial Sequence: Synthetic peptide
  Seed: STFSFRNAL (TYRP2_HUMAN)
SGFSFRNAK

SEQ ID NO: 184972 - protein, 11 aa, Artificial Sequence
  Description of Artificial Sequence: Synthetic peptide
  Seed: RADTRPWSGPY (TYRP2_HUMAN)
RYDTRPWSGPY

SEQ ID NO: 184973 - protein, 10 aa, Artificial Sequence
  Description of Artificial Sequence: Synthetic peptide
  Seed: VALVGLFVLL (TYRP2_HUMAN)
VMLVGLFVLV

SEQ ID NO: 184974 - protein, 10 aa, Artificial Sequence
  Description of Artificial Sequence: Synthetic peptide
  Seed: YAIDLPVSVE (TYRP2_HUMAN)
YMIDLPVSVG

SEQ ID NO: 184975 - protein, 9 aa, Artificial Sequence
  Description of Artificial Sequence: Synthetic peptide
  Seed: MTVDSLVNK (TYRP2_HUMAN)
MLVDSLVNY

SEQ ID NO: 184976 - protein, 11 aa, Artificial Sequence
  Description of Artificial Sequence: Synthetic peptide
  Seed: FLTSDQLGYSY (TYRP2_HUMAN)
FGTSDQLGYSY

SEQ ID NO: 184977 - protein, 10 aa, Artificial Sequence
  Description of Artificial Sequence: Synthetic peptide
  Seed: NSTFSFRNAL (TYRP2_HUMAN)
NHTFSFRNAL

SEQ ID NO: 184978 - protein, 10 aa, Artificial Sequence
  Description of Artificial Sequence: Synthetic peptide
  Seed: RLIGNESFAL (TYRP2_HUMAN)
RSIGNESFAF

SEQ ID NO: 184979 - protein, 9 aa, Artificial Sequence
  Description of Artificial Sequence: Synthetic peptide
  Seed: DDYNHLVTL (TYRP2_HUMAN)
DVYNHLVTY

SEQ ID NO: 184980 - protein, 11 aa, Artificial Sequence
  Description of Artificial Sequence: Synthetic peptide
  Seed: YTPLMETHLSS (TYRP2_HUMAN)
YPPLMETHLSA

SEQ ID NO: 184981 - protein, 8 aa, Artificial Sequence
  Description of Artificial Sequence: Synthetic peptide
  Seed: KFDNPPFF (TYRP2_HUMAN)
KYDNPPFL

SEQ ID NO: 184982 - protein, 10 aa, Artificial Sequence
  Description of Artificial Sequence: Synthetic peptide
  Seed: SPLWWGFLLS (TYRP2_HUMAN)
SMLWWGFLLI

SEQ ID NO: 184983 - protein, 10 aa, Artificial Sequence
  Description of Artificial Sequence: Synthetic peptide
  Seed: HSFLNGTNAL (TYRP2_HUMAN)
HMFLNGTNAY

SEQ ID NO: 184984 - protein, 9 aa, Artificial Sequence
  Description of Artificial Sequence: Synthetic peptide
  Seed: RMYNMVPFF (TYRP2_HUMAN)
RIYNMVPFR

SEQ ID NO: 184985 - protein, 10 aa, Artificial Sequence
  Description of Artificial Sequence: Synthetic peptide
  Seed: CMTVDSLVNK (TYRP2_HUMAN)
CDTVDSLVNK

SEQ ID NO: 184986 - protein, 11 aa, Artificial Sequence
  Description of Artificial Sequence: Synthetic peptide
  Seed: ELAPIGHNRMY (TYRP2_HUMAN)
EIAPIGHNRMR

SEQ ID NO: 184987 - protein, 11 aa, Artificial Sequence
  Description of Artificial Sequence: Synthetic peptide
  Seed: RADTRPWSGPY (TYRP2_HUMAN)
RFDTRPWSGPW

SEQ ID NO: 184988 - protein, 9 aa, Artificial Sequence
  Description of Artificial Sequence: Synthetic peptide
  Seed: AANDPIFVV (TYRP2_HUMAN)
AANDPIFVF

SEQ ID NO: 184989 - protein, 10 aa, Artificial Sequence
  Description of Artificial Sequence: Synthetic peptide
  Seed: RPWSGPYILR (TYRP2_HUMAN)
RAWSGPYILR

SEQ ID NO: 184990 - protein, 10 aa, Artificial Sequence
  Description of Artificial Sequence: Synthetic peptide
  Seed: SPLWWGFLLS (TYRP2_HUMAN)
SCLWWGFLLI

SEQ ID NO: 184991 - protein, 8 aa, Artificial Sequence
  Description of Artificial Sequence: Synthetic peptide
  Seed: AIDLPVSV (TYRP2_HUMAN)
AMDLPVSI

SEQ ID NO: 184992 - protein, 9 aa, Artificial Sequence
  Description of Artificial Sequence: Synthetic peptide
  Seed: GPNGTQPQF (TYRP2_HUMAN)
GPNGTQPQM

SEQ ID NO: 184993 - protein, 9 aa, Artificial Sequence
  Description of Artificial Sequence: Synthetic peptide
  Seed: VLHSFTDAI (TYRP2_HUMAN)
VNHSFTDAF

SEQ ID NO: 184994 - protein, 9 aa, Artificial Sequence
  Description of Artificial Sequence: Synthetic peptide
  Seed: DSLDDYNHL (TYRP2_HUMAN)
DSLDDYNHR

SEQ ID NO: 184995 - protein, 9 aa, Artificial Sequence
  Description of Artificial Sequence: Synthetic peptide
  Seed: GPNGTQPQF (TYRP2_HUMAN)
GMNGTQPQF

SEQ ID NO: 184996 - protein, 9 aa, Artificial Sequence
  Description of Artificial Sequence: Synthetic peptide
  Seed: FANCSVYDF (TYRP2_HUMAN)
FTNCSVYDF

SEQ ID NO: 184997 - protein, 9 aa, Artificial Sequence
  Description of Artificial Sequence: Synthetic peptide
  Seed: GPAFVTWHR (TYRP2_HUMAN)
GSAFVTWHK

SEQ ID NO: 184998 - protein, 9 aa, Artificial Sequence
  Description of Artificial Sequence: Synthetic peptide
  Seed: YSYAIDLPV (TYRP2_HUMAN)
YQYAIDLPV

SEQ ID NO: 184999 - protein, 9 aa, Artificial Sequence
  Description of Artificial Sequence: Synthetic peptide
  Seed: VTWHRYHLL (TYRP2_HUMAN)
VAWHRYHLK

SEQ ID NO: 185000 - protein, 9 aa, Artificial Sequence
  Description of Artificial Sequence: Synthetic peptide
  Seed: WMKRFNPPA (TYRP2_HUMAN)
WQKRFNPPY

SEQ ID NO: 185001 - protein, 10 aa, Artificial Sequence
  Description of Artificial Sequence: Synthetic peptide
  Seed: FFPPVTNEEL (TYRP2_HUMAN)
FVPPVTNEEY

SEQ ID NO: 185002 - protein, 11 aa, Artificial Sequence
  Description of Artificial Sequence: Synthetic peptide
  Seed: RADTRPWSGPY (TYRP2_HUMAN)
RIDTRPWSGPY

SEQ ID NO: 185003 - protein, 10 aa, Artificial Sequence
  Description of Artificial Sequence: Synthetic peptide
  Seed: RMYNMVPFFP (TYRP2_HUMAN)
RMYNMVPFFF

SEQ ID NO: 185004 - protein, 9 aa, Artificial Sequence
  Description of Artificial Sequence: Synthetic peptide
  Seed: IFDEWMKRF (TYRP2_HUMAN)
IADEWMKRY

SEQ ID NO: 185005 - protein, 11 aa, Artificial Sequence
  Description of Artificial Sequence: Synthetic peptide
  Seed: FLTSDQLGYSY (TYRP2_HUMAN)
FITSDQLGYSY

SEQ ID NO: 185006 - protein, 11 aa, Artificial Sequence
  Description of Artificial Sequence: Synthetic peptide
  Seed: LSLQKFDNPPF (TYRP2_HUMAN)
LALQKFDNPPW

SEQ ID NO: 185007 - protein, 9 aa, Artificial Sequence
  Description of Artificial Sequence: Synthetic peptide
  Seed: GLFVLLAFL (TYRP2_HUMAN)
GIFVLLAFI

SEQ ID NO: 185008 - protein, 11 aa, Artificial Sequence
  Description of Artificial Sequence: Synthetic peptide
  Seed: RADTRPWSGPY (TYRP2_HUMAN)
RTDTRPWSGPF

SEQ ID NO: 185009 - protein, 9 aa, Artificial Sequence
  Description of Artificial Sequence: Synthetic peptide
  Seed: SLDDYNHLV (TYRP2_HUMAN)
SCDDYNHLI

SEQ ID NO: 185010 - protein, 9 aa, Artificial Sequence
  Description of Artificial Sequence: Synthetic peptide
  Seed: YAIDLPVSV (TYRP2_HUMAN)
YLIDLPVSK

SEQ ID NO: 185011 - protein, 10 aa, Artificial Sequence
  Description of Artificial Sequence: Synthetic peptide
  Seed: VVMGTLVALV (TYRP2_HUMAN)
VQMGTLVALI

SEQ ID NO: 185012 - protein, 9 aa, Artificial Sequence
  Description of Artificial Sequence: Synthetic peptide
  Seed: FVWLHYYSV (TYRP2_HUMAN)
FLWLHYYST

SEQ ID NO: 185013 - protein, 10 aa, Artificial Sequence
  Description of Artificial Sequence: Synthetic peptide
  Seed: SYAIDLPVSV (TYRP2_HUMAN)
SLAIDLPVSV

SEQ ID NO: 185014 - protein, 11 aa, Artificial Sequence
  Description of Artificial Sequence: Synthetic peptide
  Seed: FFPPVTNEELF (TYRP2_HUMAN)
FWPPVTNEELY

SEQ ID NO: 185015 - protein, 9 aa, Artificial Sequence
  Description of Artificial Sequence: Synthetic peptide
  Seed: WPQELAPIG (TYRP2_HUMAN)
WPQELAPIA

SEQ ID NO: 185016 - protein, 9 aa, Artificial Sequence
  Description of Artificial Sequence: Synthetic peptide
  Seed: FSHQGPAFV (TYRP2_HUMAN)
FFHQGPAFL

SEQ ID NO: 185017 - protein, 10 aa, Artificial Sequence
  Description of Artificial Sequence: Synthetic peptide
  Seed: FQNSTFSFRN (TYRP2_HUMAN)
FVNSTFSFRK

SEQ ID NO: 185018 - protein, 10 aa, Artificial Sequence
  Description of Artificial Sequence: Synthetic peptide
  Seed: RLIGNESFAL (TYRP2_HUMAN)
RQIGNESFAW

SEQ ID NO: 185019 - protein, 9 aa, Artificial Sequence
  Description of Artificial Sequence: Synthetic peptide
  Seed: SFRNALEGF (TYRP2_HUMAN)
SYRNALEGM

SEQ ID NO: 185020 - protein, 9 aa, Artificial Sequence
  Description of Artificial Sequence: Synthetic peptide
  Seed: ANDPIFVVL (TYRP2_HUMAN)
AIDPIFVVV

SEQ ID NO: 185021 - protein, 10 aa, Artificial Sequence
  Description of Artificial Sequence: Synthetic peptide
  Seed: SSWETVCDSL (TYRP2_HUMAN)
STWETVCDSF

SEQ ID NO: 185022 - protein, 10 aa, Artificial Sequence
  Description of Artificial Sequence: Synthetic peptide
  Seed: VLLAFLQYRR (TYRP2_HUMAN)
VRLAFLQYRK

SEQ ID NO: 185023 - protein, 9 aa, Artificial Sequence
  Description of Artificial Sequence: Synthetic peptide
  Seed: YDFFVWLHY (TYRP2_HUMAN)
YMFFVWLHF

SEQ ID NO: 185024 - protein, 10 aa, Artificial Sequence
  Description of Artificial Sequence: Synthetic peptide
  Seed: AIFDEWMKRF (TYRP2_HUMAN)
ALFDEWMKRW

SEQ ID NO: 185025 - protein, 10 aa, Artificial Sequence
  Description of Artificial Sequence: Synthetic peptide
  Seed: AANDPIFVVL (TYRP2_HUMAN)
ALNDPIFVVL

SEQ ID NO: 185026 - protein, 9 aa, Artificial Sequence
  Description of Artificial Sequence: Synthetic peptide
  Seed: FANCSVYDF (TYRP2_HUMAN)
FSNCSVYDL

SEQ ID NO: 185027 - protein, 9 aa, Artificial Sequence
  Description of Artificial Sequence: Synthetic peptide
  Seed: DDYNHLVTL (TYRP2_HUMAN)
DRYNHLVTF

SEQ ID NO: 185028 - protein, 10 aa, Artificial Sequence
  Description of Artificial Sequence: Synthetic peptide
  Seed: SDQLGYSYAI (TYRP2_HUMAN)
SPQLGYSYAY

SEQ ID NO: 185029 - protein, 10 aa, Artificial Sequence
  Description of Artificial Sequence: Synthetic peptide
  Seed: CCPRLGAESA (TYRP2_HUMAN)
CWPRLGAESM

SEQ ID NO: 185030 - protein, 10 aa, Artificial Sequence
  Description of Artificial Sequence: Synthetic peptide
  Seed: MTVDSLVNKE (TYRP2_HUMAN)
MSVDSLVNKK

SEQ ID NO: 185031 - protein, 10 aa, Artificial Sequence
  Description of Artificial Sequence: Synthetic peptide
  Seed: FVLLAFLQYR (TYRP2_HUMAN)
FSLLAFLQYR

SEQ ID NO: 185032 - protein, 10 aa, Artificial Sequence
  Description of Artificial Sequence: Synthetic peptide
  Seed: TRPWSGPYIL (TYRP2_HUMAN)
TDPWSGPYIF

SEQ ID NO: 185033 - protein, 11 aa, Artificial Sequence
  Description of Artificial Sequence: Synthetic peptide
  Seed: YTPLMETHLSS (TYRP2_HUMAN)
YTPLMETHLSI

SEQ ID NO: 185034 - protein, 9 aa, Artificial Sequence
  Description of Artificial Sequence: Synthetic peptide
  Seed: ITTQHWLGL (TYRP2_HUMAN)
ITTQHWLGM

SEQ ID NO: 185035 - protein, 11 aa, Artificial Sequence
  Description of Artificial Sequence: Synthetic peptide
  Seed: HSLSPQEREQF (TYRP2_HUMAN)
HQLSPQEREQM

SEQ ID NO: 185036 - protein, 9 aa, Artificial Sequence
  Description of Artificial Sequence: Synthetic peptide
  Seed: RRLRKGYTP (TYRP2_HUMAN)
RQLRKGYTL

SEQ ID NO: 185037 - protein, 9 aa, Artificial Sequence
  Description of Artificial Sequence: Synthetic peptide
  Seed: QKFDNPPFF (TYRP2_HUMAN)
QIFDNPPFF

SEQ ID NO: 185038 - protein, 9 aa, Artificial Sequence
  Description of Artificial Sequence: Synthetic peptide
  Seed: RYHLLCLER (TYRP2_HUMAN)
RLHLLCLEK

SEQ ID NO: 185039 - protein, 10 aa, Artificial Sequence
  Description of Artificial Sequence: Synthetic peptide
  Seed: SLSPQEREQF (TYRP2_HUMAN)
SASPQEREQY

SEQ ID NO: 185040 - protein, 9 aa, Artificial Sequence
  Description of Artificial Sequence: Synthetic peptide
  Seed: HYYSVRDTL (TYRP2_HUMAN)
HRYSVRDTY

SEQ ID NO: 185041 - protein, 9 aa, Artificial Sequence
  Description of Artificial Sequence: Synthetic peptide
  Seed: VLHSFTDAI (TYRP2_HUMAN)
VLHSFTDAF

SEQ ID NO: 185042 - protein, 10 aa, Artificial Sequence
  Description of Artificial Sequence: Synthetic peptide
  Seed: FVWLHYYSVR (TYRP2_HUMAN)
FLWLHYYSVE

SEQ ID NO: 185043 - protein, 9 aa, Artificial Sequence
  Description of Artificial Sequence: Synthetic peptide
  Seed: SLDDYNHLV (TYRP2_HUMAN)
SCDDYNHLF

SEQ ID NO: 185044 - protein, 9 aa, Artificial Sequence
  Description of Artificial Sequence: Synthetic peptide
  Seed: HSFLNGTNA (TYRP2_HUMAN)
HAFLNGTNM

SEQ ID NO: 185045 - protein, 11 aa, Artificial Sequence
  Description of Artificial Sequence: Synthetic peptide
  Seed: FQNSTFSFRNA (TYRP2_HUMAN)
FMNSTFSFRNL

SEQ ID NO: 185046 - protein, 11 aa, Artificial Sequence
  Description of Artificial Sequence: Synthetic peptide
  Seed: RADTRPWSGPY (TYRP2_HUMAN)
RCDTRPWSGPF

SEQ ID NO: 185047 - protein, 9 aa, Artificial Sequence
  Description of Artificial Sequence: Synthetic peptide
  Seed: FSHQGPAFV (TYRP2_HUMAN)
FGHQGPAFL

SEQ ID NO: 185048 - protein, 10 aa, Artificial Sequence
  Description of Artificial Sequence: Synthetic peptide
  Seed: SQVMSLHNLV (TYRP2_HUMAN)
SLVMSLHNLI

SEQ ID NO: 185049 - protein, 9 aa, Artificial Sequence
  Description of Artificial Sequence: Synthetic peptide
  Seed: YSYAIDLPV (TYRP2_HUMAN)
YQYAIDLPG

SEQ ID NO: 185050 - protein, 10 aa, Artificial Sequence
  Description of Artificial Sequence: Synthetic peptide
  Seed: DAIFDEWMKR (TYRP2_HUMAN)
DVIFDEWMKR

SEQ ID NO: 185051 - protein, 10 aa, Artificial Sequence
  Description of Artificial Sequence: Synthetic peptide
  Seed: IGNESFALPY (TYRP2_HUMAN)
IINESFALPF

SEQ ID NO: 185052 - protein, 9 aa, Artificial Sequence
  Description of Artificial Sequence: Synthetic peptide
  Seed: NGTYEGLLR (TYRP2_HUMAN)
NVTYEGLLR

SEQ ID NO: 185053 - protein, 9 aa, Artificial Sequence
  Description of Artificial Sequence: Synthetic peptide
  Seed: RPWSGPYIL (TYRP2_HUMAN)
RRWSGPYII

SEQ ID NO: 185054 - protein, 9 aa, Artificial Sequence
  Description of Artificial Sequence: Synthetic peptide
  Seed: FLTSDQLGY (TYRP2_HUMAN)
FMTSDQLGF

SEQ ID NO: 185055 - protein, 11 aa, Artificial Sequence
  Description of Artificial Sequence: Synthetic peptide
  Seed: GHNRMYNMVPF (TYRP2_HUMAN)
GRNRMYNMVPL

SEQ ID NO: 185056 - protein, 10 aa, Artificial Sequence
  Description of Artificial Sequence: Synthetic peptide
  Seed: TQPQFANCSV (TYRP2_HUMAN)
TMPQFANCSV

SEQ ID NO: 185057 - protein, 9 aa, Artificial Sequence
  Description of Artificial Sequence: Synthetic peptide
  Seed: HQGPAFVTW (TYRP2_HUMAN)
HWGPAFVTW

SEQ ID NO: 185058 - protein, 9 aa, Artificial Sequence
  Description of Artificial Sequence: Synthetic peptide
  Seed: MSPLWWGFL (TYRP2_HUMAN)
MQPLWWGFF

SEQ ID NO: 185059 - protein, 10 aa, Artificial Sequence
  Description of Artificial Sequence: Synthetic peptide
  Seed: YAIDLPVSVE (TYRP2_HUMAN)
YMIDLPVSVM

SEQ ID NO: 185060 - protein, 9 aa, Artificial Sequence
  Description of Artificial Sequence: Synthetic peptide
  Seed: FFQNSTFSF (TYRP2_HUMAN)
FNQNSTFSF

SEQ ID NO: 185061 - protein, 10 aa, Artificial Sequence
  Description of Artificial Sequence: Synthetic peptide
  Seed: AANDPIFVVL (TYRP2_HUMAN)
AVNDPIFVVW

SEQ ID NO: 185062 - protein, 8 aa, Artificial Sequence
  Description of Artificial Sequence: Synthetic peptide
  Seed: FLNGTNAL (TYRP2_HUMAN)
FANGTNAF

SEQ ID NO: 185063 - protein, 11 aa, Artificial Sequence
  Description of Artificial Sequence: Synthetic peptide
  Seed: MYNMVPFFPPV (TYRP2_HUMAN)
MGNMVPFFPPI

SEQ ID NO: 185064 - protein, 11 aa, Artificial Sequence
  Description of Artificial Sequence: Synthetic peptide
  Seed: YTPLMETHLSS (TYRP2_HUMAN)
YWPLMETHLST

SEQ ID NO: 185065 - protein, 9 aa, Artificial Sequence
  Description of Artificial Sequence: Synthetic peptide
  Seed: FANCSVYDF (TYRP2_HUMAN)
FSNCSVYDY

SEQ ID NO: 185066 - protein, 9 aa, Artificial Sequence
  Description of Artificial Sequence: Synthetic peptide
  Seed: DTRPWSGPY (TYRP2_HUMAN)
DQRPWSGPY

SEQ ID NO: 185067 - protein, 10 aa, Artificial Sequence
  Description of Artificial Sequence: Synthetic peptide
  Seed: IGNESFALPY (TYRP2_HUMAN)
IKNESFALPF

SEQ ID NO: 185068 - protein, 9 aa, Artificial Sequence
  Description of Artificial Sequence: Synthetic peptide
  Seed: VTWHRYHLL (TYRP2_HUMAN)
VLWHRYHLL

SEQ ID NO: 185069 - protein, 11 aa, Artificial Sequence
  Description of Artificial Sequence: Synthetic peptide
  Seed: FVVLHSFTDAI (TYRP2_HUMAN)
FAVLHSFTDAI

SEQ ID NO: 185070 - protein, 9 aa, Artificial Sequence
  Description of Artificial Sequence: Synthetic peptide
  Seed: VPFFPPVTN (TYRP2_HUMAN)
VPFFPPVTG

SEQ ID NO: 185071 - protein, 9 aa, Artificial Sequence
  Description of Artificial Sequence: Synthetic peptide
  Seed: HYYSVRDTL (TYRP2_HUMAN)
HHYSVRDTA

SEQ ID NO: 185072 - protein, 9 aa, Artificial Sequence
  Description of Artificial Sequence: Synthetic peptide
  Seed: WPTTLLVVM (TYRP2_HUMAN)
WPTTLLVVA

SEQ ID NO: 185073 - protein, 11 aa, Artificial Sequence
  Description of Artificial Sequence: Synthetic peptide
  Seed: HNRMYNMVPFF (TYRP2_HUMAN)
HQRMYNMVPFM

SEQ ID NO: 185074 - protein, 10 aa, Artificial Sequence
  Description of Artificial Sequence: Synthetic peptide
  Seed: YNCGDCKFGW (TYRP2_HUMAN)
YTCGDCKFGW

SEQ ID NO: 185075 - protein, 10 aa, Artificial Sequence
  Description of Artificial Sequence: Synthetic peptide
  Seed: TLVALVGLFV (TYRP2_HUMAN)
TTVALVGLFV

SEQ ID NO: 185076 - protein, 9 aa, Artificial Sequence
  Description of Artificial Sequence: Synthetic peptide
  Seed: YSYAIDLPV (TYRP2_HUMAN)
YYYAIDLPH

SEQ ID NO: 185077 - protein, 9 aa, Artificial Sequence
  Description of Artificial Sequence: Synthetic peptide
  Seed: YSYAIDLPV (TYRP2_HUMAN)
YCYAIDLPL

SEQ ID NO: 185078 - protein, 10 aa, Artificial Sequence
  Description of Artificial Sequence: Synthetic peptide
  Seed: QPQFANCSVY (TYRP2_HUMAN)
QKQFANCSVF

SEQ ID NO: 185079 - protein, 10 aa, Artificial Sequence
  Description of Artificial Sequence: Synthetic peptide
  Seed: RNSRFSSWET (TYRP2_HUMAN)
RYSRFSSWEV

SEQ ID NO: 185080 - protein, 9 aa, Artificial Sequence
  Description of Artificial Sequence: Synthetic peptide
  Seed: LLSCLGCKI (TYRP2_HUMAN)
LVSCLGCKV

SEQ ID NO: 185081 - protein, 10 aa, Artificial Sequence
  Description of Artificial Sequence: Synthetic peptide
  Seed: SLQKFDNPPF (TYRP2_HUMAN)
SRQKFDNPPY

SEQ ID NO: 185082 - protein, 10 aa, Artificial Sequence
  Description of Artificial Sequence: Synthetic peptide
  Seed: FLLSCLGCKI (TYRP2_HUMAN)
FHLSCLGCKV

SEQ ID NO: 185083 - protein, 10 aa, Artificial Sequence
  Description of Artificial Sequence: Synthetic peptide
  Seed: VALVGLFVLL (TYRP2_HUMAN)
VYLVGLFVLV

SEQ ID NO: 185084 - protein, 10 aa, Artificial Sequence
  Description of Artificial Sequence: Synthetic peptide
  Seed: FFQNSTFSFR (TYRP2_HUMAN)
FQQNSTFSFR

SEQ ID NO: 185085 - protein, 10 aa, Artificial Sequence
  Description of Artificial Sequence: Synthetic peptide
  Seed: NPPFFQNSTF (TYRP2_HUMAN)
NIPFFQNSTY

SEQ ID NO: 185086 - protein, 8 aa, Artificial Sequence
  Description of Artificial Sequence: Synthetic peptide
  Seed: RELWPRKF (TYRP2_HUMAN)
RELWPRKL

SEQ ID NO: 185087 - protein, 9 aa, Artificial Sequence
  Description of Artificial Sequence: Synthetic peptide
  Seed: VHPDYVITT (TYRP2_HUMAN)
VWPDYVITL

SEQ ID NO: 185088 - protein, 10 aa, Artificial Sequence
  Description of Artificial Sequence: Synthetic peptide
  Seed: LDDYNHLVTL (TYRP2_HUMAN)
LIDYNHLVTL

SEQ ID NO: 185089 - protein, 10 aa, Artificial Sequence
  Description of Artificial Sequence: Synthetic peptide
  Seed: NSTFSFRNAL (TYRP2_HUMAN)
NDTFSFRNAV

SEQ ID NO: 185090 - protein, 9 aa, Artificial Sequence
  Description of Artificial Sequence: Synthetic peptide
  Seed: SLHNLVHSF (TYRP2_HUMAN)
STHNLVHSK

SEQ ID NO: 185091 - protein, 9 aa, Artificial Sequence
  Description of Artificial Sequence: Synthetic peptide
  Seed: LVHSFLNGT (TYRP2_HUMAN)
LVHSFLNGL

SEQ ID NO: 185092 - protein, 9 aa, Artificial Sequence
  Description of Artificial Sequence: Synthetic peptide
  Seed: ALVGLFVLL (TYRP2_HUMAN)
AMVGLFVLT

SEQ ID NO: 185093 - protein, 9 aa, Artificial Sequence
  Description of Artificial Sequence: Synthetic peptide
  Seed: RDCLSLQKF (TYRP2_HUMAN)
RECLSLQKL

SEQ ID NO: 185094 - protein, 10 aa, Artificial Sequence
  Description of Artificial Sequence: Synthetic peptide
  Seed: RLRKGYTPLM (TYRP2_HUMAN)
RVRKGYTPLM

SEQ ID NO: 185095 - protein, 10 aa, Artificial Sequence
  Description of Artificial Sequence: Synthetic peptide
  Seed: LQRLIGNESF (TYRP2_HUMAN)
LKRLIGNESF

SEQ ID NO: 185096 - protein, 10 aa, Artificial Sequence
  Description of Artificial Sequence: Synthetic peptide
  Seed: MSPLWWGFLL (TYRP2_HUMAN)
MCPLWWGFLA

SEQ ID NO: 185097 - protein, 10 aa, Artificial Sequence
  Description of Artificial Sequence: Synthetic peptide
  Seed: FQNSTFSFRN (TYRP2_HUMAN)
FANSTFSFRR

SEQ ID NO: 185098 - protein, 11 aa, Artificial Sequence
  Description of Artificial Sequence: Synthetic peptide
  Seed: LLGPNGTQPQF (TYRP2_HUMAN)
LQGPNGTQPQY

SEQ ID NO: 185099 - protein, 9 aa, Artificial Sequence
  Description of Artificial Sequence: Synthetic peptide
  Seed: VTWHRYHLL (TYRP2_HUMAN)
VVWHRYHLF

SEQ ID NO: 185100 - protein, 10 aa, Artificial Sequence
  Description of Artificial Sequence: Synthetic peptide
  Seed: GQFPRVCMTV (TYRP2_HUMAN)
GLFPRVCMTT

SEQ ID NO: 185101 - protein, 9 aa, Artificial Sequence
  Description of Artificial Sequence: Synthetic peptide
  Seed: YSYAIDLPV (TYRP2_HUMAN)
YVYAIDLPM

SEQ ID NO: 185102 - protein, 9 aa, Artificial Sequence
  Description of Artificial Sequence: Synthetic peptide
  Seed: SLDDYNHLV (TYRP2_HUMAN)
SQDDYNHLM

SEQ ID NO: 185103 - protein, 10 aa, Artificial Sequence
  Description of Artificial Sequence: Synthetic peptide
  Seed: FPPVTNEELF (TYRP2_HUMAN)
FQPVTNEELY

SEQ ID NO: 185104 - protein, 9 aa, Artificial Sequence
  Description of Artificial Sequence: Synthetic peptide
  Seed: RNQMGRNSM (TYRP2_HUMAN)
RRQMGRNSY

SEQ ID NO: 185105 - protein, 9 aa, Artificial Sequence
  Description of Artificial Sequence: Synthetic peptide
  Seed: ILPGAQGQF (TYRP2_HUMAN)
ISPGAQGQM

SEQ ID NO: 185106 - protein, 10 aa, Artificial Sequence
  Description of Artificial Sequence: Synthetic peptide
  Seed: ADTRPWSGPY (TYRP2_HUMAN)
ASTRPWSGPW

SEQ ID NO: 185107 - protein, 9 aa, Artificial Sequence
  Description of Artificial Sequence: Synthetic peptide
  Seed: RLRKGYTPL (TYRP2_HUMAN)
RMRKGYTPS

SEQ ID NO: 185108 - protein, 9 aa, Artificial Sequence
  Description of Artificial Sequence: Synthetic peptide
  Seed: TSDQLGYSY (TYRP2_HUMAN)
TLDQLGYSF

SEQ ID NO: 185109 - protein, 10 aa, Artificial Sequence
  Description of Artificial Sequence: Synthetic peptide
  Seed: VLHSFTDAIF (TYRP2_HUMAN)
VQHSFTDAIF

SEQ ID NO: 185110 - protein, 9 aa, Artificial Sequence
  Description of Artificial Sequence: Synthetic peptide
  Seed: FFPPVTNEE (TYRP2_HUMAN)
FTPPVTNEL

SEQ ID NO: 185111 - protein, 10 aa, Artificial Sequence
  Description of Artificial Sequence: Synthetic peptide
  Seed: RRLRKGYTPL (TYRP2_HUMAN)
RPLRKGYTPF

SEQ ID NO: 185112 - protein, 10 aa, Artificial Sequence
  Description of Artificial Sequence: Synthetic peptide
  Seed: RRLRKGYTPL (TYRP2_HUMAN)
RVLRKGYTPA

SEQ ID NO: 185113 - protein, 9 aa, Artificial Sequence
  Description of Artificial Sequence: Synthetic peptide
  Seed: DFFVWLHYY (TYRP2_HUMAN)
DAFVWLHYK

SEQ ID NO: 185114 - protein, 10 aa, Artificial Sequence
  Description of Artificial Sequence: Synthetic peptide
  Seed: SDQLGYSYAI (TYRP2_HUMAN)
SRQLGYSYAI

SEQ ID NO: 185115 - protein, 9 aa, Artificial Sequence
  Description of Artificial Sequence: Synthetic peptide
  Seed: VSVEETPGW (TYRP2_HUMAN)
VQVEETPGF

SEQ ID NO: 185116 - protein, 9 aa, Artificial Sequence
  Description of Artificial Sequence: Synthetic peptide
  Seed: GPAFVTWHR (TYRP2_HUMAN)
GIAFVTWHK

SEQ ID NO: 185117 - protein, 9 aa, Artificial Sequence
  Description of Artificial Sequence: Synthetic peptide
  Seed: LHNLVHSFL (TYRP2_HUMAN)
LSNLVHSFF

SEQ ID NO: 185118 - protein, 9 aa, Artificial Sequence
  Description of Artificial Sequence: Synthetic peptide
  Seed: LVTLCNGTY (TYRP2_HUMAN)
LKTLCNGTF

SEQ ID NO: 185119 - protein, 9 aa, Artificial Sequence
  Description of Artificial Sequence: Synthetic peptide
  Seed: ETPGWPTTL (TYRP2_HUMAN)
EAPGWPTTY

SEQ ID NO: 185120 - protein, 9 aa, Artificial Sequence
  Description of Artificial Sequence: Synthetic peptide
  Seed: AANDPIFVV (TYRP2_HUMAN)
AVNDPIFVV

SEQ ID NO: 185121 - protein, 11 aa, Artificial Sequence
  Description of Artificial Sequence: Synthetic peptide
  Seed: FANCSVYDFFV (TYRP2_HUMAN)
FINCSVYDFFV

SEQ ID NO: 185122 - protein, 10 aa, Artificial Sequence
  Description of Artificial Sequence: Synthetic peptide
  Seed: HNRMYNMVPF (TYRP2_HUMAN)
HQRMYNMVPF

SEQ ID NO: 185123 - protein, 10 aa, Artificial Sequence
  Description of Artificial Sequence: Synthetic peptide
  Seed: QVMSLHNLVH (TYRP2_HUMAN)
QVMSLHNLVR

SEQ ID NO: 185124 - protein, 9 aa, Artificial Sequence
  Description of Artificial Sequence: Synthetic peptide
  Seed: RDCLSLQKF (TYRP2_HUMAN)
RTCLSLQKF

SEQ ID NO: 185125 - protein, 9 aa, Artificial Sequence
  Description of Artificial Sequence: Synthetic peptide
  Seed: MTVDSLVNK (TYRP2_HUMAN)
MAVDSLVNR

SEQ ID NO: 185126 - protein, 11 aa, Artificial Sequence
  Description of Artificial Sequence: Synthetic peptide
  Seed: RMYNMVPFFPP (TYRP2_HUMAN)
RMYNMVPFFPM

SEQ ID NO: 185127 - protein, 10 aa, Artificial Sequence
  Description of Artificial Sequence: Synthetic peptide
  Seed: RLRKGYTPLM (TYRP2_HUMAN)
RIRKGYTPLT

SEQ ID NO: 185128 - protein, 9 aa, Artificial Sequence
  Description of Artificial Sequence: Synthetic peptide
  Seed: YSYAIDLPV (TYRP2_HUMAN)
YYYAIDLPW

SEQ ID NO: 185129 - protein, 10 aa, Artificial Sequence
  Description of Artificial Sequence: Synthetic peptide
  Seed: FFPPVTNEEL (TYRP2_HUMAN)
FLPPVTNEEL

SEQ ID NO: 185130 - protein, 10 aa, Artificial Sequence
  Description of Artificial Sequence: Synthetic peptide
  Seed: YDFFVWLHYY (TYRP2_HUMAN)
YMFFVWLHYM

SEQ ID NO: 185131 - protein, 10 aa, Artificial Sequence
  Description of Artificial Sequence: Synthetic peptide
  Seed: YNMVPFFPPV (TYRP2_HUMAN)
YHMVPFFPPA

SEQ ID NO: 185132 - protein, 9 aa, Artificial Sequence
  Description of Artificial Sequence: Synthetic peptide
  Seed: LLSCLGCKI (TYRP2_HUMAN)
LQSCLGCKV

SEQ ID NO: 185133 - protein, 8 aa, Artificial Sequence
  Description of Artificial Sequence: Synthetic peptide
  Seed: FSHQGPAF (TYRP2_HUMAN)
FTHQGPAL

SEQ ID NO: 185134 - protein, 10 aa, Artificial Sequence
  Description of Artificial Sequence: Synthetic peptide
  Seed: ELAPIGHNRM (TYRP2_HUMAN)
EIAPIGHNRI

SEQ ID NO: 185135 - protein, 9 aa, Artificial Sequence
  Description of Artificial Sequence: Synthetic peptide
  Seed: SPLWWGFLL (TYRP2_HUMAN)
SPLWWGFLY

SEQ ID NO: 185136 - protein, 9 aa, Artificial Sequence
  Description of Artificial Sequence: Synthetic peptide
  Seed: TSDQLGYSY (TYRP2_HUMAN)
TCDQLGYSV

SEQ ID NO: 185137 - protein, 11 aa, Artificial Sequence
  Description of Artificial Sequence: Synthetic peptide
  Seed: ANCSVYDFFVW (TYRP2_HUMAN)
AHCSVYDFFVW

SEQ ID NO: 185138 - protein, 11 aa, Artificial Sequence
  Description of Artificial Sequence: Synthetic peptide
  Seed: RADTRPWSGPY (TYRP2_HUMAN)
RSDTRPWSGPK

SEQ ID NO: 185139 - protein, 9 aa, Artificial Sequence
  Description of Artificial Sequence: Synthetic peptide
  Seed: YAIDLPVSV (TYRP2_HUMAN)
YGIDLPVSW

SEQ ID NO: 185140 - protein, 10 aa, Artificial Sequence
  Description of Artificial Sequence: Synthetic peptide
  Seed: FPPVTNEELF (TYRP2_HUMAN)
FGPVTNEELF

SEQ ID NO: 185141 - protein, 10 aa, Artificial Sequence
  Description of Artificial Sequence: Synthetic peptide
  Seed: LVALVGLFVL (TYRP2_HUMAN)
LVALVGLFVV

SEQ ID NO: 185142 - protein, 9 aa, Artificial Sequence
  Description of Artificial Sequence: Synthetic peptide
  Seed: HQGPAFVTW (TYRP2_HUMAN)
HSGPAFVTF

SEQ ID NO: 185143 - protein, 11 aa, Artificial Sequence
  Description of Artificial Sequence: Synthetic peptide
  Seed: VLLAFLQYRRL (TYRP2_HUMAN)
VMLAFLQYRRV

SEQ ID NO: 185144 - protein, 9 aa, Artificial Sequence
  Description of Artificial Sequence: Synthetic peptide
  Seed: TNALPHSAA (TYRP2_HUMAN)
THALPHSAI

SEQ ID NO: 185145 - protein, 9 aa, Artificial Sequence
  Description of Artificial Sequence: Synthetic peptide
  Seed: GQFPRVCMT (TYRP2_HUMAN)
GVFPRVCMI

SEQ ID NO: 185146 - protein, 10 aa, Artificial Sequence
  Description of Artificial Sequence: Synthetic peptide
  Seed: YNMVPFFPPV (TYRP2_HUMAN)
YMMVPFFPPT

SEQ ID NO: 185147 - protein, 10 aa, Artificial Sequence
  Description of Artificial Sequence: Synthetic peptide
  Seed: ELAPIGHNRM (TYRP2_HUMAN)
ETAPIGHNRY

SEQ ID NO: 185148 - protein, 10 aa, Artificial Sequence
  Description of Artificial Sequence: Synthetic peptide
  Seed: LVVMGTLVAL (TYRP2_HUMAN)
LFVMGTLVAF

SEQ ID NO: 185149 - protein, 9 aa, Artificial Sequence
  Description of Artificial Sequence: Synthetic peptide
  Seed: VVMGTLVAL (TYRP2_HUMAN)
VMMGTLVAS

SEQ ID NO: 185150 - protein, 11 aa, Artificial Sequence
  Description of Artificial Sequence: Synthetic peptide
  Seed: YNMVPFFPPVT (TYRP2_HUMAN)
YMMVPFFPPVF

SEQ ID NO: 185151 - protein, 9 aa, Artificial Sequence
  Description of Artificial Sequence: Synthetic peptide
  Seed: AQGQFPRVC (TYRP2_HUMAN)
AEGQFPRVP

SEQ ID NO: 185152 - protein, 10 aa, Artificial Sequence
  Description of Artificial Sequence: Synthetic peptide
  Seed: RNSMKLPTLK (TYRP2_HUMAN)
RWSMKLPTLR

SEQ ID NO: 185153 - protein, 10 aa, Artificial Sequence
  Description of Artificial Sequence: Synthetic peptide
  Seed: LAFLQYRRLR (TYRP2_HUMAN)
LMFLQYRRLR

SEQ ID NO: 185154 - protein, 10 aa, Artificial Sequence
  Description of Artificial Sequence: Synthetic peptide
  Seed: ADTRPWSGPY (TYRP2_HUMAN)
AHTRPWSGPY

SEQ ID NO: 185155 - protein, 9 aa, Artificial Sequence
  Description of Artificial Sequence: Synthetic peptide
  Seed: LVHSFLNGT (TYRP2_HUMAN)
LQHSFLNGV

SEQ ID NO: 185156 - protein, 10 aa, Artificial Sequence
  Description of Artificial Sequence: Synthetic peptide
  Seed: AANDPIFVVL (TYRP2_HUMAN)
AQNDPIFVVY

SEQ ID NO: 185157 - protein, 8 aa, Artificial Sequence
  Description of Artificial Sequence: Synthetic peptide
  Seed: RPDDPTLI (TYRP2_HUMAN)
RYDDPTLM

SEQ ID NO: 185158 - protein, 10 aa, Artificial Sequence
  Description of Artificial Sequence: Synthetic peptide
  Seed: FLLSCLGCKI (TYRP2_HUMAN)
FRLSCLGCKV

SEQ ID NO: 185159 - protein, 9 aa, Artificial Sequence
  Description of Artificial Sequence: Synthetic peptide
  Seed: VMSLHNLVH (TYRP2_HUMAN)
VQSLHNLVY

SEQ ID NO: 185160 - protein, 9 aa, Artificial Sequence
  Description of Artificial Sequence: Synthetic peptide
  Seed: YSYAIDLPV (TYRP2_HUMAN)
YEYAIDLPI

SEQ ID NO: 185161 - protein, 8 aa, Artificial Sequence
  Description of Artificial Sequence: Synthetic peptide
  Seed: RPDDPTLI (TYRP2_HUMAN)
RADDPTLV

SEQ ID NO: 185162 - protein, 10 aa, Artificial Sequence
  Description of Artificial Sequence: Synthetic peptide
  Seed: RRLRKGYTPL (TYRP2_HUMAN)
RPLRKGYTPY

SEQ ID NO: 185163 - protein, 10 aa, Artificial Sequence
  Description of Artificial Sequence: Synthetic peptide
  Seed: LHYYSVRDTL (TYRP2_HUMAN)
LIYYSVRDTI

SEQ ID NO: 185164 - protein, 10 aa, Artificial Sequence
  Description of Artificial Sequence: Synthetic peptide
  Seed: NCSVYDFFVW (TYRP2_HUMAN)
NSSVYDFFVW

SEQ ID NO: 185165 - protein, 11 aa, Artificial Sequence
  Description of Artificial Sequence: Synthetic peptide
  Seed: YNMVPFFPPVT (TYRP2_HUMAN)
YIMVPFFPPVK

SEQ ID NO: 185166 - protein, 10 aa, Artificial Sequence
  Description of Artificial Sequence: Synthetic peptide
  Seed: TDAIFDEWMK (TYRP2_HUMAN)
TWAIFDEWMR

SEQ ID NO: 185167 - protein, 10 aa, Artificial Sequence
  Description of Artificial Sequence: Synthetic peptide
  Seed: MGTLVALVGL (TYRP2_HUMAN)
MWTLVALVGV

SEQ ID NO: 185168 - protein, 10 aa, Artificial Sequence
  Description of Artificial Sequence: Synthetic peptide
  Seed: FVWLHYYSVR (TYRP2_HUMAN)
FTWLHYYSVV

SEQ ID NO: 185169 - protein, 8 aa, Artificial Sequence
  Description of Artificial Sequence: Synthetic peptide
  Seed: REQFLGAL (TYRP2_HUMAN)
REQFLGAV

SEQ ID NO: 185170 - protein, 10 aa, Artificial Sequence
  Description of Artificial Sequence: Synthetic peptide
  Seed: SQVMSLHNLV (TYRP2_HUMAN)
SSVMSLHNLV

SEQ ID NO: 185171 - protein, 9 aa, Artificial Sequence
  Description of Artificial Sequence: Synthetic peptide
  Seed: SRNSRFSSW (TYRP2_HUMAN)
SQNSRFSSH

SEQ ID NO: 185172 - protein, 10 aa, Artificial Sequence
  Description of Artificial Sequence: Synthetic peptide
  Seed: MSPLWWGFLL (TYRP2_HUMAN)
MCPLWWGFLV

SEQ ID NO: 185173 - protein, 9 aa, Artificial Sequence
  Description of Artificial Sequence: Synthetic peptide
  Seed: YSYAIDLPV (TYRP2_HUMAN)
YYYAIDLPV

SEQ ID NO: 185174 - protein, 10 aa, Artificial Sequence
  Description of Artificial Sequence: Synthetic peptide
  Seed: DAIFDEWMKR (TYRP2_HUMAN)
DKIFDEWMKR

SEQ ID NO: 185175 - protein, 9 aa, Artificial Sequence
  Description of Artificial Sequence: Synthetic peptide
  Seed: LHSFTDAIF (TYRP2_HUMAN)
LMSFTDAIL

SEQ ID NO: 185176 - protein, 9 aa, Artificial Sequence
  Description of Artificial Sequence: Synthetic peptide
  Seed: NMVPFFPPV (TYRP2_HUMAN)
NTVPFFPPV

SEQ ID NO: 185177 - protein, 9 aa, Artificial Sequence
  Description of Artificial Sequence: Synthetic peptide
  Seed: FSHQGPAFV (TYRP2_HUMAN)
FSHQGPAFI

SEQ ID NO: 185178 - protein, 11 aa, Artificial Sequence
  Description of Artificial Sequence: Synthetic peptide
  Seed: LLVVMGTLVAL (TYRP2_HUMAN)
LWVVMGTLVAV

SEQ ID NO: 185179 - protein, 10 aa, Artificial Sequence
  Description of Artificial Sequence: Synthetic peptide
  Seed: NGTYEGLLRR (TYRP2_HUMAN)
NKTYEGLLRK

SEQ ID NO: 185180 - protein, 9 aa, Artificial Sequence
  Description of Artificial Sequence: Synthetic peptide
  Seed: DQLGYSYAI (TYRP2_HUMAN)
DMLGYSYAV

SEQ ID NO: 185181 - protein, 9 aa, Artificial Sequence
  Description of Artificial Sequence: Synthetic peptide
  Seed: FVLLAFLQY (TYRP2_HUMAN)
FQLLAFLQF

SEQ ID NO: 185182 - protein, 9 aa, Artificial Sequence
  Description of Artificial Sequence: Synthetic peptide
  Seed: WMKRFNPPA (TYRP2_HUMAN)
WQKRFNPPW

SEQ ID NO: 185183 - protein, 10 aa, Artificial Sequence
  Description of Artificial Sequence: Synthetic peptide
  Seed: MSPLWWGFLL (TYRP2_HUMAN)
MRPLWWGFLA

SEQ ID NO: 185184 - protein, 10 aa, Artificial Sequence
  Description of Artificial Sequence: Synthetic peptide
  Seed: QPQFANCSVY (TYRP2_HUMAN)
QPQFANCSVF

SEQ ID NO: 185185 - protein, 10 aa, Artificial Sequence
  Description of Artificial Sequence: Synthetic peptide
  Seed: YAIDLPVSVE (TYRP2_HUMAN)
YQIDLPVSVC

SEQ ID NO: 185186 - protein, 9 aa, Artificial Sequence
  Description of Artificial Sequence: Synthetic peptide
  Seed: IFDEWMKRF (TYRP2_HUMAN)
IVDEWMKRY

SEQ ID NO: 185187 - protein, 9 aa, Artificial Sequence
  Description of Artificial Sequence: Synthetic peptide
  Seed: NMVPFFPPV (TYRP2_HUMAN)
NTVPFFPPM

SEQ ID NO: 185188 - protein, 9 aa, Artificial Sequence
  Description of Artificial Sequence: Synthetic peptide
  Seed: QRLIGNESF (TYRP2_HUMAN)
QKLIGNESF

SEQ ID NO: 185189 - protein, 8 aa, Artificial Sequence
  Description of Artificial Sequence: Synthetic peptide
  Seed: RMYNMVPF (TYRP2_HUMAN)
RYYNMVPL

SEQ ID NO: 185190 - protein, 9 aa, Artificial Sequence
  Description of Artificial Sequence: Synthetic peptide
  Seed: ALDLAKKRV (TYRP2_HUMAN)
AADLAKKRI

SEQ ID NO: 185191 - protein, 10 aa, Artificial Sequence
  Description of Artificial Sequence: Synthetic peptide
  Seed: GQFPRVCMTV (TYRP2_HUMAN)
GHFPRVCMTY

SEQ ID NO: 185192 - protein, 9 aa, Artificial Sequence
  Description of Artificial Sequence: Synthetic peptide
  Seed: HYYSVRDTL (TYRP2_HUMAN)
HRYSVRDTI

SEQ ID NO: 185193 - protein, 9 aa, Artificial Sequence
  Description of Artificial Sequence: Synthetic peptide
  Seed: ALVGLFVLL (TYRP2_HUMAN)
ALVGLFVLY

SEQ ID NO: 185194 - protein, 10 aa, Artificial Sequence
  Description of Artificial Sequence: Synthetic peptide
  Seed: AANDPIFVVL (TYRP2_HUMAN)
ALNDPIFVVY

SEQ ID NO: 185195 - protein, 10 aa, Artificial Sequence
  Description of Artificial Sequence: Synthetic peptide
  Seed: ELAPIGHNRM (TYRP2_HUMAN)
EVAPIGHNRG

SEQ ID NO: 185196 - protein, 10 aa, Artificial Sequence
  Description of Artificial Sequence: Synthetic peptide
  Seed: FVLLAFLQYR (TYRP2_HUMAN)
FYLLAFLQYK

SEQ ID NO: 185197 - protein, 10 aa, Artificial Sequence
  Description of Artificial Sequence: Synthetic peptide
  Seed: NSTFSFRNAL (TYRP2_HUMAN)
NHTFSFRNAV

SEQ ID NO: 185198 - protein, 9 aa, Artificial Sequence
  Description of Artificial Sequence: Synthetic peptide
  Seed: VVMGTLVAL (TYRP2_HUMAN)
VYMGTLVAM

SEQ ID NO: 185199 - protein, 10 aa, Artificial Sequence
  Description of Artificial Sequence: Synthetic peptide
  Seed: QFLGALDLAK (TYRP2_HUMAN)
QVLGALDLAK

SEQ ID NO: 185200 - protein, 10 aa, Artificial Sequence
  Description of Artificial Sequence: Synthetic peptide
  Seed: ELAPIGHNRM (TYRP2_HUMAN)
EMAPIGHNRR

SEQ ID NO: 185201 - protein, 10 aa, Artificial Sequence
  Description of Artificial Sequence: Synthetic peptide
  Seed: SLDDYNHLVT (TYRP2_HUMAN)
SMDDYNHLVA

SEQ ID NO: 185202 - protein, 9 aa, Artificial Sequence
  Description of Artificial Sequence: Synthetic peptide
  Seed: TLLGPGRPY (TYRP2_HUMAN)
TILGPGRPM

SEQ ID NO: 185203 - protein, 9 aa, Artificial Sequence
  Description of Artificial Sequence: Synthetic peptide
  Seed: RRLRKGYTP (TYRP2_HUMAN)
RRLRKGYTV

SEQ ID NO: 185204 - protein, 10 aa, Artificial Sequence
  Description of Artificial Sequence: Synthetic peptide
  Seed: LTSDQLGYSY (TYRP2_HUMAN)
LWSDQLGYSY

SEQ ID NO: 185205 - protein, 10 aa, Artificial Sequence
  Description of Artificial Sequence: Synthetic peptide
  Seed: MSLHNLVHSF (TYRP2_HUMAN)
MSLHNLVHSY

SEQ ID NO: 185206 - protein, 11 aa, Artificial Sequence
  Description of Artificial Sequence: Synthetic peptide
  Seed: QRLIGNESFAL (TYRP2_HUMAN)
QHLIGNESFAF

SEQ ID NO: 185207 - protein, 11 aa, Artificial Sequence
  Description of Artificial Sequence: Synthetic peptide
  Seed: RNQDDRELWPR (TYRP2_HUMAN)
RMQDDRELWPR

SEQ ID NO: 185208 - protein, 8 aa, Artificial Sequence
  Description of Artificial Sequence: Synthetic peptide
  Seed: LLGPGRPY (TYRP2_HUMAN)
LAGPGRPM

SEQ ID NO: 185209 - protein, 9 aa, Artificial Sequence
  Description of Artificial Sequence: Synthetic peptide
  Seed: SVYDFFVWL (TYRP2_HUMAN)
SIYDFFVWY

SEQ ID NO: 185210 - protein, 9 aa, Artificial Sequence
  Description of Artificial Sequence: Synthetic peptide
  Seed: SFLNGTNAL (TYRP2_HUMAN)
SWLNGTNAM

SEQ ID NO: 185211 - protein, 11 aa, Artificial Sequence
  Description of Artificial Sequence: Synthetic peptide
  Seed: YNMVPFFPPVT (TYRP2_HUMAN)
YIMVPFFPPVC

SEQ ID NO: 185212 - protein, 10 aa, Artificial Sequence
  Description of Artificial Sequence: Synthetic peptide
  Seed: RRLRKGYTPL (TYRP2_HUMAN)
RVLRKGYTPF

SEQ ID NO: 185213 - protein, 10 aa, Artificial Sequence
  Description of Artificial Sequence: Synthetic peptide
  Seed: FFPPVTNEEL (TYRP2_HUMAN)
FRPPVTNEEM

SEQ ID NO: 185214 - protein, 10 aa, Artificial Sequence
  Description of Artificial Sequence: Synthetic peptide
  Seed: QELAPIGHNR (TYRP2_HUMAN)
QSLAPIGHNK

SEQ ID NO: 185215 - protein, 10 aa, Artificial Sequence
  Description of Artificial Sequence: Synthetic peptide
  Seed: LAFLQYRRLR (TYRP2_HUMAN)
LSFLQYRRLR

SEQ ID NO: 185216 - protein, 9 aa, Artificial Sequence
  Description of Artificial Sequence: Synthetic peptide
  Seed: ETPGWPTTL (TYRP2_HUMAN)
EIPGWPTTM

SEQ ID NO: 185217 - protein, 9 aa, Artificial Sequence
  Description of Artificial Sequence: Synthetic peptide
  Seed: RKFFHRTCK (TYRP2_HUMAN)
RFFFHRTCA

SEQ ID NO: 185218 - protein, 10 aa, Artificial Sequence
  Description of Artificial Sequence: Synthetic peptide
  Seed: NPPFFQNSTF (TYRP2_HUMAN)
NFPFFQNSTM

SEQ ID NO: 185219 - protein, 9 aa, Artificial Sequence
  Description of Artificial Sequence: Synthetic peptide
  Seed: RFNPPADAW (TYRP2_HUMAN)
RMNPPADAF

SEQ ID NO: 185220 - protein, 9 aa, Artificial Sequence
  Description of Artificial Sequence: Synthetic peptide
  Seed: YAIDLPVSV (TYRP2_HUMAN)
YSIDLPVSM

SEQ ID NO: 185221 - protein, 9 aa, Artificial Sequence
  Description of Artificial Sequence: Synthetic peptide
  Seed: SLDDYNHLV (TYRP2_HUMAN)
SYDDYNHLI

SEQ ID NO: 185222 - protein, 10 aa, Artificial Sequence
  Description of Artificial Sequence: Synthetic peptide
  Seed: SDQLGYSYAI (TYRP2_HUMAN)
SSQLGYSYAM

SEQ ID NO: 185223 - protein, 9 aa, Artificial Sequence
  Description of Artificial Sequence: Synthetic peptide
  Seed: SVYDFFVWL (TYRP2_HUMAN)
SLYDFFVWT

SEQ ID NO: 185224 - protein, 9 aa, Artificial Sequence
  Description of Artificial Sequence: Synthetic peptide
  Seed: LVTLCNGTY (TYRP2_HUMAN)
LKTLCNGTY

SEQ ID NO: 185225 - protein, 9 aa, Artificial Sequence
  Description of Artificial Sequence: Synthetic peptide
  Seed: YTPLMETHL (TYRP2_HUMAN)
YAPLMETHY

SEQ ID NO: 185226 - protein, 9 aa, Artificial Sequence
  Description of Artificial Sequence: Synthetic peptide
  Seed: ANCSVYDFF (TYRP2_HUMAN)
AQCSVYDFW

SEQ ID NO: 185227 - protein, 9 aa, Artificial Sequence
  Description of Artificial Sequence: Synthetic peptide
  Seed: ANDPIFVVL (TYRP2_HUMAN)
AQDPIFVVL

SEQ ID NO: 185228 - protein, 10 aa, Artificial Sequence
  Description of Artificial Sequence: Synthetic peptide
  Seed: MSPLWWGFLL (TYRP2_HUMAN)
MAPLWWGFLV

SEQ ID NO: 185229 - protein, 9 aa, Artificial Sequence
  Description of Artificial Sequence: Synthetic peptide
  Seed: VPFFPPVTN (TYRP2_HUMAN)
VPFFPPVTT

SEQ ID NO: 185230 - protein, 9 aa, Artificial Sequence
  Description of Artificial Sequence: Synthetic peptide
  Seed: RFNPPADAW (TYRP2_HUMAN)
RINPPADAL

SEQ ID NO: 185231 - protein, 9 aa, Artificial Sequence
  Description of Artificial Sequence: Synthetic peptide
  Seed: QVMSLHNLV (TYRP2_HUMAN)
QVMSLHNLI

SEQ ID NO: 185232 - protein, 9 aa, Artificial Sequence
  Description of Artificial Sequence: Synthetic peptide
  Seed: YSYAIDLPV (TYRP2_HUMAN)
YRYAIDLPL

SEQ ID NO: 185233 - protein, 9 aa, Artificial Sequence
  Description of Artificial Sequence: Synthetic peptide
  Seed: DQLGYSYAI (TYRP2_HUMAN)
DSLGYSYAI

SEQ ID NO: 185234 - protein, 9 aa, Artificial Sequence
  Description of Artificial Sequence: Synthetic peptide
  Seed: FTDAIFDEW (TYRP2_HUMAN)
FQDAIFDEW

SEQ ID NO: 185235 - protein, 10 aa, Artificial Sequence
  Description of Artificial Sequence: Synthetic peptide
  Seed: RLRKGYTPLM (TYRP2_HUMAN)
RVRKGYTPLR

SEQ ID NO: 185236 - protein, 8 aa, Artificial Sequence
  Description of Artificial Sequence: Synthetic peptide
  Seed: SLDDYNHL (TYRP2_HUMAN)
SSDDYNHF

SEQ ID NO: 185237 - protein, 11 aa, Artificial Sequence
  Description of Artificial Sequence: Synthetic peptide
  Seed: LPVSVEETPGW (TYRP2_HUMAN)
LQVSVEETPGW

SEQ ID NO: 185238 - protein, 9 aa, Artificial Sequence
  Description of Artificial Sequence: Synthetic peptide
  Seed: MVPFFPPVT (TYRP2_HUMAN)
MAPFFPPVV

SEQ ID NO: 185239 - protein, 10 aa, Artificial Sequence
  Description of Artificial Sequence: Synthetic peptide
  Seed: TQPQFANCSV (TYRP2_HUMAN)
TDPQFANCSL

SEQ ID NO: 185240 - protein, 10 aa, Artificial Sequence
  Description of Artificial Sequence: Synthetic peptide
  Seed: RNSRFSSWET (TYRP2_HUMAN)
RVSRFSSWEK

SEQ ID NO: 185241 - protein, 9 aa, Artificial Sequence
  Description of Artificial Sequence: Synthetic peptide
  Seed: VVLHSFTDA (TYRP2_HUMAN)
VILHSFTDV

SEQ ID NO: 185242 - protein, 9 aa, Artificial Sequence
  Description of Artificial Sequence: Synthetic peptide
  Seed: HQGPAFVTW (TYRP2_HUMAN)
HPGPAFVTW

SEQ ID NO: 185243 - protein, 10 aa, Artificial Sequence
  Description of Artificial Sequence: Synthetic peptide
  Seed: RLRKGYTPLM (TYRP2_HUMAN)
RYRKGYTPLL

SEQ ID NO: 185244 - protein, 10 aa, Artificial Sequence
  Description of Artificial Sequence: Synthetic peptide
  Seed: NQDDRELWPR (TYRP2_HUMAN)
NTDDRELWPY

SEQ ID NO: 185245 - protein, 9 aa, Artificial Sequence
  Description of Artificial Sequence: Synthetic peptide
  Seed: RLRKGYTPL (TYRP2_HUMAN)
RVRKGYTPN

SEQ ID NO: 185246 - protein, 11 aa, Artificial Sequence
  Description of Artificial Sequence: Synthetic peptide
  Seed: RNSRFSSWETV (TYRP2_HUMAN)
RNSRFSSWETI

SEQ ID NO: 185247 - protein, 10 aa, Artificial Sequence
  Description of Artificial Sequence: Synthetic peptide
  Seed: YAIDLPVSVE (TYRP2_HUMAN)
YMIDLPVSVT

SEQ ID NO: 185248 - protein, 9 aa, Artificial Sequence
  Description of Artificial Sequence: Synthetic peptide
  Seed: ADAWPQELA (TYRP2_HUMAN)
AEAWPQELV

SEQ ID NO: 185249 - protein, 9 aa, Artificial Sequence
  Description of Artificial Sequence: Synthetic peptide
  Seed: VTWHRYHLL (TYRP2_HUMAN)
VMWHRYHLV

SEQ ID NO: 185250 - protein, 10 aa, Artificial Sequence
  Description of Artificial Sequence: Synthetic peptide
  Seed: MSLHNLVHSF (TYRP2_HUMAN)
MWLHNLVHSW

SEQ ID NO: 185251 - protein, 8 aa, Artificial Sequence
  Description of Artificial Sequence: Synthetic peptide
  Seed: YYSVRDTL (TYRP2_HUMAN)
YASVRDTY

SEQ ID NO: 185252 - protein, 10 aa, Artificial Sequence
  Description of Artificial Sequence: Synthetic peptide
  Seed: FVWLHYYSVR (TYRP2_HUMAN)
FTWLHYYSVR

SEQ ID NO: 185253 - protein, 10 aa, Artificial Sequence
  Description of Artificial Sequence: Synthetic peptide
  Seed: LVVMGTLVAL (TYRP2_HUMAN)
LWVMGTLVAV

SEQ ID NO: 185254 - protein, 10 aa, Artificial Sequence
  Description of Artificial Sequence: Synthetic peptide
  Seed: LVVMGTLVAL (TYRP2_HUMAN)
LLVMGTLVAT

SEQ ID NO: 185255 - protein, 10 aa, Artificial Sequence
  Description of Artificial Sequence: Synthetic peptide
  Seed: RMYNMVPFFP (TYRP2_HUMAN)
RTYNMVPFFK

SEQ ID NO: 185256 - protein, 10 aa, Artificial Sequence
  Description of Artificial Sequence: Synthetic peptide
  Seed: LHYYSVRDTL (TYRP2_HUMAN)
LSYYSVRDTL

SEQ ID NO: 185257 - protein, 10 aa, Artificial Sequence
  Description of Artificial Sequence: Synthetic peptide
  Seed: HNRMYNMVPF (TYRP2_HUMAN)
HLRMYNMVPY

SEQ ID NO: 185258 - protein, 9 aa, Artificial Sequence
  Description of Artificial Sequence: Synthetic peptide
  Seed: YAIDLPVSV (TYRP2_HUMAN)
YAIDLPVSA

SEQ ID NO: 185259 - protein, 11 aa, Artificial Sequence
  Description of Artificial Sequence: Synthetic peptide
  Seed: RNSRFSSWETV (TYRP2_HUMAN)
RGSRFSSWETM

SEQ ID NO: 185260 - protein, 9 aa, Artificial Sequence
  Description of Artificial Sequence: Synthetic peptide
  Seed: RDCLSLQKF (TYRP2_HUMAN)
RMCLSLQKL

SEQ ID NO: 185261 - protein, 9 aa, Artificial Sequence
  Description of Artificial Sequence: Synthetic peptide
  Seed: SFLNGTNAL (TYRP2_HUMAN)
SALNGTNAM

SEQ ID NO: 185262 - protein, 9 aa, Artificial Sequence
  Description of Artificial Sequence: Synthetic peptide
  Seed: WHRYHLLCL (TYRP2_HUMAN)
WVRYHLLCL

SEQ ID NO: 185263 - protein, 9 aa, Artificial Sequence
  Description of Artificial Sequence: Synthetic peptide
  Seed: AIFDEWMKR (TYRP2_HUMAN)
AIFDEWMKY

SEQ ID NO: 185264 - protein, 9 aa, Artificial Sequence
  Description of Artificial Sequence: Synthetic peptide
  Seed: LWPRKFFHR (TYRP2_HUMAN)
LFPRKFFHR

SEQ ID NO: 185265 - protein, 9 aa, Artificial Sequence
  Description of Artificial Sequence: Synthetic peptide
  Seed: SFLNGTNAL (TYRP2_HUMAN)
SSLNGTNAM

SEQ ID NO: 185266 - protein, 11 aa, Artificial Sequence
  Description of Artificial Sequence: Synthetic peptide
  Seed: HNRMYNMVPFF (TYRP2_HUMAN)
HMRMYNMVPFY

SEQ ID NO: 185267 - protein, 11 aa, Artificial Sequence
  Description of Artificial Sequence: Synthetic peptide
  Seed: YVITTQHWLGL (TYRP2_HUMAN)
YQITTQHWLGL

SEQ ID NO: 185268 - protein, 9 aa, Artificial Sequence
  Description of Artificial Sequence: Synthetic peptide
  Seed: FFPPVTNEE (TYRP2_HUMAN)
FIPPVTNEF

SEQ ID NO: 185269 - protein, 9 aa, Artificial Sequence
  Description of Artificial Sequence: Synthetic peptide
  Seed: SLHNLVHSF (TYRP2_HUMAN)
SMHNLVHSY

SEQ ID NO: 185270 - protein, 9 aa, Artificial Sequence
  Description of Artificial Sequence: Synthetic peptide
  Seed: QKFDNPPFF (TYRP2_HUMAN)
QVFDNPPFY

SEQ ID NO: 185271 - protein, 9 aa, Artificial Sequence
  Description of Artificial Sequence: Synthetic peptide
  Seed: RNQMGRNSM (TYRP2_HUMAN)
RIQMGRNSY

SEQ ID NO: 185272 - protein, 9 aa, Artificial Sequence
  Description of Artificial Sequence: Synthetic peptide
  Seed: AANDPIFVV (TYRP2_HUMAN)
ASNDPIFVM

SEQ ID NO: 185273 - protein, 10 aa, Artificial Sequence
  Description of Artificial Sequence: Synthetic peptide
  Seed: LHYYSVRDTL (TYRP2_HUMAN)
LCYYSVRDTW

SEQ ID NO: 185274 - protein, 10 aa, Artificial Sequence
  Description of Artificial Sequence: Synthetic peptide
  Seed: LVVMGTLVAL (TYRP2_HUMAN)
LQVMGTLVAF

SEQ ID NO: 185275 - protein, 9 aa, Artificial Sequence
  Description of Artificial Sequence: Synthetic peptide
  Seed: SRFSSWETV (TYRP2_HUMAN)
SHFSSWETF

SEQ ID NO: 185276 - protein, 10 aa, Artificial Sequence
  Description of Artificial Sequence: Synthetic peptide
  Seed: LVVMGTLVAL (TYRP2_HUMAN)
LEVMGTLVAY

SEQ ID NO: 185277 - protein, 10 aa, Artificial Sequence
  Description of Artificial Sequence: Synthetic peptide
  Seed: RMYNMVPFFP (TYRP2_HUMAN)
RNYNMVPFFK

SEQ ID NO: 185278 - protein, 10 aa, Artificial Sequence
  Description of Artificial Sequence: Synthetic peptide
  Seed: AIFDEWMKRF (TYRP2_HUMAN)
AVFDEWMKRY

SEQ ID NO: 185279 - protein, 8 aa, Artificial Sequence
  Description of Artificial Sequence: Synthetic peptide
  Seed: FSHQGPAF (TYRP2_HUMAN)
FFHQGPAV

SEQ ID NO: 185280 - protein, 9 aa, Artificial Sequence
  Description of Artificial Sequence: Synthetic peptide
  Seed: TLDSQVMSL (TYRP2_HUMAN)
TTDSQVMSF

SEQ ID NO: 185281 - protein, 11 aa, Artificial Sequence
  Description of Artificial Sequence: Synthetic peptide
  Seed: YNMVPFFPPVT (TYRP2_HUMAN)
YIMVPFFPPVR

SEQ ID NO: 185282 - protein, 11 aa, Artificial Sequence
  Description of Artificial Sequence: Synthetic peptide
  Seed: RNSRFSSWETV (TYRP2_HUMAN)
RMSRFSSWETM

SEQ ID NO: 185283 - protein, 10 aa, Artificial Sequence
  Description of Artificial Sequence: Synthetic peptide
  Seed: FFPPVTNEEL (TYRP2_HUMAN)
FTPPVTNEEF

SEQ ID NO: 185284 - protein, 9 aa, Artificial Sequence
  Description of Artificial Sequence: Synthetic peptide
  Seed: RQNIHSLSP (TYRP2_HUMAN)
RMNIHSLSH

SEQ ID NO: 185285 - protein, 10 aa, Artificial Sequence
  Description of Artificial Sequence: Synthetic peptide
  Seed: AIFDEWMKRF (TYRP2_HUMAN)
AMFDEWMKRW

SEQ ID NO: 185286 - protein, 9 aa, Artificial Sequence
  Description of Artificial Sequence: Synthetic peptide
  Seed: DDYNHLVTL (TYRP2_HUMAN)
DTYNHLVTY

SEQ ID NO: 185287 - protein, 10 aa, Artificial Sequence
  Description of Artificial Sequence: Synthetic peptide
  Seed: TVDSLVNKEC (TYRP2_HUMAN)
TADSLVNKEF

SEQ ID NO: 185288 - protein, 9 aa, Artificial Sequence
  Description of Artificial Sequence: Synthetic peptide
  Seed: NRMYNMVPF (TYRP2_HUMAN)
NRMYNMVPM

SEQ ID NO: 185289 - protein, 10 aa, Artificial Sequence
  Description of Artificial Sequence: Synthetic peptide
  Seed: QPQFANCSVY (TYRP2_HUMAN)
QSQFANCSVL

SEQ ID NO: 185290 - protein, 11 aa, Artificial Sequence
  Description of Artificial Sequence: Synthetic peptide
  Seed: FVVLHSFTDAI (TYRP2_HUMAN)
FRVLHSFTDAL

SEQ ID NO: 185291 - protein, 9 aa, Artificial Sequence
  Description of Artificial Sequence: Synthetic peptide
  Seed: VLHSFTDAI (TYRP2_HUMAN)
VLHSFTDAY

SEQ ID NO: 185292 - protein, 11 aa, Artificial Sequence
  Description of Artificial Sequence: Synthetic peptide
  Seed: SLDDYNHLVTL (TYRP2_HUMAN)
SLDDYNHLVTF

SEQ ID NO: 185293 - protein, 9 aa, Artificial Sequence
  Description of Artificial Sequence: Synthetic peptide
  Seed: VIRQNIHSL (TYRP2_HUMAN)
VARQNIHSL

SEQ ID NO: 185294 - protein, 9 aa, Artificial Sequence
  Description of Artificial Sequence: Synthetic peptide
  Seed: QKFDNPPFF (TYRP2_HUMAN)
QRFDNPPFF

SEQ ID NO: 185295 - protein, 9 aa, Artificial Sequence
  Description of Artificial Sequence: Synthetic peptide
  Seed: RLRKGYTPL (TYRP2_HUMAN)
RKRKGYTPM

SEQ ID NO: 185296 - protein, 11 aa, Artificial Sequence
  Description of Artificial Sequence: Synthetic peptide
  Seed: ELAPIGHNRMY (TYRP2_HUMAN)
EIAPIGHNRMK

SEQ ID NO: 185297 - protein, 10 aa, Artificial Sequence
  Description of Artificial Sequence: Synthetic peptide
  Seed: YAIDLPVSVE (TYRP2_HUMAN)
YLIDLPVSVI

SEQ ID NO: 185298 - protein, 9 aa, Artificial Sequence
  Description of Artificial Sequence: Synthetic peptide
  Seed: SFLNGTNAL (TYRP2_HUMAN)
SYLNGTNAM

SEQ ID NO: 185299 - protein, 10 aa, Artificial Sequence
  Description of Artificial Sequence: Synthetic peptide
  Seed: RNSRFSSWET (TYRP2_HUMAN)
RDSRFSSWEV

SEQ ID NO: 185300 - protein, 10 aa, Artificial Sequence
  Description of Artificial Sequence: Synthetic peptide
  Seed: FLLSCLGCKI (TYRP2_HUMAN)
FILSCLGCKM

SEQ ID NO: 185301 - protein, 9 aa, Artificial Sequence
  Description of Artificial Sequence: Synthetic peptide
  Seed: LAPIGHNRM (TYRP2_HUMAN)
LYPIGHNRL

SEQ ID NO: 185302 - protein, 10 aa, Artificial Sequence
  Description of Artificial Sequence: Synthetic peptide
  Seed: TLCNGTYEGL (TYRP2_HUMAN)
TLCNGTYEGI

SEQ ID NO: 185303 - protein, 9 aa, Artificial Sequence
  Description of Artificial Sequence: Synthetic peptide
  Seed: FTDAIFDEW (TYRP2_HUMAN)
FNDAIFDEI

SEQ ID NO: 185304 - protein, 10 aa, Artificial Sequence
  Description of Artificial Sequence: Synthetic peptide
  Seed: GQFPRVCMTV (TYRP2_HUMAN)
GVFPRVCMTV

SEQ ID NO: 185305 - protein, 9 aa, Artificial Sequence
  Description of Artificial Sequence: Synthetic peptide
  Seed: VHPDYVITT (TYRP2_HUMAN)
VRPDYVITL

SEQ ID NO: 185306 - protein, 10 aa, Artificial Sequence
  Description of Artificial Sequence: Synthetic peptide
  Seed: CCPRLGAESA (TYRP2_HUMAN)
CKPRLGAESL

SEQ ID NO: 185307 - protein, 9 aa, Artificial Sequence
  Description of Artificial Sequence: Synthetic peptide
  Seed: FTDAIFDEW (TYRP2_HUMAN)
FQDAIFDEV

SEQ ID NO: 185308 - protein, 9 aa, Artificial Sequence
  Description of Artificial Sequence: Synthetic peptide
  Seed: RLRKGYTPL (TYRP2_HUMAN)
RTRKGYTPL

SEQ ID NO: 185309 - protein, 10 aa, Artificial Sequence
  Description of Artificial Sequence: Synthetic peptide
  Seed: FGWTGPNCER (TYRP2_HUMAN)
FAWTGPNCEY

SEQ ID NO: 185310 - protein, 9 aa, Artificial Sequence
  Description of Artificial Sequence: Synthetic peptide
  Seed: ETPGWPTTL (TYRP2_HUMAN)
EQPGWPTTF

SEQ ID NO: 185311 - protein, 10 aa, Artificial Sequence
  Description of Artificial Sequence: Synthetic peptide
  Seed: LHYYSVRDTL (TYRP2_HUMAN)
LGYYSVRDTW

SEQ ID NO: 185312 - protein, 11 aa, Artificial Sequence
  Description of Artificial Sequence: Synthetic peptide
  Seed: SVYDFFVWLHY (TYRP2_HUMAN)
SMYDFFVWLHK

SEQ ID NO: 185313 - protein, 9 aa, Artificial Sequence
  Description of Artificial Sequence: Synthetic peptide
  Seed: SRFSSWETV (TYRP2_HUMAN)
SHFSSWETI

SEQ ID NO: 185314 - protein, 11 aa, Artificial Sequence
  Description of Artificial Sequence: Synthetic peptide
  Seed: RADTRPWSGPY (TYRP2_HUMAN)
RHDTRPWSGPA

SEQ ID NO: 185315 - protein, 9 aa, Artificial Sequence
  Description of Artificial Sequence: Synthetic peptide
  Seed: RMYNMVPFF (TYRP2_HUMAN)
RMYNMVPFA

SEQ ID NO: 185316 - protein, 9 aa, Artificial Sequence
  Description of Artificial Sequence: Synthetic peptide
  Seed: SLDDYNHLV (TYRP2_HUMAN)
SWDDYNHLI

SEQ ID NO: 185317 - protein, 10 aa, Artificial Sequence
  Description of Artificial Sequence: Synthetic peptide
  Seed: YNMVPFFPPV (TYRP2_HUMAN)
YPMVPFFPPA

SEQ ID NO: 185318 - protein, 10 aa, Artificial Sequence
  Description of Artificial Sequence: Synthetic peptide
  Seed: YNMVPFFPPV (TYRP2_HUMAN)
YGMVPFFPPA

SEQ ID NO: 185319 - protein, 9 aa, Artificial Sequence
  Description of Artificial Sequence: Synthetic peptide
  Seed: ETPGWPTTL (TYRP2_HUMAN)
ELPGWPTTY

SEQ ID NO: 185320 - protein, 9 aa, Artificial Sequence
  Description of Artificial Sequence: Synthetic peptide
  Seed: HSAANDPIF (TYRP2_HUMAN)
HKAANDPIF

SEQ ID NO: 185321 - protein, 10 aa, Artificial Sequence
  Description of Artificial Sequence: Synthetic peptide
  Seed: RPWSGPYILR (TYRP2_HUMAN)
RRWSGPYILR

SEQ ID NO: 185322 - protein, 9 aa, Artificial Sequence
  Description of Artificial Sequence: Synthetic peptide
  Seed: RFNPPADAW (TYRP2_HUMAN)
RQNPPADAF

SEQ ID NO: 185323 - protein, 10 aa, Artificial Sequence
  Description of Artificial Sequence: Synthetic peptide
  Seed: VVMGTLVALV (TYRP2_HUMAN)
VDMGTLVALV

SEQ ID NO: 185324 - protein, 9 aa, Artificial Sequence
  Description of Artificial Sequence: Synthetic peptide
  Seed: ANDPIFVVL (TYRP2_HUMAN)
ADDPIFVVM

SEQ ID NO: 185325 - protein, 9 aa, Artificial Sequence
  Description of Artificial Sequence: Synthetic peptide
  Seed: ANDPIFVVL (TYRP2_HUMAN)
AWDPIFVVI

SEQ ID NO: 185326 - protein, 9 aa, Artificial Sequence
  Description of Artificial Sequence: Synthetic peptide
  Seed: VPFFPPVTN (TYRP2_HUMAN)
VPFFPPVTP

SEQ ID NO: 185327 - protein, 9 aa, Artificial Sequence
  Description of Artificial Sequence: Synthetic peptide
  Seed: SFLNGTNAL (TYRP2_HUMAN)
SGLNGTNAY

SEQ ID NO: 185328 - protein, 11 aa, Artificial Sequence
  Description of Artificial Sequence: Synthetic peptide
  Seed: RADTRPWSGPY (TYRP2_HUMAN)
RVDTRPWSGPK

SEQ ID NO: 185329 - protein, 9 aa, Artificial Sequence
  Description of Artificial Sequence: Synthetic peptide
  Seed: STFSFRNAL (TYRP2_HUMAN)
SYFSFRNAY

SEQ ID NO: 185330 - protein, 10 aa, Artificial Sequence
  Description of Artificial Sequence: Synthetic peptide
  Seed: IDFSHQGPAF (TYRP2_HUMAN)
IMFSHQGPAF

SEQ ID NO: 185331 - protein, 9 aa, Artificial Sequence
  Description of Artificial Sequence: Synthetic peptide
  Seed: FTDAIFDEW (TYRP2_HUMAN)
FSDAIFDEI

SEQ ID NO: 185332 - protein, 9 aa, Artificial Sequence
  Description of Artificial Sequence: Synthetic peptide
  Seed: SAANDPIFV (TYRP2_HUMAN)
SQANDPIFL

SEQ ID NO: 185333 - protein, 10 aa, Artificial Sequence
  Description of Artificial Sequence: Synthetic peptide
  Seed: FFQNSTFSFR (TYRP2_HUMAN)
FFQNSTFSFL

SEQ ID NO: 185334 - protein, 9 aa, Artificial Sequence
  Description of Artificial Sequence: Synthetic peptide
  Seed: ADAWPQELA (TYRP2_HUMAN)
AEAWPQELA

SEQ ID NO: 185335 - protein, 11 aa, Artificial Sequence
  Description of Artificial Sequence: Synthetic peptide
  Seed: EQFLGALDLAK (TYRP2_HUMAN)
ETFLGALDLAK

SEQ ID NO: 185336 - protein, 10 aa, Artificial Sequence
  Description of Artificial Sequence: Synthetic peptide
  Seed: QPQFANCSVY (TYRP2_HUMAN)
QHQFANCSVL

SEQ ID NO: 185337 - protein, 9 aa, Artificial Sequence
  Description of Artificial Sequence: Synthetic peptide
  Seed: SRFSSWETV (TYRP2_HUMAN)
SAFSSWETF

SEQ ID NO: 185338 - protein, 10 aa, Artificial Sequence
  Description of Artificial Sequence: Synthetic peptide
  Seed: RNSRFSSWET (TYRP2_HUMAN)
RYSRFSSWEI

SEQ ID NO: 185339 - protein, 10 aa, Artificial Sequence
  Description of Artificial Sequence: Synthetic peptide
  Seed: TPLMETHLSS (TYRP2_HUMAN)
TPLMETHLSA

SEQ ID NO: 185340 - protein, 10 aa, Artificial Sequence
  Description of Artificial Sequence: Synthetic peptide
  Seed: RRLRKGYTPL (TYRP2_HUMAN)
RELRKGYTPK

SEQ ID NO: 185341 - protein, 9 aa, Artificial Sequence
  Description of Artificial Sequence: Synthetic peptide
  Seed: SFALPYWNF (TYRP2_HUMAN)
SYALPYWNI

SEQ ID NO: 185342 - protein, 10 aa, Artificial Sequence
  Description of Artificial Sequence: Synthetic peptide
  Seed: FVWLHYYSVR (TYRP2_HUMAN)
FLWLHYYSVV

SEQ ID NO: 185343 - protein, 11 aa, Artificial Sequence
  Description of Artificial Sequence: Synthetic peptide
  Seed: LVVMGTLVALV (TYRP2_HUMAN)
LYVMGTLVALV

SEQ ID NO: 185344 - protein, 11 aa, Artificial Sequence
  Description of Artificial Sequence: Synthetic peptide
  Seed: SLDDYNHLVTL (TYRP2_HUMAN)
SIDDYNHLVTL

SEQ ID NO: 185345 - protein, 11 aa, Artificial Sequence
  Description of Artificial Sequence: Synthetic peptide
  Seed: KADGTLDSQVM (TYRP2_HUMAN)
KLDGTLDSQVL

SEQ ID NO: 185346 - protein, 9 aa, Artificial Sequence
  Description of Artificial Sequence: Synthetic peptide
  Seed: VTWHRYHLL (TYRP2_HUMAN)
VLWHRYHLT

SEQ ID NO: 185347 - protein, 11 aa, Artificial Sequence
  Description of Artificial Sequence: Synthetic peptide
  Seed: KRVHPDYVITT (TYRP2_HUMAN)
KRVHPDYVITL

SEQ ID NO: 185348 - protein, 10 aa, Artificial Sequence
  Description of Artificial Sequence: Synthetic peptide
  Seed: RLRKGYTPLM (TYRP2_HUMAN)
RWRKGYTPLM

SEQ ID NO: 185349 - protein, 9 aa, Artificial Sequence
  Description of Artificial Sequence: Synthetic peptide
  Seed: HYYSVRDTL (TYRP2_HUMAN)
HEYSVRDTY

SEQ ID NO: 185350 - protein, 10 aa, Artificial Sequence
  Description of Artificial Sequence: Synthetic peptide
  Seed: SFTDAIFDEW (TYRP2_HUMAN)
SYTDAIFDEW

SEQ ID NO: 185351 - protein, 9 aa, Artificial Sequence
  Description of Artificial Sequence: Synthetic peptide
  Seed: RFNPPADAW (TYRP2_HUMAN)
RWNPPADAI

SEQ ID NO: 185352 - protein, 11 aa, Artificial Sequence
  Description of Artificial Sequence: Synthetic peptide
  Seed: FLTSDQLGYSY (TYRP2_HUMAN)
FDTSDQLGYSY

SEQ ID NO: 185353 - protein, 10 aa, Artificial Sequence
  Description of Artificial Sequence: Synthetic peptide
  Seed: MSPLWWGFLL (TYRP2_HUMAN)
MIPLWWGFLW

SEQ ID NO: 185354 - protein, 9 aa, Artificial Sequence
  Description of Artificial Sequence: Synthetic peptide
  Seed: REQFLGALD (TYRP2_HUMAN)
REQFLGALL

SEQ ID NO: 185355 - protein, 10 aa, Artificial Sequence
  Description of Artificial Sequence: Synthetic peptide
  Seed: CCPRLGAESA (TYRP2_HUMAN)
CWPRLGAESL

SEQ ID NO: 185356 - protein, 10 aa, Artificial Sequence
  Description of Artificial Sequence: Synthetic peptide
  Seed: LTSDQLGYSY (TYRP2_HUMAN)
LFSDQLGYSY

SEQ ID NO: 185357 - protein, 10 aa, Artificial Sequence
  Description of Artificial Sequence: Synthetic peptide
  Seed: ELAPIGHNRM (TYRP2_HUMAN)
EMAPIGHNRV

SEQ ID NO: 185358 - protein, 9 aa, Artificial Sequence
  Description of Artificial Sequence: Synthetic peptide
  Seed: NSMKLPTLK (TYRP2_HUMAN)
NPMKLPTLR

SEQ ID NO: 185359 - protein, 9 aa, Artificial Sequence
  Description of Artificial Sequence: Synthetic peptide
  Seed: DFFVWLHYY (TYRP2_HUMAN)
DTFVWLHYR

SEQ ID NO: 185360 - protein, 9 aa, Artificial Sequence
  Description of Artificial Sequence: Synthetic peptide
  Seed: TLVALVGLF (TYRP2_HUMAN)
TQVALVGLM

SEQ ID NO: 185361 - protein, 10 aa, Artificial Sequence
  Description of Artificial Sequence: Synthetic peptide
  Seed: VLLAFLQYRR (TYRP2_HUMAN)
VKLAFLQYRR

SEQ ID NO: 185362 - protein, 9 aa, Artificial Sequence
  Description of Artificial Sequence: Synthetic peptide
  Seed: TLDSQVMSL (TYRP2_HUMAN)
TYDSQVMSM

SEQ ID NO: 185363 - protein, 10 aa, Artificial Sequence
  Description of Artificial Sequence: Synthetic peptide
  Seed: VVMGTLVALV (TYRP2_HUMAN)
VYMGTLVALL

SEQ ID NO: 185364 - protein, 10 aa, Artificial Sequence
  Description of Artificial Sequence: Synthetic peptide
  Seed: HRYHLLCLER (TYRP2_HUMAN)
HMYHLLCLEK

SEQ ID NO: 185365 - protein, 9 aa, Artificial Sequence
  Description of Artificial Sequence: Synthetic peptide
  Seed: NMVPFFPPV (TYRP2_HUMAN)
NVVPFFPPL

SEQ ID NO: 185366 - protein, 9 aa, Artificial Sequence
  Description of Artificial Sequence: Synthetic peptide
  Seed: KCTGNFAGY (TYRP2_HUMAN)
KLTGNFAGY

SEQ ID NO: 185367 - protein, 10 aa, Artificial Sequence
  Description of Artificial Sequence: Synthetic peptide
  Seed: YAIDLPVSVE (TYRP2_HUMAN)
YLIDLPVSVQ

SEQ ID NO: 185368 - protein, 9 aa, Artificial Sequence
  Description of Artificial Sequence: Synthetic peptide
  Seed: VLHSFTDAI (TYRP2_HUMAN)
VQHSFTDAM

SEQ ID NO: 185369 - protein, 10 aa, Artificial Sequence
  Description of Artificial Sequence: Synthetic peptide
  Seed: AGYNCGDCKF (TYRP2_HUMAN)
ASYNCGDCKW

SEQ ID NO: 185370 - protein, 9 aa, Artificial Sequence
  Description of Artificial Sequence: Synthetic peptide
  Seed: RKFFHRTCK (TYRP2_HUMAN)
RIFFHRTCY

SEQ ID NO: 185371 - protein, 9 aa, Artificial Sequence
  Description of Artificial Sequence: Synthetic peptide
  Seed: NSMKLPTLK (TYRP2_HUMAN)
NMMKLPTLK

SEQ ID NO: 185372 - protein, 10 aa, Artificial Sequence
  Description of Artificial Sequence: Synthetic peptide
  Seed: NSTFSFRNAL (TYRP2_HUMAN)
NNTFSFRNAI

SEQ ID NO: 185373 - protein, 8 aa, Artificial Sequence
  Description of Artificial Sequence: Synthetic peptide
  Seed: KFDNPPFF (TYRP2_HUMAN)
KMDNPPFL

SEQ ID NO: 185374 - protein, 10 aa, Artificial Sequence
  Description of Artificial Sequence: Synthetic peptide
  Seed: LVVMGTLVAL (TYRP2_HUMAN)
LWVMGTLVAF

SEQ ID NO: 185375 - protein, 9 aa, Artificial Sequence
  Description of Artificial Sequence: Synthetic peptide
  Seed: TLDSQVMSL (TYRP2_HUMAN)
TLDSQVMSA

SEQ ID NO: 185376 - protein, 9 aa, Artificial Sequence
  Description of Artificial Sequence: Synthetic peptide
  Seed: FTDAIFDEW (TYRP2_HUMAN)
FSDAIFDEM

SEQ ID NO: 185377 - protein, 9 aa, Artificial Sequence
  Description of Artificial Sequence: Synthetic peptide
  Seed: TLDSQVMSL (TYRP2_HUMAN)
TGDSQVMSM

SEQ ID NO: 185378 - protein, 11 aa, Artificial Sequence
  Description of Artificial Sequence: Synthetic peptide
  Seed: AIDFSHQGPAF (TYRP2_HUMAN)
AADFSHQGPAL

SEQ ID NO: 185379 - protein, 11 aa, Artificial Sequence
  Description of Artificial Sequence: Synthetic peptide
  Seed: PFFQNSTFSFR (TYRP2_HUMAN)
PMFQNSTFSFR

SEQ ID NO: 185380 - protein, 9 aa, Artificial Sequence
  Description of Artificial Sequence: Synthetic peptide
  Seed: STFSFRNAL (TYRP2_HUMAN)
SHFSFRNAY

SEQ ID NO: 185381 - protein, 9 aa, Artificial Sequence
  Description of Artificial Sequence: Synthetic peptide
  Seed: PAFVTWHRY (TYRP2_HUMAN)
PMFVTWHRY

SEQ ID NO: 185382 - protein, 9 aa, Artificial Sequence
  Description of Artificial Sequence: Synthetic peptide
  Seed: VIRQNIHSL (TYRP2_HUMAN)
VVRQNIHSW

SEQ ID NO: 185383 - protein, 9 aa, Artificial Sequence
  Description of Artificial Sequence: Synthetic peptide
  Seed: SLDDYNHLV (TYRP2_HUMAN)
SSDDYNHLC

SEQ ID NO: 185384 - protein, 10 aa, Artificial Sequence
  Description of Artificial Sequence: Synthetic peptide
  Seed: ESANVCGSQQ (TYRP2_HUMAN)
EVANVCGSQK

SEQ ID NO: 185385 - protein, 10 aa, Artificial Sequence
  Description of Artificial Sequence: Synthetic peptide
  Seed: AANDPIFVVL (TYRP2_HUMAN)
AANDPIFVVH

SEQ ID NO: 185386 - protein, 9 aa, Artificial Sequence
  Description of Artificial Sequence: Synthetic peptide
  Seed: FTDAIFDEW (TYRP2_HUMAN)
FMDAIFDEV

SEQ ID NO: 185387 - protein, 9 aa, Artificial Sequence
  Description of Artificial Sequence: Synthetic peptide
  Seed: TSDQLGYSY (TYRP2_HUMAN)
TFDQLGYSL

SEQ ID NO: 185388 - protein, 9 aa, Artificial Sequence
  Description of Artificial Sequence: Synthetic peptide
  Seed: SLHNLVHSF (TYRP2_HUMAN)
SHHNLVHSY

SEQ ID NO: 185389 - protein, 10 aa, Artificial Sequence
  Description of Artificial Sequence: Synthetic peptide
  Seed: KILPGAQGQF (TYRP2_HUMAN)
KTLPGAQGQM

SEQ ID NO: 185390 - protein, 9 aa, Artificial Sequence
  Description of Artificial Sequence: Synthetic peptide
  Seed: TLDSQVMSL (TYRP2_HUMAN)
TVDSQVMSC

SEQ ID NO: 185391 - protein, 11 aa, Artificial Sequence
  Description of Artificial Sequence: Synthetic peptide
  Seed: RADTRPWSGPY (TYRP2_HUMAN)
RLDTRPWSGPK

SEQ ID NO: 185392 - protein, 9 aa, Artificial Sequence
  Description of Artificial Sequence: Synthetic peptide
  Seed: YYSVRDTLL (TYRP2_HUMAN)
YSSVRDTLM

SEQ ID NO: 185393 - protein, 10 aa, Artificial Sequence
  Description of Artificial Sequence: Synthetic peptide
  Seed: YNMVPFFPPV (TYRP2_HUMAN)
YCMVPFFPPT

SEQ ID NO: 185394 - protein, 11 aa, Artificial Sequence
  Description of Artificial Sequence: Synthetic peptide
  Seed: YSYAIDLPVSV (TYRP2_HUMAN)
YMYAIDLPVST

SEQ ID NO: 185395 - protein, 10 aa, Artificial Sequence
  Description of Artificial Sequence: Synthetic peptide
  Seed: AANDPIFVVL (TYRP2_HUMAN)
AMNDPIFVVF

SEQ ID NO: 185396 - protein, 9 aa, Artificial Sequence
  Description of Artificial Sequence: Synthetic peptide
  Seed: VIRQNIHSL (TYRP2_HUMAN)
VTRQNIHSK

SEQ ID NO: 185397 - protein, 11 aa, Artificial Sequence
  Description of Artificial Sequence: Synthetic peptide
  Seed: FFPPVTNEELF (TYRP2_HUMAN)
FVPPVTNEELW

SEQ ID NO: 185398 - protein, 10 aa, Artificial Sequence
  Description of Artificial Sequence: Synthetic peptide
  Seed: QPQFANCSVY (TYRP2_HUMAN)
QFQFANCSVY

SEQ ID NO: 185399 - protein, 9 aa, Artificial Sequence
  Description of Artificial Sequence: Synthetic peptide
  Seed: DQLGYSYAI (TYRP2_HUMAN)
DMLGYSYAL

SEQ ID NO: 185400 - protein, 9 aa, Artificial Sequence
  Description of Artificial Sequence: Synthetic peptide
  Seed: SLDDYNHLV (TYRP2_HUMAN)
SLDDYNHLA

SEQ ID NO: 185401 - protein, 10 aa, Artificial Sequence
  Description of Artificial Sequence: Synthetic peptide
  Seed: SLDDYNHLVT (TYRP2_HUMAN)
SYDDYNHLVL

SEQ ID NO: 185402 - protein, 9 aa, Artificial Sequence
  Description of Artificial Sequence: Synthetic peptide
  Seed: YDFFVWLHY (TYRP2_HUMAN)
YEFFVWLHL

SEQ ID NO: 185403 - protein, 9 aa, Artificial Sequence
  Description of Artificial Sequence: Synthetic peptide
  Seed: RVHPDYVIT (TYRP2_HUMAN)
RSHPDYVIA

SEQ ID NO: 185404 - protein, 9 aa, Artificial Sequence
  Description of Artificial Sequence: Synthetic peptide
  Seed: ITTQHWLGL (TYRP2_HUMAN)
ISTQHWLGW

SEQ ID NO: 185405 - protein, 10 aa, Artificial Sequence
  Description of Artificial Sequence: Synthetic peptide
  Seed: VGLFVLLAFL (TYRP2_HUMAN)
VYLFVLLAFL

SEQ ID NO: 185406 - protein, 10 aa, Artificial Sequence
  Description of Artificial Sequence: Synthetic peptide
  Seed: SPLWWGFLLS (TYRP2_HUMAN)
SYLWWGFLLA

SEQ ID NO: 185407 - protein, 9 aa, Artificial Sequence
  Description of Artificial Sequence: Synthetic peptide
  Seed: HQGPAFVTW (TYRP2_HUMAN)
HEGPAFVTF

SEQ ID NO: 185408 - protein, 9 aa, Artificial Sequence
  Description of Artificial Sequence: Synthetic peptide
  Seed: RNQMGRNSM (TYRP2_HUMAN)
RHQMGRNSF

SEQ ID NO: 185409 - protein, 9 aa, Artificial Sequence
  Description of Artificial Sequence: Synthetic peptide
  Seed: YSYAIDLPV (TYRP2_HUMAN)
YQYAIDLPT

SEQ ID NO: 185410 - protein, 9 aa, Artificial Sequence
  Description of Artificial Sequence: Synthetic peptide
  Seed: ANDPIFVVL (TYRP2_HUMAN)
AADPIFVVY

SEQ ID NO: 185411 - protein, 9 aa, Artificial Sequence
  Description of Artificial Sequence: Synthetic peptide
  Seed: ISRNSRFSS (TYRP2_HUMAN)
ITRNSRFSM

SEQ ID NO: 185412 - protein, 10 aa, Artificial Sequence
  Description of Artificial Sequence: Synthetic peptide
  Seed: LHYYSVRDTL (TYRP2_HUMAN)
LFYYSVRDTL

SEQ ID NO: 185413 - protein, 9 aa, Artificial Sequence
  Description of Artificial Sequence: Synthetic peptide
  Seed: LQKFDNPPF (TYRP2_HUMAN)
LKKFDNPPF

SEQ ID NO: 185414 - protein, 10 aa, Artificial Sequence
  Description of Artificial Sequence: Synthetic peptide
  Seed: SDQLGYSYAI (TYRP2_HUMAN)
SKQLGYSYAL

SEQ ID NO: 185415 - protein, 10 aa, Artificial Sequence
  Description of Artificial Sequence: Synthetic peptide
  Seed: ESANVCGSQQ (TYRP2_HUMAN)
EQANVCGSQR

SEQ ID NO: 185416 - protein, 9 aa, Artificial Sequence
  Description of Artificial Sequence: Synthetic peptide
  Seed: ALVGLFVLL (TYRP2_HUMAN)
ATVGLFVLV

SEQ ID NO: 185417 - protein, 11 aa, Artificial Sequence
  Description of Artificial Sequence: Synthetic peptide
  Seed: FANCSVYDFFV (TYRP2_HUMAN)
FQNCSVYDFFV

SEQ ID NO: 185418 - protein, 9 aa, Artificial Sequence
  Description of Artificial Sequence: Synthetic peptide
  Seed: LAFLQYRRL (TYRP2_HUMAN)
LSFLQYRRL

SEQ ID NO: 185419 - protein, 10 aa, Artificial Sequence
  Description of Artificial Sequence: Synthetic peptide
  Seed: HSFLNGTNAL (TYRP2_HUMAN)
HYFLNGTNAL

SEQ ID NO: 185420 - protein, 9 aa, Artificial Sequence
  Description of Artificial Sequence: Synthetic peptide
  Seed: HQGPAFVTW (TYRP2_HUMAN)
HSGPAFVTL

SEQ ID NO: 185421 - protein, 11 aa, Artificial Sequence
  Description of Artificial Sequence: Synthetic peptide
  Seed: FVVLHSFTDAI (TYRP2_HUMAN)
FYVLHSFTDAI

SEQ ID NO: 185422 - protein, 10 aa, Artificial Sequence
  Description of Artificial Sequence: Synthetic peptide
  Seed: NSTFSFRNAL (TYRP2_HUMAN)
NITFSFRNAI

SEQ ID NO: 185423 - protein, 9 aa, Artificial Sequence
  Description of Artificial Sequence: Synthetic peptide
  Seed: RKFFHRTCK (TYRP2_HUMAN)
RIFFHRTCM

SEQ ID NO: 185424 - protein, 11 aa, Artificial Sequence
  Description of Artificial Sequence: Synthetic peptide
  Seed: YNMVPFFPPVT (TYRP2_HUMAN)
YQMVPFFPPVV

SEQ ID NO: 185425 - protein, 9 aa, Artificial Sequence
  Description of Artificial Sequence: Synthetic peptide
  Seed: NMVPFFPPV (TYRP2_HUMAN)
NIVPFFPPR

SEQ ID NO: 185426 - protein, 10 aa, Artificial Sequence
  Description of Artificial Sequence: Synthetic peptide
  Seed: RPWSGPYILR (TYRP2_HUMAN)
RPWSGPYILL

SEQ ID NO: 185427 - protein, 9 aa, Artificial Sequence
  Description of Artificial Sequence: Synthetic peptide
  Seed: FSHQGPAFV (TYRP2_HUMAN)
FVHQGPAFM

SEQ ID NO: 185428 - protein, 9 aa, Artificial Sequence
  Description of Artificial Sequence: Synthetic peptide
  Seed: WHRYHLLCL (TYRP2_HUMAN)
WPRYHLLCM

SEQ ID NO: 185429 - protein, 10 aa, Artificial Sequence
  Description of Artificial Sequence: Synthetic peptide
  Seed: RNSRFSSWET (TYRP2_HUMAN)
RWSRFSSWEV

SEQ ID NO: 185430 - protein, 11 aa, Artificial Sequence
  Description of Artificial Sequence: Synthetic peptide
  Seed: YTPLMETHLSS (TYRP2_HUMAN)
YCPLMETHLSM

SEQ ID NO: 185431 - protein, 8 aa, Artificial Sequence
  Description of Artificial Sequence: Synthetic peptide
  Seed: LLGPGRPY (TYRP2_HUMAN)
LTGPGRPL

SEQ ID NO: 185432 - protein, 9 aa, Artificial Sequence
  Description of Artificial Sequence: Synthetic peptide
  Seed: FTDAIFDEW (TYRP2_HUMAN)
FTDAIFDEF

SEQ ID NO: 185433 - protein, 11 aa, Artificial Sequence
  Description of Artificial Sequence: Synthetic peptide
  Seed: RADTRPWSGPY (TYRP2_HUMAN)
RDDTRPWSGPA

SEQ ID NO: 185434 - protein, 9 aa, Artificial Sequence
  Description of Artificial Sequence: Synthetic peptide
  Seed: TLLGPGRPY (TYRP2_HUMAN)
TPLGPGRPY

SEQ ID NO: 185435 - protein, 8 aa, Artificial Sequence
  Description of Artificial Sequence: Synthetic peptide
  Seed: NSMKLPTL (TYRP2_HUMAN)
NAMKLPTI

SEQ ID NO: 185436 - protein, 9 aa, Artificial Sequence
  Description of Artificial Sequence: Synthetic peptide
  Seed: YVITTQHWL (TYRP2_HUMAN)
YMITTQHWL

SEQ ID NO: 185437 - protein, 11 aa, Artificial Sequence
  Description of Artificial Sequence: Synthetic peptide
  Seed: MYNMVPFFPPV (TYRP2_HUMAN)
MMNMVPFFPPL

SEQ ID NO: 185438 - protein, 9 aa, Artificial Sequence
  Description of Artificial Sequence: Synthetic peptide
  Seed: TLDSQVMSL (TYRP2_HUMAN)
TFDSQVMSW

SEQ ID NO: 185439 - protein, 10 aa, Artificial Sequence
  Description of Artificial Sequence: Synthetic peptide
  Seed: ELAPIGHNRM (TYRP2_HUMAN)
ETAPIGHNRR

SEQ ID NO: 185440 - protein, 10 aa, Artificial Sequence
  Description of Artificial Sequence: Synthetic peptide
  Seed: RRLRKGYTPL (TYRP2_HUMAN)
RWLRKGYTPV

SEQ ID NO: 185441 - protein, 8 aa, Artificial Sequence
  Description of Artificial Sequence: Synthetic peptide
  Seed: GQFPRVCM (TYRP2_HUMAN)
GQFPRVCF

SEQ ID NO: 185442 - protein, 10 aa, Artificial Sequence
  Description of Artificial Sequence: Synthetic peptide
  Seed: HSFLNGTNAL (TYRP2_HUMAN)
HTFLNGTNAF

SEQ ID NO: 185443 - protein, 9 aa, Artificial Sequence
  Description of Artificial Sequence: Synthetic peptide
  Seed: ELWPRKFFH (TYRP2_HUMAN)
EDWPRKFFR

SEQ ID NO: 185444 - protein, 9 aa, Artificial Sequence
  Description of Artificial Sequence: Synthetic peptide
  Seed: SFRNALEGF (TYRP2_HUMAN)
SARNALEGF

SEQ ID NO: 185445 - protein, 8 aa, Artificial Sequence
  Description of Artificial Sequence: Synthetic peptide
  Seed: IGNESFAL (TYRP2_HUMAN)
IANESFAL

SEQ ID NO: 185446 - protein, 10 aa, Artificial Sequence
  Description of Artificial Sequence: Synthetic peptide
  Seed: ETPGWPTTLL (TYRP2_HUMAN)
EMPGWPTTLK

SEQ ID NO: 185447 - protein, 9 aa, Artificial Sequence
  Description of Artificial Sequence: Synthetic peptide
  Seed: RVCMTVDSL (TYRP2_HUMAN)
RACMTVDSW

SEQ ID NO: 185448 - protein, 9 aa, Artificial Sequence
  Description of Artificial Sequence: Synthetic peptide
  Seed: FFPPVTNEE (TYRP2_HUMAN)
FMPPVTNEY

SEQ ID NO: 185449 - protein, 11 aa, Artificial Sequence
  Description of Artificial Sequence: Synthetic peptide
  Seed: YNMVPFFPPVT (TYRP2_HUMAN)
YVMVPFFPPVL

SEQ ID NO: 185450 - protein, 9 aa, Artificial Sequence
  Description of Artificial Sequence: Synthetic peptide
  Seed: SLHNLVHSF (TYRP2_HUMAN)
SEHNLVHSL

SEQ ID NO: 185451 - protein, 9 aa, Artificial Sequence
  Description of Artificial Sequence: Synthetic peptide
  Seed: VIRQNIHSL (TYRP2_HUMAN)
VMRQNIHSI

SEQ ID NO: 185452 - protein, 10 aa, Artificial Sequence
  Description of Artificial Sequence: Synthetic peptide
  Seed: YDFFVWLHYY (TYRP2_HUMAN)
YFFFVWLHYS

SEQ ID NO: 185453 - protein, 9 aa, Artificial Sequence
  Description of Artificial Sequence: Synthetic peptide
  Seed: ANDPIFVVL (TYRP2_HUMAN)
AQDPIFVVM

SEQ ID NO: 185454 - protein, 9 aa, Artificial Sequence
  Description of Artificial Sequence: Synthetic peptide
  Seed: VMSLHNLVH (TYRP2_HUMAN)
VQSLHNLVM

SEQ ID NO: 185455 - protein, 10 aa, Artificial Sequence
  Description of Artificial Sequence: Synthetic peptide
  Seed: RNSRFSSWET (TYRP2_HUMAN)
RKSRFSSWEK

SEQ ID NO: 185456 - protein, 9 aa, Artificial Sequence
  Description of Artificial Sequence: Synthetic peptide
  Seed: ISRNSRFSS (TYRP2_HUMAN)
IIRNSRFSK

SEQ ID NO: 185457 - protein, 9 aa, Artificial Sequence
  Description of Artificial Sequence: Synthetic peptide
  Seed: VPFFPPVTN (TYRP2_HUMAN)
VAFFPPVTA

SEQ ID NO: 185458 - protein, 9 aa, Artificial Sequence
  Description of Artificial Sequence: Synthetic peptide
  Seed: LAFLQYRRL (TYRP2_HUMAN)
LAFLQYRRM

SEQ ID NO: 185459 - protein, 9 aa, Artificial Sequence
  Description of Artificial Sequence: Synthetic peptide
  Seed: SRNSRFSSW (TYRP2_HUMAN)
SQNSRFSSV

SEQ ID NO: 185460 - protein, 10 aa, Artificial Sequence
  Description of Artificial Sequence: Synthetic peptide
  Seed: ELAPIGHNRM (TYRP2_HUMAN)
ETAPIGHNRQ

SEQ ID NO: 185461 - protein, 11 aa, Artificial Sequence
  Description of Artificial Sequence: Synthetic peptide
  Seed: RNSRFSSWETV (TYRP2_HUMAN)
RDSRFSSWETV

SEQ ID NO: 185462 - protein, 10 aa, Artificial Sequence
  Description of Artificial Sequence: Synthetic peptide
  Seed: MSPLWWGFLL (TYRP2_HUMAN)
MWPLWWGFLL

SEQ ID NO: 185463 - protein, 10 aa, Artificial Sequence
  Description of Artificial Sequence: Synthetic peptide
  Seed: SVRDTLLGPG (TYRP2_HUMAN)
SSRDTLLGPA

SEQ ID NO: 185464 - protein, 10 aa, Artificial Sequence
  Description of Artificial Sequence: Synthetic peptide
  Seed: IGNESFALPY (TYRP2_HUMAN)
IRNESFALPF

SEQ ID NO: 185465 - protein, 10 aa, Artificial Sequence
  Description of Artificial Sequence: Synthetic peptide
  Seed: VALVGLFVLL (TYRP2_HUMAN)
VFLVGLFVLV

SEQ ID NO: 185466 - protein, 9 aa, Artificial Sequence
  Description of Artificial Sequence: Synthetic peptide
  Seed: QFPRVCMTV (TYRP2_HUMAN)
QWPRVCMTM

SEQ ID NO: 185467 - protein, 9 aa, Artificial Sequence
  Description of Artificial Sequence: Synthetic peptide
  Seed: YSYAIDLPV (TYRP2_HUMAN)
YAYAIDLPY

SEQ ID NO: 185468 - protein, 9 aa, Artificial Sequence
  Description of Artificial Sequence: Synthetic peptide
  Seed: LERDLQRLI (TYRP2_HUMAN)
LERDLQRLL

SEQ ID NO: 185469 - protein, 9 aa, Artificial Sequence
  Description of Artificial Sequence: Synthetic peptide
  Seed: FVLLAFLQY (TYRP2_HUMAN)
FALLAFLQW

SEQ ID NO: 185470 - protein, 9 aa, Artificial Sequence
  Description of Artificial Sequence: Synthetic peptide
  Seed: SSKRYTEEA (TYRP2_HUMAN)
SAKRYTEEK

SEQ ID NO: 185471 - protein, 11 aa, Artificial Sequence
  Description of Artificial Sequence: Synthetic peptide
  Seed: MYNMVPFFPPV (TYRP2_HUMAN)
MLNMVPFFPPL

SEQ ID NO: 185472 - protein, 10 aa, Artificial Sequence
  Description of Artificial Sequence: Synthetic peptide
  Seed: FSFRNALEGF (TYRP2_HUMAN)
FSFRNALEGW

SEQ ID NO: 185473 - protein, 9 aa, Artificial Sequence
  Description of Artificial Sequence: Synthetic peptide
  Seed: FSHQGPAFV (TYRP2_HUMAN)
FTHQGPAFL

SEQ ID NO: 185474 - protein, 9 aa, Artificial Sequence
  Description of Artificial Sequence: Synthetic peptide
  Seed: SLDDYNHLV (TYRP2_HUMAN)
SFDDYNHLY

SEQ ID NO: 185475 - protein, 11 aa, Artificial Sequence
  Description of Artificial Sequence: Synthetic peptide
  Seed: MYNMVPFFPPV (TYRP2_HUMAN)
MHNMVPFFPPV

SEQ ID NO: 185476 - protein, 10 aa, Artificial Sequence
  Description of Artificial Sequence: Synthetic peptide
  Seed: ADTRPWSGPY (TYRP2_HUMAN)
ACTRPWSGPK

SEQ ID NO: 185477 - protein, 11 aa, Artificial Sequence
  Description of Artificial Sequence: Synthetic peptide
  Seed: MYNMVPFFPPV (TYRP2_HUMAN)
MWNMVPFFPPW

SEQ ID NO: 185478 - protein, 10 aa, Artificial Sequence
  Description of Artificial Sequence: Synthetic peptide
  Seed: MSPLWWGFLL (TYRP2_HUMAN)
MQPLWWGFLA

SEQ ID NO: 185479 - protein, 10 aa, Artificial Sequence
  Description of Artificial Sequence: Synthetic peptide
  Seed: ESFALPYWNF (TYRP2_HUMAN)
EYFALPYWNW

SEQ ID NO: 185480 - protein, 10 aa, Artificial Sequence
  Description of Artificial Sequence: Synthetic peptide
  Seed: RELWPRKFFH (TYRP2_HUMAN)
RWLWPRKFFK

SEQ ID NO: 185481 - protein, 9 aa, Artificial Sequence
  Description of Artificial Sequence: Synthetic peptide
  Seed: FVLLAFLQY (TYRP2_HUMAN)
FALLAFLQL

SEQ ID NO: 185482 - protein, 9 aa, Artificial Sequence
  Description of Artificial Sequence: Synthetic peptide
  Seed: TLDSQVMSL (TYRP2_HUMAN)
THDSQVMSL

SEQ ID NO: 185483 - protein, 9 aa, Artificial Sequence
  Description of Artificial Sequence: Synthetic peptide
  Seed: FANCSVYDF (TYRP2_HUMAN)
FQNCSVYDM

SEQ ID NO: 185484 - protein, 9 aa, Artificial Sequence
  Description of Artificial Sequence: Synthetic peptide
  Seed: ALVGLFVLL (TYRP2_HUMAN)
AIVGLFVLI

SEQ ID NO: 185485 - protein, 9 aa, Artificial Sequence
  Description of Artificial Sequence: Synthetic peptide
  Seed: DDYNHLVTL (TYRP2_HUMAN)
DIYNHLVTY

SEQ ID NO: 185486 - protein, 8 aa, Artificial Sequence
  Description of Artificial Sequence: Synthetic peptide
  Seed: FSHQGPAF (TYRP2_HUMAN)
FQHQGPAM

SEQ ID NO: 185487 - protein, 9 aa, Artificial Sequence
  Description of Artificial Sequence: Synthetic peptide
  Seed: LHNLVHSFL (TYRP2_HUMAN)
LLNLVHSFF

SEQ ID NO: 185488 - protein, 9 aa, Artificial Sequence
  Description of Artificial Sequence: Synthetic peptide
  Seed: ISRNSRFSS (TYRP2_HUMAN)
ISRNSRFSG

SEQ ID NO: 185489 - protein, 10 aa, Artificial Sequence
  Description of Artificial Sequence: Synthetic peptide
  Seed: NGTYEGLLRR (TYRP2_HUMAN)
NVTYEGLLRK

SEQ ID NO: 185490 - protein, 9 aa, Artificial Sequence
  Description of Artificial Sequence: Synthetic peptide
  Seed: WPQELAPIG (TYRP2_HUMAN)
WPQELAPIY

SEQ ID NO: 185491 - protein, 10 aa, Artificial Sequence
  Description of Artificial Sequence: Synthetic peptide
  Seed: RLRKGYTPLM (TYRP2_HUMAN)
RPRKGYTPLT

SEQ ID NO: 185492 - protein, 8 aa, Artificial Sequence
  Description of Artificial Sequence: Synthetic peptide
  Seed: MYNMVPFF (TYRP2_HUMAN)
MYNMVPFM

SEQ ID NO: 185493 - protein, 11 aa, Artificial Sequence
  Description of Artificial Sequence: Synthetic peptide
  Seed: RELWPRKFFHR (TYRP2_HUMAN)
RILWPRKFFHK

SEQ ID NO: 185494 - protein, 9 aa, Artificial Sequence
  Description of Artificial Sequence: Synthetic peptide
  Seed: STFSFRNAL (TYRP2_HUMAN)
SKFSFRNAL

SEQ ID NO: 185495 - protein, 9 aa, Artificial Sequence
  Description of Artificial Sequence: Synthetic peptide
  Seed: VTWHRYHLL (TYRP2_HUMAN)
VLWHRYHLI

SEQ ID NO: 185496 - protein, 9 aa, Artificial Sequence
  Description of Artificial Sequence: Synthetic peptide
  Seed: VTWHRYHLL (TYRP2_HUMAN)
VSWHRYHLI

SEQ ID NO: 185497 - protein, 9 aa, Artificial Sequence
  Description of Artificial Sequence: Synthetic peptide
  Seed: DTRPWSGPY (TYRP2_HUMAN)
DMRPWSGPK

SEQ ID NO: 185498 - protein, 10 aa, Artificial Sequence
  Description of Artificial Sequence: Synthetic peptide
  Seed: METHLSSKRY (TYRP2_HUMAN)
MQTHLSSKRY

SEQ ID NO: 185499 - protein, 11 aa, Artificial Sequence
  Description of Artificial Sequence: Synthetic peptide
  Seed: QPQFANCSVYD (TYRP2_HUMAN)
QKQFANCSVYY

SEQ ID NO: 185500 - protein, 9 aa, Artificial Sequence
  Description of Artificial Sequence: Synthetic peptide
  Seed: FANCSVYDF (TYRP2_HUMAN)
FQNCSVYDF

SEQ ID NO: 185501 - protein, 10 aa, Artificial Sequence
  Description of Artificial Sequence: Synthetic peptide
  Seed: LISRNSRFSS (TYRP2_HUMAN)
LHSRNSRFSK

SEQ ID NO: 185502 - protein, 10 aa, Artificial Sequence
  Description of Artificial Sequence: Synthetic peptide
  Seed: LVVMGTLVAL (TYRP2_HUMAN)
LEVMGTLVAV

SEQ ID NO: 185503 - protein, 9 aa, Artificial Sequence
  Description of Artificial Sequence: Synthetic peptide
  Seed: SLHNLVHSF (TYRP2_HUMAN)
SLHNLVHSC

SEQ ID NO: 185504 - protein, 10 aa, Artificial Sequence
  Description of Artificial Sequence: Synthetic peptide
  Seed: LGPGRPYRAI (TYRP2_HUMAN)
LPPGRPYRAM

SEQ ID NO: 185505 - protein, 10 aa, Artificial Sequence
  Description of Artificial Sequence: Synthetic peptide
  Seed: RELWPRKFFH (TYRP2_HUMAN)
RFLWPRKFFY

SEQ ID NO: 185506 - protein, 10 aa, Artificial Sequence
  Description of Artificial Sequence: Synthetic peptide
  Seed: LVVMGTLVAL (TYRP2_HUMAN)
LEVMGTLVAL

SEQ ID NO: 185507 - protein, 9 aa, Artificial Sequence
  Description of Artificial Sequence: Synthetic peptide
  Seed: YSYAIDLPV (TYRP2_HUMAN)
YTYAIDLPM

SEQ ID NO: 185508 - protein, 8 aa, Artificial Sequence
  Description of Artificial Sequence: Synthetic peptide
  Seed: MVPFFPPV (TYRP2_HUMAN)
MMPFFPPL

SEQ ID NO: 185509 - protein, 9 aa, Artificial Sequence
  Description of Artificial Sequence: Synthetic peptide
  Seed: RLRKGYTPL (TYRP2_HUMAN)
RSRKGYTPF

SEQ ID NO: 185510 - protein, 9 aa, Artificial Sequence
  Description of Artificial Sequence: Synthetic peptide
  Seed: ECDVCTDQL (TYRP2_HUMAN)
EADVCTDQM

SEQ ID NO: 185511 - protein, 9 aa, Artificial Sequence
  Description of Artificial Sequence: Synthetic peptide
  Seed: RLRKGYTPL (TYRP2_HUMAN)
RPRKGYTPF

SEQ ID NO: 185512 - protein, 9 aa, Artificial Sequence
  Description of Artificial Sequence: Synthetic peptide
  Seed: FANCSVYDF (TYRP2_HUMAN)
FVNCSVYDW

SEQ ID NO: 185513 - protein, 10 aa, Artificial Sequence
  Description of Artificial Sequence: Synthetic peptide
  Seed: QPQFANCSVY (TYRP2_HUMAN)
QNQFANCSVF

SEQ ID NO: 185514 - protein, 9 aa, Artificial Sequence
  Description of Artificial Sequence: Synthetic peptide
  Seed: SRFSSWETV (TYRP2_HUMAN)
SMFSSWETL

SEQ ID NO: 185515 - protein, 10 aa, Artificial Sequence
  Description of Artificial Sequence: Synthetic peptide
  Seed: ELAPIGHNRM (TYRP2_HUMAN)
EVAPIGHNRT

SEQ ID NO: 185516 - protein, 9 aa, Artificial Sequence
  Description of Artificial Sequence: Synthetic peptide
  Seed: QFPRVCMTV (TYRP2_HUMAN)
QFPRVCMTY

SEQ ID NO: 185517 - protein, 9 aa, Artificial Sequence
  Description of Artificial Sequence: Synthetic peptide
  Seed: ANDPIFVVL (TYRP2_HUMAN)
AMDPIFVVV

SEQ ID NO: 185518 - protein, 9 aa, Artificial Sequence
  Description of Artificial Sequence: Synthetic peptide
  Seed: FTDAIFDEW (TYRP2_HUMAN)
FCDAIFDEY

SEQ ID NO: 185519 - protein, 9 aa, Artificial Sequence
  Description of Artificial Sequence: Synthetic peptide
  Seed: SLHNLVHSF (TYRP2_HUMAN)
SPHNLVHSY

SEQ ID NO: 185520 - protein, 10 aa, Artificial Sequence
  Description of Artificial Sequence: Synthetic peptide
  Seed: MSPLWWGFLL (TYRP2_HUMAN)
MYPLWWGFLM

SEQ ID NO: 185521 - protein, 9 aa, Artificial Sequence
  Description of Artificial Sequence: Synthetic peptide
  Seed: AESANVCGS (TYRP2_HUMAN)
AESANVCGM

SEQ ID NO: 185522 - protein, 10 aa, Artificial Sequence
  Description of Artificial Sequence: Synthetic peptide
  Seed: ALVGLFVLLA (TYRP2_HUMAN)
AMVGLFVLLL

SEQ ID NO: 185523 - protein, 10 aa, Artificial Sequence
  Description of Artificial Sequence: Synthetic peptide
  Seed: VLHSFTDAIF (TYRP2_HUMAN)
VMHSFTDAIY

SEQ ID NO: 185524 - protein, 9 aa, Artificial Sequence
  Description of Artificial Sequence: Synthetic peptide
  Seed: ISRNSRFSS (TYRP2_HUMAN)
ITRNSRFSS

SEQ ID NO: 185525 - protein, 9 aa, Artificial Sequence
  Description of Artificial Sequence: Synthetic peptide
  Seed: VVMGTLVAL (TYRP2_HUMAN)
VMMGTLVAH

SEQ ID NO: 185526 - protein, 9 aa, Artificial Sequence
  Description of Artificial Sequence: Synthetic peptide
  Seed: DDYNHLVTL (TYRP2_HUMAN)
DAYNHLVTF

SEQ ID NO: 185527 - protein, 9 aa, Artificial Sequence
  Description of Artificial Sequence: Synthetic peptide
  Seed: ESANVCGSQ (TYRP2_HUMAN)
EVANVCGSR

SEQ ID NO: 185528 - protein, 9 aa, Artificial Sequence
  Description of Artificial Sequence: Synthetic peptide
  Seed: AANDPIFVV (TYRP2_HUMAN)
AHNDPIFVY

SEQ ID NO: 185529 - protein, 9 aa, Artificial Sequence
  Description of Artificial Sequence: Synthetic peptide
  Seed: TSDQLGYSY (TYRP2_HUMAN)
TPDQLGYSF

SEQ ID NO: 185530 - protein, 10 aa, Artificial Sequence
  Description of Artificial Sequence: Synthetic peptide
  Seed: RLIGNESFAL (TYRP2_HUMAN)
RIIGNESFAW

SEQ ID NO: 185531 - protein, 10 aa, Artificial Sequence
  Description of Artificial Sequence: Synthetic peptide
  Seed: RMYNMVPFFP (TYRP2_HUMAN)
RIYNMVPFFW

SEQ ID NO: 185532 - protein, 9 aa, Artificial Sequence
  Description of Artificial Sequence: Synthetic peptide
  Seed: LSPQEREQF (TYRP2_HUMAN)
LMPQEREQL

SEQ ID NO: 185533 - protein, 10 aa, Artificial Sequence
  Description of Artificial Sequence: Synthetic peptide
  Seed: NSRFSSWETV (TYRP2_HUMAN)
NVRFSSWETL

SEQ ID NO: 185534 - protein, 10 aa, Artificial Sequence
  Description of Artificial Sequence: Synthetic peptide
  Seed: AIFDEWMKRF (TYRP2_HUMAN)
AIFDEWMKRR

SEQ ID NO: 185535 - protein, 10 aa, Artificial Sequence
  Description of Artificial Sequence: Synthetic peptide
  Seed: REQFLGALDL (TYRP2_HUMAN)
REQFLGALDM

SEQ ID NO: 185536 - protein, 9 aa, Artificial Sequence
  Description of Artificial Sequence: Synthetic peptide
  Seed: GTYEGLLRR (TYRP2_HUMAN)
GVYEGLLRH

SEQ ID NO: 185537 - protein, 10 aa, Artificial Sequence
  Description of Artificial Sequence: Synthetic peptide
  Seed: HRYHLLCLER (TYRP2_HUMAN)
HTYHLLCLEK

SEQ ID NO: 185538 - protein, 9 aa, Artificial Sequence
  Description of Artificial Sequence: Synthetic peptide
  Seed: SLDDYNHLV (TYRP2_HUMAN)
SEDDYNHLL

SEQ ID NO: 185539 - protein, 9 aa, Artificial Sequence
  Description of Artificial Sequence: Synthetic peptide
  Seed: FFPPVTNEE (TYRP2_HUMAN)
FAPPVTNEL

SEQ ID NO: 185540 - protein, 10 aa, Artificial Sequence
  Description of Artificial Sequence: Synthetic peptide
  Seed: LAPIGHNRMY (TYRP2_HUMAN)
LMPIGHNRMY

SEQ ID NO: 185541 - protein, 10 aa, Artificial Sequence
  Description of Artificial Sequence: Synthetic peptide
  Seed: NSTFSFRNAL (TYRP2_HUMAN)
NKTFSFRNAL

SEQ ID NO: 185542 - protein, 10 aa, Artificial Sequence
  Description of Artificial Sequence: Synthetic peptide
  Seed: ELAPIGHNRM (TYRP2_HUMAN)
ETAPIGHNRF

SEQ ID NO: 185543 - protein, 11 aa, Artificial Sequence
  Description of Artificial Sequence: Synthetic peptide
  Seed: HSFTDAIFDEW (TYRP2_HUMAN)
HPFTDAIFDEW

SEQ ID NO: 185544 - protein, 9 aa, Artificial Sequence
  Description of Artificial Sequence: Synthetic peptide
  Seed: SSKRYTEEA (TYRP2_HUMAN)
SIKRYTEEK

SEQ ID NO: 185545 - protein, 9 aa, Artificial Sequence
  Description of Artificial Sequence: Synthetic peptide
  Seed: TSDQLGYSY (TYRP2_HUMAN)
TMDQLGYSL

SEQ ID NO: 185546 - protein, 9 aa, Artificial Sequence
  Description of Artificial Sequence: Synthetic peptide
  Seed: VTWHRYHLL (TYRP2_HUMAN)
VSWHRYHLK

SEQ ID NO: 185547 - protein, 9 aa, Artificial Sequence
  Description of Artificial Sequence: Synthetic peptide
  Seed: GYTPLMETH (TYRP2_HUMAN)
GYTPLMETF

SEQ ID NO: 185548 - protein, 11 aa, Artificial Sequence
  Description of Artificial Sequence: Synthetic peptide
  Seed: QRLIGNESFAL (TYRP2_HUMAN)
QFLIGNESFAV

SEQ ID NO: 185549 - protein, 9 aa, Artificial Sequence
  Description of Artificial Sequence: Synthetic peptide
  Seed: ANDPIFVVL (TYRP2_HUMAN)
AHDPIFVVM

SEQ ID NO: 185550 - protein, 9 aa, Artificial Sequence
  Description of Artificial Sequence: Synthetic peptide
  Seed: VGLFVLLAF (TYRP2_HUMAN)
VTLFVLLAW

SEQ ID NO: 185551 - protein, 10 aa, Artificial Sequence
  Description of Artificial Sequence: Synthetic peptide
  Seed: TRPWSGPYIL (TYRP2_HUMAN)
TAPWSGPYIF

SEQ ID NO: 185552 - protein, 9 aa, Artificial Sequence
  Description of Artificial Sequence: Synthetic peptide
  Seed: VPFFPPVTN (TYRP2_HUMAN)
VPFFPPVTY

SEQ ID NO: 185553 - protein, 9 aa, Artificial Sequence
  Description of Artificial Sequence: Synthetic peptide
  Seed: YSYAIDLPV (TYRP2_HUMAN)
YSYAIDLPL

SEQ ID NO: 185554 - protein, 10 aa, Artificial Sequence
  Description of Artificial Sequence: Synthetic peptide
  Seed: ADTRPWSGPY (TYRP2_HUMAN)
ARTRPWSGPY

SEQ ID NO: 185555 - protein, 9 aa, Artificial Sequence
  Description of Artificial Sequence: Synthetic peptide
  Seed: YAIDLPVSV (TYRP2_HUMAN)
YLIDLPVSI

SEQ ID NO: 185556 - protein, 9 aa, Artificial Sequence
  Description of Artificial Sequence: Synthetic peptide
  Seed: DDYNHLVTL (TYRP2_HUMAN)
DMYNHLVTY

SEQ ID NO: 185557 - protein, 10 aa, Artificial Sequence
  Description of Artificial Sequence: Synthetic peptide
  Seed: VVLHSFTDAI (TYRP2_HUMAN)
VPLHSFTDAV

SEQ ID NO: 185558 - protein, 9 aa, Artificial Sequence
  Description of Artificial Sequence: Synthetic peptide
  Seed: LRKGYTPLM (TYRP2_HUMAN)
LRKGYTPLF

SEQ ID NO: 185559 - protein, 10 aa, Artificial Sequence
  Description of Artificial Sequence: Synthetic peptide
  Seed: RPWSGPYILR (TYRP2_HUMAN)
RMWSGPYILH

SEQ ID NO: 185560 - protein, 9 aa, Artificial Sequence
  Description of Artificial Sequence: Synthetic peptide
  Seed: VTNEELFLT (TYRP2_HUMAN)
VTNEELFLA

SEQ ID NO: 185561 - protein, 9 aa, Artificial Sequence
  Description of Artificial Sequence: Synthetic peptide
  Seed: TLLGPGRPY (TYRP2_HUMAN)
TMLGPGRPR

SEQ ID NO: 185562 - protein, 11 aa, Artificial Sequence
  Description of Artificial Sequence: Synthetic peptide
  Seed: FVLLAFLQYRR (TYRP2_HUMAN)
FRLLAFLQYRR

SEQ ID NO: 185563 - protein, 9 aa, Artificial Sequence
  Description of Artificial Sequence: Synthetic peptide
  Seed: ANDPIFVVL (TYRP2_HUMAN)
AGDPIFVVF

SEQ ID NO: 185564 - protein, 10 aa, Artificial Sequence
  Description of Artificial Sequence: Synthetic peptide
  Seed: RLIGNESFAL (TYRP2_HUMAN)
REIGNESFAY

SEQ ID NO: 185565 - protein, 9 aa, Artificial Sequence
  Description of Artificial Sequence: Synthetic peptide
  Seed: YTPLMETHL (TYRP2_HUMAN)
YGPLMETHL

SEQ ID NO: 185566 - protein, 9 aa, Artificial Sequence
  Description of Artificial Sequence: Synthetic peptide
  Seed: FPPVTNEEL (TYRP2_HUMAN)
FFPVTNEEY

SEQ ID NO: 185567 - protein, 9 aa, Artificial Sequence
  Description of Artificial Sequence: Synthetic peptide
  Seed: FQNSTFSFR (TYRP2_HUMAN)
FCNSTFSFR

SEQ ID NO: 185568 - protein, 9 aa, Artificial Sequence
  Description of Artificial Sequence: Synthetic peptide
  Seed: MTVDSLVNK (TYRP2_HUMAN)
MIVDSLVNL

SEQ ID NO: 185569 - protein, 9 aa, Artificial Sequence
  Description of Artificial Sequence: Synthetic peptide
  Seed: HRYHLLCLE (TYRP2_HUMAN)
HRYHLLCLM

SEQ ID NO: 185570 - protein, 9 aa, Artificial Sequence
  Description of Artificial Sequence: Synthetic peptide
  Seed: RNQDDRELW (TYRP2_HUMAN)
RGQDDRELW

SEQ ID NO: 185571 - protein, 11 aa, Artificial Sequence
  Description of Artificial Sequence: Synthetic peptide
  Seed: RELWPRKFFHR (TYRP2_HUMAN)
RGLWPRKFFHR

SEQ ID NO: 185572 - protein, 9 aa, Artificial Sequence
  Description of Artificial Sequence: Synthetic peptide
  Seed: FFQNSTFSF (TYRP2_HUMAN)
FAQNSTFSL

SEQ ID NO: 185573 - protein, 9 aa, Artificial Sequence
  Description of Artificial Sequence: Synthetic peptide
  Seed: FLTSDQLGY (TYRP2_HUMAN)
FATSDQLGL

SEQ ID NO: 185574 - protein, 9 aa, Artificial Sequence
  Description of Artificial Sequence: Synthetic peptide
  Seed: SFRNALEGF (TYRP2_HUMAN)
SYRNALEGF

SEQ ID NO: 185575 - protein, 9 aa, Artificial Sequence
  Description of Artificial Sequence: Synthetic peptide
  Seed: AANDPIFVV (TYRP2_HUMAN)
AVNDPIFVA

SEQ ID NO: 185576 - protein, 10 aa, Artificial Sequence
  Description of Artificial Sequence: Synthetic peptide
  Seed: FFVWLHYYSV (TYRP2_HUMAN)
FVVWLHYYSI

SEQ ID NO: 185577 - protein, 10 aa, Artificial Sequence
  Description of Artificial Sequence: Synthetic peptide
  Seed: NSRFSSWETV (TYRP2_HUMAN)
NGRFSSWETL

SEQ ID NO: 185578 - protein, 9 aa, Artificial Sequence
  Description of Artificial Sequence: Synthetic peptide
  Seed: AARPDDPTL (TYRP2_HUMAN)
ALRPDDPTI

SEQ ID NO: 185579 - protein, 9 aa, Artificial Sequence
  Description of Artificial Sequence: Synthetic peptide
  Seed: YSYAIDLPV (TYRP2_HUMAN)
YTYAIDLPA

SEQ ID NO: 185580 - protein, 9 aa, Artificial Sequence
  Description of Artificial Sequence: Synthetic peptide
  Seed: FVLLAFLQY (TYRP2_HUMAN)
FSLLAFLQK

SEQ ID NO: 185581 - protein, 9 aa, Artificial Sequence
  Description of Artificial Sequence: Synthetic peptide
  Seed: HQGPAFVTW (TYRP2_HUMAN)
HPGPAFVTY

SEQ ID NO: 185582 - protein, 9 aa, Artificial Sequence
  Description of Artificial Sequence: Synthetic peptide
  Seed: YDFFVWLHY (TYRP2_HUMAN)
YAFFVWLHY

SEQ ID NO: 185583 - protein, 9 aa, Artificial Sequence
  Description of Artificial Sequence: Synthetic peptide
  Seed: VVMGTLVAL (TYRP2_HUMAN)
VEMGTLVAM

SEQ ID NO: 185584 - protein, 9 aa, Artificial Sequence
  Description of Artificial Sequence: Synthetic peptide
  Seed: VVMGTLVAL (TYRP2_HUMAN)
VMMGTLVAC

SEQ ID NO: 185585 - protein, 10 aa, Artificial Sequence
  Description of Artificial Sequence: Synthetic peptide
  Seed: GNESFALPYW (TYRP2_HUMAN)
GDESFALPYW

SEQ ID NO: 185586 - protein, 9 aa, Artificial Sequence
  Description of Artificial Sequence: Synthetic peptide
  Seed: RKFFHRTCK (TYRP2_HUMAN)
RWFFHRTCA

SEQ ID NO: 185587 - protein, 10 aa, Artificial Sequence
  Description of Artificial Sequence: Synthetic peptide
  Seed: CTDQLFGAAR (TYRP2_HUMAN)
CTDQLFGAAY

SEQ ID NO: 185588 - protein, 9 aa, Artificial Sequence
  Description of Artificial Sequence: Synthetic peptide
  Seed: GPAFVTWHR (TYRP2_HUMAN)
GLAFVTWHR

SEQ ID NO: 185589 - protein, 9 aa, Artificial Sequence
  Description of Artificial Sequence: Synthetic peptide
  Seed: SLHNLVHSF (TYRP2_HUMAN)
SAHNLVHSL

SEQ ID NO: 185590 - protein, 9 aa, Artificial Sequence
  Description of Artificial Sequence: Synthetic peptide
  Seed: FFQNSTFSF (TYRP2_HUMAN)
FMQNSTFSM

SEQ ID NO: 185591 - protein, 10 aa, Artificial Sequence
  Description of Artificial Sequence: Synthetic peptide
  Seed: FVVLHSFTDA (TYRP2_HUMAN)
FNVLHSFTDV

SEQ ID NO: 185592 - protein, 11 aa, Artificial Sequence
  Description of Artificial Sequence: Synthetic peptide
  Seed: IGNESFALPYW (TYRP2_HUMAN)
IANESFALPYW

SEQ ID NO: 185593 - protein, 9 aa, Artificial Sequence
  Description of Artificial Sequence: Synthetic peptide
  Seed: FLNGTNALP (TYRP2_HUMAN)
FLNGTNALI

SEQ ID NO: 185594 - protein, 9 aa, Artificial Sequence
  Description of Artificial Sequence: Synthetic peptide
  Seed: SLHNLVHSF (TYRP2_HUMAN)
SQHNLVHSR

SEQ ID NO: 185595 - protein, 9 aa, Artificial Sequence
  Description of Artificial Sequence: Synthetic peptide
  Seed: YSYAIDLPV (TYRP2_HUMAN)
YSYAIDLPF

SEQ ID NO: 185596 - protein, 9 aa, Artificial Sequence
  Description of Artificial Sequence: Synthetic peptide
  Seed: YAIDLPVSV (TYRP2_HUMAN)
YPIDLPVSG

SEQ ID NO: 185597 - protein, 10 aa, Artificial Sequence
  Description of Artificial Sequence: Synthetic peptide
  Seed: YNMVPFFPPV (TYRP2_HUMAN)
YHMVPFFPPV

SEQ ID NO: 185598 - protein, 9 aa, Artificial Sequence
  Description of Artificial Sequence: Synthetic peptide
  Seed: YAIDLPVSV (TYRP2_HUMAN)
YNIDLPVSF

SEQ ID NO: 185599 - protein, 10 aa, Artificial Sequence
  Description of Artificial Sequence: Synthetic peptide
  Seed: RLRKGYTPLM (TYRP2_HUMAN)
RFRKGYTPLR

SEQ ID NO: 185600 - protein, 10 aa, Artificial Sequence
  Description of Artificial Sequence: Synthetic peptide
  Seed: SDQLGYSYAI (TYRP2_HUMAN)
SFQLGYSYAM

SEQ ID NO: 185601 - protein, 11 aa, Artificial Sequence
  Description of Artificial Sequence: Synthetic peptide
  Seed: YRRLRKGYTPL (TYRP2_HUMAN)
YPRLRKGYTPL

SEQ ID NO: 185602 - protein, 9 aa, Artificial Sequence
  Description of Artificial Sequence: Synthetic peptide
  Seed: TLLVVMGTL (TYRP2_HUMAN)
TMLVVMGTI

SEQ ID NO: 185603 - protein, 9 aa, Artificial Sequence
  Description of Artificial Sequence: Synthetic peptide
  Seed: HQGPAFVTW (TYRP2_HUMAN)
HFGPAFVTI

SEQ ID NO: 185604 - protein, 9 aa, Artificial Sequence
  Description of Artificial Sequence: Synthetic peptide
  Seed: HYYSVRDTL (TYRP2_HUMAN)
HQYSVRDTF

SEQ ID NO: 185605 - protein, 9 aa, Artificial Sequence
  Description of Artificial Sequence: Synthetic peptide
  Seed: ILPGAQGQF (TYRP2_HUMAN)
IVPGAQGQL

SEQ ID NO: 185606 - protein, 9 aa, Artificial Sequence
  Description of Artificial Sequence: Synthetic peptide
  Seed: NGTYEGLLR (TYRP2_HUMAN)
NYTYEGLLR

SEQ ID NO: 185607 - protein, 10 aa, Artificial Sequence
  Description of Artificial Sequence: Synthetic peptide
  Seed: RLRKGYTPLM (TYRP2_HUMAN)
RFRKGYTPLA

SEQ ID NO: 185608 - protein, 11 aa, Artificial Sequence
  Description of Artificial Sequence: Synthetic peptide
  Seed: HPDYVITTQHW (TYRP2_HUMAN)
HPDYVITTQHF

SEQ ID NO: 185609 - protein, 9 aa, Artificial Sequence
  Description of Artificial Sequence: Synthetic peptide
  Seed: DAIFDEWMK (TYRP2_HUMAN)
DMIFDEWMR

SEQ ID NO: 185610 - protein, 9 aa, Artificial Sequence
  Description of Artificial Sequence: Synthetic peptide
  Seed: VVMGTLVAL (TYRP2_HUMAN)
VPMGTLVAA

SEQ ID NO: 185611 - protein, 10 aa, Artificial Sequence
  Description of Artificial Sequence: Synthetic peptide
  Seed: FFPPVTNEEL (TYRP2_HUMAN)
FPPPVTNEEY

SEQ ID NO: 185612 - protein, 10 aa, Artificial Sequence
  Description of Artificial Sequence: Synthetic peptide
  Seed: ADTRPWSGPY (TYRP2_HUMAN)
APTRPWSGPK

SEQ ID NO: 185613 - protein, 9 aa, Artificial Sequence
  Description of Artificial Sequence: Synthetic peptide
  Seed: SPLWWGFLL (TYRP2_HUMAN)
SSLWWGFLV

SEQ ID NO: 185614 - protein, 9 aa, Artificial Sequence
  Description of Artificial Sequence: Synthetic peptide
  Seed: FTDAIFDEW (TYRP2_HUMAN)
FTDAIFDEM

SEQ ID NO: 185615 - protein, 10 aa, Artificial Sequence
  Description of Artificial Sequence: Synthetic peptide
  Seed: MSPLWWGFLL (TYRP2_HUMAN)
MSPLWWGFLM

SEQ ID NO: 185616 - protein, 10 aa, Artificial Sequence
  Description of Artificial Sequence: Synthetic peptide
  Seed: TRPWSGPYIL (TYRP2_HUMAN)
TYPWSGPYIY

SEQ ID NO: 185617 - protein, 10 aa, Artificial Sequence
  Description of Artificial Sequence: Synthetic peptide
  Seed: HSFLNGTNAL (TYRP2_HUMAN)
HSFLNGTNAY

SEQ ID NO: 185618 - protein, 9 aa, Artificial Sequence
  Description of Artificial Sequence: Synthetic peptide
  Seed: VTWHRYHLL (TYRP2_HUMAN)
VYWHRYHLW

SEQ ID NO: 185619 - protein, 9 aa, Artificial Sequence
  Description of Artificial Sequence: Synthetic peptide
  Seed: VHPDYVITT (TYRP2_HUMAN)
VHPDYVITA

SEQ ID NO: 185620 - protein, 9 aa, Artificial Sequence
  Description of Artificial Sequence: Synthetic peptide
  Seed: RYHLLCLER (TYRP2_HUMAN)
RSHLLCLER

SEQ ID NO: 185621 - protein, 10 aa, Artificial Sequence
  Description of Artificial Sequence: Synthetic peptide
  Seed: SLQKFDNPPF (TYRP2_HUMAN)
SEQKFDNPPY

SEQ ID NO: 185622 - protein, 9 aa, Artificial Sequence
  Description of Artificial Sequence: Synthetic peptide
  Seed: DSLDDYNHL (TYRP2_HUMAN)
DALDDYNHF

SEQ ID NO: 185623 - protein, 11 aa, Artificial Sequence
  Description of Artificial Sequence: Synthetic peptide
  Seed: FFPPVTNEELF (TYRP2_HUMAN)
FWPPVTNEELF

SEQ ID NO: 185624 - protein, 10 aa, Artificial Sequence
  Description of Artificial Sequence: Synthetic peptide
  Seed: RMYNMVPFFP (TYRP2_HUMAN)
RVYNMVPFFI

SEQ ID NO: 185625 - protein, 10 aa, Artificial Sequence
  Description of Artificial Sequence: Synthetic peptide
  Seed: FFPPVTNEEL (TYRP2_HUMAN)
FVPPVTNEEM

SEQ ID NO: 185626 - protein, 10 aa, Artificial Sequence
  Description of Artificial Sequence: Synthetic peptide
  Seed: RRLRKGYTPL (TYRP2_HUMAN)
RDLRKGYTPK

SEQ ID NO: 185627 - protein, 10 aa, Artificial Sequence
  Description of Artificial Sequence: Synthetic peptide
  Seed: RRLRKGYTPL (TYRP2_HUMAN)
RTLRKGYTPG

SEQ ID NO: 185628 - protein, 10 aa, Artificial Sequence
  Description of Artificial Sequence: Synthetic peptide
  Seed: ADTRPWSGPY (TYRP2_HUMAN)
AGTRPWSGPY

SEQ ID NO: 185629 - protein, 10 aa, Artificial Sequence
  Description of Artificial Sequence: Synthetic peptide
  Seed: FFPPVTNEEL (TYRP2_HUMAN)
FYPPVTNEEI

SEQ ID NO: 185630 - protein, 9 aa, Artificial Sequence
  Description of Artificial Sequence: Synthetic peptide
  Seed: VLHSFTDAI (TYRP2_HUMAN)
VQHSFTDAV

SEQ ID NO: 185631 - protein, 10 aa, Artificial Sequence
  Description of Artificial Sequence: Synthetic peptide
  Seed: FVWLHYYSVR (TYRP2_HUMAN)
FMWLHYYSVK

SEQ ID NO: 185632 - protein, 10 aa, Artificial Sequence
  Description of Artificial Sequence: Synthetic peptide
  Seed: RELWPRKFFH (TYRP2_HUMAN)
RDLWPRKFFR

SEQ ID NO: 185633 - protein, 9 aa, Artificial Sequence
  Description of Artificial Sequence: Synthetic peptide
  Seed: SRNSRFSSW (TYRP2_HUMAN)
SFNSRFSSL

SEQ ID NO: 185634 - protein, 9 aa, Artificial Sequence
  Description of Artificial Sequence: Synthetic peptide
  Seed: RVCMTVDSL (TYRP2_HUMAN)
RLCMTVDSW

SEQ ID NO: 185635 - protein, 9 aa, Artificial Sequence
  Description of Artificial Sequence: Synthetic peptide
  Seed: RLRKGYTPL (TYRP2_HUMAN)
RPRKGYTPL

SEQ ID NO: 185636 - protein, 9 aa, Artificial Sequence
  Description of Artificial Sequence: Synthetic peptide
  Seed: RMYNMVPFF (TYRP2_HUMAN)
RQYNMVPFC

SEQ ID NO: 185637 - protein, 10 aa, Artificial Sequence
  Description of Artificial Sequence: Synthetic peptide
  Seed: SLDDYNHLVT (TYRP2_HUMAN)
SIDDYNHLVF

SEQ ID NO: 185638 - protein, 11 aa, Artificial Sequence
  Description of Artificial Sequence: Synthetic peptide
  Seed: RNSRFSSWETV (TYRP2_HUMAN)
RPSRFSSWETM

SEQ ID NO: 185639 - protein, 10 aa, Artificial Sequence
  Description of Artificial Sequence: Synthetic peptide
  Seed: MSLHNLVHSF (TYRP2_HUMAN)
MELHNLVHSY

SEQ ID NO: 185640 - protein, 11 aa, Artificial Sequence
  Description of Artificial Sequence: Synthetic peptide
  Seed: SVYDFFVWLHY (TYRP2_HUMAN)
SSYDFFVWLHW

SEQ ID NO: 185641 - protein, 9 aa, Artificial Sequence
  Description of Artificial Sequence: Synthetic peptide
  Seed: YAIDLPVSV (TYRP2_HUMAN)
YEIDLPVSL

SEQ ID NO: 185642 - protein, 9 aa, Artificial Sequence
  Description of Artificial Sequence: Synthetic peptide
  Seed: IFDEWMKRF (TYRP2_HUMAN)
IADEWMKRM

SEQ ID NO: 185643 - protein, 10 aa, Artificial Sequence
  Description of Artificial Sequence: Synthetic peptide
  Seed: MSLHNLVHSF (TYRP2_HUMAN)
MWLHNLVHSY

SEQ ID NO: 185644 - protein, 9 aa, Artificial Sequence
  Description of Artificial Sequence: Synthetic peptide
  Seed: ESANVCGSQ (TYRP2_HUMAN)
ETANVCGSK

SEQ ID NO: 185645 - protein, 10 aa, Artificial Sequence
  Description of Artificial Sequence: Synthetic peptide
  Seed: IGNESFALPY (TYRP2_HUMAN)
IANESFALPY

SEQ ID NO: 185646 - protein, 11 aa, Artificial Sequence
  Description of Artificial Sequence: Synthetic peptide
  Seed: CDSLDDYNHLV (TYRP2_HUMAN)
CHSLDDYNHLV

SEQ ID NO: 185647 - protein, 9 aa, Artificial Sequence
  Description of Artificial Sequence: Synthetic peptide
  Seed: TLDSQVMSL (TYRP2_HUMAN)
TFDSQVMSM

SEQ ID NO: 185648 - protein, 8 aa, Artificial Sequence
  Description of Artificial Sequence: Synthetic peptide
  Seed: SLDDYNHL (TYRP2_HUMAN)
SYDDYNHL

SEQ ID NO: 185649 - protein, 10 aa, Artificial Sequence
  Description of Artificial Sequence: Synthetic peptide
  Seed: MGTLVALVGL (TYRP2_HUMAN)
MCTLVALVGV

SEQ ID NO: 185650 - protein, 10 aa, Artificial Sequence
  Description of Artificial Sequence: Synthetic peptide
  Seed: MSPLWWGFLL (TYRP2_HUMAN)
MSPLWWGFLV

SEQ ID NO: 185651 - protein, 9 aa, Artificial Sequence
  Description of Artificial Sequence: Synthetic peptide
  Seed: HYYSVRDTL (TYRP2_HUMAN)
HHYSVRDTI

SEQ ID NO: 185652 - protein, 10 aa, Artificial Sequence
  Description of Artificial Sequence: Synthetic peptide
  Seed: VVMGTLVALV (TYRP2_HUMAN)
VLMGTLVALD

SEQ ID NO: 185653 - protein, 9 aa, Artificial Sequence
  Description of Artificial Sequence: Synthetic peptide
  Seed: ADAWPQELA (TYRP2_HUMAN)
AEAWPQELC

SEQ ID NO: 185654 - protein, 9 aa, Artificial Sequence
  Description of Artificial Sequence: Synthetic peptide
  Seed: HQGPAFVTW (TYRP2_HUMAN)
HLGPAFVTI

SEQ ID NO: 185655 - protein, 9 aa, Artificial Sequence
  Description of Artificial Sequence: Synthetic peptide
  Seed: SFLNGTNAL (TYRP2_HUMAN)
SFLNGTNAY

SEQ ID NO: 185656 - protein, 9 aa, Artificial Sequence
  Description of Artificial Sequence: Synthetic peptide
  Seed: RTCKCTGNF (TYRP2_HUMAN)
RYCKCTGNY

SEQ ID NO: 185657 - protein, 9 aa, Artificial Sequence
  Description of Artificial Sequence: Synthetic peptide
  Seed: VIRQNIHSL (TYRP2_HUMAN)
VMRQNIHSY

SEQ ID NO: 185658 - protein, 9 aa, Artificial Sequence
  Description of Artificial Sequence: Synthetic peptide
  Seed: RNQDDRELW (TYRP2_HUMAN)
RAQDDRELW

SEQ ID NO: 185659 - protein, 10 aa, Artificial Sequence
  Description of Artificial Sequence: Synthetic peptide
  Seed: MGRNSMKLPT (TYRP2_HUMAN)
MNRNSMKLPK

SEQ ID NO: 185660 - protein, 9 aa, Artificial Sequence
  Description of Artificial Sequence: Synthetic peptide
  Seed: YAIDLPVSV (TYRP2_HUMAN)
YTIDLPVSM

SEQ ID NO: 185661 - protein, 9 aa, Artificial Sequence
  Description of Artificial Sequence: Synthetic peptide
  Seed: AANDPIFVV (TYRP2_HUMAN)
APNDPIFVA

SEQ ID NO: 185662 - protein, 10 aa, Artificial Sequence
  Description of Artificial Sequence: Synthetic peptide
  Seed: ELAPIGHNRM (TYRP2_HUMAN)
EIAPIGHNRV

SEQ ID NO: 185663 - protein, 11 aa, Artificial Sequence
  Description of Artificial Sequence: Synthetic peptide
  Seed: RADTRPWSGPY (TYRP2_HUMAN)
RQDTRPWSGPA

SEQ ID NO: 185664 - protein, 9 aa, Artificial Sequence
  Description of Artificial Sequence: Synthetic peptide
  Seed: YSYAIDLPV (TYRP2_HUMAN)
YVYAIDLPW

SEQ ID NO: 185665 - protein, 9 aa, Artificial Sequence
  Description of Artificial Sequence: Synthetic peptide
  Seed: VVMGTLVAL (TYRP2_HUMAN)
VKMGTLVAY

SEQ ID NO: 185666 - protein, 10 aa, Artificial Sequence
  Description of Artificial Sequence: Synthetic peptide
  Seed: TLVALVGLFV (TYRP2_HUMAN)
TAVALVGLFV

SEQ ID NO: 185667 - protein, 10 aa, Artificial Sequence
  Description of Artificial Sequence: Synthetic peptide
  Seed: LVVMGTLVAL (TYRP2_HUMAN)
LAVMGTLVAF

SEQ ID NO: 185668 - protein, 10 aa, Artificial Sequence
  Description of Artificial Sequence: Synthetic peptide
  Seed: AANDPIFVVL (TYRP2_HUMAN)
ALNDPIFVVV

SEQ ID NO: 185669 - protein, 9 aa, Artificial Sequence
  Description of Artificial Sequence: Synthetic peptide
  Seed: SFALPYWNF (TYRP2_HUMAN)
SYALPYWNF

SEQ ID NO: 185670 - protein, 9 aa, Artificial Sequence
  Description of Artificial Sequence: Synthetic peptide
  Seed: RQNIHSLSP (TYRP2_HUMAN)
RLNIHSLSM

SEQ ID NO: 185671 - protein, 9 aa, Artificial Sequence
  Description of Artificial Sequence: Synthetic peptide
  Seed: RNQDDRELW (TYRP2_HUMAN)
RMQDDRELL

SEQ ID NO: 185672 - protein, 9 aa, Artificial Sequence
  Description of Artificial Sequence: Synthetic peptide
  Seed: GTYEGLLRR (TYRP2_HUMAN)
GVYEGLLRY

SEQ ID NO: 185673 - protein, 9 aa, Artificial Sequence
  Description of Artificial Sequence: Synthetic peptide
  Seed: NRMYNMVPF (TYRP2_HUMAN)
NVMYNMVPF

SEQ ID NO: 185674 - protein, 9 aa, Artificial Sequence
  Description of Artificial Sequence: Synthetic peptide
  Seed: WMKRFNPPA (TYRP2_HUMAN)
WMKRFNPPY

SEQ ID NO: 185675 - protein, 10 aa, Artificial Sequence
  Description of Artificial Sequence: Synthetic peptide
  Seed: RRLRKGYTPL (TYRP2_HUMAN)
RGLRKGYTPA

SEQ ID NO: 185676 - protein, 9 aa, Artificial Sequence
  Description of Artificial Sequence: Synthetic peptide
  Seed: SAANDPIFV (TYRP2_HUMAN)
SIANDPIFL

SEQ ID NO: 185677 - protein, 9 aa, Artificial Sequence
  Description of Artificial Sequence: Synthetic peptide
  Seed: TLDSQVMSL (TYRP2_HUMAN)
TFDSQVMSV

SEQ ID NO: 185678 - protein, 10 aa, Artificial Sequence
  Description of Artificial Sequence: Synthetic peptide
  Seed: TLCNGTYEGL (TYRP2_HUMAN)
TVCNGTYEGV

SEQ ID NO: 185679 - protein, 9 aa, Artificial Sequence
  Description of Artificial Sequence: Synthetic peptide
  Seed: WPTTLLVVM (TYRP2_HUMAN)
WPTTLLVVW

SEQ ID NO: 185680 - protein, 10 aa, Artificial Sequence
  Description of Artificial Sequence: Synthetic peptide
  Seed: LHYYSVRDTL (TYRP2_HUMAN)
LYYYSVRDTW

SEQ ID NO: 185681 - protein, 9 aa, Artificial Sequence
  Description of Artificial Sequence: Synthetic peptide
  Seed: SLDDYNHLV (TYRP2_HUMAN)
SCDDYNHLV

SEQ ID NO: 185682 - protein, 9 aa, Artificial Sequence
  Description of Artificial Sequence: Synthetic peptide
  Seed: YAIDLPVSV (TYRP2_HUMAN)
YNIDLPVSM

SEQ ID NO: 185683 - protein, 8 aa, Artificial Sequence
  Description of Artificial Sequence: Synthetic peptide
  Seed: RPYRAIDF (TYRP2_HUMAN)
RPYRAIDL

SEQ ID NO: 185684 - protein, 10 aa, Artificial Sequence
  Description of Artificial Sequence: Synthetic peptide
  Seed: RNSRFSSWET (TYRP2_HUMAN)
RCSRFSSWEM

SEQ ID NO: 185685 - protein, 10 aa, Artificial Sequence
  Description of Artificial Sequence: Synthetic peptide
  Seed: RLRKGYTPLM (TYRP2_HUMAN)
RPRKGYTPLK

SEQ ID NO: 185686 - protein, 9 aa, Artificial Sequence
  Description of Artificial Sequence: Synthetic peptide
  Seed: RPWSGPYIL (TYRP2_HUMAN)
RRWSGPYIL

SEQ ID NO: 185687 - protein, 9 aa, Artificial Sequence
  Description of Artificial Sequence: Synthetic peptide
  Seed: RKFFHRTCK (TYRP2_HUMAN)
RVFFHRTCK

SEQ ID NO: 185688 - protein, 9 aa, Artificial Sequence
  Description of Artificial Sequence: Synthetic peptide
  Seed: ETPGWPTTL (TYRP2_HUMAN)
EAPGWPTTW

SEQ ID NO: 185689 - protein, 11 aa, Artificial Sequence
  Description of Artificial Sequence: Synthetic peptide
  Seed: RADTRPWSGPY (TYRP2_HUMAN)
RWDTRPWSGPW

SEQ ID NO: 185690 - protein, 10 aa, Artificial Sequence
  Description of Artificial Sequence: Synthetic peptide
  Seed: FFPPVTNEEL (TYRP2_HUMAN)
FLPPVTNEEI

SEQ ID NO: 185691 - protein, 10 aa, Artificial Sequence
  Description of Artificial Sequence: Synthetic peptide
  Seed: RRLRKGYTPL (TYRP2_HUMAN)
RRLRKGYTPR

SEQ ID NO: 185692 - protein, 9 aa, Artificial Sequence
  Description of Artificial Sequence: Synthetic peptide
  Seed: FFQNSTFSF (TYRP2_HUMAN)
FWQNSTFSV

SEQ ID NO: 185693 - protein, 9 aa, Artificial Sequence
  Description of Artificial Sequence: Synthetic peptide
  Seed: LAFLQYRRL (TYRP2_HUMAN)
LTFLQYRRF

SEQ ID NO: 185694 - protein, 11 aa, Artificial Sequence
  Description of Artificial Sequence: Synthetic peptide
  Seed: RNSRFSSWETV (TYRP2_HUMAN)
RCSRFSSWETL

SEQ ID NO: 185695 - protein, 9 aa, Artificial Sequence
  Description of Artificial Sequence: Synthetic peptide
  Seed: TLLGPGRPY (TYRP2_HUMAN)
TSLGPGRPM

SEQ ID NO: 185696 - protein, 9 aa, Artificial Sequence
  Description of Artificial Sequence: Synthetic peptide
  Seed: GQFPRVCMT (TYRP2_HUMAN)
GMFPRVCMI

SEQ ID NO: 185697 - protein, 10 aa, Artificial Sequence
  Description of Artificial Sequence: Synthetic peptide
  Seed: FVWLHYYSVR (TYRP2_HUMAN)
FVWLHYYSVV

SEQ ID NO: 185698 - protein, 10 aa, Artificial Sequence
  Description of Artificial Sequence: Synthetic peptide
  Seed: SLQKFDNPPF (TYRP2_HUMAN)
SYQKFDNPPF

SEQ ID NO: 185699 - protein, 9 aa, Artificial Sequence
  Description of Artificial Sequence: Synthetic peptide
  Seed: AANDPIFVV (TYRP2_HUMAN)
ALNDPIFVM

SEQ ID NO: 185700 - protein, 9 aa, Artificial Sequence
  Description of Artificial Sequence: Synthetic peptide
  Seed: RKFFHRTCK (TYRP2_HUMAN)
RYFFHRTCA

SEQ ID NO: 185701 - protein, 10 aa, Artificial Sequence
  Description of Artificial Sequence: Synthetic peptide
  Seed: SPLWWGFLLS (TYRP2_HUMAN)
SDLWWGFLLV

SEQ ID NO: 185702 - protein, 11 aa, Artificial Sequence
  Description of Artificial Sequence: Synthetic peptide
  Seed: LLGPNGTQPQF (TYRP2_HUMAN)
LTGPNGTQPQW

SEQ ID NO: 185703 - protein, 9 aa, Artificial Sequence
  Description of Artificial Sequence: Synthetic peptide
  Seed: ANDPIFVVL (TYRP2_HUMAN)
ALDPIFVVM

SEQ ID NO: 185704 - protein, 9 aa, Artificial Sequence
  Description of Artificial Sequence: Synthetic peptide
  Seed: STFSFRNAL (TYRP2_HUMAN)
SKFSFRNAY

SEQ ID NO: 185705 - protein, 9 aa, Artificial Sequence
  Description of Artificial Sequence: Synthetic peptide
  Seed: WHRYHLLCL (TYRP2_HUMAN)
WMRYHLLCM

SEQ ID NO: 185706 - protein, 10 aa, Artificial Sequence
  Description of Artificial Sequence: Synthetic peptide
  Seed: KILPGAQGQF (TYRP2_HUMAN)
KMLPGAQGQY

SEQ ID NO: 185707 - protein, 9 aa, Artificial Sequence
  Description of Artificial Sequence: Synthetic peptide
  Seed: ALVGLFVLL (TYRP2_HUMAN)
ALVGLFVLV

SEQ ID NO: 185708 - protein, 10 aa, Artificial Sequence
  Description of Artificial Sequence: Synthetic peptide
  Seed: QPQFANCSVY (TYRP2_HUMAN)
QQQFANCSVY

SEQ ID NO: 185709 - protein, 10 aa, Artificial Sequence
  Description of Artificial Sequence: Synthetic peptide
  Seed: MSLHNLVHSF (TYRP2_HUMAN)
MWLHNLVHSI

SEQ ID NO: 185710 - protein, 10 aa, Artificial Sequence
  Description of Artificial Sequence: Synthetic peptide
  Seed: YNMVPFFPPV (TYRP2_HUMAN)
YVMVPFFPPA

SEQ ID NO: 185711 - protein, 10 aa, Artificial Sequence
  Description of Artificial Sequence: Synthetic peptide
  Seed: LQRLIGNESF (TYRP2_HUMAN)
LKRLIGNESY

SEQ ID NO: 185712 - protein, 10 aa, Artificial Sequence
  Description of Artificial Sequence: Synthetic peptide
  Seed: RLRKGYTPLM (TYRP2_HUMAN)
RHRKGYTPLL

SEQ ID NO: 185713 - protein, 9 aa, Artificial Sequence
  Description of Artificial Sequence: Synthetic peptide
  Seed: FLLSCLGCK (TYRP2_HUMAN)
FVLSCLGCR

SEQ ID NO: 185714 - protein, 9 aa, Artificial Sequence
  Description of Artificial Sequence: Synthetic peptide
  Seed: SLDDYNHLV (TYRP2_HUMAN)
SFDDYNHLI

SEQ ID NO: 185715 - protein, 9 aa, Artificial Sequence
  Description of Artificial Sequence: Synthetic peptide
  Seed: DFFVWLHYY (TYRP2_HUMAN)
DWFVWLHYR

SEQ ID NO: 185716 - protein, 8 aa, Artificial Sequence
  Description of Artificial Sequence: Synthetic peptide
  Seed: NQMGRNSM (TYRP2_HUMAN)
NLMGRNSL

SEQ ID NO: 185717 - protein, 10 aa, Artificial Sequence
  Description of Artificial Sequence: Synthetic peptide
  Seed: REQFLGALDL (TYRP2_HUMAN)
RSQFLGALDM

SEQ ID NO: 185718 - protein, 9 aa, Artificial Sequence
  Description of Artificial Sequence: Synthetic peptide
  Seed: HQGPAFVTW (TYRP2_HUMAN)
HTGPAFVTY

SEQ ID NO: 185719 - protein, 9 aa, Artificial Sequence
  Description of Artificial Sequence: Synthetic peptide
  Seed: KPPVIRQNI (TYRP2_HUMAN)
KPPVIRQNL

SEQ ID NO: 185720 - protein, 10 aa, Artificial Sequence
  Description of Artificial Sequence: Synthetic peptide
  Seed: YDFFVWLHYY (TYRP2_HUMAN)
YQFFVWLHYY

SEQ ID NO: 185721 - protein, 9 aa, Artificial Sequence
  Description of Artificial Sequence: Synthetic peptide
  Seed: YSYAIDLPV (TYRP2_HUMAN)
YQYAIDLPI

SEQ ID NO: 185722 - protein, 9 aa, Artificial Sequence
  Description of Artificial Sequence: Synthetic peptide
  Seed: RLRKGYTPL (TYRP2_HUMAN)
RQRKGYTPR

SEQ ID NO: 185723 - protein, 10 aa, Artificial Sequence
  Description of Artificial Sequence: Synthetic peptide
  Seed: LVVMGTLVAL (TYRP2_HUMAN)
LHVMGTLVAF

SEQ ID NO: 185724 - protein, 9 aa, Artificial Sequence
  Description of Artificial Sequence: Synthetic peptide
  Seed: LLAFLQYRR (TYRP2_HUMAN)
LPAFLQYRR

SEQ ID NO: 185725 - protein, 8 aa, Artificial Sequence
  Description of Artificial Sequence: Synthetic peptide
  Seed: MYNMVPFF (TYRP2_HUMAN)
MWNMVPFF

SEQ ID NO: 185726 - protein, 10 aa, Artificial Sequence
  Description of Artificial Sequence: Synthetic peptide
  Seed: FLLSCLGCKI (TYRP2_HUMAN)
FKLSCLGCKL

SEQ ID NO: 185727 - protein, 9 aa, Artificial Sequence
  Description of Artificial Sequence: Synthetic peptide
  Seed: TLVALVGLF (TYRP2_HUMAN)
TSVALVGLY

SEQ ID NO: 185728 - protein, 11 aa, Artificial Sequence
  Description of Artificial Sequence: Synthetic peptide
  Seed: LLVVMGTLVAL (TYRP2_HUMAN)
LKVVMGTLVAV

SEQ ID NO: 185729 - protein, 10 aa, Artificial Sequence
  Description of Artificial Sequence: Synthetic peptide
  Seed: AARPDDPTLI (TYRP2_HUMAN)
AIRPDDPTLW

SEQ ID NO: 185730 - protein, 10 aa, Artificial Sequence
  Description of Artificial Sequence: Synthetic peptide
  Seed: LVVMGTLVAL (TYRP2_HUMAN)
LGVMGTLVAL

SEQ ID NO: 185731 - protein, 10 aa, Artificial Sequence
  Description of Artificial Sequence: Synthetic peptide
  Seed: VLHSFTDAIF (TYRP2_HUMAN)
VLHSFTDAIL

SEQ ID NO: 185732 - protein, 9 aa, Artificial Sequence
  Description of Artificial Sequence: Synthetic peptide
  Seed: ALVGLFVLL (TYRP2_HUMAN)
AQVGLFVLL

SEQ ID NO: 185733 - protein, 9 aa, Artificial Sequence
  Description of Artificial Sequence: Synthetic peptide
  Seed: SLDDYNHLV (TYRP2_HUMAN)
SNDDYNHLF

SEQ ID NO: 185734 - protein, 9 aa, Artificial Sequence
  Description of Artificial Sequence: Synthetic peptide
  Seed: SLDDYNHLV (TYRP2_HUMAN)
SADDYNHLF

SEQ ID NO: 185735 - protein, 10 aa, Artificial Sequence
  Description of Artificial Sequence: Synthetic peptide
  Seed: ESANVCGSQQ (TYRP2_HUMAN)
EMANVCGSQK

SEQ ID NO: 185736 - protein, 10 aa, Artificial Sequence
  Description of Artificial Sequence: Synthetic peptide
  Seed: LVVMGTLVAL (TYRP2_HUMAN)
LCVMGTLVAA

SEQ ID NO: 185737 - protein, 10 aa, Artificial Sequence
  Description of Artificial Sequence: Synthetic peptide
  Seed: FFPPVTNEEL (TYRP2_HUMAN)
FSPPVTNEEL

SEQ ID NO: 185738 - protein, 11 aa, Artificial Sequence
  Description of Artificial Sequence: Synthetic peptide
  Seed: YNMVPFFPPVT (TYRP2_HUMAN)
YIMVPFFPPVE

SEQ ID NO: 185739 - protein, 10 aa, Artificial Sequence
  Description of Artificial Sequence: Synthetic peptide
  Seed: VVMGTLVALV (TYRP2_HUMAN)
VYMGTLVALV

SEQ ID NO: 185740 - protein, 9 aa, Artificial Sequence
  Description of Artificial Sequence: Synthetic peptide
  Seed: RKFFHRTCK (TYRP2_HUMAN)
RTFFHRTCC

SEQ ID NO: 185741 - protein, 9 aa, Artificial Sequence
  Description of Artificial Sequence: Synthetic peptide
  Seed: FANCSVYDF (TYRP2_HUMAN)
FPNCSVYDV

SEQ ID NO: 185742 - protein, 11 aa, Artificial Sequence
  Description of Artificial Sequence: Synthetic peptide
  Seed: FVVLHSFTDAI (TYRP2_HUMAN)
FKVLHSFTDAV

SEQ ID NO: 185743 - protein, 11 aa, Artificial Sequence
  Description of Artificial Sequence: Synthetic peptide
  Seed: GRNSMKLPTLK (TYRP2_HUMAN)
GTNSMKLPTLK

SEQ ID NO: 185744 - protein, 11 aa, Artificial Sequence
  Description of Artificial Sequence: Synthetic peptide
  Seed: FLTSDQLGYSY (TYRP2_HUMAN)
FSTSDQLGYSY

SEQ ID NO: 185745 - protein, 10 aa, Artificial Sequence
  Description of Artificial Sequence: Synthetic peptide
  Seed: AANDPIFVVL (TYRP2_HUMAN)
AVNDPIFVVY

SEQ ID NO: 185746 - protein, 10 aa, Artificial Sequence
  Description of Artificial Sequence: Synthetic peptide
  Seed: YDFFVWLHYY (TYRP2_HUMAN)
YMFFVWLHYS

SEQ ID NO: 185747 - protein, 9 aa, Artificial Sequence
  Description of Artificial Sequence: Synthetic peptide
  Seed: YSYAIDLPV (TYRP2_HUMAN)
YLYAIDLPY

SEQ ID NO: 185748 - protein, 9 aa, Artificial Sequence
  Description of Artificial Sequence: Synthetic peptide
  Seed: TLLVVMGTL (TYRP2_HUMAN)
TLLVVMGTV

SEQ ID NO: 185749 - protein, 10 aa, Artificial Sequence
  Description of Artificial Sequence: Synthetic peptide
  Seed: SDQLGYSYAI (TYRP2_HUMAN)
SEQLGYSYAM

SEQ ID NO: 185750 - protein, 9 aa, Artificial Sequence
  Description of Artificial Sequence: Synthetic peptide
  Seed: YVITTQHWL (TYRP2_HUMAN)
YQITTQHWL

SEQ ID NO: 185751 - protein, 10 aa, Artificial Sequence
  Description of Artificial Sequence: Synthetic peptide
  Seed: LVVMGTLVAL (TYRP2_HUMAN)
LIVMGTLVAI

SEQ ID NO: 185752 - protein, 9 aa, Artificial Sequence
  Description of Artificial Sequence: Synthetic peptide
  Seed: YDFFVWLHY (TYRP2_HUMAN)
YYFFVWLHF

SEQ ID NO: 185753 - protein, 10 aa, Artificial Sequence
  Description of Artificial Sequence: Synthetic peptide
  Seed: GQFPRVCMTV (TYRP2_HUMAN)
GRFPRVCMTM

SEQ ID NO: 185754 - protein, 9 aa, Artificial Sequence
  Description of Artificial Sequence: Synthetic peptide
  Seed: HYYSVRDTL (TYRP2_HUMAN)
HEYSVRDTF

SEQ ID NO: 185755 - protein, 10 aa, Artificial Sequence
  Description of Artificial Sequence: Synthetic peptide
  Seed: REQFLGALDL (TYRP2_HUMAN)
RMQFLGALDY

SEQ ID NO: 185756 - protein, 9 aa, Artificial Sequence
  Description of Artificial Sequence: Synthetic peptide
  Seed: ANDPIFVVL (TYRP2_HUMAN)
ASDPIFVVY

SEQ ID NO: 185757 - protein, 9 aa, Artificial Sequence
  Description of Artificial Sequence: Synthetic peptide
  Seed: STFSFRNAL (TYRP2_HUMAN)
SAFSFRNAM

SEQ ID NO: 185758 - protein, 10 aa, Artificial Sequence
  Description of Artificial Sequence: Synthetic peptide
  Seed: RNSRFSSWET (TYRP2_HUMAN)
RSSRFSSWEK

SEQ ID NO: 185759 - protein, 10 aa, Artificial Sequence
  Description of Artificial Sequence: Synthetic peptide
  Seed: QPQFANCSVY (TYRP2_HUMAN)
QWQFANCSVL

SEQ ID NO: 185760 - protein, 10 aa, Artificial Sequence
  Description of Artificial Sequence: Synthetic peptide
  Seed: DSLDDYNHLV (TYRP2_HUMAN)
DRLDDYNHLV

SEQ ID NO: 185761 - protein, 9 aa, Artificial Sequence
  Description of Artificial Sequence: Synthetic peptide
  Seed: RMYNMVPFF (TYRP2_HUMAN)
RLYNMVPFC

SEQ ID NO: 185762 - protein, 10 aa, Artificial Sequence
  Description of Artificial Sequence: Synthetic peptide
  Seed: AANDPIFVVL (TYRP2_HUMAN)
AINDPIFVVM

SEQ ID NO: 185763 - protein, 10 aa, Artificial Sequence
  Description of Artificial Sequence: Synthetic peptide
  Seed: CCPRLGAESA (TYRP2_HUMAN)
CFPRLGAESL

SEQ ID NO: 185764 - protein, 9 aa, Artificial Sequence
  Description of Artificial Sequence: Synthetic peptide
  Seed: TLLGPGRPY (TYRP2_HUMAN)
TALGPGRPV

SEQ ID NO: 185765 - protein, 9 aa, Artificial Sequence
  Description of Artificial Sequence: Synthetic peptide
  Seed: RYHLLCLER (TYRP2_HUMAN)
RQHLLCLER

SEQ ID NO: 185766 - protein, 10 aa, Artificial Sequence
  Description of Artificial Sequence: Synthetic peptide
  Seed: FFPPVTNEEL (TYRP2_HUMAN)
FYPPVTNEEL

SEQ ID NO: 185767 - protein, 9 aa, Artificial Sequence
  Description of Artificial Sequence: Synthetic peptide
  Seed: NMVPFFPPV (TYRP2_HUMAN)
NSVPFFPPL

SEQ ID NO: 185768 - protein, 10 aa, Artificial Sequence
  Description of Artificial Sequence: Synthetic peptide
  Seed: LHYYSVRDTL (TYRP2_HUMAN)
LMYYSVRDTI

SEQ ID NO: 185769 - protein, 9 aa, Artificial Sequence
  Description of Artificial Sequence: Synthetic peptide
  Seed: STFSFRNAL (TYRP2_HUMAN)
SAFSFRNAY

SEQ ID NO: 185770 - protein, 9 aa, Artificial Sequence
  Description of Artificial Sequence: Synthetic peptide
  Seed: ALVGLFVLL (TYRP2_HUMAN)
AIVGLFVLK

SEQ ID NO: 185771 - protein, 10 aa, Artificial Sequence
  Description of Artificial Sequence: Synthetic peptide
  Seed: SVRDTLLGPG (TYRP2_HUMAN)
SMRDTLLGPK

SEQ ID NO: 185772 - protein, 11 aa, Artificial Sequence
  Description of Artificial Sequence: Synthetic peptide
  Seed: TQPQFANCSVY (TYRP2_HUMAN)
TWPQFANCSVY

SEQ ID NO: 185773 - protein, 9 aa, Artificial Sequence
  Description of Artificial Sequence: Synthetic peptide
  Seed: FSHQGPAFV (TYRP2_HUMAN)
FMHQGPAFV

SEQ ID NO: 185774 - protein, 9 aa, Artificial Sequence
  Description of Artificial Sequence: Synthetic peptide
  Seed: SLHNLVHSF (TYRP2_HUMAN)
SQHNLVHSI

SEQ ID NO: 185775 - protein, 9 aa, Artificial Sequence
  Description of Artificial Sequence: Synthetic peptide
  Seed: VTNEELFLT (TYRP2_HUMAN)
VMNEELFLI

SEQ ID NO: 185776 - protein, 9 aa, Artificial Sequence
  Description of Artificial Sequence: Synthetic peptide
  Seed: YSYAIDLPV (TYRP2_HUMAN)
YFYAIDLPL

SEQ ID NO: 185777 - protein, 9 aa, Artificial Sequence
  Description of Artificial Sequence: Synthetic peptide
  Seed: YSYAIDLPV (TYRP2_HUMAN)
YTYAIDLPH

SEQ ID NO: 185778 - protein, 10 aa, Artificial Sequence
  Description of Artificial Sequence: Synthetic peptide
  Seed: FANCSVYDFF (TYRP2_HUMAN)
FPNCSVYDFF

SEQ ID NO: 185779 - protein, 10 aa, Artificial Sequence
  Description of Artificial Sequence: Synthetic peptide
  Seed: RMYNMVPFFP (TYRP2_HUMAN)
RQYNMVPFFI

SEQ ID NO: 185780 - protein, 9 aa, Artificial Sequence
  Description of Artificial Sequence: Synthetic peptide
  Seed: AANDPIFVV (TYRP2_HUMAN)
AVNDPIFVF

SEQ ID NO: 185781 - protein, 10 aa, Artificial Sequence
  Description of Artificial Sequence: Synthetic peptide
  Seed: KRFNPPADAW (TYRP2_HUMAN)
KKFNPPADAY

SEQ ID NO: 185782 - protein, 9 aa, Artificial Sequence
  Description of Artificial Sequence: Synthetic peptide
  Seed: GFDKADGTL (TYRP2_HUMAN)
GADKADGTF

SEQ ID NO: 185783 - protein, 9 aa, Artificial Sequence
  Description of Artificial Sequence: Synthetic peptide
  Seed: YYSVRDTLL (TYRP2_HUMAN)
YSSVRDTLY

SEQ ID NO: 185784 - protein, 9 aa, Artificial Sequence
  Description of Artificial Sequence: Synthetic peptide
  Seed: AFLQYRRLR (TYRP2_HUMAN)
AQLQYRRLR

SEQ ID NO: 185785 - protein, 9 aa, Artificial Sequence
  Description of Artificial Sequence: Synthetic peptide
  Seed: DDYNHLVTL (TYRP2_HUMAN)
DAYNHLVTM

SEQ ID NO: 185786 - protein, 9 aa, Artificial Sequence
  Description of Artificial Sequence: Synthetic peptide
  Seed: TLISRNSRF (TYRP2_HUMAN)
TQISRNSRF

SEQ ID NO: 185787 - protein, 9 aa, Artificial Sequence
  Description of Artificial Sequence: Synthetic peptide
  Seed: HQGPAFVTW (TYRP2_HUMAN)
HVGPAFVTM

SEQ ID NO: 185788 - protein, 9 aa, Artificial Sequence
  Description of Artificial Sequence: Synthetic peptide
  Seed: RKFFHRTCK (TYRP2_HUMAN)
RMFFHRTCS

SEQ ID NO: 185789 - protein, 10 aa, Artificial Sequence
  Description of Artificial Sequence: Synthetic peptide
  Seed: HNRMYNMVPF (TYRP2_HUMAN)
HARMYNMVPF

SEQ ID NO: 185790 - protein, 9 aa, Artificial Sequence
  Description of Artificial Sequence: Synthetic peptide
  Seed: VSVEETPGW (TYRP2_HUMAN)
VQVEETPGI

SEQ ID NO: 185791 - protein, 10 aa, Artificial Sequence
  Description of Artificial Sequence: Synthetic peptide
  Seed: NPPFFQNSTF (TYRP2_HUMAN)
NYPFFQNSTY

SEQ ID NO: 185792 - protein, 9 aa, Artificial Sequence
  Description of Artificial Sequence: Synthetic peptide
  Seed: HQGPAFVTW (TYRP2_HUMAN)
HAGPAFVTW

SEQ ID NO: 185793 - protein, 10 aa, Artificial Sequence
  Description of Artificial Sequence: Synthetic peptide
  Seed: RLRKGYTPLM (TYRP2_HUMAN)
RTRKGYTPLE

SEQ ID NO: 185794 - protein, 9 aa, Artificial Sequence
  Description of Artificial Sequence: Synthetic peptide
  Seed: SLDDYNHLV (TYRP2_HUMAN)
SADDYNHLM

SEQ ID NO: 185795 - protein, 9 aa, Artificial Sequence
  Description of Artificial Sequence: Synthetic peptide
  Seed: KCTGNFAGY (TYRP2_HUMAN)
KITGNFAGY

SEQ ID NO: 185796 - protein, 9 aa, Artificial Sequence
  Description of Artificial Sequence: Synthetic peptide
  Seed: YSYAIDLPV (TYRP2_HUMAN)
YPYAIDLPW

SEQ ID NO: 185797 - protein, 9 aa, Artificial Sequence
  Description of Artificial Sequence: Synthetic peptide
  Seed: TLVALVGLF (TYRP2_HUMAN)
TQVALVGLF

SEQ ID NO: 185798 - protein, 9 aa, Artificial Sequence
  Description of Artificial Sequence: Synthetic peptide
  Seed: GTYEGLLRR (TYRP2_HUMAN)
GFYEGLLRY

SEQ ID NO: 185799 - protein, 10 aa, Artificial Sequence
  Description of Artificial Sequence: Synthetic peptide
  Seed: AIDFSHQGPA (TYRP2_HUMAN)
ALDFSHQGPI

SEQ ID NO: 185800 - protein, 9 aa, Artificial Sequence
  Description of Artificial Sequence: Synthetic peptide
  Seed: GTNALPHSA (TYRP2_HUMAN)
GVNALPHSV

SEQ ID NO: 185801 - protein, 10 aa, Artificial Sequence
  Description of Artificial Sequence: Synthetic peptide
  Seed: REQFLGALDL (TYRP2_HUMAN)
RNQFLGALDY

SEQ ID NO: 185802 - protein, 9 aa, Artificial Sequence
  Description of Artificial Sequence: Synthetic peptide
  Seed: TLISRNSRF (TYRP2_HUMAN)
TMISRNSRF

SEQ ID NO: 185803 - protein, 11 aa, Artificial Sequence
  Description of Artificial Sequence: Synthetic peptide
  Seed: FFVWLHYYSVR (TYRP2_HUMAN)
FSVWLHYYSVR

SEQ ID NO: 185804 - protein, 9 aa, Artificial Sequence
  Description of Artificial Sequence: Synthetic peptide
  Seed: AIFDEWMKR (TYRP2_HUMAN)
AAFDEWMKK

SEQ ID NO: 185805 - protein, 9 aa, Artificial Sequence
  Description of Artificial Sequence: Synthetic peptide
  Seed: GLFVLLAFL (TYRP2_HUMAN)
GTFVLLAFV

SEQ ID NO: 185806 - protein, 9 aa, Artificial Sequence
  Description of Artificial Sequence: Synthetic peptide
  Seed: YSYAIDLPV (TYRP2_HUMAN)
YMYAIDLPH

SEQ ID NO: 185807 - protein, 10 aa, Artificial Sequence
  Description of Artificial Sequence: Synthetic peptide
  Seed: TRPWSGPYIL (TYRP2_HUMAN)
TNPWSGPYIF

SEQ ID NO: 185808 - protein, 9 aa, Artificial Sequence
  Description of Artificial Sequence: Synthetic peptide
  Seed: FVLLAFLQY (TYRP2_HUMAN)
FSLLAFLQW

SEQ ID NO: 185809 - protein, 9 aa, Artificial Sequence
  Description of Artificial Sequence: Synthetic peptide
  Seed: RLRKGYTPL (TYRP2_HUMAN)
RGRKGYTPS

SEQ ID NO: 185810 - protein, 9 aa, Artificial Sequence
  Description of Artificial Sequence: Synthetic peptide
  Seed: YAIDLPVSV (TYRP2_HUMAN)
YPIDLPVSN

SEQ ID NO: 185811 - protein, 9 aa, Artificial Sequence
  Description of Artificial Sequence: Synthetic peptide
  Seed: FLNGTNALP (TYRP2_HUMAN)
FQNGTNALI

SEQ ID NO: 185812 - protein, 9 aa, Artificial Sequence
  Description of Artificial Sequence: Synthetic peptide
  Seed: FFPPVTNEE (TYRP2_HUMAN)
FQPPVTNEL

SEQ ID NO: 185813 - protein, 10 aa, Artificial Sequence
  Description of Artificial Sequence: Synthetic peptide
  Seed: RNSRFSSWET (TYRP2_HUMAN)
RVSRFSSWEA

SEQ ID NO: 185814 - protein, 11 aa, Artificial Sequence
  Description of Artificial Sequence: Synthetic peptide
  Seed: SLDDYNHLVTL (TYRP2_HUMAN)
SGDDYNHLVTL

SEQ ID NO: 185815 - protein, 9 aa, Artificial Sequence
  Description of Artificial Sequence: Synthetic peptide
  Seed: SRFSSWETV (TYRP2_HUMAN)
SKFSSWETY

SEQ ID NO: 185816 - protein, 10 aa, Artificial Sequence
  Description of Artificial Sequence: Synthetic peptide
  Seed: TLVALVGLFV (TYRP2_HUMAN)
TMVALVGLFV

SEQ ID NO: 185817 - protein, 9 aa, Artificial Sequence
  Description of Artificial Sequence: Synthetic peptide
  Seed: STFSFRNAL (TYRP2_HUMAN)
SRFSFRNAI

SEQ ID NO: 185818 - protein, 10 aa, Artificial Sequence
  Description of Artificial Sequence: Synthetic peptide
  Seed: FLTSDQLGYS (TYRP2_HUMAN)
FETSDQLGYV

SEQ ID NO: 185819 - protein, 9 aa, Artificial Sequence
  Description of Artificial Sequence: Synthetic peptide
  Seed: WPRKFFHRT (TYRP2_HUMAN)
WPRKFFHRI

SEQ ID NO: 185820 - protein, 10 aa, Artificial Sequence
  Description of Artificial Sequence: Synthetic peptide
  Seed: NSRFSSWETV (TYRP2_HUMAN)
NCRFSSWETL

SEQ ID NO: 185821 - protein, 10 aa, Artificial Sequence
  Description of Artificial Sequence: Synthetic peptide
  Seed: IGNESFALPY (TYRP2_HUMAN)
IRNESFALPY

SEQ ID NO: 185822 - protein, 9 aa, Artificial Sequence
  Description of Artificial Sequence: Synthetic peptide
  Seed: YVITTQHWL (TYRP2_HUMAN)
YAITTQHWY

SEQ ID NO: 185823 - protein, 9 aa, Artificial Sequence
  Description of Artificial Sequence: Synthetic peptide
  Seed: EQFLGALDL (TYRP2_HUMAN)
EEFLGALDL

SEQ ID NO: 185824 - protein, 11 aa, Artificial Sequence
  Description of Artificial Sequence: Synthetic peptide
  Seed: FVVLHSFTDAI (TYRP2_HUMAN)
FCVLHSFTDAI

SEQ ID NO: 185825 - protein, 9 aa, Artificial Sequence
  Description of Artificial Sequence: Synthetic peptide
  Seed: DAWPQELAP (TYRP2_HUMAN)
DAWPQELAL

SEQ ID NO: 185826 - protein, 9 aa, Artificial Sequence
  Description of Artificial Sequence: Synthetic peptide
  Seed: VMSLHNLVH (TYRP2_HUMAN)
VSSLHNLVM

SEQ ID NO: 185827 - protein, 10 aa, Artificial Sequence
  Description of Artificial Sequence: Synthetic peptide
  Seed: QPQFANCSVY (TYRP2_HUMAN)
QIQFANCSVF

SEQ ID NO: 185828 - protein, 10 aa, Artificial Sequence
  Description of Artificial Sequence: Synthetic peptide
  Seed: VALVGLFVLL (TYRP2_HUMAN)
VSLVGLFVLV

SEQ ID NO: 185829 - protein, 10 aa, Artificial Sequence
  Description of Artificial Sequence: Synthetic peptide
  Seed: SLDDYNHLVT (TYRP2_HUMAN)
SMDDYNHLVV

SEQ ID NO: 185830 - protein, 9 aa, Artificial Sequence
  Description of Artificial Sequence: Synthetic peptide
  Seed: SFLNGTNAL (TYRP2_HUMAN)
SMLNGTNAF

SEQ ID NO: 185831 - protein, 10 aa, Artificial Sequence
  Description of Artificial Sequence: Synthetic peptide
  Seed: MSPLWWGFLL (TYRP2_HUMAN)
MYPLWWGFLW

SEQ ID NO: 185832 - protein, 9 aa, Artificial Sequence
  Description of Artificial Sequence: Synthetic peptide
  Seed: YSYAIDLPV (TYRP2_HUMAN)
YHYAIDLPH

SEQ ID NO: 185833 - protein, 11 aa, Artificial Sequence
  Description of Artificial Sequence: Synthetic peptide
  Seed: YTPLMETHLSS (TYRP2_HUMAN)
YNPLMETHLSL

SEQ ID NO: 185834 - protein, 10 aa, Artificial Sequence
  Description of Artificial Sequence: Synthetic peptide
  Seed: FPPVTNEELF (TYRP2_HUMAN)
FEPVTNEELW

SEQ ID NO: 185835 - protein, 9 aa, Artificial Sequence
  Description of Artificial Sequence: Synthetic peptide
  Seed: NEELFLTSD (TYRP2_HUMAN)
NEELFLTSL

SEQ ID NO: 185836 - protein, 11 aa, Artificial Sequence
  Description of Artificial Sequence: Synthetic peptide
  Seed: RNSRFSSWETV (TYRP2_HUMAN)
RYSRFSSWETL

SEQ ID NO: 185837 - protein, 10 aa, Artificial Sequence
  Description of Artificial Sequence: Synthetic peptide
  Seed: YDFFVWLHYY (TYRP2_HUMAN)
YVFFVWLHYY

SEQ ID NO: 185838 - protein, 9 aa, Artificial Sequence
  Description of Artificial Sequence: Synthetic peptide
  Seed: DQLGYSYAI (TYRP2_HUMAN)
DELGYSYAM

SEQ ID NO: 185839 - protein, 10 aa, Artificial Sequence
  Description of Artificial Sequence: Synthetic peptide
  Seed: YNMVPFFPPV (TYRP2_HUMAN)
YMMVPFFPPS

SEQ ID NO: 185840 - protein, 10 aa, Artificial Sequence
  Description of Artificial Sequence: Synthetic peptide
  Seed: NSTFSFRNAL (TYRP2_HUMAN)
NWTFSFRNAL

SEQ ID NO: 185841 - protein, 9 aa, Artificial Sequence
  Description of Artificial Sequence: Synthetic peptide
  Seed: VVMGTLVAL (TYRP2_HUMAN)
VYMGTLVAL

SEQ ID NO: 185842 - protein, 10 aa, Artificial Sequence
  Description of Artificial Sequence: Synthetic peptide
  Seed: FFQNSTFSFR (TYRP2_HUMAN)
FCQNSTFSFR

SEQ ID NO: 185843 - protein, 10 aa, Artificial Sequence
  Description of Artificial Sequence: Synthetic peptide
  Seed: SFTDAIFDEW (TYRP2_HUMAN)
SFTDAIFDEF

SEQ ID NO: 185844 - protein, 11 aa, Artificial Sequence
  Description of Artificial Sequence: Synthetic peptide
  Seed: FVVLHSFTDAI (TYRP2_HUMAN)
FSVLHSFTDAL

SEQ ID NO: 185845 - protein, 9 aa, Artificial Sequence
  Description of Artificial Sequence: Synthetic peptide
  Seed: TLLGPGRPY (TYRP2_HUMAN)
TPLGPGRPF

SEQ ID NO: 185846 - protein, 10 aa, Artificial Sequence
  Description of Artificial Sequence: Synthetic peptide
  Seed: LTSDQLGYSY (TYRP2_HUMAN)
LLSDQLGYSY

SEQ ID NO: 185847 - protein, 9 aa, Artificial Sequence
  Description of Artificial Sequence: Synthetic peptide
  Seed: IFDEWMKRF (TYRP2_HUMAN)
IVDEWMKRL

SEQ ID NO: 185848 - protein, 9 aa, Artificial Sequence
  Description of Artificial Sequence: Synthetic peptide
  Seed: ANDPIFVVL (TYRP2_HUMAN)
AADPIFVVI

SEQ ID NO: 185849 - protein, 9 aa, Artificial Sequence
  Description of Artificial Sequence: Synthetic peptide
  Seed: RDCLSLQKF (TYRP2_HUMAN)
RSCLSLQKL

SEQ ID NO: 185850 - protein, 9 aa, Artificial Sequence
  Description of Artificial Sequence: Synthetic peptide
  Seed: MTVDSLVNK (TYRP2_HUMAN)
MVVDSLVNY

SEQ ID NO: 185851 - protein, 9 aa, Artificial Sequence
  Description of Artificial Sequence: Synthetic peptide
  Seed: SFLNGTNAL (TYRP2_HUMAN)
SWLNGTNAW

SEQ ID NO: 185852 - protein, 11 aa, Artificial Sequence
  Description of Artificial Sequence: Synthetic peptide
  Seed: FFQNSTFSFRN (TYRP2_HUMAN)
FVQNSTFSFRR

SEQ ID NO: 185853 - protein, 10 aa, Artificial Sequence
  Description of Artificial Sequence: Synthetic peptide
  Seed: YHLLCLERDL (TYRP2_HUMAN)
YLLLCLERDV

SEQ ID NO: 185854 - protein, 9 aa, Artificial Sequence
  Description of Artificial Sequence: Synthetic peptide
  Seed: KCTGNFAGY (TYRP2_HUMAN)
KVTGNFAGF

SEQ ID NO: 185855 - protein, 9 aa, Artificial Sequence
  Description of Artificial Sequence: Synthetic peptide
  Seed: RRLRKGYTP (TYRP2_HUMAN)
RRLRKGYTK

SEQ ID NO: 185856 - protein, 9 aa, Artificial Sequence
  Description of Artificial Sequence: Synthetic peptide
  Seed: IFDEWMKRF (TYRP2_HUMAN)
IMDEWMKRL

SEQ ID NO: 185857 - protein, 11 aa, Artificial Sequence
  Description of Artificial Sequence: Synthetic peptide
  Seed: TQPQFANCSVY (TYRP2_HUMAN)
TVPQFANCSVY

SEQ ID NO: 185858 - protein, 10 aa, Artificial Sequence
  Description of Artificial Sequence: Synthetic peptide
  Seed: RMYNMVPFFP (TYRP2_HUMAN)
RHYNMVPFFY

SEQ ID NO: 185859 - protein, 10 aa, Artificial Sequence
  Description of Artificial Sequence: Synthetic peptide
  Seed: REQFLGALDL (TYRP2_HUMAN)
RQQFLGALDM

SEQ ID NO: 185860 - protein, 9 aa, Artificial Sequence
  Description of Artificial Sequence: Synthetic peptide
  Seed: DIRDCLSLQ (TYRP2_HUMAN)
DIRDCLSLK

SEQ ID NO: 185861 - protein, 11 aa, Artificial Sequence
  Description of Artificial Sequence: Synthetic peptide
  Seed: HSLSPQEREQF (TYRP2_HUMAN)
HVLSPQEREQW

SEQ ID NO: 185862 - protein, 10 aa, Artificial Sequence
  Description of Artificial Sequence: Synthetic peptide
  Seed: NSTFSFRNAL (TYRP2_HUMAN)
NTTFSFRNAV

SEQ ID NO: 185863 - protein, 10 aa, Artificial Sequence
  Description of Artificial Sequence: Synthetic peptide
  Seed: RMYNMVPFFP (TYRP2_HUMAN)
RAYNMVPFFK

SEQ ID NO: 185864 - protein, 10 aa, Artificial Sequence
  Description of Artificial Sequence: Synthetic peptide
  Seed: RELWPRKFFH (TYRP2_HUMAN)
RHLWPRKFFK

SEQ ID NO: 185865 - protein, 10 aa, Artificial Sequence
  Description of Artificial Sequence: Synthetic peptide
  Seed: YNMVPFFPPV (TYRP2_HUMAN)
YQMVPFFPPL

SEQ ID NO: 185866 - protein, 9 aa, Artificial Sequence
  Description of Artificial Sequence: Synthetic peptide
  Seed: NMVPFFPPV (TYRP2_HUMAN)
NMVPFFPPT

SEQ ID NO: 185867 - protein, 11 aa, Artificial Sequence
  Description of Artificial Sequence: Synthetic peptide
  Seed: RADTRPWSGPY (TYRP2_HUMAN)
RVDTRPWSGPA

SEQ ID NO: 185868 - protein, 9 aa, Artificial Sequence
  Description of Artificial Sequence: Synthetic peptide
  Seed: FSHQGPAFV (TYRP2_HUMAN)
FAHQGPAFA

SEQ ID NO: 185869 - protein, 10 aa, Artificial Sequence
  Description of Artificial Sequence: Synthetic peptide
  Seed: SLSPQEREQF (TYRP2_HUMAN)
SMSPQEREQW

SEQ ID NO: 185870 - protein, 11 aa, Artificial Sequence
  Description of Artificial Sequence: Synthetic peptide
  Seed: RNSRFSSWETV (TYRP2_HUMAN)
RMSRFSSWETV

SEQ ID NO: 185871 - protein, 9 aa, Artificial Sequence
  Description of Artificial Sequence: Synthetic peptide
  Seed: RNQMGRNSM (TYRP2_HUMAN)
RMQMGRNSY

SEQ ID NO: 185872 - protein, 9 aa, Artificial Sequence
  Description of Artificial Sequence: Synthetic peptide
  Seed: TSDQLGYSY (TYRP2_HUMAN)
TMDQLGYSV

SEQ ID NO: 185873 - protein, 9 aa, Artificial Sequence
  Description of Artificial Sequence: Synthetic peptide
  Seed: TLLVVMGTL (TYRP2_HUMAN)
TQLVVMGTY

SEQ ID NO: 185874 - protein, 9 aa, Artificial Sequence
  Description of Artificial Sequence: Synthetic peptide
  Seed: SLDDYNHLV (TYRP2_HUMAN)
SADDYNHLV

SEQ ID NO: 185875 - protein, 10 aa, Artificial Sequence
  Description of Artificial Sequence: Synthetic peptide
  Seed: IGNESFALPY (TYRP2_HUMAN)
IQNESFALPY

SEQ ID NO: 185876 - protein, 10 aa, Artificial Sequence
  Description of Artificial Sequence: Synthetic peptide
  Seed: RNSRFSSWET (TYRP2_HUMAN)
RTSRFSSWEG

SEQ ID NO: 185877 - protein, 9 aa, Artificial Sequence
  Description of Artificial Sequence: Synthetic peptide
  Seed: ADGTLDSQV (TYRP2_HUMAN)
AEGTLDSQI

SEQ ID NO: 185878 - protein, 9 aa, Artificial Sequence
  Description of Artificial Sequence: Synthetic peptide
  Seed: RLRKGYTPL (TYRP2_HUMAN)
RARKGYTPN

SEQ ID NO: 185879 - protein, 9 aa, Artificial Sequence
  Description of Artificial Sequence: Synthetic peptide
  Seed: RLGAESANV (TYRP2_HUMAN)
RMGAESANL

SEQ ID NO: 185880 - protein, 9 aa, Artificial Sequence
  Description of Artificial Sequence: Synthetic peptide
  Seed: ITTQHWLGL (TYRP2_HUMAN)
ILTQHWLGI

SEQ ID NO: 185881 - protein, 11 aa, Artificial Sequence
  Description of Artificial Sequence: Synthetic peptide
  Seed: RNSRFSSWETV (TYRP2_HUMAN)
RESRFSSWETI

SEQ ID NO: 185882 - protein, 10 aa, Artificial Sequence
  Description of Artificial Sequence: Synthetic peptide
  Seed: NPPFFQNSTF (TYRP2_HUMAN)
NMPFFQNSTM

SEQ ID NO: 185883 - protein, 11 aa, Artificial Sequence
  Description of Artificial Sequence: Synthetic peptide
  Seed: RADTRPWSGPY (TYRP2_HUMAN)
RKDTRPWSGPW

SEQ ID NO: 185884 - protein, 10 aa, Artificial Sequence
  Description of Artificial Sequence: Synthetic peptide
  Seed: YDFFVWLHYY (TYRP2_HUMAN)
YFFFVWLHYN

SEQ ID NO: 185885 - protein, 9 aa, Artificial Sequence
  Description of Artificial Sequence: Synthetic peptide
  Seed: IFDEWMKRF (TYRP2_HUMAN)
IMDEWMKRM

SEQ ID NO: 185886 - protein, 11 aa, Artificial Sequence
  Description of Artificial Sequence: Synthetic peptide
  Seed: MSLHNLVHSFL (TYRP2_HUMAN)
MTLHNLVHSFW

SEQ ID NO: 185887 - protein, 9 aa, Artificial Sequence
  Description of Artificial Sequence: Synthetic peptide
  Seed: STFSFRNAL (TYRP2_HUMAN)
SVFSFRNAY

SEQ ID NO: 185888 - protein, 11 aa, Artificial Sequence
  Description of Artificial Sequence: Synthetic peptide
  Seed: YRRLRKGYTPL (TYRP2_HUMAN)
YMRLRKGYTPI

SEQ ID NO: 185889 - protein, 9 aa, Artificial Sequence
  Description of Artificial Sequence: Synthetic peptide
  Seed: FFQNSTFSF (TYRP2_HUMAN)
FEQNSTFSM

SEQ ID NO: 185890 - protein, 9 aa, Artificial Sequence
  Description of Artificial Sequence: Synthetic peptide
  Seed: IFDEWMKRF (TYRP2_HUMAN)
IFDEWMKRL

SEQ ID NO: 185891 - protein, 10 aa, Artificial Sequence
  Description of Artificial Sequence: Synthetic peptide
  Seed: FVWLHYYSVR (TYRP2_HUMAN)
FLWLHYYSVP

SEQ ID NO: 185892 - protein, 9 aa, Artificial Sequence
  Description of Artificial Sequence: Synthetic peptide
  Seed: RNQDDRELW (TYRP2_HUMAN)
RIQDDRELL

SEQ ID NO: 185893 - protein, 10 aa, Artificial Sequence
  Description of Artificial Sequence: Synthetic peptide
  Seed: ELWPRKFFHR (TYRP2_HUMAN)
EMWPRKFFHK

SEQ ID NO: 185894 - protein, 10 aa, Artificial Sequence
  Description of Artificial Sequence: Synthetic peptide
  Seed: NCSVYDFFVW (TYRP2_HUMAN)
NYSVYDFFVW

SEQ ID NO: 185895 - protein, 9 aa, Artificial Sequence
  Description of Artificial Sequence: Synthetic peptide
  Seed: VVMGTLVAL (TYRP2_HUMAN)
VPMGTLVAF

SEQ ID NO: 185896 - protein, 11 aa, Artificial Sequence
  Description of Artificial Sequence: Synthetic peptide
  Seed: YNMVPFFPPVT (TYRP2_HUMAN)
YMMVPFFPPVC

SEQ ID NO: 185897 - protein, 9 aa, Artificial Sequence
  Description of Artificial Sequence: Synthetic peptide
  Seed: YAIDLPVSV (TYRP2_HUMAN)
YHIDLPVST

SEQ ID NO: 185898 - protein, 11 aa, Artificial Sequence
  Description of Artificial Sequence: Synthetic peptide
  Seed: MYNMVPFFPPV (TYRP2_HUMAN)
MWNMVPFFPPF

SEQ ID NO: 185899 - protein, 9 aa, Artificial Sequence
  Description of Artificial Sequence: Synthetic peptide
  Seed: FLTSDQLGY (TYRP2_HUMAN)
FMTSDQLGM

SEQ ID NO: 185900 - protein, 10 aa, Artificial Sequence
  Description of Artificial Sequence: Synthetic peptide
  Seed: RRLRKGYTPL (TYRP2_HUMAN)
RTLRKGYTPT

SEQ ID NO: 185901 - protein, 9 aa, Artificial Sequence
  Description of Artificial Sequence: Synthetic peptide
  Seed: TLLGPGRPY (TYRP2_HUMAN)
TMLGPGRPL

SEQ ID NO: 185902 - protein, 10 aa, Artificial Sequence
  Description of Artificial Sequence: Synthetic peptide
  Seed: HSFLNGTNAL (TYRP2_HUMAN)
HLFLNGTNAF

SEQ ID NO: 185903 - protein, 9 aa, Artificial Sequence
  Description of Artificial Sequence: Synthetic peptide
  Seed: VVMGTLVAL (TYRP2_HUMAN)
VIMGTLVAF

SEQ ID NO: 185904 - protein, 11 aa, Artificial Sequence
  Description of Artificial Sequence: Synthetic peptide
  Seed: QFLGALDLAKK (TYRP2_HUMAN)
QSLGALDLAKK

SEQ ID NO: 185905 - protein, 8 aa, Artificial Sequence
  Description of Artificial Sequence: Synthetic peptide
  Seed: FSHQGPAF (TYRP2_HUMAN)
FWHQGPAM

SEQ ID NO: 185906 - protein, 9 aa, Artificial Sequence
  Description of Artificial Sequence: Synthetic peptide
  Seed: ALVGLFVLL (TYRP2_HUMAN)
AVVGLFVLK

SEQ ID NO: 185907 - protein, 10 aa, Artificial Sequence
  Description of Artificial Sequence: Synthetic peptide
  Seed: RRLRKGYTPL (TYRP2_HUMAN)
RSLRKGYTPI

SEQ ID NO: 185908 - protein, 10 aa, Artificial Sequence
  Description of Artificial Sequence: Synthetic peptide
  Seed: RNSRFSSWET (TYRP2_HUMAN)
RPSRFSSWEK

SEQ ID NO: 185909 - protein, 9 aa, Artificial Sequence
  Description of Artificial Sequence: Synthetic peptide
  Seed: SLDDYNHLV (TYRP2_HUMAN)
SVDDYNHLF

SEQ ID NO: 185910 - protein, 9 aa, Artificial Sequence
  Description of Artificial Sequence: Synthetic peptide
  Seed: TLISRNSRF (TYRP2_HUMAN)
TTISRNSRY

SEQ ID NO: 185911 - protein, 9 aa, Artificial Sequence
  Description of Artificial Sequence: Synthetic peptide
  Seed: WHRYHLLCL (TYRP2_HUMAN)
WMRYHLLCL

SEQ ID NO: 185912 - protein, 10 aa, Artificial Sequence
  Description of Artificial Sequence: Synthetic peptide
  Seed: SFTDAIFDEW (TYRP2_HUMAN)
SYTDAIFDEM

SEQ ID NO: 185913 - protein, 10 aa, Artificial Sequence
  Description of Artificial Sequence: Synthetic peptide
  Seed: FPPVTNEELF (TYRP2_HUMAN)
FLPVTNEELW

SEQ ID NO: 185914 - protein, 10 aa, Artificial Sequence
  Description of Artificial Sequence: Synthetic peptide
  Seed: RNSRFSSWET (TYRP2_HUMAN)
RSSRFSSWEI

SEQ ID NO: 185915 - protein, 10 aa, Artificial Sequence
  Description of Artificial Sequence: Synthetic peptide
  Seed: VVMGTLVALV (TYRP2_HUMAN)
VKMGTLVALV

SEQ ID NO: 185916 - protein, 9 aa, Artificial Sequence
  Description of Artificial Sequence: Synthetic peptide
  Seed: HQGPAFVTW (TYRP2_HUMAN)
HHGPAFVTC

SEQ ID NO: 185917 - protein, 10 aa, Artificial Sequence
  Description of Artificial Sequence: Synthetic peptide
  Seed: ELAPIGHNRM (TYRP2_HUMAN)
ETAPIGHNRW

SEQ ID NO: 185918 - protein, 10 aa, Artificial Sequence
  Description of Artificial Sequence: Synthetic peptide
  Seed: FFPPVTNEEL (TYRP2_HUMAN)
FVPPVTNEEF

SEQ ID NO: 185919 - protein, 10 aa, Artificial Sequence
  Description of Artificial Sequence: Synthetic peptide
  Seed: YAIDLPVSVE (TYRP2_HUMAN)
YQIDLPVSVT

SEQ ID NO: 185920 - protein, 9 aa, Artificial Sequence
  Description of Artificial Sequence: Synthetic peptide
  Seed: WHRYHLLCL (TYRP2_HUMAN)
WARYHLLCF

SEQ ID NO: 185921 - protein, 9 aa, Artificial Sequence
  Description of Artificial Sequence: Synthetic peptide
  Seed: SFLNGTNAL (TYRP2_HUMAN)
SYLNGTNAY

SEQ ID NO: 185922 - protein, 11 aa, Artificial Sequence
  Description of Artificial Sequence: Synthetic peptide
  Seed: SVYDFFVWLHY (TYRP2_HUMAN)
SAYDFFVWLHK

SEQ ID NO: 185923 - protein, 9 aa, Artificial Sequence
  Description of Artificial Sequence: Synthetic peptide
  Seed: GTYEGLLRR (TYRP2_HUMAN)
GVYEGLLRR

SEQ ID NO: 185924 - protein, 10 aa, Artificial Sequence
  Description of Artificial Sequence: Synthetic peptide
  Seed: NPPFFQNSTF (TYRP2_HUMAN)
NHPFFQNSTY

SEQ ID NO: 185925 - protein, 9 aa, Artificial Sequence
  Description of Artificial Sequence: Synthetic peptide
  Seed: SLDDYNHLV (TYRP2_HUMAN)
SFDDYNHLF

SEQ ID NO: 185926 - protein, 9 aa, Artificial Sequence
  Description of Artificial Sequence: Synthetic peptide
  Seed: RFNPPADAW (TYRP2_HUMAN)
RQNPPADAV

SEQ ID NO: 185927 - protein, 9 aa, Artificial Sequence
  Description of Artificial Sequence: Synthetic peptide
  Seed: TLLGPGRPY (TYRP2_HUMAN)
TWLGPGRPM

SEQ ID NO: 185928 - protein, 9 aa, Artificial Sequence
  Description of Artificial Sequence: Synthetic peptide
  Seed: AARPDDPTL (TYRP2_HUMAN)
AVRPDDPTW

SEQ ID NO: 185929 - protein, 10 aa, Artificial Sequence
  Description of Artificial Sequence: Synthetic peptide
  Seed: RLIGNESFAL (TYRP2_HUMAN)
RVIGNESFAR

SEQ ID NO: 185930 - protein, 11 aa, Artificial Sequence
  Description of Artificial Sequence: Synthetic peptide
  Seed: FVVLHSFTDAI (TYRP2_HUMAN)
FLVLHSFTDAV

SEQ ID NO: 185931 - protein, 9 aa, Artificial Sequence
  Description of Artificial Sequence: Synthetic peptide
  Seed: DDYNHLVTL (TYRP2_HUMAN)
DEYNHLVTL

SEQ ID NO: 185932 - protein, 9 aa, Artificial Sequence
  Description of Artificial Sequence: Synthetic peptide
  Seed: FFQNSTFSF (TYRP2_HUMAN)
FSQNSTFSV

SEQ ID NO: 185933 - protein, 11 aa, Artificial Sequence
  Description of Artificial Sequence: Synthetic peptide
  Seed: MYNMVPFFPPV (TYRP2_HUMAN)
MHNMVPFFPPI

SEQ ID NO: 185934 - protein, 11 aa, Artificial Sequence
  Description of Artificial Sequence: Synthetic peptide
  Seed: SLDDYNHLVTL (TYRP2_HUMAN)
SMDDYNHLVTI

SEQ ID NO: 185935 - protein, 9 aa, Artificial Sequence
  Description of Artificial Sequence: Synthetic peptide
  Seed: WMKRFNPPA (TYRP2_HUMAN)
WTKRFNPPY

SEQ ID NO: 185936 - protein, 10 aa, Artificial Sequence
  Description of Artificial Sequence: Synthetic peptide
  Seed: IGNESFALPY (TYRP2_HUMAN)
ISNESFALPF

SEQ ID NO: 185937 - protein, 10 aa, Artificial Sequence
  Description of Artificial Sequence: Synthetic peptide
  Seed: SVYDFFVWLH (TYRP2_HUMAN)
SDYDFFVWLY

SEQ ID NO: 185938 - protein, 10 aa, Artificial Sequence
  Description of Artificial Sequence: Synthetic peptide
  Seed: GTLDSQVMSL (TYRP2_HUMAN)
GDLDSQVMSV

SEQ ID NO: 185939 - protein, 9 aa, Artificial Sequence
  Description of Artificial Sequence: Synthetic peptide
  Seed: VTWHRYHLL (TYRP2_HUMAN)
VIWHRYHLW

SEQ ID NO: 185940 - protein, 9 aa, Artificial Sequence
  Description of Artificial Sequence: Synthetic peptide
  Seed: YAIDLPVSV (TYRP2_HUMAN)
YSIDLPVSY

SEQ ID NO: 185941 - protein, 9 aa, Artificial Sequence
  Description of Artificial Sequence: Synthetic peptide
  Seed: FVWLHYYSV (TYRP2_HUMAN)
FLWLHYYSK

SEQ ID NO: 185942 - protein, 11 aa, Artificial Sequence
  Description of Artificial Sequence: Synthetic peptide
  Seed: SVYDFFVWLHY (TYRP2_HUMAN)
SYYDFFVWLHY

SEQ ID NO: 185943 - protein, 10 aa, Artificial Sequence
  Description of Artificial Sequence: Synthetic peptide
  Seed: GQFPRVCMTV (TYRP2_HUMAN)
GMFPRVCMTL

SEQ ID NO: 185944 - protein, 10 aa, Artificial Sequence
  Description of Artificial Sequence: Synthetic peptide
  Seed: MSPLWWGFLL (TYRP2_HUMAN)
MTPLWWGFLF

SEQ ID NO: 185945 - protein, 10 aa, Artificial Sequence
  Description of Artificial Sequence: Synthetic peptide
  Seed: AGYNCGDCKF (TYRP2_HUMAN)
AAYNCGDCKW

SEQ ID NO: 185946 - protein, 11 aa, Artificial Sequence
  Description of Artificial Sequence: Synthetic peptide
  Seed: YNMVPFFPPVT (TYRP2_HUMAN)
YMMVPFFPPVQ

SEQ ID NO: 185947 - protein, 9 aa, Artificial Sequence
  Description of Artificial Sequence: Synthetic peptide
  Seed: TLDSQVMSL (TYRP2_HUMAN)
TTDSQVMSY

SEQ ID NO: 185948 - protein, 9 aa, Artificial Sequence
  Description of Artificial Sequence: Synthetic peptide
  Seed: VLHSFTDAI (TYRP2_HUMAN)
VQHSFTDAI

SEQ ID NO: 185949 - protein, 9 aa, Artificial Sequence
  Description of Artificial Sequence: Synthetic peptide
  Seed: VIRQNIHSL (TYRP2_HUMAN)
VPRQNIHSL

SEQ ID NO: 185950 - protein, 9 aa, Artificial Sequence
  Description of Artificial Sequence: Synthetic peptide
  Seed: HYYSVRDTL (TYRP2_HUMAN)
HHYSVRDTV

SEQ ID NO: 185951 - protein, 10 aa, Artificial Sequence
  Description of Artificial Sequence: Synthetic peptide
  Seed: FSFRNALEGF (TYRP2_HUMAN)
FQFRNALEGM

SEQ ID NO: 185952 - protein, 9 aa, Artificial Sequence
  Description of Artificial Sequence: Synthetic peptide
  Seed: DDYNHLVTL (TYRP2_HUMAN)
DGYNHLVTF

SEQ ID NO: 185953 - protein, 10 aa, Artificial Sequence
  Description of Artificial Sequence: Synthetic peptide
  Seed: RPWSGPYILR (TYRP2_HUMAN)
RTWSGPYILR

SEQ ID NO: 185954 - protein, 9 aa, Artificial Sequence
  Description of Artificial Sequence: Synthetic peptide
  Seed: LIGNESFAL (TYRP2_HUMAN)
LVGNESFAV

SEQ ID NO: 185955 - protein, 9 aa, Artificial Sequence
  Description of Artificial Sequence: Synthetic peptide
  Seed: NMVPFFPPV (TYRP2_HUMAN)
NFVPFFPPY

SEQ ID NO: 185956 - protein, 10 aa, Artificial Sequence
  Description of Artificial Sequence: Synthetic peptide
  Seed: YNMVPFFPPV (TYRP2_HUMAN)
YDMVPFFPPI

SEQ ID NO: 185957 - protein, 10 aa, Artificial Sequence
  Description of Artificial Sequence: Synthetic peptide
  Seed: RNSMKLPTLK (TYRP2_HUMAN)
RKSMKLPTLR

SEQ ID NO: 185958 - protein, 9 aa, Artificial Sequence
  Description of Artificial Sequence: Synthetic peptide
  Seed: SAANDPIFV (TYRP2_HUMAN)
SMANDPIFL

SEQ ID NO: 185959 - protein, 9 aa, Artificial Sequence
  Description of Artificial Sequence: Synthetic peptide
  Seed: YSYAIDLPV (TYRP2_HUMAN)
YYYAIDLPL

SEQ ID NO: 185960 - protein, 10 aa, Artificial Sequence
  Description of Artificial Sequence: Synthetic peptide
  Seed: CSVYDFFVWL (TYRP2_HUMAN)
CYVYDFFVWV

SEQ ID NO: 185961 - protein, 9 aa, Artificial Sequence
  Description of Artificial Sequence: Synthetic peptide
  Seed: FQNSTFSFR (TYRP2_HUMAN)
FVNSTFSFM

SEQ ID NO: 185962 - protein, 9 aa, Artificial Sequence
  Description of Artificial Sequence: Synthetic peptide
  Seed: FFQNSTFSF (TYRP2_HUMAN)
FAQNSTFSW

SEQ ID NO: 185963 - protein, 11 aa, Artificial Sequence
  Description of Artificial Sequence: Synthetic peptide
  Seed: FLTSDQLGYSY (TYRP2_HUMAN)
FVTSDQLGYSY

SEQ ID NO: 185964 - protein, 9 aa, Artificial Sequence
  Description of Artificial Sequence: Synthetic peptide
  Seed: LWPRKFFHR (TYRP2_HUMAN)
LIPRKFFHR

SEQ ID NO: 185965 - protein, 9 aa, Artificial Sequence
  Description of Artificial Sequence: Synthetic peptide
  Seed: STFSFRNAL (TYRP2_HUMAN)
SIFSFRNAI

SEQ ID NO: 185966 - protein, 10 aa, Artificial Sequence
  Description of Artificial Sequence: Synthetic peptide
  Seed: KRFNPPADAW (TYRP2_HUMAN)
KYFNPPADAF

SEQ ID NO: 185967 - protein, 10 aa, Artificial Sequence
  Description of Artificial Sequence: Synthetic peptide
  Seed: QELAPIGHNR (TYRP2_HUMAN)
QLLAPIGHNR

SEQ ID NO: 185968 - protein, 9 aa, Artificial Sequence
  Description of Artificial Sequence: Synthetic peptide
  Seed: RLRKGYTPL (TYRP2_HUMAN)
RVRKGYTPP

SEQ ID NO: 185969 - protein, 9 aa, Artificial Sequence
  Description of Artificial Sequence: Synthetic peptide
  Seed: SLDDYNHLV (TYRP2_HUMAN)
SLDDYNHLW

SEQ ID NO: 185970 - protein, 9 aa, Artificial Sequence
  Description of Artificial Sequence: Synthetic peptide
  Seed: NMVPFFPPV (TYRP2_HUMAN)
NVVPFFPPY

SEQ ID NO: 185971 - protein, 11 aa, Artificial Sequence
  Description of Artificial Sequence: Synthetic peptide
  Seed: HPDYVITTQHW (TYRP2_HUMAN)
HHDYVITTQHF

SEQ ID NO: 185972 - protein, 10 aa, Artificial Sequence
  Description of Artificial Sequence: Synthetic peptide
  Seed: MSPLWWGFLL (TYRP2_HUMAN)
MTPLWWGFLI

SEQ ID NO: 185973 - protein, 9 aa, Artificial Sequence
  Description of Artificial Sequence: Synthetic peptide
  Seed: RLRKGYTPL (TYRP2_HUMAN)
RWRKGYTPK

SEQ ID NO: 185974 - protein, 10 aa, Artificial Sequence
  Description of Artificial Sequence: Synthetic peptide
  Seed: FVVLHSFTDA (TYRP2_HUMAN)
FLVLHSFTDI

SEQ ID NO: 185975 - protein, 10 aa, Artificial Sequence
  Description of Artificial Sequence: Synthetic peptide
  Seed: MSPLWWGFLL (TYRP2_HUMAN)
MAPLWWGFLF

SEQ ID NO: 185976 - protein, 9 aa, Artificial Sequence
  Description of Artificial Sequence: Synthetic peptide
  Seed: GPAFVTWHR (TYRP2_HUMAN)
GVAFVTWHK

SEQ ID NO: 185977 - protein, 9 aa, Artificial Sequence
  Description of Artificial Sequence: Synthetic peptide
  Seed: VSVEETPGW (TYRP2_HUMAN)
VTVEETPGM

SEQ ID NO: 185978 - protein, 10 aa, Artificial Sequence
  Description of Artificial Sequence: Synthetic peptide
  Seed: RNQMGRNSMK (TYRP2_HUMAN)
RTQMGRNSMR

SEQ ID NO: 185979 - protein, 8 aa, Artificial Sequence
  Description of Artificial Sequence: Synthetic peptide
  Seed: RPDDPTLI (TYRP2_HUMAN)
RFDDPTLI

SEQ ID NO: 185980 - protein, 9 aa, Artificial Sequence
  Description of Artificial Sequence: Synthetic peptide
  Seed: DSLDDYNHL (TYRP2_HUMAN)
DALDDYNHR

SEQ ID NO: 185981 - protein, 10 aa, Artificial Sequence
  Description of Artificial Sequence: Synthetic peptide
  Seed: LKDIRDCLSL (TYRP2_HUMAN)
LMDIRDCLSY

SEQ ID NO: 185982 - protein, 10 aa, Artificial Sequence
  Description of Artificial Sequence: Synthetic peptide
  Seed: RLRKGYTPLM (TYRP2_HUMAN)
RTRKGYTPLH

SEQ ID NO: 185983 - protein, 9 aa, Artificial Sequence
  Description of Artificial Sequence: Synthetic peptide
  Seed: YSYAIDLPV (TYRP2_HUMAN)
YPYAIDLPD

SEQ ID NO: 185984 - protein, 9 aa, Artificial Sequence
  Description of Artificial Sequence: Synthetic peptide
  Seed: FQNSTFSFR (TYRP2_HUMAN)
FSNSTFSFK

SEQ ID NO: 185985 - protein, 11 aa, Artificial Sequence
  Description of Artificial Sequence: Synthetic peptide
  Seed: HQGPAFVTWHR (TYRP2_HUMAN)
HTGPAFVTWHK

SEQ ID NO: 185986 - protein, 10 aa, Artificial Sequence
  Description of Artificial Sequence: Synthetic peptide
  Seed: MSPLWWGFLL (TYRP2_HUMAN)
MRPLWWGFLW

SEQ ID NO: 185987 - protein, 10 aa, Artificial Sequence
  Description of Artificial Sequence: Synthetic peptide
  Seed: AANDPIFVVL (TYRP2_HUMAN)
AINDPIFVVF

SEQ ID NO: 185988 - protein, 9 aa, Artificial Sequence
  Description of Artificial Sequence: Synthetic peptide
  Seed: HQGPAFVTW (TYRP2_HUMAN)
HAGPAFVTF

SEQ ID NO: 185989 - protein, 9 aa, Artificial Sequence
  Description of Artificial Sequence: Synthetic peptide
  Seed: GTYEGLLRR (TYRP2_HUMAN)
GAYEGLLRF

SEQ ID NO: 185990 - protein, 9 aa, Artificial Sequence
  Description of Artificial Sequence: Synthetic peptide
  Seed: FLNGTNALP (TYRP2_HUMAN)
FMNGTNALI

SEQ ID NO: 185991 - protein, 10 aa, Artificial Sequence
  Description of Artificial Sequence: Synthetic peptide
  Seed: RMYNMVPFFP (TYRP2_HUMAN)
RTYNMVPFFL

SEQ ID NO: 185992 - protein, 10 aa, Artificial Sequence
  Description of Artificial Sequence: Synthetic peptide
  Seed: MGTLVALVGL (TYRP2_HUMAN)
MQTLVALVGV

SEQ ID NO: 185993 - protein, 9 aa, Artificial Sequence
  Description of Artificial Sequence: Synthetic peptide
  Seed: LMETHLSSK (TYRP2_HUMAN)
LIETHLSSY

SEQ ID NO: 185994 - protein, 10 aa, Artificial Sequence
  Description of Artificial Sequence: Synthetic peptide
  Seed: RRLRKGYTPL (TYRP2_HUMAN)
RFLRKGYTPY

SEQ ID NO: 185995 - protein, 9 aa, Artificial Sequence
  Description of Artificial Sequence: Synthetic peptide
  Seed: FVWLHYYSV (TYRP2_HUMAN)
FVWLHYYSL

SEQ ID NO: 185996 - protein, 11 aa, Artificial Sequence
  Description of Artificial Sequence: Synthetic peptide
  Seed: KRVHPDYVITT (TYRP2_HUMAN)
KRVHPDYVITM

SEQ ID NO: 185997 - protein, 11 aa, Artificial Sequence
  Description of Artificial Sequence: Synthetic peptide
  Seed: FFPPVTNEELF (TYRP2_HUMAN)
FYPPVTNEELI

SEQ ID NO: 185998 - protein, 10 aa, Artificial Sequence
  Description of Artificial Sequence: Synthetic peptide
  Seed: FFQNSTFSFR (TYRP2_HUMAN)
FRQNSTFSFR

SEQ ID NO: 185999 - protein, 9 aa, Artificial Sequence
  Description of Artificial Sequence: Synthetic peptide
  Seed: STFSFRNAL (TYRP2_HUMAN)
SSFSFRNAK

SEQ ID NO: 186000 - protein, 10 aa, Artificial Sequence
  Description of Artificial Sequence: Synthetic peptide
  Seed: NGTYEGLLRR (TYRP2_HUMAN)
NCTYEGLLRR

SEQ ID NO: 186001 - protein, 10 aa, Artificial Sequence
  Description of Artificial Sequence: Synthetic peptide
  Seed: RNSRFSSWET (TYRP2_HUMAN)
RTSRFSSWET

SEQ ID NO: 186002 - protein, 10 aa, Artificial Sequence
  Description of Artificial Sequence: Synthetic peptide
  Seed: SVRDTLLGPG (TYRP2_HUMAN)
SVRDTLLGPK

SEQ ID NO: 186003 - protein, 10 aa, Artificial Sequence
  Description of Artificial Sequence: Synthetic peptide
  Seed: TLLGPGRPYR (TYRP2_HUMAN)
TILGPGRPYK

SEQ ID NO: 186004 - protein, 9 aa, Artificial Sequence
  Description of Artificial Sequence: Synthetic peptide
  Seed: YYSVRDTLL (TYRP2_HUMAN)
YRSVRDTLY

SEQ ID NO: 186005 - protein, 9 aa, Artificial Sequence
  Description of Artificial Sequence: Synthetic peptide
  Seed: VTNEELFLT (TYRP2_HUMAN)
VVNEELFLI

SEQ ID NO: 186006 - protein, 10 aa, Artificial Sequence
  Description of Artificial Sequence: Synthetic peptide
  Seed: FFQNSTFSFR (TYRP2_HUMAN)
FKQNSTFSFR

SEQ ID NO: 186007 - protein, 11 aa, Artificial Sequence
  Description of Artificial Sequence: Synthetic peptide
  Seed: YTPLMETHLSS (TYRP2_HUMAN)
YGPLMETHLSL

SEQ ID NO: 186008 - protein, 10 aa, Artificial Sequence
  Description of Artificial Sequence: Synthetic peptide
  Seed: FFQNSTFSFR (TYRP2_HUMAN)
FYQNSTFSFS

SEQ ID NO: 186009 - protein, 10 aa, Artificial Sequence
  Description of Artificial Sequence: Synthetic peptide
  Seed: NSRFSSWETV (TYRP2_HUMAN)
NQRFSSWETL

SEQ ID NO: 186010 - protein, 9 aa, Artificial Sequence
  Description of Artificial Sequence: Synthetic peptide
  Seed: VVMGTLVAL (TYRP2_HUMAN)
VTMGTLVAI

SEQ ID NO: 186011 - protein, 11 aa, Artificial Sequence
  Description of Artificial Sequence: Synthetic peptide
  Seed: VCDSLDDYNHL (TYRP2_HUMAN)
VADSLDDYNHV

SEQ ID NO: 186012 - protein, 10 aa, Artificial Sequence
  Description of Artificial Sequence: Synthetic peptide
  Seed: ALVGLFVLLA (TYRP2_HUMAN)
ALVGLFVLLI

SEQ ID NO: 186013 - protein, 9 aa, Artificial Sequence
  Description of Artificial Sequence: Synthetic peptide
  Seed: FANCSVYDF (TYRP2_HUMAN)
FPNCSVYDM

SEQ ID NO: 186014 - protein, 9 aa, Artificial Sequence
  Description of Artificial Sequence: Synthetic peptide
  Seed: VSVEETPGW (TYRP2_HUMAN)
VQVEETPGW

SEQ ID NO: 186015 - protein, 10 aa, Artificial Sequence
  Description of Artificial Sequence: Synthetic peptide
  Seed: ADTRPWSGPY (TYRP2_HUMAN)
ALTRPWSGPY

SEQ ID NO: 186016 - protein, 9 aa, Artificial Sequence
  Description of Artificial Sequence: Synthetic peptide
  Seed: EGLLRRNQM (TYRP2_HUMAN)
EMLLRRNQL

SEQ ID NO: 186017 - protein, 10 aa, Artificial Sequence
  Description of Artificial Sequence: Synthetic peptide
  Seed: NSTFSFRNAL (TYRP2_HUMAN)
NETFSFRNAI

SEQ ID NO: 186018 - protein, 9 aa, Artificial Sequence
  Description of Artificial Sequence: Synthetic peptide
  Seed: VMGTLVALV (TYRP2_HUMAN)
VMGTLVALR

SEQ ID NO: 186019 - protein, 10 aa, Artificial Sequence
  Description of Artificial Sequence: Synthetic peptide
  Seed: VALVGLFVLL (TYRP2_HUMAN)
VVLVGLFVLV

SEQ ID NO: 186020 - protein, 10 aa, Artificial Sequence
  Description of Artificial Sequence: Synthetic peptide
  Seed: NESFALPYWN (TYRP2_HUMAN)
NESFALPYWF

SEQ ID NO: 186021 - protein, 9 aa, Artificial Sequence
  Description of Artificial Sequence: Synthetic peptide
  Seed: YSYAIDLPV (TYRP2_HUMAN)
YPYAIDLPS

SEQ ID NO: 186022 - protein, 10 aa, Artificial Sequence
  Description of Artificial Sequence: Synthetic peptide
  Seed: CCPRLGAESA (TYRP2_HUMAN)
CRPRLGAESI

SEQ ID NO: 186023 - protein, 9 aa, Artificial Sequence
  Description of Artificial Sequence: Synthetic peptide
  Seed: AKKRVHPDY (TYRP2_HUMAN)
AQKRVHPDF

SEQ ID NO: 186024 - protein, 11 aa, Artificial Sequence
  Description of Artificial Sequence: Synthetic peptide
  Seed: CDSLDDYNHLV (TYRP2_HUMAN)
CLSLDDYNHLV

SEQ ID NO: 186025 - protein, 9 aa, Artificial Sequence
  Description of Artificial Sequence: Synthetic peptide
  Seed: SAANDPIFV (TYRP2_HUMAN)
SLANDPIFL

SEQ ID NO: 186026 - protein, 9 aa, Artificial Sequence
  Description of Artificial Sequence: Synthetic peptide
  Seed: WMKRFNPPA (TYRP2_HUMAN)
WLKRFNPPK

SEQ ID NO: 186027 - protein, 9 aa, Artificial Sequence
  Description of Artificial Sequence: Synthetic peptide
  Seed: TLLGPGRPY (TYRP2_HUMAN)
TALGPGRPA

SEQ ID NO: 186028 - protein, 9 aa, Artificial Sequence
  Description of Artificial Sequence: Synthetic peptide
  Seed: SVYDFFVWL (TYRP2_HUMAN)
STYDFFVWW

SEQ ID NO: 186029 - protein, 9 aa, Artificial Sequence
  Description of Artificial Sequence: Synthetic peptide
  Seed: FFQNSTFSF (TYRP2_HUMAN)
FQQNSTFSL

SEQ ID NO: 186030 - protein, 9 aa, Artificial Sequence
  Description of Artificial Sequence: Synthetic peptide
  Seed: ISRNSRFSS (TYRP2_HUMAN)
ITRNSRFSV

SEQ ID NO: 186031 - protein, 9 aa, Artificial Sequence
  Description of Artificial Sequence: Synthetic peptide
  Seed: RLRKGYTPL (TYRP2_HUMAN)
RIRKGYTPF

SEQ ID NO: 186032 - protein, 9 aa, Artificial Sequence
  Description of Artificial Sequence: Synthetic peptide
  Seed: LLGPGRPYR (TYRP2_HUMAN)
LVGPGRPYK

SEQ ID NO: 186033 - protein, 9 aa, Artificial Sequence
  Description of Artificial Sequence: Synthetic peptide
  Seed: LVALVGLFV (TYRP2_HUMAN)
LLALVGLFA

SEQ ID NO: 186034 - protein, 9 aa, Artificial Sequence
  Description of Artificial Sequence: Synthetic peptide
  Seed: RTCKCTGNF (TYRP2_HUMAN)
RACKCTGNW

SEQ ID NO: 186035 - protein, 9 aa, Artificial Sequence
  Description of Artificial Sequence: Synthetic peptide
  Seed: YSYAIDLPV (TYRP2_HUMAN)
YIYAIDLPW

SEQ ID NO: 186036 - protein, 9 aa, Artificial Sequence
  Description of Artificial Sequence: Synthetic peptide
  Seed: YAIDLPVSV (TYRP2_HUMAN)
YPIDLPVSH

SEQ ID NO: 186037 - protein, 9 aa, Artificial Sequence
  Description of Artificial Sequence: Synthetic peptide
  Seed: FVWLHYYSV (TYRP2_HUMAN)
FIWLHYYSK

SEQ ID NO: 186038 - protein, 9 aa, Artificial Sequence
  Description of Artificial Sequence: Synthetic peptide
  Seed: TLKDIRDCL (TYRP2_HUMAN)
TLKDIRDCV

SEQ ID NO: 186039 - protein, 9 aa, Artificial Sequence
  Description of Artificial Sequence: Synthetic peptide
  Seed: VIRQNIHSL (TYRP2_HUMAN)
VARQNIHSM

SEQ ID NO: 186040 - protein, 9 aa, Artificial Sequence
  Description of Artificial Sequence: Synthetic peptide
  Seed: YAIDLPVSV (TYRP2_HUMAN)
YWIDLPVSI

SEQ ID NO: 186041 - protein, 9 aa, Artificial Sequence
  Description of Artificial Sequence: Synthetic peptide
  Seed: DDYNHLVTL (TYRP2_HUMAN)
DPYNHLVTV

SEQ ID NO: 186042 - protein, 10 aa, Artificial Sequence
  Description of Artificial Sequence: Synthetic peptide
  Seed: ADTRPWSGPY (TYRP2_HUMAN)
ATTRPWSGPF

SEQ ID NO: 186043 - protein, 9 aa, Artificial Sequence
  Description of Artificial Sequence: Synthetic peptide
  Seed: NRMYNMVPF (TYRP2_HUMAN)
NHMYNMVPY

SEQ ID NO: 186044 - protein, 9 aa, Artificial Sequence
  Description of Artificial Sequence: Synthetic peptide
  Seed: TLDSQVMSL (TYRP2_HUMAN)
TIDSQVMSY

SEQ ID NO: 186045 - protein, 10 aa, Artificial Sequence
  Description of Artificial Sequence: Synthetic peptide
  Seed: RRLRKGYTPL (TYRP2_HUMAN)
RPLRKGYTPT

SEQ ID NO: 186046 - protein, 9 aa, Artificial Sequence
  Description of Artificial Sequence: Synthetic peptide
  Seed: AANDPIFVV (TYRP2_HUMAN)
AMNDPIFVY

SEQ ID NO: 186047 - protein, 9 aa, Artificial Sequence
  Description of Artificial Sequence: Synthetic peptide
  Seed: RPDDPTLIS (TYRP2_HUMAN)
RPDDPTLIA

SEQ ID NO: 186048 - protein, 9 aa, Artificial Sequence
  Description of Artificial Sequence: Synthetic peptide
  Seed: DDYNHLVTL (TYRP2_HUMAN)
DEYNHLVTY

SEQ ID NO: 186049 - protein, 10 aa, Artificial Sequence
  Description of Artificial Sequence: Synthetic peptide
  Seed: SVYDFFVWLH (TYRP2_HUMAN)
SYYDFFVWLR

SEQ ID NO: 186050 - protein, 10 aa, Artificial Sequence
  Description of Artificial Sequence: Synthetic peptide
  Seed: HYYSVRDTLL (TYRP2_HUMAN)
HYYSVRDTLY

SEQ ID NO: 186051 - protein, 10 aa, Artificial Sequence
  Description of Artificial Sequence: Synthetic peptide
  Seed: RNSMKLPTLK (TYRP2_HUMAN)
RRSMKLPTLR

SEQ ID NO: 186052 - protein, 10 aa, Artificial Sequence
  Description of Artificial Sequence: Synthetic peptide
  Seed: YDFFVWLHYY (TYRP2_HUMAN)
YMFFVWLHYG

SEQ ID NO: 186053 - protein, 9 aa, Artificial Sequence
  Description of Artificial Sequence: Synthetic peptide
  Seed: FVWLHYYSV (TYRP2_HUMAN)
FAWLHYYSM

SEQ ID NO: 186054 - protein, 10 aa, Artificial Sequence
  Description of Artificial Sequence: Synthetic peptide
  Seed: YDFFVWLHYY (TYRP2_HUMAN)
YIFFVWLHYF

SEQ ID NO: 186055 - protein, 10 aa, Artificial Sequence
  Description of Artificial Sequence: Synthetic peptide
  Seed: NRMYNMVPFF (TYRP2_HUMAN)
NKMYNMVPFY

SEQ ID NO: 186056 - protein, 9 aa, Artificial Sequence
  Description of Artificial Sequence: Synthetic peptide
  Seed: NALEGFDKA (TYRP2_HUMAN)
NMLEGFDKA

SEQ ID NO: 186057 - protein, 10 aa, Artificial Sequence
  Description of Artificial Sequence: Synthetic peptide
  Seed: QPQFANCSVY (TYRP2_HUMAN)
QKQFANCSVM

SEQ ID NO: 186058 - protein, 9 aa, Artificial Sequence
  Description of Artificial Sequence: Synthetic peptide
  Seed: ANDPIFVVL (TYRP2_HUMAN)
ATDPIFVVI

SEQ ID NO: 186059 - protein, 10 aa, Artificial Sequence
  Description of Artificial Sequence: Synthetic peptide
  Seed: RRLRKGYTPL (TYRP2_HUMAN)
RMLRKGYTPA

SEQ ID NO: 186060 - protein, 9 aa, Artificial Sequence
  Description of Artificial Sequence: Synthetic peptide
  Seed: FFPPVTNEE (TYRP2_HUMAN)
FWPPVTNEI

SEQ ID NO: 186061 - protein, 10 aa, Artificial Sequence
  Description of Artificial Sequence: Synthetic peptide
  Seed: LTSDQLGYSY (TYRP2_HUMAN)
LHSDQLGYSY

SEQ ID NO: 186062 - protein, 9 aa, Artificial Sequence
  Description of Artificial Sequence: Synthetic peptide
  Seed: LQKFDNPPF (TYRP2_HUMAN)
LQKFDNPPI

SEQ ID NO: 186063 - protein, 9 aa, Artificial Sequence
  Description of Artificial Sequence: Synthetic peptide
  Seed: RVCMTVDSL (TYRP2_HUMAN)
RQCMTVDSW

SEQ ID NO: 186064 - protein, 10 aa, Artificial Sequence
  Description of Artificial Sequence: Synthetic peptide
  Seed: YHLLCLERDL (TYRP2_HUMAN)
YMLLCLERDV

SEQ ID NO: 186065 - protein, 10 aa, Artificial Sequence
  Description of Artificial Sequence: Synthetic peptide
  Seed: SLDDYNHLVT (TYRP2_HUMAN)
SCDDYNHLVF

SEQ ID NO: 186066 - protein, 9 aa, Artificial Sequence
  Description of Artificial Sequence: Synthetic peptide
  Seed: ARPDDPTLI (TYRP2_HUMAN)
AIPDDPTLL

SEQ ID NO: 186067 - protein, 10 aa, Artificial Sequence
  Description of Artificial Sequence: Synthetic peptide
  Seed: FSFRNALEGF (TYRP2_HUMAN)
FLFRNALEGY

SEQ ID NO: 186068 - protein, 10 aa, Artificial Sequence
  Description of Artificial Sequence: Synthetic peptide
  Seed: RLRKGYTPLM (TYRP2_HUMAN)
RHRKGYTPLY

SEQ ID NO: 186069 - protein, 9 aa, Artificial Sequence
  Description of Artificial Sequence: Synthetic peptide
  Seed: TLLGPGRPY (TYRP2_HUMAN)
TSLGPGRPF

SEQ ID NO: 186070 - protein, 10 aa, Artificial Sequence
  Description of Artificial Sequence: Synthetic peptide
  Seed: METHLSSKRY (TYRP2_HUMAN)
MMTHLSSKRY

SEQ ID NO: 186071 - protein, 9 aa, Artificial Sequence
  Description of Artificial Sequence: Synthetic peptide
  Seed: SVYDFFVWL (TYRP2_HUMAN)
SFYDFFVWK

SEQ ID NO: 186072 - protein, 11 aa, Artificial Sequence
  Description of Artificial Sequence: Synthetic peptide
  Seed: YTPLMETHLSS (TYRP2_HUMAN)
YFPLMETHLSV

SEQ ID NO: 186073 - protein, 10 aa, Artificial Sequence
  Description of Artificial Sequence: Synthetic peptide
  Seed: SHQGPAFVTW (TYRP2_HUMAN)
SHQGPAFVTM

SEQ ID NO: 186074 - protein, 9 aa, Artificial Sequence
  Description of Artificial Sequence: Synthetic peptide
  Seed: RMYNMVPFF (TYRP2_HUMAN)
RMYNMVPFG

SEQ ID NO: 186075 - protein, 9 aa, Artificial Sequence
  Description of Artificial Sequence: Synthetic peptide
  Seed: RLRKGYTPL (TYRP2_HUMAN)
RWRKGYTPY

SEQ ID NO: 186076 - protein, 10 aa, Artificial Sequence
  Description of Artificial Sequence: Synthetic peptide
  Seed: HYYSVRDTLL (TYRP2_HUMAN)
HRYSVRDTLL

SEQ ID NO: 186077 - protein, 10 aa, Artificial Sequence
  Description of Artificial Sequence: Synthetic peptide
  Seed: HSFLNGTNAL (TYRP2_HUMAN)
HSFLNGTNAW

SEQ ID NO: 186078 - protein, 9 aa, Artificial Sequence
  Description of Artificial Sequence: Synthetic peptide
  Seed: WHRYHLLCL (TYRP2_HUMAN)
WNRYHLLCL

SEQ ID NO: 186079 - protein, 10 aa, Artificial Sequence
  Description of Artificial Sequence: Synthetic peptide
  Seed: TDAIFDEWMK (TYRP2_HUMAN)
TCAIFDEWMR

SEQ ID NO: 186080 - protein, 10 aa, Artificial Sequence
  Description of Artificial Sequence: Synthetic peptide
  Seed: MGTLVALVGL (TYRP2_HUMAN)
MMTLVALVGV

SEQ ID NO: 186081 - protein, 9 aa, Artificial Sequence
  Description of Artificial Sequence: Synthetic peptide
  Seed: ALDLAKKRV (TYRP2_HUMAN)
ATDLAKKRL

SEQ ID NO: 186082 - protein, 10 aa, Artificial Sequence
  Description of Artificial Sequence: Synthetic peptide
  Seed: VALVGLFVLL (TYRP2_HUMAN)
VRLVGLFVLV

SEQ ID NO: 186083 - protein, 9 aa, Artificial Sequence
  Description of Artificial Sequence: Synthetic peptide
  Seed: KCTGNFAGY (TYRP2_HUMAN)
KTTGNFAGY

SEQ ID NO: 186084 - protein, 10 aa, Artificial Sequence
  Description of Artificial Sequence: Synthetic peptide
  Seed: RRLRKGYTPL (TYRP2_HUMAN)
RCLRKGYTPK

SEQ ID NO: 186085 - protein, 10 aa, Artificial Sequence
  Description of Artificial Sequence: Synthetic peptide
  Seed: ESFALPYWNF (TYRP2_HUMAN)
EYFALPYWNF

SEQ ID NO: 186086 - protein, 9 aa, Artificial Sequence
  Description of Artificial Sequence: Synthetic peptide
  Seed: LHSFTDAIF (TYRP2_HUMAN)
LLSFTDAIF

SEQ ID NO: 186087 - protein, 9 aa, Artificial Sequence
  Description of Artificial Sequence: Synthetic peptide
  Seed: ANDPIFVVL (TYRP2_HUMAN)
AWDPIFVVL

SEQ ID NO: 186088 - protein, 10 aa, Artificial Sequence
  Description of Artificial Sequence: Synthetic peptide
  Seed: YNMVPFFPPV (TYRP2_HUMAN)
YCMVPFFPPI

SEQ ID NO: 186089 - protein, 9 aa, Artificial Sequence
  Description of Artificial Sequence: Synthetic peptide
  Seed: LRKGYTPLM (TYRP2_HUMAN)
LMKGYTPLF

SEQ ID NO: 186090 - protein, 9 aa, Artificial Sequence
  Description of Artificial Sequence: Synthetic peptide
  Seed: SLDDYNHLV (TYRP2_HUMAN)
SMDDYNHLI

SEQ ID NO: 186091 - protein, 10 aa, Artificial Sequence
  Description of Artificial Sequence: Synthetic peptide
  Seed: HRYHLLCLER (TYRP2_HUMAN)
HRYHLLCLEM

SEQ ID NO: 186092 - protein, 11 aa, Artificial Sequence
  Description of Artificial Sequence: Synthetic peptide
  Seed: FLTSDQLGYSY (TYRP2_HUMAN)
FYTSDQLGYSY

SEQ ID NO: 186093 - protein, 11 aa, Artificial Sequence
  Description of Artificial Sequence: Synthetic peptide
  Seed: RADTRPWSGPY (TYRP2_HUMAN)
RVDTRPWSGPW

SEQ ID NO: 186094 - protein, 10 aa, Artificial Sequence
  Description of Artificial Sequence: Synthetic peptide
  Seed: RLRKGYTPLM (TYRP2_HUMAN)
RWRKGYTPLL

SEQ ID NO: 186095 - protein, 9 aa, Artificial Sequence
  Description of Artificial Sequence: Synthetic peptide
  Seed: FVWLHYYSV (TYRP2_HUMAN)
FIWLHYYSI

SEQ ID NO: 186096 - protein, 9 aa, Artificial Sequence
  Description of Artificial Sequence: Synthetic peptide
  Seed: RKFFHRTCK (TYRP2_HUMAN)
RSFFHRTCK

SEQ ID NO: 186097 - protein, 10 aa, Artificial Sequence
  Description of Artificial Sequence: Synthetic peptide
  Seed: YNMVPFFPPV (TYRP2_HUMAN)
YHMVPFFPPM

SEQ ID NO: 186098 - protein, 9 aa, Artificial Sequence
  Description of Artificial Sequence: Synthetic peptide
  Seed: DTRPWSGPY (TYRP2_HUMAN)
DLRPWSGPK

SEQ ID NO: 186099 - protein, 8 aa, Artificial Sequence
  Description of Artificial Sequence: Synthetic peptide
  Seed: SLDDYNHL (TYRP2_HUMAN)
STDDYNHM

SEQ ID NO: 186100 - protein, 9 aa, Artificial Sequence
  Description of Artificial Sequence: Synthetic peptide
  Seed: FFQNSTFSF (TYRP2_HUMAN)
FAQNSTFSV

SEQ ID NO: 186101 - protein, 11 aa, Artificial Sequence
  Description of Artificial Sequence: Synthetic peptide
  Seed: FFPPVTNEELF (TYRP2_HUMAN)
FKPPVTNEELY

SEQ ID NO: 186102 - protein, 9 aa, Artificial Sequence
  Description of Artificial Sequence: Synthetic peptide
  Seed: RFNPPADAW (TYRP2_HUMAN)
RVNPPADAY

SEQ ID NO: 186103 - protein, 10 aa, Artificial Sequence
  Description of Artificial Sequence: Synthetic peptide
  Seed: TQPQFANCSV (TYRP2_HUMAN)
TMPQFANCSI

SEQ ID NO: 186104 - protein, 10 aa, Artificial Sequence
  Description of Artificial Sequence: Synthetic peptide
  Seed: QPQFANCSVY (TYRP2_HUMAN)
QDQFANCSVF

SEQ ID NO: 186105 - protein, 9 aa, Artificial Sequence
  Description of Artificial Sequence: Synthetic peptide
  Seed: SVRDTLLGP (TYRP2_HUMAN)
STRDTLLGL

SEQ ID NO: 186106 - protein, 9 aa, Artificial Sequence
  Description of Artificial Sequence: Synthetic peptide
  Seed: AANDPIFVV (TYRP2_HUMAN)
AQNDPIFVV

SEQ ID NO: 186107 - protein, 9 aa, Artificial Sequence
  Description of Artificial Sequence: Synthetic peptide
  Seed: ANDPIFVVL (TYRP2_HUMAN)
ARDPIFVVV

SEQ ID NO: 186108 - protein, 10 aa, Artificial Sequence
  Description of Artificial Sequence: Synthetic peptide
  Seed: KRFNPPADAW (TYRP2_HUMAN)
KQFNPPADAY

SEQ ID NO: 186109 - protein, 9 aa, Artificial Sequence
  Description of Artificial Sequence: Synthetic peptide
  Seed: GQFPRVCMT (TYRP2_HUMAN)
GLFPRVCMA

SEQ ID NO: 186110 - protein, 9 aa, Artificial Sequence
  Description of Artificial Sequence: Synthetic peptide
  Seed: NRMYNMVPF (TYRP2_HUMAN)
NTMYNMVPF

SEQ ID NO: 186111 - protein, 10 aa, Artificial Sequence
  Description of Artificial Sequence: Synthetic peptide
  Seed: FFPPVTNEEL (TYRP2_HUMAN)
FWPPVTNEEW

SEQ ID NO: 186112 - protein, 9 aa, Artificial Sequence
  Description of Artificial Sequence: Synthetic peptide
  Seed: RLRKGYTPL (TYRP2_HUMAN)
RFRKGYTPR

SEQ ID NO: 186113 - protein, 8 aa, Artificial Sequence
  Description of Artificial Sequence: Synthetic peptide
  Seed: RLIGNESF (TYRP2_HUMAN)
RMIGNESY

SEQ ID NO: 186114 - protein, 9 aa, Artificial Sequence
  Description of Artificial Sequence: Synthetic peptide
  Seed: YSYAIDLPV (TYRP2_HUMAN)
YYYAIDLPM

SEQ ID NO: 186115 - protein, 9 aa, Artificial Sequence
  Description of Artificial Sequence: Synthetic peptide
  Seed: YVITTQHWL (TYRP2_HUMAN)
YSITTQHWL

SEQ ID NO: 186116 - protein, 10 aa, Artificial Sequence
  Description of Artificial Sequence: Synthetic peptide
  Seed: RNSRFSSWET (TYRP2_HUMAN)
RWSRFSSWEK

SEQ ID NO: 186117 - protein, 9 aa, Artificial Sequence
  Description of Artificial Sequence: Synthetic peptide
  Seed: VALVGLFVL (TYRP2_HUMAN)
VSLVGLFVF

SEQ ID NO: 186118 - protein, 9 aa, Artificial Sequence
  Description of Artificial Sequence: Synthetic peptide
  Seed: VVMGTLVAL (TYRP2_HUMAN)
VSMGTLVAV

SEQ ID NO: 186119 - protein, 9 aa, Artificial Sequence
  Description of Artificial Sequence: Synthetic peptide
  Seed: SVRDTLLGP (TYRP2_HUMAN)
SVRDTLLGI

SEQ ID NO: 186120 - protein, 10 aa, Artificial Sequence
  Description of Artificial Sequence: Synthetic peptide
  Seed: LHYYSVRDTL (TYRP2_HUMAN)
LPYYSVRDTW

SEQ ID NO: 186121 - protein, 10 aa, Artificial Sequence
  Description of Artificial Sequence: Synthetic peptide
  Seed: RELWPRKFFH (TYRP2_HUMAN)
RLLWPRKFFK

SEQ ID NO: 186122 - protein, 9 aa, Artificial Sequence
  Description of Artificial Sequence: Synthetic peptide
  Seed: LRKGYTPLM (TYRP2_HUMAN)
LKKGYTPLY

SEQ ID NO: 186123 - protein, 9 aa, Artificial Sequence
  Description of Artificial Sequence: Synthetic peptide
  Seed: YDFFVWLHY (TYRP2_HUMAN)
YTFFVWLHY

SEQ ID NO: 186124 - protein, 10 aa, Artificial Sequence
  Description of Artificial Sequence: Synthetic peptide
  Seed: ESANVCGSQQ (TYRP2_HUMAN)
ETANVCGSQY

SEQ ID NO: 186125 - protein, 9 aa, Artificial Sequence
  Description of Artificial Sequence: Synthetic peptide
  Seed: RNSMKLPTL (TYRP2_HUMAN)
RASMKLPTF

SEQ ID NO: 186126 - protein, 10 aa, Artificial Sequence
  Description of Artificial Sequence: Synthetic peptide
  Seed: SDQLGYSYAI (TYRP2_HUMAN)
SSQLGYSYAF

SEQ ID NO: 186127 - protein, 9 aa, Artificial Sequence
  Description of Artificial Sequence: Synthetic peptide
  Seed: YAIDLPVSV (TYRP2_HUMAN)
YKIDLPVSM

SEQ ID NO: 186128 - protein, 9 aa, Artificial Sequence
  Description of Artificial Sequence: Synthetic peptide
  Seed: YAIDLPVSV (TYRP2_HUMAN)
YWIDLPVSL

SEQ ID NO: 186129 - protein, 11 aa, Artificial Sequence
  Description of Artificial Sequence: Synthetic peptide
  Seed: LLVVMGTLVAL (TYRP2_HUMAN)
LSVVMGTLVAV

SEQ ID NO: 186130 - protein, 8 aa, Artificial Sequence
  Description of Artificial Sequence: Synthetic peptide
  Seed: FLNGTNAL (TYRP2_HUMAN)
FYNGTNAV

SEQ ID NO: 186131 - protein, 10 aa, Artificial Sequence
  Description of Artificial Sequence: Synthetic peptide
  Seed: LGPNGTQPQF (TYRP2_HUMAN)
LLPNGTQPQW

SEQ ID NO: 186132 - protein, 8 aa, Artificial Sequence
  Description of Artificial Sequence: Synthetic peptide
  Seed: SDQLGYSY (TYRP2_HUMAN)
SEQLGYSL

SEQ ID NO: 186133 - protein, 10 aa, Artificial Sequence
  Description of Artificial Sequence: Synthetic peptide
  Seed: SPLWWGFLLS (TYRP2_HUMAN)
SNLWWGFLLV

SEQ ID NO: 186134 - protein, 9 aa, Artificial Sequence
  Description of Artificial Sequence: Synthetic peptide
  Seed: WHRYHLLCL (TYRP2_HUMAN)
WYRYHLLCY

SEQ ID NO: 186135 - protein, 11 aa, Artificial Sequence
  Description of Artificial Sequence: Synthetic peptide
  Seed: SLDDYNHLVTL (TYRP2_HUMAN)
SCDDYNHLVTL

SEQ ID NO: 186136 - protein, 10 aa, Artificial Sequence
  Description of Artificial Sequence: Synthetic peptide
  Seed: SLDDYNHLVT (TYRP2_HUMAN)
SIDDYNHLVM

SEQ ID NO: 186137 - protein, 9 aa, Artificial Sequence
  Description of Artificial Sequence: Synthetic peptide
  Seed: VVMGTLVAL (TYRP2_HUMAN)
VKMGTLVAF

SEQ ID NO: 186138 - protein, 8 aa, Artificial Sequence
  Description of Artificial Sequence: Synthetic peptide
  Seed: SLDDYNHL (TYRP2_HUMAN)
SSDDYNHM

SEQ ID NO: 186139 - protein, 9 aa, Artificial Sequence
  Description of Artificial Sequence: Synthetic peptide
  Seed: RNQDDRELW (TYRP2_HUMAN)
REQDDRELF

SEQ ID NO: 186140 - protein, 9 aa, Artificial Sequence
  Description of Artificial Sequence: Synthetic peptide
  Seed: ANDPIFVVL (TYRP2_HUMAN)
AHDPIFVVI

SEQ ID NO: 186141 - protein, 10 aa, Artificial Sequence
  Description of Artificial Sequence: Synthetic peptide
  Seed: LVVMGTLVAL (TYRP2_HUMAN)
LIVMGTLVAY

SEQ ID NO: 186142 - protein, 9 aa, Artificial Sequence
  Description of Artificial Sequence: Synthetic peptide
  Seed: ALVGLFVLL (TYRP2_HUMAN)
AMVGLFVLL

SEQ ID NO: 186143 - protein, 9 aa, Artificial Sequence
  Description of Artificial Sequence: Synthetic peptide
  Seed: TLDSQVMSL (TYRP2_HUMAN)
TADSQVMSM

SEQ ID NO: 186144 - protein, 10 aa, Artificial Sequence
  Description of Artificial Sequence: Synthetic peptide
  Seed: SDQLGYSYAI (TYRP2_HUMAN)
SHQLGYSYAV

SEQ ID NO: 186145 - protein, 9 aa, Artificial Sequence
  Description of Artificial Sequence: Synthetic peptide
  Seed: TLVALVGLF (TYRP2_HUMAN)
TLVALVGLY

SEQ ID NO: 186146 - protein, 10 aa, Artificial Sequence
  Description of Artificial Sequence: Synthetic peptide
  Seed: RLIGNESFAL (TYRP2_HUMAN)
RTIGNESFAY

SEQ ID NO: 186147 - protein, 9 aa, Artificial Sequence
  Description of Artificial Sequence: Synthetic peptide
  Seed: RLRKGYTPL (TYRP2_HUMAN)
RARKGYTPP

SEQ ID NO: 186148 - protein, 9 aa, Artificial Sequence
  Description of Artificial Sequence: Synthetic peptide
  Seed: YTPLMETHL (TYRP2_HUMAN)
YSPLMETHW

SEQ ID NO: 186149 - protein, 9 aa, Artificial Sequence
  Description of Artificial Sequence: Synthetic peptide
  Seed: SRNSRFSSW (TYRP2_HUMAN)
SHNSRFSSF

SEQ ID NO: 186150 - protein, 10 aa, Artificial Sequence
  Description of Artificial Sequence: Synthetic peptide
  Seed: DSLDDYNHLV (TYRP2_HUMAN)
DYLDDYNHLV

SEQ ID NO: 186151 - protein, 9 aa, Artificial Sequence
  Description of Artificial Sequence: Synthetic peptide
  Seed: RLRKGYTPL (TYRP2_HUMAN)
RARKGYTPG

SEQ ID NO: 186152 - protein, 10 aa, Artificial Sequence
  Description of Artificial Sequence: Synthetic peptide
  Seed: VVMGTLVALV (TYRP2_HUMAN)
VMMGTLVALC

SEQ ID NO: 186153 - protein, 10 aa, Artificial Sequence
  Description of Artificial Sequence: Synthetic peptide
  Seed: RLRKGYTPLM (TYRP2_HUMAN)
RMRKGYTPLG

SEQ ID NO: 186154 - protein, 9 aa, Artificial Sequence
  Description of Artificial Sequence: Synthetic peptide
  Seed: VLLAFLQYR (TYRP2_HUMAN)
VQLAFLQYR

SEQ ID NO: 186155 - protein, 10 aa, Artificial Sequence
  Description of Artificial Sequence: Synthetic peptide
  Seed: AIDFSHQGPA (TYRP2_HUMAN)
AMDFSHQGPA

SEQ ID NO: 186156 - protein, 10 aa, Artificial Sequence
  Description of Artificial Sequence: Synthetic peptide
  Seed: FTDAIFDEWM (TYRP2_HUMAN)
FLDAIFDEWA

SEQ ID NO: 186157 - protein, 10 aa, Artificial Sequence
  Description of Artificial Sequence: Synthetic peptide
  Seed: RLRKGYTPLM (TYRP2_HUMAN)
RIRKGYTPLA

SEQ ID NO: 186158 - protein, 9 aa, Artificial Sequence
  Description of Artificial Sequence: Synthetic peptide
  Seed: ECDVCTDQL (TYRP2_HUMAN)
EYDVCTDQM

SEQ ID NO: 186159 - protein, 9 aa, Artificial Sequence
  Description of Artificial Sequence: Synthetic peptide
  Seed: FVWLHYYSV (TYRP2_HUMAN)
FMWLHYYSR

SEQ ID NO: 186160 - protein, 9 aa, Artificial Sequence
  Description of Artificial Sequence: Synthetic peptide
  Seed: RLRKGYTPL (TYRP2_HUMAN)
RWRKGYTPI

SEQ ID NO: 186161 - protein, 8 aa, Artificial Sequence
  Description of Artificial Sequence: Synthetic peptide
  Seed: IRQNIHSL (TYRP2_HUMAN)
IHQNIHSL

SEQ ID NO: 186162 - protein, 11 aa, Artificial Sequence
  Description of Artificial Sequence: Synthetic peptide
  Seed: LSLQKFDNPPF (TYRP2_HUMAN)
LQLQKFDNPPY

SEQ ID NO: 186163 - protein, 10 aa, Artificial Sequence
  Description of Artificial Sequence: Synthetic peptide
  Seed: GTLDSQVMSL (TYRP2_HUMAN)
GTLDSQVMSF

SEQ ID NO: 186164 - protein, 11 aa, Artificial Sequence
  Description of Artificial Sequence: Synthetic peptide
  Seed: RYHLLCLERDL (TYRP2_HUMAN)
RYHLLCLERDF

SEQ ID NO: 186165 - protein, 10 aa, Artificial Sequence
  Description of Artificial Sequence: Synthetic peptide
  Seed: HSFLNGTNAL (TYRP2_HUMAN)
HEFLNGTNAM

SEQ ID NO: 186166 - protein, 10 aa, Artificial Sequence
  Description of Artificial Sequence: Synthetic peptide
  Seed: VLHSFTDAIF (TYRP2_HUMAN)
VKHSFTDAIY

SEQ ID NO: 186167 - protein, 9 aa, Artificial Sequence
  Description of Artificial Sequence: Synthetic peptide
  Seed: STFSFRNAL (TYRP2_HUMAN)
SVFSFRNAM

SEQ ID NO: 186168 - protein, 9 aa, Artificial Sequence
  Description of Artificial Sequence: Synthetic peptide
  Seed: SLDDYNHLV (TYRP2_HUMAN)
SIDDYNHLA

SEQ ID NO: 186169 - protein, 10 aa, Artificial Sequence
  Description of Artificial Sequence: Synthetic peptide
  Seed: ELAPIGHNRM (TYRP2_HUMAN)
ETAPIGHNRP

SEQ ID NO: 186170 - protein, 9 aa, Artificial Sequence
  Description of Artificial Sequence: Synthetic peptide
  Seed: HYYSVRDTL (TYRP2_HUMAN)
HHYSVRDTC

SEQ ID NO: 186171 - protein, 9 aa, Artificial Sequence
  Description of Artificial Sequence: Synthetic peptide
  Seed: VMGTLVALV (TYRP2_HUMAN)
VQGTLVALV

SEQ ID NO: 186172 - protein, 10 aa, Artificial Sequence
  Description of Artificial Sequence: Synthetic peptide
  Seed: HRYHLLCLER (TYRP2_HUMAN)
HRYHLLCLEF

SEQ ID NO: 186173 - protein, 10 aa, Artificial Sequence
  Description of Artificial Sequence: Synthetic peptide
  Seed: RNSRFSSWET (TYRP2_HUMAN)
RNSRFSSWEV

SEQ ID NO: 186174 - protein, 9 aa, Artificial Sequence
  Description of Artificial Sequence: Synthetic peptide
  Seed: VLHSFTDAI (TYRP2_HUMAN)
VLHSFTDAM

SEQ ID NO: 186175 - protein, 10 aa, Artificial Sequence
  Description of Artificial Sequence: Synthetic peptide
  Seed: MGRNSMKLPT (TYRP2_HUMAN)
MTRNSMKLPK

SEQ ID NO: 186176 - protein, 10 aa, Artificial Sequence
  Description of Artificial Sequence: Synthetic peptide
  Seed: VLLAFLQYRR (TYRP2_HUMAN)
VHLAFLQYRK

SEQ ID NO: 186177 - protein, 10 aa, Artificial Sequence
  Description of Artificial Sequence: Synthetic peptide
  Seed: MGTLVALVGL (TYRP2_HUMAN)
MDTLVALVGV

SEQ ID NO: 186178 - protein, 10 aa, Artificial Sequence
  Description of Artificial Sequence: Synthetic peptide
  Seed: FFPPVTNEEL (TYRP2_HUMAN)
FMPPVTNEEM

SEQ ID NO: 186179 - protein, 9 aa, Artificial Sequence
  Description of Artificial Sequence: Synthetic peptide
  Seed: MSPLWWGFL (TYRP2_HUMAN)
MMPLWWGFF

SEQ ID NO: 186180 - protein, 10 aa, Artificial Sequence
  Description of Artificial Sequence: Synthetic peptide
  Seed: RNQMGRNSMK (TYRP2_HUMAN)
RRQMGRNSMF

SEQ ID NO: 186181 - protein, 9 aa, Artificial Sequence
  Description of Artificial Sequence: Synthetic peptide
  Seed: GQFPRVCMT (TYRP2_HUMAN)
GIFPRVCMV

SEQ ID NO: 186182 - protein, 9 aa, Artificial Sequence
  Description of Artificial Sequence: Synthetic peptide
  Seed: RDCLSLQKF (TYRP2_HUMAN)
RICLSLQKW

SEQ ID NO: 186183 - protein, 10 aa, Artificial Sequence
  Description of Artificial Sequence: Synthetic peptide
  Seed: YEGLLRRNQM (TYRP2_HUMAN)
YMGLLRRNQM

SEQ ID NO: 186184 - protein, 10 aa, Artificial Sequence
  Description of Artificial Sequence: Synthetic peptide
  Seed: RPWSGPYILR (TYRP2_HUMAN)
RNWSGPYILR

SEQ ID NO: 186185 - protein, 9 aa, Artificial Sequence
  Description of Artificial Sequence: Synthetic peptide
  Seed: FFPPVTNEE (TYRP2_HUMAN)
FQPPVTNEM

SEQ ID NO: 186186 - protein, 9 aa, Artificial Sequence
  Description of Artificial Sequence: Synthetic peptide
  Seed: MTVDSLVNK (TYRP2_HUMAN)
MWVDSLVNR

SEQ ID NO: 186187 - protein, 10 aa, Artificial Sequence
  Description of Artificial Sequence: Synthetic peptide
  Seed: NSTFSFRNAL (TYRP2_HUMAN)
NITFSFRNAV

SEQ ID NO: 186188 - protein, 11 aa, Artificial Sequence
  Description of Artificial Sequence: Synthetic peptide
  Seed: RNSRFSSWETV (TYRP2_HUMAN)
RTSRFSSWETM

SEQ ID NO: 186189 - protein, 10 aa, Artificial Sequence
  Description of Artificial Sequence: Synthetic peptide
  Seed: FVWLHYYSVR (TYRP2_HUMAN)
FQWLHYYSVL

SEQ ID NO: 186190 - protein, 9 aa, Artificial Sequence
  Description of Artificial Sequence: Synthetic peptide
  Seed: ITTQHWLGL (TYRP2_HUMAN)
IMTQHWLGL

SEQ ID NO: 186191 - protein, 10 aa, Artificial Sequence
  Description of Artificial Sequence: Synthetic peptide
  Seed: FFPPVTNEEL (TYRP2_HUMAN)
FLPPVTNEEY

SEQ ID NO: 186192 - protein, 10 aa, Artificial Sequence
  Description of Artificial Sequence: Synthetic peptide
  Seed: ADTRPWSGPY (TYRP2_HUMAN)
AYTRPWSGPW

SEQ ID NO: 186193 - protein, 10 aa, Artificial Sequence
  Description of Artificial Sequence: Synthetic peptide
  Seed: RNSRFSSWET (TYRP2_HUMAN)
RKSRFSSWEV

SEQ ID NO: 186194 - protein, 9 aa, Artificial Sequence
  Description of Artificial Sequence: Synthetic peptide
  Seed: IFDEWMKRF (TYRP2_HUMAN)
IIDEWMKRL

SEQ ID NO: 186195 - protein, 9 aa, Artificial Sequence
  Description of Artificial Sequence: Synthetic peptide
  Seed: SAANDPIFV (TYRP2_HUMAN)
SVANDPIFV

SEQ ID NO: 186196 - protein, 11 aa, Artificial Sequence
  Description of Artificial Sequence: Synthetic peptide
  Seed: RRLRKGYTPLM (TYRP2_HUMAN)
RRLRKGYTPLL

SEQ ID NO: 186197 - protein, 9 aa, Artificial Sequence
  Description of Artificial Sequence: Synthetic peptide
  Seed: ADGTLDSQV (TYRP2_HUMAN)
AEGTLDSQV

SEQ ID NO: 186198 - protein, 9 aa, Artificial Sequence
  Description of Artificial Sequence: Synthetic peptide
  Seed: AARPDDPTL (TYRP2_HUMAN)
APRPDDPTM

SEQ ID NO: 186199 - protein, 9 aa, Artificial Sequence
  Description of Artificial Sequence: Synthetic peptide
  Seed: RLRKGYTPL (TYRP2_HUMAN)
RARKGYTPV

SEQ ID NO: 186200 - protein, 9 aa, Artificial Sequence
  Description of Artificial Sequence: Synthetic peptide
  Seed: DDYNHLVTL (TYRP2_HUMAN)
DQYNHLVTL

SEQ ID NO: 186201 - protein, 9 aa, Artificial Sequence
  Description of Artificial Sequence: Synthetic peptide
  Seed: SLHNLVHSF (TYRP2_HUMAN)
SMHNLVHSK

SEQ ID NO: 186202 - protein, 10 aa, Artificial Sequence
  Description of Artificial Sequence: Synthetic peptide
  Seed: SVYDFFVWLH (TYRP2_HUMAN)
SIYDFFVWLK

SEQ ID NO: 186203 - protein, 10 aa, Artificial Sequence
  Description of Artificial Sequence: Synthetic peptide
  Seed: MSLHNLVHSF (TYRP2_HUMAN)
MGLHNLVHSY

SEQ ID NO: 186204 - protein, 10 aa, Artificial Sequence
  Description of Artificial Sequence: Synthetic peptide
  Seed: AIFDEWMKRF (TYRP2_HUMAN)
AQFDEWMKRL

SEQ ID NO: 186205 - protein, 10 aa, Artificial Sequence
  Description of Artificial Sequence: Synthetic peptide
  Seed: SDQLGYSYAI (TYRP2_HUMAN)
SYQLGYSYAI

SEQ ID NO: 186206 - protein, 9 aa, Artificial Sequence
  Description of Artificial Sequence: Synthetic peptide
  Seed: RDCLSLQKF (TYRP2_HUMAN)
RMCLSLQKF

SEQ ID NO: 186207 - protein, 9 aa, Artificial Sequence
  Description of Artificial Sequence: Synthetic peptide
  Seed: YAIDLPVSV (TYRP2_HUMAN)
YPIDLPVSY

SEQ ID NO: 186208 - protein, 9 aa, Artificial Sequence
  Description of Artificial Sequence: Synthetic peptide
  Seed: LVVMGTLVA (TYRP2_HUMAN)
LPVMGTLVV

SEQ ID NO: 186209 - protein, 11 aa, Artificial Sequence
  Description of Artificial Sequence: Synthetic peptide
  Seed: YNMVPFFPPVT (TYRP2_HUMAN)
YMMVPFFPPVE

SEQ ID NO: 186210 - protein, 10 aa, Artificial Sequence
  Description of Artificial Sequence: Synthetic peptide
  Seed: YAIDLPVSVE (TYRP2_HUMAN)
YLIDLPVSVP

SEQ ID NO: 186211 - protein, 11 aa, Artificial Sequence
  Description of Artificial Sequence: Synthetic peptide
  Seed: HNRMYNMVPFF (TYRP2_HUMAN)
HQRMYNMVPFY

SEQ ID NO: 186212 - protein, 9 aa, Artificial Sequence
  Description of Artificial Sequence: Synthetic peptide
  Seed: WMKRFNPPA (TYRP2_HUMAN)
WLKRFNPPI

SEQ ID NO: 186213 - protein, 10 aa, Artificial Sequence
  Description of Artificial Sequence: Synthetic peptide
  Seed: ETPGWPTTLL (TYRP2_HUMAN)
ESPGWPTTLK

SEQ ID NO: 186214 - protein, 8 aa, Artificial Sequence
  Description of Artificial Sequence: Synthetic peptide
  Seed: SVYDFFVW (TYRP2_HUMAN)
SSYDFFVW

SEQ ID NO: 186215 - protein, 10 aa, Artificial Sequence
  Description of Artificial Sequence: Synthetic peptide
  Seed: IGNESFALPY (TYRP2_HUMAN)
IFNESFALPY

SEQ ID NO: 186216 - protein, 9 aa, Artificial Sequence
  Description of Artificial Sequence: Synthetic peptide
  Seed: STFSFRNAL (TYRP2_HUMAN)
SFFSFRNAY

SEQ ID NO: 186217 - protein, 9 aa, Artificial Sequence
  Description of Artificial Sequence: Synthetic peptide
  Seed: RFNPPADAW (TYRP2_HUMAN)
RSNPPADAY

SEQ ID NO: 186218 - protein, 9 aa, Artificial Sequence
  Description of Artificial Sequence: Synthetic peptide
  Seed: ALVGLFVLL (TYRP2_HUMAN)
ATVGLFVLY

SEQ ID NO: 186219 - protein, 10 aa, Artificial Sequence
  Description of Artificial Sequence: Synthetic peptide
  Seed: FFVWLHYYSV (TYRP2_HUMAN)
FLVWLHYYSA

SEQ ID NO: 186220 - protein, 10 aa, Artificial Sequence
  Description of Artificial Sequence: Synthetic peptide
  Seed: YSYAIDLPVS (TYRP2_HUMAN)
YQYAIDLPVL

SEQ ID NO: 186221 - protein, 9 aa, Artificial Sequence
  Description of Artificial Sequence: Synthetic peptide
  Seed: FVLLAFLQY (TYRP2_HUMAN)
FQLLAFLQL

SEQ ID NO: 186222 - protein, 9 aa, Artificial Sequence
  Description of Artificial Sequence: Synthetic peptide
  Seed: FFQNSTFSF (TYRP2_HUMAN)
FGQNSTFSF

SEQ ID NO: 186223 - protein, 9 aa, Artificial Sequence
  Description of Artificial Sequence: Synthetic peptide
  Seed: ETPGWPTTL (TYRP2_HUMAN)
ETPGWPTTY

SEQ ID NO: 186224 - protein, 10 aa, Artificial Sequence
  Description of Artificial Sequence: Synthetic peptide
  Seed: QPQFANCSVY (TYRP2_HUMAN)
QFQFANCSVM

SEQ ID NO: 186225 - protein, 9 aa, Artificial Sequence
  Description of Artificial Sequence: Synthetic peptide
  Seed: WMKRFNPPA (TYRP2_HUMAN)
WPKRFNPPL

SEQ ID NO: 186226 - protein, 10 aa, Artificial Sequence
  Description of Artificial Sequence: Synthetic peptide
  Seed: TLVALVGLFV (TYRP2_HUMAN)
TTVALVGLFL

SEQ ID NO: 186227 - protein, 9 aa, Artificial Sequence
  Description of Artificial Sequence: Synthetic peptide
  Seed: ANDPIFVVL (TYRP2_HUMAN)
AIDPIFVVF

SEQ ID NO: 186228 - protein, 9 aa, Artificial Sequence
  Description of Artificial Sequence: Synthetic peptide
  Seed: MTVDSLVNK (TYRP2_HUMAN)
MSVDSLVNK

SEQ ID NO: 186229 - protein, 11 aa, Artificial Sequence
  Description of Artificial Sequence: Synthetic peptide
  Seed: RADTRPWSGPY (TYRP2_HUMAN)
RKDTRPWSGPK

SEQ ID NO: 186230 - protein, 9 aa, Artificial Sequence
  Description of Artificial Sequence: Synthetic peptide
  Seed: LHSFTDAIF (TYRP2_HUMAN)
LQSFTDAIL

SEQ ID NO: 186231 - protein, 9 aa, Artificial Sequence
  Description of Artificial Sequence: Synthetic peptide
  Seed: RKFFHRTCK (TYRP2_HUMAN)
RTFFHRTCK

SEQ ID NO: 186232 - protein, 10 aa, Artificial Sequence
  Description of Artificial Sequence: Synthetic peptide
  Seed: CCPRLGAESA (TYRP2_HUMAN)
CMPRLGAESL

SEQ ID NO: 186233 - protein, 11 aa, Artificial Sequence
  Description of Artificial Sequence: Synthetic peptide
  Seed: MYNMVPFFPPV (TYRP2_HUMAN)
MQNMVPFFPPV

SEQ ID NO: 186234 - protein, 11 aa, Artificial Sequence
  Description of Artificial Sequence: Synthetic peptide
  Seed: YNMVPFFPPVT (TYRP2_HUMAN)
YLMVPFFPPVP

SEQ ID NO: 186235 - protein, 10 aa, Artificial Sequence
  Description of Artificial Sequence: Synthetic peptide
  Seed: IGNESFALPY (TYRP2_HUMAN)
IMNESFALPL

SEQ ID NO: 186236 - protein, 9 aa, Artificial Sequence
  Description of Artificial Sequence: Synthetic peptide
  Seed: IFDEWMKRF (TYRP2_HUMAN)
IVDEWMKRV

SEQ ID NO: 186237 - protein, 10 aa, Artificial Sequence
  Description of Artificial Sequence: Synthetic peptide
  Seed: NMVPFFPPVT (TYRP2_HUMAN)
NQVPFFPPVV

SEQ ID NO: 186238 - protein, 9 aa, Artificial Sequence
  Description of Artificial Sequence: Synthetic peptide
  Seed: YDFFVWLHY (TYRP2_HUMAN)
YMFFVWLHH

SEQ ID NO: 186239 - protein, 9 aa, Artificial Sequence
  Description of Artificial Sequence: Synthetic peptide
  Seed: LAPIGHNRM (TYRP2_HUMAN)
LFPIGHNRY

SEQ ID NO: 186240 - protein, 9 aa, Artificial Sequence
  Description of Artificial Sequence: Synthetic peptide
  Seed: VHPDYVITT (TYRP2_HUMAN)
VQPDYVITL

SEQ ID NO: 186241 - protein, 9 aa, Artificial Sequence
  Description of Artificial Sequence: Synthetic peptide
  Seed: FFQNSTFSF (TYRP2_HUMAN)
FFQNSTFSY

SEQ ID NO: 186242 - protein, 10 aa, Artificial Sequence
  Description of Artificial Sequence: Synthetic peptide
  Seed: FLTSDQLGYS (TYRP2_HUMAN)
FNTSDQLGYV

SEQ ID NO: 186243 - protein, 9 aa, Artificial Sequence
  Description of Artificial Sequence: Synthetic peptide
  Seed: HSAANDPIF (TYRP2_HUMAN)
HKAANDPIM

SEQ ID NO: 186244 - protein, 10 aa, Artificial Sequence
  Description of Artificial Sequence: Synthetic peptide
  Seed: RLIGNESFAL (TYRP2_HUMAN)
RVIGNESFAV

SEQ ID NO: 186245 - protein, 9 aa, Artificial Sequence
  Description of Artificial Sequence: Synthetic peptide
  Seed: HSFLNGTNA (TYRP2_HUMAN)
HTFLNGTNI

SEQ ID NO: 186246 - protein, 10 aa, Artificial Sequence
  Description of Artificial Sequence: Synthetic peptide
  Seed: NSTFSFRNAL (TYRP2_HUMAN)
NQTFSFRNAL

SEQ ID NO: 186247 - protein, 9 aa, Artificial Sequence
  Description of Artificial Sequence: Synthetic peptide
  Seed: STFSFRNAL (TYRP2_HUMAN)
SSFSFRNAM

SEQ ID NO: 186248 - protein, 9 aa, Artificial Sequence
  Description of Artificial Sequence: Synthetic peptide
  Seed: AARPDDPTL (TYRP2_HUMAN)
APRPDDPTF

SEQ ID NO: 186249 - protein, 11 aa, Artificial Sequence
  Description of Artificial Sequence: Synthetic peptide
  Seed: RRNQMGRNSMK (TYRP2_HUMAN)
RWNQMGRNSMR

SEQ ID NO: 186250 - protein, 10 aa, Artificial Sequence
  Description of Artificial Sequence: Synthetic peptide
  Seed: FVVLHSFTDA (TYRP2_HUMAN)
FLVLHSFTDL

SEQ ID NO: 186251 - protein, 9 aa, Artificial Sequence
  Description of Artificial Sequence: Synthetic peptide
  Seed: NMVPFFPPV (TYRP2_HUMAN)
NYVPFFPPV

SEQ ID NO: 186252 - protein, 10 aa, Artificial Sequence
  Description of Artificial Sequence: Synthetic peptide
  Seed: LGPNGTQPQF (TYRP2_HUMAN)
LFPNGTQPQY

SEQ ID NO: 186253 - protein, 9 aa, Artificial Sequence
  Description of Artificial Sequence: Synthetic peptide
  Seed: VMSLHNLVH (TYRP2_HUMAN)
VLSLHNLVY

SEQ ID NO: 186254 - protein, 10 aa, Artificial Sequence
  Description of Artificial Sequence: Synthetic peptide
  Seed: FSFRNALEGF (TYRP2_HUMAN)
FHFRNALEGY

SEQ ID NO: 186255 - protein, 11 aa, Artificial Sequence
  Description of Artificial Sequence: Synthetic peptide
  Seed: YNMVPFFPPVT (TYRP2_HUMAN)
YIMVPFFPPVM

SEQ ID NO: 186256 - protein, 9 aa, Artificial Sequence
  Description of Artificial Sequence: Synthetic peptide
  Seed: VHPDYVITT (TYRP2_HUMAN)
VAPDYVITF

SEQ ID NO: 186257 - protein, 10 aa, Artificial Sequence
  Description of Artificial Sequence: Synthetic peptide
  Seed: ELWPRKFFHR (TYRP2_HUMAN)
EQWPRKFFHR

SEQ ID NO: 186258 - protein, 9 aa, Artificial Sequence
  Description of Artificial Sequence: Synthetic peptide
  Seed: YVITTQHWL (TYRP2_HUMAN)
YIITTQHWR

SEQ ID NO: 186259 - protein, 11 aa, Artificial Sequence
  Description of Artificial Sequence: Synthetic peptide
  Seed: ANCSVYDFFVW (TYRP2_HUMAN)
AKCSVYDFFVW

SEQ ID NO: 186260 - protein, 10 aa, Artificial Sequence
  Description of Artificial Sequence: Synthetic peptide
  Seed: LVVMGTLVAL (TYRP2_HUMAN)
LSVMGTLVAI

SEQ ID NO: 186261 - protein, 10 aa, Artificial Sequence
  Description of Artificial Sequence: Synthetic peptide
  Seed: NSTFSFRNAL (TYRP2_HUMAN)
NCTFSFRNAV

SEQ ID NO: 186262 - protein, 10 aa, Artificial Sequence
  Description of Artificial Sequence: Synthetic peptide
  Seed: SYAIDLPVSV (TYRP2_HUMAN)
SLAIDLPVSM

SEQ ID NO: 186263 - protein, 9 aa, Artificial Sequence
  Description of Artificial Sequence: Synthetic peptide
  Seed: FLNGTNALP (TYRP2_HUMAN)
FINGTNALM

SEQ ID NO: 186264 - protein, 9 aa, Artificial Sequence
  Description of Artificial Sequence: Synthetic peptide
  Seed: STFSFRNAL (TYRP2_HUMAN)
STFSFRNAI

SEQ ID NO: 186265 - protein, 9 aa, Artificial Sequence
  Description of Artificial Sequence: Synthetic peptide
  Seed: VHPDYVITT (TYRP2_HUMAN)
VHPDYVITL

SEQ ID NO: 186266 - protein, 9 aa, Artificial Sequence
  Description of Artificial Sequence: Synthetic peptide
  Seed: ILPGAQGQF (TYRP2_HUMAN)
IIPGAQGQI

SEQ ID NO: 186267 - protein, 8 aa, Artificial Sequence
  Description of Artificial Sequence: Synthetic peptide
  Seed: FQNSTFSF (TYRP2_HUMAN)
FQNSTFSY

SEQ ID NO: 186268 - protein, 9 aa, Artificial Sequence
  Description of Artificial Sequence: Synthetic peptide
  Seed: YVITTQHWL (TYRP2_HUMAN)
YMITTQHWF

SEQ ID NO: 186269 - protein, 10 aa, Artificial Sequence
  Description of Artificial Sequence: Synthetic peptide
  Seed: FFQNSTFSFR (TYRP2_HUMAN)
FYQNSTFSFW

SEQ ID NO: 186270 - protein, 9 aa, Artificial Sequence
  Description of Artificial Sequence: Synthetic peptide
  Seed: LPVSVEETP (TYRP2_HUMAN)
LPVSVEETM

SEQ ID NO: 186271 - protein, 9 aa, Artificial Sequence
  Description of Artificial Sequence: Synthetic peptide
  Seed: YAIDLPVSV (TYRP2_HUMAN)
YQIDLPVSH

SEQ ID NO: 186272 - protein, 9 aa, Artificial Sequence
  Description of Artificial Sequence: Synthetic peptide
  Seed: RFNPPADAW (TYRP2_HUMAN)
RYNPPADAW

SEQ ID NO: 186273 - protein, 11 aa, Artificial Sequence
  Description of Artificial Sequence: Synthetic peptide
  Seed: ALPYWNFATGR (TYRP2_HUMAN)
AGPYWNFATGR

SEQ ID NO: 186274 - protein, 9 aa, Artificial Sequence
  Description of Artificial Sequence: Synthetic peptide
  Seed: RLRKGYTPL (TYRP2_HUMAN)
RIRKGYTPM

SEQ ID NO: 186275 - protein, 9 aa, Artificial Sequence
  Description of Artificial Sequence: Synthetic peptide
  Seed: YTPLMETHL (TYRP2_HUMAN)
YVPLMETHV

SEQ ID NO: 186276 - protein, 10 aa, Artificial Sequence
  Description of Artificial Sequence: Synthetic peptide
  Seed: IGNESFALPY (TYRP2_HUMAN)
IQNESFALPI

SEQ ID NO: 186277 - protein, 10 aa, Artificial Sequence
  Description of Artificial Sequence: Synthetic peptide
  Seed: MSLHNLVHSF (TYRP2_HUMAN)
MLLHNLVHSY

SEQ ID NO: 186278 - protein, 11 aa, Artificial Sequence
  Description of Artificial Sequence: Synthetic peptide
  Seed: FVVLHSFTDAI (TYRP2_HUMAN)
FVVLHSFTDAL

SEQ ID NO: 186279 - protein, 10 aa, Artificial Sequence
  Description of Artificial Sequence: Synthetic peptide
  Seed: KILPGAQGQF (TYRP2_HUMAN)
KSLPGAQGQR

SEQ ID NO: 186280 - protein, 10 aa, Artificial Sequence
  Description of Artificial Sequence: Synthetic peptide
  Seed: RELWPRKFFH (TYRP2_HUMAN)
RGLWPRKFFK

SEQ ID NO: 186281 - protein, 9 aa, Artificial Sequence
  Description of Artificial Sequence: Synthetic peptide
  Seed: LVHSFLNGT (TYRP2_HUMAN)
LMHSFLNGM

SEQ ID NO: 186282 - protein, 9 aa, Artificial Sequence
  Description of Artificial Sequence: Synthetic peptide
  Seed: RKFFHRTCK (TYRP2_HUMAN)
RVFFHRTCR

SEQ ID NO: 186283 - protein, 9 aa, Artificial Sequence
  Description of Artificial Sequence: Synthetic peptide
  Seed: ANDPIFVVL (TYRP2_HUMAN)
ACDPIFVVF

SEQ ID NO: 186284 - protein, 9 aa, Artificial Sequence
  Description of Artificial Sequence: Synthetic peptide
  Seed: WPTTLLVVM (TYRP2_HUMAN)
WATTLLVVF

SEQ ID NO: 186285 - protein, 8 aa, Artificial Sequence
  Description of Artificial Sequence: Synthetic peptide
  Seed: AIDLPVSV (TYRP2_HUMAN)
AFDLPVSF

SEQ ID NO: 186286 - protein, 9 aa, Artificial Sequence
  Description of Artificial Sequence: Synthetic peptide
  Seed: RQNIHSLSP (TYRP2_HUMAN)
RVNIHSLSY

SEQ ID NO: 186287 - protein, 9 aa, Artificial Sequence
  Description of Artificial Sequence: Synthetic peptide
  Seed: VSVEETPGW (TYRP2_HUMAN)
VQVEETPGM

SEQ ID NO: 186288 - protein, 9 aa, Artificial Sequence
  Description of Artificial Sequence: Synthetic peptide
  Seed: KRVHPDYVI (TYRP2_HUMAN)
KHVHPDYVL

SEQ ID NO: 186289 - protein, 8 aa, Artificial Sequence
  Description of Artificial Sequence: Synthetic peptide
  Seed: AIDLPVSV (TYRP2_HUMAN)
AGDLPVSF

SEQ ID NO: 186290 - protein, 9 aa, Artificial Sequence
  Description of Artificial Sequence: Synthetic peptide
  Seed: STFSFRNAL (TYRP2_HUMAN)
SMFSFRNAR

SEQ ID NO: 186291 - protein, 9 aa, Artificial Sequence
  Description of Artificial Sequence: Synthetic peptide
  Seed: ALPYWNFAT (TYRP2_HUMAN)
AMPYWNFAV

SEQ ID NO: 186292 - protein, 10 aa, Artificial Sequence
  Description of Artificial Sequence: Synthetic peptide
  Seed: NPPFFQNSTF (TYRP2_HUMAN)
NVPFFQNSTY

SEQ ID NO: 186293 - protein, 10 aa, Artificial Sequence
  Description of Artificial Sequence: Synthetic peptide
  Seed: KILPGAQGQF (TYRP2_HUMAN)
KFLPGAQGQY

SEQ ID NO: 186294 - protein, 10 aa, Artificial Sequence
  Description of Artificial Sequence: Synthetic peptide
  Seed: MSPLWWGFLL (TYRP2_HUMAN)
MIPLWWGFLL

SEQ ID NO: 186295 - protein, 10 aa, Artificial Sequence
  Description of Artificial Sequence: Synthetic peptide
  Seed: FSFRNALEGF (TYRP2_HUMAN)
FIFRNALEGY

SEQ ID NO: 186296 - protein, 9 aa, Artificial Sequence
  Description of Artificial Sequence: Synthetic peptide
  Seed: VLHSFTDAI (TYRP2_HUMAN)
VSHSFTDAY

SEQ ID NO: 186297 - protein, 10 aa, Artificial Sequence
  Description of Artificial Sequence: Synthetic peptide
  Seed: LRNQDDRELW (TYRP2_HUMAN)
LSNQDDRELW

SEQ ID NO: 186298 - protein, 8 aa, Artificial Sequence
  Description of Artificial Sequence: Synthetic peptide
  Seed: FPRVCMTV (TYRP2_HUMAN)
FPRVCMTI

SEQ ID NO: 186299 - protein, 10 aa, Artificial Sequence
  Description of Artificial Sequence: Synthetic peptide
  Seed: NGTYEGLLRR (TYRP2_HUMAN)
NLTYEGLLRK

SEQ ID NO: 186300 - protein, 8 aa, Artificial Sequence
  Description of Artificial Sequence: Synthetic peptide
  Seed: FSHQGPAF (TYRP2_HUMAN)
FYHQGPAL

SEQ ID NO: 186301 - protein, 8 aa, Artificial Sequence
  Description of Artificial Sequence: Synthetic peptide
  Seed: LDDYNHLV (TYRP2_HUMAN)
LNDYNHLL

SEQ ID NO: 186302 - protein, 9 aa, Artificial Sequence
  Description of Artificial Sequence: Synthetic peptide
  Seed: TLDSQVMSL (TYRP2_HUMAN)
TADSQVMSF

SEQ ID NO: 186303 - protein, 9 aa, Artificial Sequence
  Description of Artificial Sequence: Synthetic peptide
  Seed: RMYNMVPFF (TYRP2_HUMAN)
RAYNMVPFS

SEQ ID NO: 186304 - protein, 9 aa, Artificial Sequence
  Description of Artificial Sequence: Synthetic peptide
  Seed: VLLAFLQYR (TYRP2_HUMAN)
VYLAFLQYK

SEQ ID NO: 186305 - protein, 9 aa, Artificial Sequence
  Description of Artificial Sequence: Synthetic peptide
  Seed: VVLHSFTDA (TYRP2_HUMAN)
VLLHSFTDV

SEQ ID NO: 186306 - protein, 10 aa, Artificial Sequence
  Description of Artificial Sequence: Synthetic peptide
  Seed: FANCSVYDFF (TYRP2_HUMAN)
FANCSVYDFY

SEQ ID NO: 186307 - protein, 9 aa, Artificial Sequence
  Description of Artificial Sequence: Synthetic peptide
  Seed: GLFVLLAFL (TYRP2_HUMAN)
GIFVLLAFV

SEQ ID NO: 186308 - protein, 10 aa, Artificial Sequence
  Description of Artificial Sequence: Synthetic peptide
  Seed: SLQKFDNPPF (TYRP2_HUMAN)
SAQKFDNPPY

SEQ ID NO: 186309 - protein, 11 aa, Artificial Sequence
  Description of Artificial Sequence: Synthetic peptide
  Seed: MYNMVPFFPPV (TYRP2_HUMAN)
MVNMVPFFPPI

SEQ ID NO: 186310 - protein, 10 aa, Artificial Sequence
  Description of Artificial Sequence: Synthetic peptide
  Seed: HSFLNGTNAL (TYRP2_HUMAN)
HTFLNGTNAW

SEQ ID NO: 186311 - protein, 9 aa, Artificial Sequence
  Description of Artificial Sequence: Synthetic peptide
  Seed: FANCSVYDF (TYRP2_HUMAN)
FVNCSVYDM

SEQ ID NO: 186312 - protein, 10 aa, Artificial Sequence
  Description of Artificial Sequence: Synthetic peptide
  Seed: NLVHSFLNGT (TYRP2_HUMAN)
NFVHSFLNGV

SEQ ID NO: 186313 - protein, 10 aa, Artificial Sequence
  Description of Artificial Sequence: Synthetic peptide
  Seed: LGPGRPYRAI (TYRP2_HUMAN)
LFPGRPYRAL

SEQ ID NO: 186314 - protein, 10 aa, Artificial Sequence
  Description of Artificial Sequence: Synthetic peptide
  Seed: RNSRFSSWET (TYRP2_HUMAN)
RPSRFSSWEI

SEQ ID NO: 186315 - protein, 9 aa, Artificial Sequence
  Description of Artificial Sequence: Synthetic peptide
  Seed: GQFPRVCMT (TYRP2_HUMAN)
GIFPRVCMA

SEQ ID NO: 186316 - protein, 9 aa, Artificial Sequence
  Description of Artificial Sequence: Synthetic peptide
  Seed: GQFPRVCMT (TYRP2_HUMAN)
GMFPRVCML

SEQ ID NO: 186317 - protein, 9 aa, Artificial Sequence
  Description of Artificial Sequence: Synthetic peptide
  Seed: SQVMSLHNL (TYRP2_HUMAN)
SDVMSLHNF

SEQ ID NO: 186318 - protein, 11 aa, Artificial Sequence
  Description of Artificial Sequence: Synthetic peptide
  Seed: QRLIGNESFAL (TYRP2_HUMAN)
QKLIGNESFAV

SEQ ID NO: 186319 - protein, 9 aa, Artificial Sequence
  Description of Artificial Sequence: Synthetic peptide
  Seed: SLHNLVHSF (TYRP2_HUMAN)
SHHNLVHSL

SEQ ID NO: 186320 - protein, 10 aa, Artificial Sequence
  Description of Artificial Sequence: Synthetic peptide
  Seed: HSFLNGTNAL (TYRP2_HUMAN)
HTFLNGTNAI

SEQ ID NO: 186321 - protein, 9 aa, Artificial Sequence
  Description of Artificial Sequence: Synthetic peptide
  Seed: DTRPWSGPY (TYRP2_HUMAN)
DVRPWSGPR

SEQ ID NO: 186322 - protein, 11 aa, Artificial Sequence
  Description of Artificial Sequence: Synthetic peptide
  Seed: YTPLMETHLSS (TYRP2_HUMAN)
YEPLMETHLSA

SEQ ID NO: 186323 - protein, 9 aa, Artificial Sequence
  Description of Artificial Sequence: Synthetic peptide
  Seed: NRMYNMVPF (TYRP2_HUMAN)
NFMYNMVPV

SEQ ID NO: 186324 - protein, 10 aa, Artificial Sequence
  Description of Artificial Sequence: Synthetic peptide
  Seed: YDFFVWLHYY (TYRP2_HUMAN)
YMFFVWLHYI

SEQ ID NO: 186325 - protein, 9 aa, Artificial Sequence
  Description of Artificial Sequence: Synthetic peptide
  Seed: LCLERDLQR (TYRP2_HUMAN)
LYLERDLQR

SEQ ID NO: 186326 - protein, 9 aa, Artificial Sequence
  Description of Artificial Sequence: Synthetic peptide
  Seed: SQVMSLHNL (TYRP2_HUMAN)
SRVMSLHNL

SEQ ID NO: 186327 - protein, 9 aa, Artificial Sequence
  Description of Artificial Sequence: Synthetic peptide
  Seed: AIFDEWMKR (TYRP2_HUMAN)
ATFDEWMKR

SEQ ID NO: 186328 - protein, 9 aa, Artificial Sequence
  Description of Artificial Sequence: Synthetic peptide
  Seed: SVYDFFVWL (TYRP2_HUMAN)
SQYDFFVWT

SEQ ID NO: 186329 - protein, 11 aa, Artificial Sequence
  Description of Artificial Sequence: Synthetic peptide
  Seed: RNSRFSSWETV (TYRP2_HUMAN)
RDSRFSSWETL

SEQ ID NO: 186330 - protein, 10 aa, Artificial Sequence
  Description of Artificial Sequence: Synthetic peptide
  Seed: YNMVPFFPPV (TYRP2_HUMAN)
YCMVPFFPPV

SEQ ID NO: 186331 - protein, 9 aa, Artificial Sequence
  Description of Artificial Sequence: Synthetic peptide
  Seed: FFQNSTFSF (TYRP2_HUMAN)
FRQNSTFSF

SEQ ID NO: 186332 - protein, 9 aa, Artificial Sequence
  Description of Artificial Sequence: Synthetic peptide
  Seed: YAIDLPVSV (TYRP2_HUMAN)
YAIDLPVSH

SEQ ID NO: 186333 - protein, 11 aa, Artificial Sequence
  Description of Artificial Sequence: Synthetic peptide
  Seed: YNMVPFFPPVT (TYRP2_HUMAN)
YQMVPFFPPVR

SEQ ID NO: 186334 - protein, 9 aa, Artificial Sequence
  Description of Artificial Sequence: Synthetic peptide
  Seed: WPRKFFHRT (TYRP2_HUMAN)
WPRKFFHRM

SEQ ID NO: 186335 - protein, 9 aa, Artificial Sequence
  Description of Artificial Sequence: Synthetic peptide
  Seed: LQKFDNPPF (TYRP2_HUMAN)
LTKFDNPPF

SEQ ID NO: 186336 - protein, 10 aa, Artificial Sequence
  Description of Artificial Sequence: Synthetic peptide
  Seed: SDQLGYSYAI (TYRP2_HUMAN)
SMQLGYSYAL

SEQ ID NO: 186337 - protein, 10 aa, Artificial Sequence
  Description of Artificial Sequence: Synthetic peptide
  Seed: AIFDEWMKRF (TYRP2_HUMAN)
AQFDEWMKRY

SEQ ID NO: 186338 - protein, 11 aa, Artificial Sequence
  Description of Artificial Sequence: Synthetic peptide
  Seed: TQPQFANCSVY (TYRP2_HUMAN)
TMPQFANCSVF

SEQ ID NO: 186339 - protein, 10 aa, Artificial Sequence
  Description of Artificial Sequence: Synthetic peptide
  Seed: EETPGWPTTL (TYRP2_HUMAN)
EHTPGWPTTF

SEQ ID NO: 186340 - protein, 10 aa, Artificial Sequence
  Description of Artificial Sequence: Synthetic peptide
  Seed: FSFRNALEGF (TYRP2_HUMAN)
FHFRNALEGF

SEQ ID NO: 186341 - protein, 10 aa, Artificial Sequence
  Description of Artificial Sequence: Synthetic peptide
  Seed: VLLAFLQYRR (TYRP2_HUMAN)
VDLAFLQYRK

SEQ ID NO: 186342 - protein, 9 aa, Artificial Sequence
  Description of Artificial Sequence: Synthetic peptide
  Seed: ELWPRKFFH (TYRP2_HUMAN)
EFWPRKFFR

SEQ ID NO: 186343 - protein, 10 aa, Artificial Sequence
  Description of Artificial Sequence: Synthetic peptide
  Seed: FVVLHSFTDA (TYRP2_HUMAN)
FMVLHSFTDI

SEQ ID NO: 186344 - protein, 10 aa, Artificial Sequence
  Description of Artificial Sequence: Synthetic peptide
  Seed: SQVMSLHNLV (TYRP2_HUMAN)
SKVMSLHNLV

SEQ ID NO: 186345 - protein, 10 aa, Artificial Sequence
  Description of Artificial Sequence: Synthetic peptide
  Seed: YAIDLPVSVE (TYRP2_HUMAN)
YAIDLPVSVV

SEQ ID NO: 186346 - protein, 10 aa, Artificial Sequence
  Description of Artificial Sequence: Synthetic peptide
  Seed: MGRNSMKLPT (TYRP2_HUMAN)
MTRNSMKLPS

SEQ ID NO: 186347 - protein, 10 aa, Artificial Sequence
  Description of Artificial Sequence: Synthetic peptide
  Seed: GTLDSQVMSL (TYRP2_HUMAN)
GGLDSQVMSV

SEQ ID NO: 186348 - protein, 10 aa, Artificial Sequence
  Description of Artificial Sequence: Synthetic peptide
  Seed: HNRMYNMVPF (TYRP2_HUMAN)
HYRMYNMVPL

SEQ ID NO: 186349 - protein, 10 aa, Artificial Sequence
  Description of Artificial Sequence: Synthetic peptide
  Seed: NSTFSFRNAL (TYRP2_HUMAN)
NITFSFRNAL

SEQ ID NO: 186350 - protein, 10 aa, Artificial Sequence
  Description of Artificial Sequence: Synthetic peptide
  Seed: HSFLNGTNAL (TYRP2_HUMAN)
HIFLNGTNAY

SEQ ID NO: 186351 - protein, 10 aa, Artificial Sequence
  Description of Artificial Sequence: Synthetic peptide
  Seed: IDFSHQGPAF (TYRP2_HUMAN)
IVFSHQGPAY

SEQ ID NO: 186352 - protein, 11 aa, Artificial Sequence
  Description of Artificial Sequence: Synthetic peptide
  Seed: FANCSVYDFFV (TYRP2_HUMAN)
FINCSVYDFFI

SEQ ID NO: 186353 - protein, 9 aa, Artificial Sequence
  Description of Artificial Sequence: Synthetic peptide
  Seed: QVMSLHNLV (TYRP2_HUMAN)
QMMSLHNLI

SEQ ID NO: 186354 - protein, 10 aa, Artificial Sequence
  Description of Artificial Sequence: Synthetic peptide
  Seed: REQFLGALDL (TYRP2_HUMAN)
REQFLGALDW

SEQ ID NO: 186355 - protein, 10 aa, Artificial Sequence
  Description of Artificial Sequence: Synthetic peptide
  Seed: VMGTLVALVG (TYRP2_HUMAN)
VMGTLVALVV

SEQ ID NO: 186356 - protein, 9 aa, Artificial Sequence
  Description of Artificial Sequence: Synthetic peptide
  Seed: WHRYHLLCL (TYRP2_HUMAN)
WMRYHLLCF

SEQ ID NO: 186357 - protein, 10 aa, Artificial Sequence
  Description of Artificial Sequence: Synthetic peptide
  Seed: SDQLGYSYAI (TYRP2_HUMAN)
SCQLGYSYAF

SEQ ID NO: 186358 - protein, 10 aa, Artificial Sequence
  Description of Artificial Sequence: Synthetic peptide
  Seed: YNMVPFFPPV (TYRP2_HUMAN)
YYMVPFFPPT

SEQ ID NO: 186359 - protein, 9 aa, Artificial Sequence
  Description of Artificial Sequence: Synthetic peptide
  Seed: DTRPWSGPY (TYRP2_HUMAN)
DTRPWSGPF

SEQ ID NO: 186360 - protein, 10 aa, Artificial Sequence
  Description of Artificial Sequence: Synthetic peptide
  Seed: GQFPRVCMTV (TYRP2_HUMAN)
GLFPRVCMTL

SEQ ID NO: 186361 - protein, 9 aa, Artificial Sequence
  Description of Artificial Sequence: Synthetic peptide
  Seed: SRNSRFSSW (TYRP2_HUMAN)
SANSRFSSF

SEQ ID NO: 186362 - protein, 9 aa, Artificial Sequence
  Description of Artificial Sequence: Synthetic peptide
  Seed: YSYAIDLPV (TYRP2_HUMAN)
YNYAIDLPF

SEQ ID NO: 186363 - protein, 9 aa, Artificial Sequence
  Description of Artificial Sequence: Synthetic peptide
  Seed: YSYAIDLPV (TYRP2_HUMAN)
YLYAIDLPC

SEQ ID NO: 186364 - protein, 9 aa, Artificial Sequence
  Description of Artificial Sequence: Synthetic peptide
  Seed: YAIDLPVSV (TYRP2_HUMAN)
YPIDLPVSQ

SEQ ID NO: 186365 - protein, 10 aa, Artificial Sequence
  Description of Artificial Sequence: Synthetic peptide
  Seed: SLDDYNHLVT (TYRP2_HUMAN)
SFDDYNHLVL

SEQ ID NO: 186366 - protein, 9 aa, Artificial Sequence
  Description of Artificial Sequence: Synthetic peptide
  Seed: NRMYNMVPF (TYRP2_HUMAN)
NHMYNMVPI

SEQ ID NO: 186367 - protein, 10 aa, Artificial Sequence
  Description of Artificial Sequence: Synthetic peptide
  Seed: GNESFALPYW (TYRP2_HUMAN)
GHESFALPYW

SEQ ID NO: 186368 - protein, 11 aa, Artificial Sequence
  Description of Artificial Sequence: Synthetic peptide
  Seed: RNSRFSSWETV (TYRP2_HUMAN)
RTSRFSSWETI

SEQ ID NO: 186369 - protein, 8 aa, Artificial Sequence
  Description of Artificial Sequence: Synthetic peptide
  Seed: SVYDFFVW (TYRP2_HUMAN)
SMYDFFVW

SEQ ID NO: 186370 - protein, 9 aa, Artificial Sequence
  Description of Artificial Sequence: Synthetic peptide
  Seed: FSHQGPAFV (TYRP2_HUMAN)
FMHQGPAFC

SEQ ID NO: 186371 - protein, 9 aa, Artificial Sequence
  Description of Artificial Sequence: Synthetic peptide
  Seed: FSHQGPAFV (TYRP2_HUMAN)
FSHQGPAFW

SEQ ID NO: 186372 - protein, 10 aa, Artificial Sequence
  Description of Artificial Sequence: Synthetic peptide
  Seed: MSPLWWGFLL (TYRP2_HUMAN)
MMPLWWGFLI

SEQ ID NO: 186373 - protein, 10 aa, Artificial Sequence
  Description of Artificial Sequence: Synthetic peptide
  Seed: VLLAFLQYRR (TYRP2_HUMAN)
VWLAFLQYRR

SEQ ID NO: 186374 - protein, 9 aa, Artificial Sequence
  Description of Artificial Sequence: Synthetic peptide
  Seed: GQFPRVCMT (TYRP2_HUMAN)
GAFPRVCMV

SEQ ID NO: 186375 - protein, 9 aa, Artificial Sequence
  Description of Artificial Sequence: Synthetic peptide
  Seed: KRFNPPADA (TYRP2_HUMAN)
KRFNPPADY

SEQ ID NO: 186376 - protein, 10 aa, Artificial Sequence
  Description of Artificial Sequence: Synthetic peptide
  Seed: YAIDLPVSVE (TYRP2_HUMAN)
YIIDLPVSVA

SEQ ID NO: 186377 - protein, 9 aa, Artificial Sequence
  Description of Artificial Sequence: Synthetic peptide
  Seed: FSHQGPAFV (TYRP2_HUMAN)
FIHQGPAFV

SEQ ID NO: 186378 - protein, 9 aa, Artificial Sequence
  Description of Artificial Sequence: Synthetic peptide
  Seed: RLRKGYTPL (TYRP2_HUMAN)
RFRKGYTPA

SEQ ID NO: 186379 - protein, 9 aa, Artificial Sequence
  Description of Artificial Sequence: Synthetic peptide
  Seed: VMSLHNLVH (TYRP2_HUMAN)
VMSLHNLVM

SEQ ID NO: 186380 - protein, 10 aa, Artificial Sequence
  Description of Artificial Sequence: Synthetic peptide
  Seed: VVMGTLVALV (TYRP2_HUMAN)
VMMGTLVALK

SEQ ID NO: 186381 - protein, 11 aa, Artificial Sequence
  Description of Artificial Sequence: Synthetic peptide
  Seed: YNMVPFFPPVT (TYRP2_HUMAN)
YVMVPFFPPVR

SEQ ID NO: 186382 - protein, 10 aa, Artificial Sequence
  Description of Artificial Sequence: Synthetic peptide
  Seed: REQFLGALDL (TYRP2_HUMAN)
RGQFLGALDF

SEQ ID NO: 186383 - protein, 10 aa, Artificial Sequence
  Description of Artificial Sequence: Synthetic peptide
  Seed: VGLFVLLAFL (TYRP2_HUMAN)
VYLFVLLAFV

SEQ ID NO: 186384 - protein, 9 aa, Artificial Sequence
  Description of Artificial Sequence: Synthetic peptide
  Seed: ANDPIFVVL (TYRP2_HUMAN)
AHDPIFVVF

SEQ ID NO: 186385 - protein, 9 aa, Artificial Sequence
  Description of Artificial Sequence: Synthetic peptide
  Seed: RMYNMVPFF (TYRP2_HUMAN)
RQYNMVPFT

SEQ ID NO: 186386 - protein, 11 aa, Artificial Sequence
  Description of Artificial Sequence: Synthetic peptide
  Seed: LPVSVEETPGW (TYRP2_HUMAN)
LFVSVEETPGW

SEQ ID NO: 186387 - protein, 10 aa, Artificial Sequence
  Description of Artificial Sequence: Synthetic peptide
  Seed: SDQLGYSYAI (TYRP2_HUMAN)
STQLGYSYAF

SEQ ID NO: 186388 - protein, 10 aa, Artificial Sequence
  Description of Artificial Sequence: Synthetic peptide
  Seed: FVWLHYYSVR (TYRP2_HUMAN)
FLWLHYYSVI

SEQ ID NO: 186389 - protein, 9 aa, Artificial Sequence
  Description of Artificial Sequence: Synthetic peptide
  Seed: VPFFPPVTN (TYRP2_HUMAN)
VAFFPPVTY

SEQ ID NO: 186390 - protein, 9 aa, Artificial Sequence
  Description of Artificial Sequence: Synthetic peptide
  Seed: VIRQNIHSL (TYRP2_HUMAN)
VIRQNIHSK

SEQ ID NO: 186391 - protein, 10 aa, Artificial Sequence
  Description of Artificial Sequence: Synthetic peptide
  Seed: NSTFSFRNAL (TYRP2_HUMAN)
NRTFSFRNAL

SEQ ID NO: 186392 - protein, 10 aa, Artificial Sequence
  Description of Artificial Sequence: Synthetic peptide
  Seed: YDFFVWLHYY (TYRP2_HUMAN)
YMFFVWLHYL

SEQ ID NO: 186393 - protein, 9 aa, Artificial Sequence
  Description of Artificial Sequence: Synthetic peptide
  Seed: RNQDDRELW (TYRP2_HUMAN)
RIQDDRELV

SEQ ID NO: 186394 - protein, 9 aa, Artificial Sequence
  Description of Artificial Sequence: Synthetic peptide
  Seed: FQNSTFSFR (TYRP2_HUMAN)
FNNSTFSFK

SEQ ID NO: 186395 - protein, 10 aa, Artificial Sequence
  Description of Artificial Sequence: Synthetic peptide
  Seed: VLHSFTDAIF (TYRP2_HUMAN)
VMHSFTDAIF

SEQ ID NO: 186396 - protein, 9 aa, Artificial Sequence
  Description of Artificial Sequence: Synthetic peptide
  Seed: VHPDYVITT (TYRP2_HUMAN)
VLPDYVITM

SEQ ID NO: 186397 - protein, 9 aa, Artificial Sequence
  Description of Artificial Sequence: Synthetic peptide
  Seed: RLRKGYTPL (TYRP2_HUMAN)
RQRKGYTPY

SEQ ID NO: 186398 - protein, 9 aa, Artificial Sequence
  Description of Artificial Sequence: Synthetic peptide
  Seed: NMVPFFPPV (TYRP2_HUMAN)
NMVPFFPPA

SEQ ID NO: 186399 - protein, 10 aa, Artificial Sequence
  Description of Artificial Sequence: Synthetic peptide
  Seed: TRPWSGPYIL (TYRP2_HUMAN)
TIPWSGPYIF

SEQ ID NO: 186400 - protein, 9 aa, Artificial Sequence
  Description of Artificial Sequence: Synthetic peptide
  Seed: FFQNSTFSF (TYRP2_HUMAN)
FHQNSTFSF

SEQ ID NO: 186401 - protein, 9 aa, Artificial Sequence
  Description of Artificial Sequence: Synthetic peptide
  Seed: SLHNLVHSF (TYRP2_HUMAN)
SRHNLVHSL

SEQ ID NO: 186402 - protein, 10 aa, Artificial Sequence
  Description of Artificial Sequence: Synthetic peptide
  Seed: IDFSHQGPAF (TYRP2_HUMAN)
IPFSHQGPAF

SEQ ID NO: 186403 - protein, 9 aa, Artificial Sequence
  Description of Artificial Sequence: Synthetic peptide
  Seed: SVYDFFVWL (TYRP2_HUMAN)
SRYDFFVWM

SEQ ID NO: 186404 - protein, 9 aa, Artificial Sequence
  Description of Artificial Sequence: Synthetic peptide
  Seed: TLDSQVMSL (TYRP2_HUMAN)
TVDSQVMSY

SEQ ID NO: 186405 - protein, 10 aa, Artificial Sequence
  Description of Artificial Sequence: Synthetic peptide
  Seed: YAIDLPVSVE (TYRP2_HUMAN)
YLIDLPVSVG

SEQ ID NO: 186406 - protein, 9 aa, Artificial Sequence
  Description of Artificial Sequence: Synthetic peptide
  Seed: QVMSLHNLV (TYRP2_HUMAN)
QAMSLHNLK

SEQ ID NO: 186407 - protein, 9 aa, Artificial Sequence
  Description of Artificial Sequence: Synthetic peptide
  Seed: SRFSSWETV (TYRP2_HUMAN)
SVFSSWETF

SEQ ID NO: 186408 - protein, 10 aa, Artificial Sequence
  Description of Artificial Sequence: Synthetic peptide
  Seed: VGLFVLLAFL (TYRP2_HUMAN)
VLLFVLLAFI

SEQ ID NO: 186409 - protein, 9 aa, Artificial Sequence
  Description of Artificial Sequence: Synthetic peptide
  Seed: YSYAIDLPV (TYRP2_HUMAN)
YMYAIDLPM

SEQ ID NO: 186410 - protein, 9 aa, Artificial Sequence
  Description of Artificial Sequence: Synthetic peptide
  Seed: NRMYNMVPF (TYRP2_HUMAN)
NFMYNMVPF

SEQ ID NO: 186411 - protein, 9 aa, Artificial Sequence
  Description of Artificial Sequence: Synthetic peptide
  Seed: NMVPFFPPV (TYRP2_HUMAN)
NYVPFFPPI

SEQ ID NO: 186412 - protein, 9 aa, Artificial Sequence
  Description of Artificial Sequence: Synthetic peptide
  Seed: RVHPDYVIT (TYRP2_HUMAN)
RFHPDYVIK

SEQ ID NO: 186413 - protein, 9 aa, Artificial Sequence
  Description of Artificial Sequence: Synthetic peptide
  Seed: AARPDDPTL (TYRP2_HUMAN)
AIRPDDPTM

SEQ ID NO: 186414 - protein, 11 aa, Artificial Sequence
  Description of Artificial Sequence: Synthetic peptide
  Seed: FSHQGPAFVTW (TYRP2_HUMAN)
FAHQGPAFVTW

SEQ ID NO: 186415 - protein, 9 aa, Artificial Sequence
  Description of Artificial Sequence: Synthetic peptide
  Seed: AANDPIFVV (TYRP2_HUMAN)
AQNDPIFVF

SEQ ID NO: 186416 - protein, 10 aa, Artificial Sequence
  Description of Artificial Sequence: Synthetic peptide
  Seed: HNRMYNMVPF (TYRP2_HUMAN)
HVRMYNMVPL

SEQ ID NO: 186417 - protein, 9 aa, Artificial Sequence
  Description of Artificial Sequence: Synthetic peptide
  Seed: FPPVTNEEL (TYRP2_HUMAN)
FYPVTNEEI

SEQ ID NO: 186418 - protein, 9 aa, Artificial Sequence
  Description of Artificial Sequence: Synthetic peptide
  Seed: DQLGYSYAI (TYRP2_HUMAN)
DELGYSYAF

SEQ ID NO: 186419 - protein, 9 aa, Artificial Sequence
  Description of Artificial Sequence: Synthetic peptide
  Seed: YAIDLPVSV (TYRP2_HUMAN)
YTIDLPVSA

SEQ ID NO: 186420 - protein, 9 aa, Artificial Sequence
  Description of Artificial Sequence: Synthetic peptide
  Seed: HYYSVRDTL (TYRP2_HUMAN)
HVYSVRDTY

SEQ ID NO: 186421 - protein, 9 aa, Artificial Sequence
  Description of Artificial Sequence: Synthetic peptide
  Seed: STFSFRNAL (TYRP2_HUMAN)
SKFSFRNAI

SEQ ID NO: 186422 - protein, 9 aa, Artificial Sequence
  Description of Artificial Sequence: Synthetic peptide
  Seed: SFLNGTNAL (TYRP2_HUMAN)
SYLNGTNAV

SEQ ID NO: 186423 - protein, 9 aa, Artificial Sequence
  Description of Artificial Sequence: Synthetic peptide
  Seed: NALEGFDKA (TYRP2_HUMAN)
NTLEGFDKA

SEQ ID NO: 186424 - protein, 10 aa, Artificial Sequence
  Description of Artificial Sequence: Synthetic peptide
  Seed: RNSRFSSWET (TYRP2_HUMAN)
RHSRFSSWEI

SEQ ID NO: 186425 - protein, 10 aa, Artificial Sequence
  Description of Artificial Sequence: Synthetic peptide
  Seed: VVMGTLVALV (TYRP2_HUMAN)
VMMGTLVALV

SEQ ID NO: 186426 - protein, 9 aa, Artificial Sequence
  Description of Artificial Sequence: Synthetic peptide
  Seed: LQKFDNPPF (TYRP2_HUMAN)
LIKFDNPPY

SEQ ID NO: 186427 - protein, 11 aa, Artificial Sequence
  Description of Artificial Sequence: Synthetic peptide
  Seed: QPQFANCSVYD (TYRP2_HUMAN)
QLQFANCSVYF

SEQ ID NO: 186428 - protein, 9 aa, Artificial Sequence
  Description of Artificial Sequence: Synthetic peptide
  Seed: FQNSTFSFR (TYRP2_HUMAN)
FNNSTFSFR

SEQ ID NO: 186429 - protein, 10 aa, Artificial Sequence
  Description of Artificial Sequence: Synthetic peptide
  Seed: SPLWWGFLLS (TYRP2_HUMAN)
SNLWWGFLLI

SEQ ID NO: 186430 - protein, 9 aa, Artificial Sequence
  Description of Artificial Sequence: Synthetic peptide
  Seed: SVYDFFVWL (TYRP2_HUMAN)
SQYDFFVWK

SEQ ID NO: 186431 - protein, 11 aa, Artificial Sequence
  Description of Artificial Sequence: Synthetic peptide
  Seed: YTPLMETHLSS (TYRP2_HUMAN)
YGPLMETHLST

SEQ ID NO: 186432 - protein, 9 aa, Artificial Sequence
  Description of Artificial Sequence: Synthetic peptide
  Seed: VDSLVNKEC (TYRP2_HUMAN)
VDSLVNKEF

SEQ ID NO: 186433 - protein, 10 aa, Artificial Sequence
  Description of Artificial Sequence: Synthetic peptide
  Seed: HSFLNGTNAL (TYRP2_HUMAN)
HFFLNGTNAY

SEQ ID NO: 186434 - protein, 11 aa, Artificial Sequence
  Description of Artificial Sequence: Synthetic peptide
  Seed: FFQNSTFSFRN (TYRP2_HUMAN)
FSQNSTFSFRR

SEQ ID NO: 186435 - protein, 10 aa, Artificial Sequence
  Description of Artificial Sequence: Synthetic peptide
  Seed: MSPLWWGFLL (TYRP2_HUMAN)
MWPLWWGFLM

SEQ ID NO: 186436 - protein, 9 aa, Artificial Sequence
  Description of Artificial Sequence: Synthetic peptide
  Seed: YDFFVWLHY (TYRP2_HUMAN)
YGFFVWLHY

SEQ ID NO: 186437 - protein, 9 aa, Artificial Sequence
  Description of Artificial Sequence: Synthetic peptide
  Seed: TLVALVGLF (TYRP2_HUMAN)
TFVALVGLF

SEQ ID NO: 186438 - protein, 9 aa, Artificial Sequence
  Description of Artificial Sequence: Synthetic peptide
  Seed: ALPYWNFAT (TYRP2_HUMAN)
AMPYWNFAA

SEQ ID NO: 186439 - protein, 10 aa, Artificial Sequence
  Description of Artificial Sequence: Synthetic peptide
  Seed: FFPPVTNEEL (TYRP2_HUMAN)
FFPPVTNEEF

SEQ ID NO: 186440 - protein, 9 aa, Artificial Sequence
  Description of Artificial Sequence: Synthetic peptide
  Seed: FANCSVYDF (TYRP2_HUMAN)
FMNCSVYDF

SEQ ID NO: 186441 - protein, 10 aa, Artificial Sequence
  Description of Artificial Sequence: Synthetic peptide
  Seed: LGPNGTQPQF (TYRP2_HUMAN)
LEPNGTQPQW

SEQ ID NO: 186442 - protein, 9 aa, Artificial Sequence
  Description of Artificial Sequence: Synthetic peptide
  Seed: RKFFHRTCK (TYRP2_HUMAN)
RGFFHRTCR

SEQ ID NO: 186443 - protein, 9 aa, Artificial Sequence
  Description of Artificial Sequence: Synthetic peptide
  Seed: STFSFRNAL (TYRP2_HUMAN)
SWFSFRNAY

SEQ ID NO: 186444 - protein, 10 aa, Artificial Sequence
  Description of Artificial Sequence: Synthetic peptide
  Seed: HSFLNGTNAL (TYRP2_HUMAN)
HSFLNGTNAV

SEQ ID NO: 186445 - protein, 10 aa, Artificial Sequence
  Description of Artificial Sequence: Synthetic peptide
  Seed: GQFPRVCMTV (TYRP2_HUMAN)
GLFPRVCMTI

SEQ ID NO: 186446 - protein, 9 aa, Artificial Sequence
  Description of Artificial Sequence: Synthetic peptide
  Seed: GFDKADGTL (TYRP2_HUMAN)
GIDKADGTM

SEQ ID NO: 186447 - protein, 11 aa, Artificial Sequence
  Description of Artificial Sequence: Synthetic peptide
  Seed: RNSRFSSWETV (TYRP2_HUMAN)
RTSRFSSWETF

SEQ ID NO: 186448 - protein, 11 aa, Artificial Sequence
  Description of Artificial Sequence: Synthetic peptide
  Seed: YRRLRKGYTPL (TYRP2_HUMAN)
YMRLRKGYTPM

SEQ ID NO: 186449 - protein, 10 aa, Artificial Sequence
  Description of Artificial Sequence: Synthetic peptide
  Seed: SDQLGYSYAI (TYRP2_HUMAN)
SPQLGYSYAM

SEQ ID NO: 186450 - protein, 10 aa, Artificial Sequence
  Description of Artificial Sequence: Synthetic peptide
  Seed: NPPFFQNSTF (TYRP2_HUMAN)
NAPFFQNSTW

SEQ ID NO: 186451 - protein, 9 aa, Artificial Sequence
  Description of Artificial Sequence: Synthetic peptide
  Seed: VTWHRYHLL (TYRP2_HUMAN)
VSWHRYHLL

SEQ ID NO: 186452 - protein, 9 aa, Artificial Sequence
  Description of Artificial Sequence: Synthetic peptide
  Seed: TQHWLGLLG (TYRP2_HUMAN)
TMHWLGLLF

SEQ ID NO: 186453 - protein, 9 aa, Artificial Sequence
  Description of Artificial Sequence: Synthetic peptide
  Seed: YSYAIDLPV (TYRP2_HUMAN)
YGYAIDLPM

SEQ ID NO: 186454 - protein, 9 aa, Artificial Sequence
  Description of Artificial Sequence: Synthetic peptide
  Seed: ALDLAKKRV (TYRP2_HUMAN)
ASDLAKKRM

SEQ ID NO: 186455 - protein, 9 aa, Artificial Sequence
  Description of Artificial Sequence: Synthetic peptide
  Seed: YAIDLPVSV (TYRP2_HUMAN)
YVIDLPVSR

SEQ ID NO: 186456 - protein, 10 aa, Artificial Sequence
  Description of Artificial Sequence: Synthetic peptide
  Seed: GYSYAIDLPV (TYRP2_HUMAN)
GQSYAIDLPV

SEQ ID NO: 186457 - protein, 9 aa, Artificial Sequence
  Description of Artificial Sequence: Synthetic peptide
  Seed: FPPVTNEEL (TYRP2_HUMAN)
FVPVTNEEF

SEQ ID NO: 186458 - protein, 10 aa, Artificial Sequence
  Description of Artificial Sequence: Synthetic peptide
  Seed: DAIFDEWMKR (TYRP2_HUMAN)
DAIFDEWMKK

SEQ ID NO: 186459 - protein, 9 aa, Artificial Sequence
  Description of Artificial Sequence: Synthetic peptide
  Seed: VLHSFTDAI (TYRP2_HUMAN)
VTHSFTDAF

SEQ ID NO: 186460 - protein, 9 aa, Artificial Sequence
  Description of Artificial Sequence: Synthetic peptide
  Seed: TSDQLGYSY (TYRP2_HUMAN)
TGDQLGYSI

SEQ ID NO: 186461 - protein, 9 aa, Artificial Sequence
  Description of Artificial Sequence: Synthetic peptide
  Seed: YYSVRDTLL (TYRP2_HUMAN)
YFSVRDTLL

SEQ ID NO: 186462 - protein, 11 aa, Artificial Sequence
  Description of Artificial Sequence: Synthetic peptide
  Seed: TQPQFANCSVY (TYRP2_HUMAN)
TCPQFANCSVY

SEQ ID NO: 186463 - protein, 9 aa, Artificial Sequence
  Description of Artificial Sequence: Synthetic peptide
  Seed: YSYAIDLPV (TYRP2_HUMAN)
YCYAIDLPF

SEQ ID NO: 186464 - protein, 11 aa, Artificial Sequence
  Description of Artificial Sequence: Synthetic peptide
  Seed: TQPQFANCSVY (TYRP2_HUMAN)
TVPQFANCSVF

SEQ ID NO: 186465 - protein, 9 aa, Artificial Sequence
  Description of Artificial Sequence: Synthetic peptide
  Seed: YSYAIDLPV (TYRP2_HUMAN)
YMYAIDLPW

SEQ ID NO: 186466 - protein, 11 aa, Artificial Sequence
  Description of Artificial Sequence: Synthetic peptide
  Seed: RADTRPWSGPY (TYRP2_HUMAN)
RFDTRPWSGPK

SEQ ID NO: 186467 - protein, 9 aa, Artificial Sequence
  Description of Artificial Sequence: Synthetic peptide
  Seed: ESANVCGSQ (TYRP2_HUMAN)
EIANVCGSK

SEQ ID NO: 186468 - protein, 10 aa, Artificial Sequence
  Description of Artificial Sequence: Synthetic peptide
  Seed: NRMYNMVPFF (TYRP2_HUMAN)
NMMYNMVPFF

SEQ ID NO: 186469 - protein, 9 aa, Artificial Sequence
  Description of Artificial Sequence: Synthetic peptide
  Seed: DIRDCLSLQ (TYRP2_HUMAN)
DIRDCLSLR

SEQ ID NO: 186470 - protein, 9 aa, Artificial Sequence
  Description of Artificial Sequence: Synthetic peptide
  Seed: MTVDSLVNK (TYRP2_HUMAN)
MIVDSLVNY

SEQ ID NO: 186471 - protein, 9 aa, Artificial Sequence
  Description of Artificial Sequence: Synthetic peptide
  Seed: KDIRDCLSL (TYRP2_HUMAN)
KQIRDCLSW

SEQ ID NO: 186472 - protein, 10 aa, Artificial Sequence
  Description of Artificial Sequence: Synthetic peptide
  Seed: YAIDLPVSVE (TYRP2_HUMAN)
YLIDLPVSVN

SEQ ID NO: 186473 - protein, 9 aa, Artificial Sequence
  Description of Artificial Sequence: Synthetic peptide
  Seed: ALVGLFVLL (TYRP2_HUMAN)
ATVGLFVLR

SEQ ID NO: 186474 - protein, 9 aa, Artificial Sequence
  Description of Artificial Sequence: Synthetic peptide
  Seed: TLDSQVMSL (TYRP2_HUMAN)
TEDSQVMSL

SEQ ID NO: 186475 - protein, 9 aa, Artificial Sequence
  Description of Artificial Sequence: Synthetic peptide
  Seed: LVHSFLNGT (TYRP2_HUMAN)
LLHSFLNGI

SEQ ID NO: 186476 - protein, 9 aa, Artificial Sequence
  Description of Artificial Sequence: Synthetic peptide
  Seed: SLDDYNHLV (TYRP2_HUMAN)
SMDDYNHLR

SEQ ID NO: 186477 - protein, 10 aa, Artificial Sequence
  Description of Artificial Sequence: Synthetic peptide
  Seed: MGTLVALVGL (TYRP2_HUMAN)
MQTLVALVGL

SEQ ID NO: 186478 - protein, 10 aa, Artificial Sequence
  Description of Artificial Sequence: Synthetic peptide
  Seed: NSRFSSWETV (TYRP2_HUMAN)
NTRFSSWETV

SEQ ID NO: 186479 - protein, 11 aa, Artificial Sequence
  Description of Artificial Sequence: Synthetic peptide
  Seed: SLDDYNHLVTL (TYRP2_HUMAN)
SIDDYNHLVTV

SEQ ID NO: 186480 - protein, 10 aa, Artificial Sequence
  Description of Artificial Sequence: Synthetic peptide
  Seed: MSLHNLVHSF (TYRP2_HUMAN)
MPLHNLVHSF

SEQ ID NO: 186481 - protein, 9 aa, Artificial Sequence
  Description of Artificial Sequence: Synthetic peptide
  Seed: VHPDYVITT (TYRP2_HUMAN)
VAPDYVITV

SEQ ID NO: 186482 - protein, 9 aa, Artificial Sequence
  Description of Artificial Sequence: Synthetic peptide
  Seed: AIFDEWMKR (TYRP2_HUMAN)
ATFDEWMKK

SEQ ID NO: 186483 - protein, 10 aa, Artificial Sequence
  Description of Artificial Sequence: Synthetic peptide
  Seed: RLRKGYTPLM (TYRP2_HUMAN)
RLRKGYTPLY

SEQ ID NO: 186484 - protein, 8 aa, Artificial Sequence
  Description of Artificial Sequence: Synthetic peptide
  Seed: HSFTDAIF (TYRP2_HUMAN)
HQFTDAIM

SEQ ID NO: 186485 - protein, 9 aa, Artificial Sequence
  Description of Artificial Sequence: Synthetic peptide
  Seed: DDRELWPRK (TYRP2_HUMAN)
DIRELWPRK

SEQ ID NO: 186486 - protein, 10 aa, Artificial Sequence
  Description of Artificial Sequence: Synthetic peptide
  Seed: SYAIDLPVSV (TYRP2_HUMAN)
SYAIDLPVSM

SEQ ID NO: 186487 - protein, 10 aa, Artificial Sequence
  Description of Artificial Sequence: Synthetic peptide
  Seed: RNQMGRNSMK (TYRP2_HUMAN)
RRQMGRNSMK

SEQ ID NO: 186488 - protein, 10 aa, Artificial Sequence
  Description of Artificial Sequence: Synthetic peptide
  Seed: NECDVCTDQL (TYRP2_HUMAN)
NECDVCTDQW

SEQ ID NO: 186489 - protein, 9 aa, Artificial Sequence
  Description of Artificial Sequence: Synthetic peptide
  Seed: FVWLHYYSV (TYRP2_HUMAN)
FMWLHYYSP

SEQ ID NO: 186490 - protein, 9 aa, Artificial Sequence
  Description of Artificial Sequence: Synthetic peptide
  Seed: AQGQFPRVC (TYRP2_HUMAN)
AEGQFPRVL

SEQ ID NO: 186491 - protein, 9 aa, Artificial Sequence
  Description of Artificial Sequence: Synthetic peptide
  Seed: VVMGTLVAL (TYRP2_HUMAN)
VQMGTLVAS

SEQ ID NO: 186492 - protein, 9 aa, Artificial Sequence
  Description of Artificial Sequence: Synthetic peptide
  Seed: FPPVTNEEL (TYRP2_HUMAN)
FWPVTNEEL

SEQ ID NO: 186493 - protein, 10 aa, Artificial Sequence
  Description of Artificial Sequence: Synthetic peptide
  Seed: HRYHLLCLER (TYRP2_HUMAN)
HRYHLLCLEK

SEQ ID NO: 186494 - protein, 10 aa, Artificial Sequence
  Description of Artificial Sequence: Synthetic peptide
  Seed: FPPVTNEELF (TYRP2_HUMAN)
FMPVTNEELY

SEQ ID NO: 186495 - protein, 10 aa, Artificial Sequence
  Description of Artificial Sequence: Synthetic peptide
  Seed: REQFLGALDL (TYRP2_HUMAN)
RRQFLGALDL

SEQ ID NO: 186496 - protein, 10 aa, Artificial Sequence
  Description of Artificial Sequence: Synthetic peptide
  Seed: SVRDTLLGPG (TYRP2_HUMAN)
STRDTLLGPK

SEQ ID NO: 186497 - protein, 9 aa, Artificial Sequence
  Description of Artificial Sequence: Synthetic peptide
  Seed: HQGPAFVTW (TYRP2_HUMAN)
HTGPAFVTF

SEQ ID NO: 186498 - protein, 11 aa, Artificial Sequence
  Description of Artificial Sequence: Synthetic peptide
  Seed: TQPQFANCSVY (TYRP2_HUMAN)
TFPQFANCSVY

SEQ ID NO: 186499 - protein, 9 aa, Artificial Sequence
  Description of Artificial Sequence: Synthetic peptide
  Seed: HSAANDPIF (TYRP2_HUMAN)
HPAANDPIF

SEQ ID NO: 186500 - protein, 10 aa, Artificial Sequence
  Description of Artificial Sequence: Synthetic peptide
  Seed: REQFLGALDL (TYRP2_HUMAN)
RVQFLGALDF

SEQ ID NO: 186501 - protein, 10 aa, Artificial Sequence
  Description of Artificial Sequence: Synthetic peptide
  Seed: RPDDPTLISR (TYRP2_HUMAN)
RMDDPTLISL

SEQ ID NO: 186502 - protein, 9 aa, Artificial Sequence
  Description of Artificial Sequence: Synthetic peptide
  Seed: QVMSLHNLV (TYRP2_HUMAN)
QIMSLHNLV

SEQ ID NO: 186503 - protein, 9 aa, Artificial Sequence
  Description of Artificial Sequence: Synthetic peptide
  Seed: DQLGYSYAI (TYRP2_HUMAN)
DTLGYSYAV

SEQ ID NO: 186504 - protein, 11 aa, Artificial Sequence
  Description of Artificial Sequence: Synthetic peptide
  Seed: VCDSLDDYNHL (TYRP2_HUMAN)
VLDSLDDYNHL

SEQ ID NO: 186505 - protein, 9 aa, Artificial Sequence
  Description of Artificial Sequence: Synthetic peptide
  Seed: FSHQGPAFV (TYRP2_HUMAN)
FVHQGPAFH

SEQ ID NO: 186506 - protein, 9 aa, Artificial Sequence
  Description of Artificial Sequence: Synthetic peptide
  Seed: ANDPIFVVL (TYRP2_HUMAN)
AHDPIFVVL

SEQ ID NO: 186507 - protein, 9 aa, Artificial Sequence
  Description of Artificial Sequence: Synthetic peptide
  Seed: RFNPPADAW (TYRP2_HUMAN)
RLNPPADAL

SEQ ID NO: 186508 - protein, 10 aa, Artificial Sequence
  Description of Artificial Sequence: Synthetic peptide
  Seed: SYAIDLPVSV (TYRP2_HUMAN)
SLAIDLPVSL

SEQ ID NO: 186509 - protein, 9 aa, Artificial Sequence
  Description of Artificial Sequence: Synthetic peptide
  Seed: RLRKGYTPL (TYRP2_HUMAN)
RGRKGYTPR

SEQ ID NO: 186510 - protein, 11 aa, Artificial Sequence
  Description of Artificial Sequence: Synthetic peptide
  Seed: YNMVPFFPPVT (TYRP2_HUMAN)
YIMVPFFPPVD

SEQ ID NO: 186511 - protein, 9 aa, Artificial Sequence
  Description of Artificial Sequence: Synthetic peptide
  Seed: RMYNMVPFF (TYRP2_HUMAN)
RSYNMVPFG

SEQ ID NO: 186512 - protein, 9 aa, Artificial Sequence
  Description of Artificial Sequence: Synthetic peptide
  Seed: VMGTLVALV (TYRP2_HUMAN)
VMGTLVALI

SEQ ID NO: 186513 - protein, 8 aa, Artificial Sequence
  Description of Artificial Sequence: Synthetic peptide
  Seed: LHNLVHSF (TYRP2_HUMAN)
LHNLVHSV

SEQ ID NO: 186514 - protein, 10 aa, Artificial Sequence
  Description of Artificial Sequence: Synthetic peptide
  Seed: RMYNMVPFFP (TYRP2_HUMAN)
RQYNMVPFFP

SEQ ID NO: 186515 - protein, 9 aa, Artificial Sequence
  Description of Artificial Sequence: Synthetic peptide
  Seed: TLLVVMGTL (TYRP2_HUMAN)
TALVVMGTY

SEQ ID NO: 186516 - protein, 9 aa, Artificial Sequence
  Description of Artificial Sequence: Synthetic peptide
  Seed: YAIDLPVSV (TYRP2_HUMAN)
YTIDLPVSW

SEQ ID NO: 186517 - protein, 9 aa, Artificial Sequence
  Description of Artificial Sequence: Synthetic peptide
  Seed: TLDSQVMSL (TYRP2_HUMAN)
TCDSQVMSF

SEQ ID NO: 186518 - protein, 9 aa, Artificial Sequence
  Description of Artificial Sequence: Synthetic peptide
  Seed: LVALVGLFV (TYRP2_HUMAN)
LQALVGLFL

SEQ ID NO: 186519 - protein, 10 aa, Artificial Sequence
  Description of Artificial Sequence: Synthetic peptide
  Seed: SDQLGYSYAI (TYRP2_HUMAN)
SRQLGYSYAF

SEQ ID NO: 186520 - protein, 9 aa, Artificial Sequence
  Description of Artificial Sequence: Synthetic peptide
  Seed: VLHSFTDAI (TYRP2_HUMAN)
VLHSFTDAL

SEQ ID NO: 186521 - protein, 10 aa, Artificial Sequence
  Description of Artificial Sequence: Synthetic peptide
  Seed: GWPTTLLVVM (TYRP2_HUMAN)
GMPTTLLVVF

SEQ ID NO: 186522 - protein, 9 aa, Artificial Sequence
  Description of Artificial Sequence: Synthetic peptide
  Seed: WHRYHLLCL (TYRP2_HUMAN)
WMRYHLLCI

SEQ ID NO: 186523 - protein, 9 aa, Artificial Sequence
  Description of Artificial Sequence: Synthetic peptide
  Seed: WPRKFFHRT (TYRP2_HUMAN)
WPRKFFHRA

SEQ ID NO: 186524 - protein, 9 aa, Artificial Sequence
  Description of Artificial Sequence: Synthetic peptide
  Seed: ISRNSRFSS (TYRP2_HUMAN)
IMRNSRFSG

SEQ ID NO: 186525 - protein, 10 aa, Artificial Sequence
  Description of Artificial Sequence: Synthetic peptide
  Seed: RNSMKLPTLK (TYRP2_HUMAN)
RLSMKLPTLR

SEQ ID NO: 186526 - protein, 10 aa, Artificial Sequence
  Description of Artificial Sequence: Synthetic peptide
  Seed: YDFFVWLHYY (TYRP2_HUMAN)
YMFFVWLHYQ

SEQ ID NO: 186527 - protein, 9 aa, Artificial Sequence
  Description of Artificial Sequence: Synthetic peptide
  Seed: YSYAIDLPV (TYRP2_HUMAN)
YPYAIDLPV

SEQ ID NO: 186528 - protein, 10 aa, Artificial Sequence
  Description of Artificial Sequence: Synthetic peptide
  Seed: FGWTGPNCER (TYRP2_HUMAN)
FAWTGPNCEF

SEQ ID NO: 186529 - protein, 9 aa, Artificial Sequence
  Description of Artificial Sequence: Synthetic peptide
  Seed: SFRNALEGF (TYRP2_HUMAN)
SARNALEGY

SEQ ID NO: 186530 - protein, 9 aa, Artificial Sequence
  Description of Artificial Sequence: Synthetic peptide
  Seed: NMVPFFPPV (TYRP2_HUMAN)
NQVPFFPPT

SEQ ID NO: 186531 - protein, 8 aa, Artificial Sequence
  Description of Artificial Sequence: Synthetic peptide
  Seed: SDQLGYSY (TYRP2_HUMAN)
SEQLGYSM

SEQ ID NO: 186532 - protein, 10 aa, Artificial Sequence
  Description of Artificial Sequence: Synthetic peptide
  Seed: LVVMGTLVAL (TYRP2_HUMAN)
LFVMGTLVAY

SEQ ID NO: 186533 - protein, 9 aa, Artificial Sequence
  Description of Artificial Sequence: Synthetic peptide
  Seed: DSLDDYNHL (TYRP2_HUMAN)
DALDDYNHV

SEQ ID NO: 186534 - protein, 10 aa, Artificial Sequence
  Description of Artificial Sequence: Synthetic peptide
  Seed: FFPPVTNEEL (TYRP2_HUMAN)
FVPPVTNEEV

SEQ ID NO: 186535 - protein, 10 aa, Artificial Sequence
  Description of Artificial Sequence: Synthetic peptide
  Seed: SVYDFFVWLH (TYRP2_HUMAN)
SPYDFFVWLY

SEQ ID NO: 186536 - protein, 9 aa, Artificial Sequence
  Description of Artificial Sequence: Synthetic peptide
  Seed: SAANDPIFV (TYRP2_HUMAN)
SAANDPIFL

SEQ ID NO: 186537 - protein, 9 aa, Artificial Sequence
  Description of Artificial Sequence: Synthetic peptide
  Seed: HSFLNGTNA (TYRP2_HUMAN)
HQFLNGTNA

SEQ ID NO: 186538 - protein, 9 aa, Artificial Sequence
  Description of Artificial Sequence: Synthetic peptide
  Seed: ITTQHWLGL (TYRP2_HUMAN)
ISTQHWLGL

SEQ ID NO: 186539 - protein, 11 aa, Artificial Sequence
  Description of Artificial Sequence: Synthetic peptide
  Seed: RADTRPWSGPY (TYRP2_HUMAN)
RSDTRPWSGPY

SEQ ID NO: 186540 - protein, 9 aa, Artificial Sequence
  Description of Artificial Sequence: Synthetic peptide
  Seed: DQLGYSYAI (TYRP2_HUMAN)
DQLGYSYAY

SEQ ID NO: 186541 - protein, 10 aa, Artificial Sequence
  Description of Artificial Sequence: Synthetic peptide
  Seed: VLLAFLQYRR (TYRP2_HUMAN)
VGLAFLQYRK

SEQ ID NO: 186542 - protein, 11 aa, Artificial Sequence
  Description of Artificial Sequence: Synthetic peptide
  Seed: YTPLMETHLSS (TYRP2_HUMAN)
YIPLMETHLST

SEQ ID NO: 186543 - protein, 9 aa, Artificial Sequence
  Description of Artificial Sequence: Synthetic peptide
  Seed: RKFFHRTCK (TYRP2_HUMAN)
RAFFHRTCI

SEQ ID NO: 186544 - protein, 10 aa, Artificial Sequence
  Description of Artificial Sequence: Synthetic peptide
  Seed: YNMVPFFPPV (TYRP2_HUMAN)
YGMVPFFPPI

SEQ ID NO: 186545 - protein, 9 aa, Artificial Sequence
  Description of Artificial Sequence: Synthetic peptide
  Seed: ILPGAQGQF (TYRP2_HUMAN)
IIPGAQGQL

SEQ ID NO: 186546 - protein, 9 aa, Artificial Sequence
  Description of Artificial Sequence: Synthetic peptide
  Seed: HYYSVRDTL (TYRP2_HUMAN)
HHYSVRDTW

SEQ ID NO: 186547 - protein, 10 aa, Artificial Sequence
  Description of Artificial Sequence: Synthetic peptide
  Seed: RELWPRKFFH (TYRP2_HUMAN)
RLLWPRKFFH

SEQ ID NO: 186548 - protein, 9 aa, Artificial Sequence
  Description of Artificial Sequence: Synthetic peptide
  Seed: ALVGLFVLL (TYRP2_HUMAN)
AQVGLFVLM

SEQ ID NO: 186549 - protein, 10 aa, Artificial Sequence
  Description of Artificial Sequence: Synthetic peptide
  Seed: TRPWSGPYIL (TYRP2_HUMAN)
TQPWSGPYIY

SEQ ID NO: 186550 - protein, 9 aa, Artificial Sequence
  Description of Artificial Sequence: Synthetic peptide
  Seed: ANDPIFVVL (TYRP2_HUMAN)
AQDPIFVVF

SEQ ID NO: 186551 - protein, 8 aa, Artificial Sequence
  Description of Artificial Sequence: Synthetic peptide
  Seed: HRYHLLCL (TYRP2_HUMAN)
HHYHLLCA

SEQ ID NO: 186552 - protein, 11 aa, Artificial Sequence
  Description of Artificial Sequence: Synthetic peptide
  Seed: TVCDSLDDYNH (TYRP2_HUMAN)
TTCDSLDDYNY

SEQ ID NO: 186553 - protein, 9 aa, Artificial Sequence
  Description of Artificial Sequence: Synthetic peptide
  Seed: TQHWLGLLG (TYRP2_HUMAN)
TSHWLGLLY

SEQ ID NO: 186554 - protein, 9 aa, Artificial Sequence
  Description of Artificial Sequence: Synthetic peptide
  Seed: ANDPIFVVL (TYRP2_HUMAN)
AYDPIFVVF

SEQ ID NO: 186555 - protein, 9 aa, Artificial Sequence
  Description of Artificial Sequence: Synthetic peptide
  Seed: IFDEWMKRF (TYRP2_HUMAN)
IADEWMKRL

SEQ ID NO: 186556 - protein, 9 aa, Artificial Sequence
  Description of Artificial Sequence: Synthetic peptide
  Seed: VGLFVLLAF (TYRP2_HUMAN)
VSLFVLLAF

SEQ ID NO: 186557 - protein, 10 aa, Artificial Sequence
  Description of Artificial Sequence: Synthetic peptide
  Seed: FVVLHSFTDA (TYRP2_HUMAN)
FAVLHSFTDV

SEQ ID NO: 186558 - protein, 10 aa, Artificial Sequence
  Description of Artificial Sequence: Synthetic peptide
  Seed: RRLRKGYTPL (TYRP2_HUMAN)
RPLRKGYTPV

SEQ ID NO: 186559 - protein, 9 aa, Artificial Sequence
  Description of Artificial Sequence: Synthetic peptide
  Seed: TLDSQVMSL (TYRP2_HUMAN)
TVDSQVMSL

SEQ ID NO: 186560 - protein, 10 aa, Artificial Sequence
  Description of Artificial Sequence: Synthetic peptide
  Seed: FSFRNALEGF (TYRP2_HUMAN)
FTFRNALEGY

SEQ ID NO: 186561 - protein, 9 aa, Artificial Sequence
  Description of Artificial Sequence: Synthetic peptide
  Seed: VVMGTLVAL (TYRP2_HUMAN)
VYMGTLVAV

SEQ ID NO: 186562 - protein, 9 aa, Artificial Sequence
  Description of Artificial Sequence: Synthetic peptide
  Seed: WMKRFNPPA (TYRP2_HUMAN)
WTKRFNPPF

SEQ ID NO: 186563 - protein, 10 aa, Artificial Sequence
  Description of Artificial Sequence: Synthetic peptide
  Seed: WPRKFFHRTC (TYRP2_HUMAN)
WPRKFFHRTF

SEQ ID NO: 186564 - protein, 9 aa, Artificial Sequence
  Description of Artificial Sequence: Synthetic peptide
  Seed: FFQNSTFSF (TYRP2_HUMAN)
FYQNSTFSH

SEQ ID NO: 186565 - protein, 9 aa, Artificial Sequence
  Description of Artificial Sequence: Synthetic peptide
  Seed: RLRKGYTPL (TYRP2_HUMAN)
RTRKGYTPA

SEQ ID NO: 186566 - protein, 11 aa, Artificial Sequence
  Description of Artificial Sequence: Synthetic peptide
  Seed: SVYDFFVWLHY (TYRP2_HUMAN)
SQYDFFVWLHK

SEQ ID NO: 186567 - protein, 10 aa, Artificial Sequence
  Description of Artificial Sequence: Synthetic peptide
  Seed: YNMVPFFPPV (TYRP2_HUMAN)
YEMVPFFPPA

SEQ ID NO: 186568 - protein, 9 aa, Artificial Sequence
  Description of Artificial Sequence: Synthetic peptide
  Seed: ANDPIFVVL (TYRP2_HUMAN)
AFDPIFVVF

SEQ ID NO: 186569 - protein, 8 aa, Artificial Sequence
  Description of Artificial Sequence: Synthetic peptide
  Seed: KFDNPPFF (TYRP2_HUMAN)
KVDNPPFI

SEQ ID NO: 186570 - protein, 10 aa, Artificial Sequence
  Description of Artificial Sequence: Synthetic peptide
  Seed: CSVYDFFVWL (TYRP2_HUMAN)
CMVYDFFVWV

SEQ ID NO: 186571 - protein, 10 aa, Artificial Sequence
  Description of Artificial Sequence: Synthetic peptide
  Seed: RLRKGYTPLM (TYRP2_HUMAN)
RTRKGYTPLK

SEQ ID NO: 186572 - protein, 11 aa, Artificial Sequence
  Description of Artificial Sequence: Synthetic peptide
  Seed: VCDSLDDYNHL (TYRP2_HUMAN)
VGDSLDDYNHL

SEQ ID NO: 186573 - protein, 9 aa, Artificial Sequence
  Description of Artificial Sequence: Synthetic peptide
  Seed: LRKGYTPLM (TYRP2_HUMAN)
LSKGYTPLF

SEQ ID NO: 186574 - protein, 9 aa, Artificial Sequence
  Description of Artificial Sequence: Synthetic peptide
  Seed: VTNEELFLT (TYRP2_HUMAN)
VMNEELFLM

SEQ ID NO: 186575 - protein, 9 aa, Artificial Sequence
  Description of Artificial Sequence: Synthetic peptide
  Seed: KDIRDCLSL (TYRP2_HUMAN)
KLIRDCLSI

SEQ ID NO: 186576 - protein, 11 aa, Artificial Sequence
  Description of Artificial Sequence: Synthetic peptide
  Seed: SLDDYNHLVTL (TYRP2_HUMAN)
SMDDYNHLVTF

SEQ ID NO: 186577 - protein, 9 aa, Artificial Sequence
  Description of Artificial Sequence: Synthetic peptide
  Seed: VVMGTLVAL (TYRP2_HUMAN)
VWMGTLVAM

SEQ ID NO: 186578 - protein, 9 aa, Artificial Sequence
  Description of Artificial Sequence: Synthetic peptide
  Seed: FPPVTNEEL (TYRP2_HUMAN)
FIPVTNEEF

SEQ ID NO: 186579 - protein, 9 aa, Artificial Sequence
  Description of Artificial Sequence: Synthetic peptide
  Seed: RAIDFSHQG (TYRP2_HUMAN)
RQIDFSHQY

SEQ ID NO: 186580 - protein, 10 aa, Artificial Sequence
  Description of Artificial Sequence: Synthetic peptide
  Seed: QPQFANCSVY (TYRP2_HUMAN)
QAQFANCSVY

SEQ ID NO: 186581 - protein, 9 aa, Artificial Sequence
  Description of Artificial Sequence: Synthetic peptide
  Seed: DFFVWLHYY (TYRP2_HUMAN)
DSFVWLHYY

SEQ ID NO: 186582 - protein, 9 aa, Artificial Sequence
  Description of Artificial Sequence: Synthetic peptide
  Seed: RKFFHRTCK (TYRP2_HUMAN)
RRFFHRTCY

SEQ ID NO: 186583 - protein, 9 aa, Artificial Sequence
  Description of Artificial Sequence: Synthetic peptide
  Seed: FFQNSTFSF (TYRP2_HUMAN)
FQQNSTFSW

SEQ ID NO: 186584 - protein, 11 aa, Artificial Sequence
  Description of Artificial Sequence: Synthetic peptide
  Seed: FFPPVTNEELF (TYRP2_HUMAN)
FWPPVTNEELW

SEQ ID NO: 186585 - protein, 10 aa, Artificial Sequence
  Description of Artificial Sequence: Synthetic peptide
  Seed: LVVMGTLVAL (TYRP2_HUMAN)
LAVMGTLVAI

SEQ ID NO: 186586 - protein, 9 aa, Artificial Sequence
  Description of Artificial Sequence: Synthetic peptide
  Seed: HQGPAFVTW (TYRP2_HUMAN)
HRGPAFVTL

SEQ ID NO: 186587 - protein, 9 aa, Artificial Sequence
  Description of Artificial Sequence: Synthetic peptide
  Seed: RNQMGRNSM (TYRP2_HUMAN)
RKQMGRNSF

SEQ ID NO: 186588 - protein, 9 aa, Artificial Sequence
  Description of Artificial Sequence: Synthetic peptide
  Seed: RLIGNESFA (TYRP2_HUMAN)
RLIGNESFI

SEQ ID NO: 186589 - protein, 9 aa, Artificial Sequence
  Description of Artificial Sequence: Synthetic peptide
  Seed: VIRQNIHSL (TYRP2_HUMAN)
VMRQNIHSK

SEQ ID NO: 186590 - protein, 9 aa, Artificial Sequence
  Description of Artificial Sequence: Synthetic peptide
  Seed: YSYAIDLPV (TYRP2_HUMAN)
YVYAIDLPH

SEQ ID NO: 186591 - protein, 9 aa, Artificial Sequence
  Description of Artificial Sequence: Synthetic peptide
  Seed: SVYDFFVWL (TYRP2_HUMAN)
SVYDFFVWR

SEQ ID NO: 186592 - protein, 10 aa, Artificial Sequence
  Description of Artificial Sequence: Synthetic peptide
  Seed: RNSRFSSWET (TYRP2_HUMAN)
RHSRFSSWEM

SEQ ID NO: 186593 - protein, 9 aa, Artificial Sequence
  Description of Artificial Sequence: Synthetic peptide
  Seed: NMVPFFPPV (TYRP2_HUMAN)
NVVPFFPPT

SEQ ID NO: 186594 - protein, 10 aa, Artificial Sequence
  Description of Artificial Sequence: Synthetic peptide
  Seed: SVYDFFVWLH (TYRP2_HUMAN)
SQYDFFVWLY

SEQ ID NO: 186595 - protein, 10 aa, Artificial Sequence
  Description of Artificial Sequence: Synthetic peptide
  Seed: CMTVDSLVNK (TYRP2_HUMAN)
CETVDSLVNK

SEQ ID NO: 186596 - protein, 9 aa, Artificial Sequence
  Description of Artificial Sequence: Synthetic peptide
  Seed: AIFDEWMKR (TYRP2_HUMAN)
AAFDEWMKF

SEQ ID NO: 186597 - protein, 9 aa, Artificial Sequence
  Description of Artificial Sequence: Synthetic peptide
  Seed: RKFFHRTCK (TYRP2_HUMAN)
RRFFHRTCR

SEQ ID NO: 186598 - protein, 9 aa, Artificial Sequence
  Description of Artificial Sequence: Synthetic peptide
  Seed: VIRQNIHSL (TYRP2_HUMAN)
VYRQNIHSL

SEQ ID NO: 186599 - protein, 10 aa, Artificial Sequence
  Description of Artificial Sequence: Synthetic peptide
  Seed: REQFLGALDL (TYRP2_HUMAN)
RFQFLGALDF

SEQ ID NO: 186600 - protein, 9 aa, Artificial Sequence
  Description of Artificial Sequence: Synthetic peptide
  Seed: VIRQNIHSL (TYRP2_HUMAN)
VPRQNIHSI

SEQ ID NO: 186601 - protein, 11 aa, Artificial Sequence
  Description of Artificial Sequence: Synthetic peptide
  Seed: KADGTLDSQVM (TYRP2_HUMAN)
KTDGTLDSQVW

SEQ ID NO: 186602 - protein, 8 aa, Artificial Sequence
  Description of Artificial Sequence: Synthetic peptide
  Seed: SLDDYNHL (TYRP2_HUMAN)
SIDDYNHF

SEQ ID NO: 186603 - protein, 11 aa, Artificial Sequence
  Description of Artificial Sequence: Synthetic peptide
  Seed: ALPYWNFATGR (TYRP2_HUMAN)
ASPYWNFATGR

SEQ ID NO: 186604 - protein, 10 aa, Artificial Sequence
  Description of Artificial Sequence: Synthetic peptide
  Seed: RLRKGYTPLM (TYRP2_HUMAN)
RQRKGYTPLY

SEQ ID NO: 186605 - protein, 10 aa, Artificial Sequence
  Description of Artificial Sequence: Synthetic peptide
  Seed: SVYDFFVWLH (TYRP2_HUMAN)
SRYDFFVWLR

SEQ ID NO: 186606 - protein, 10 aa, Artificial Sequence
  Description of Artificial Sequence: Synthetic peptide
  Seed: SFTDAIFDEW (TYRP2_HUMAN)
SYTDAIFDEF

SEQ ID NO: 186607 - protein, 9 aa, Artificial Sequence
  Description of Artificial Sequence: Synthetic peptide
  Seed: SLDDYNHLV (TYRP2_HUMAN)
SWDDYNHLY

SEQ ID NO: 186608 - protein, 9 aa, Artificial Sequence
  Description of Artificial Sequence: Synthetic peptide
  Seed: RLRKGYTPL (TYRP2_HUMAN)
RTRKGYTPR

SEQ ID NO: 186609 - protein, 9 aa, Artificial Sequence
  Description of Artificial Sequence: Synthetic peptide
  Seed: SLHNLVHSF (TYRP2_HUMAN)
SIHNLVHSI

SEQ ID NO: 186610 - protein, 9 aa, Artificial Sequence
  Description of Artificial Sequence: Synthetic peptide
  Seed: VIRQNIHSL (TYRP2_HUMAN)
VTRQNIHSM

SEQ ID NO: 186611 - protein, 9 aa, Artificial Sequence
  Description of Artificial Sequence: Synthetic peptide
  Seed: VTWHRYHLL (TYRP2_HUMAN)
VVWHRYHLY

SEQ ID NO: 186612 - protein, 10 aa, Artificial Sequence
  Description of Artificial Sequence: Synthetic peptide
  Seed: MSPLWWGFLL (TYRP2_HUMAN)
MMPLWWGFLY

SEQ ID NO: 186613 - protein, 10 aa, Artificial Sequence
  Description of Artificial Sequence: Synthetic peptide
  Seed: SPLWWGFLLS (TYRP2_HUMAN)
STLWWGFLLA

SEQ ID NO: 186614 - protein, 10 aa, Artificial Sequence
  Description of Artificial Sequence: Synthetic peptide
  Seed: ESANVCGSQQ (TYRP2_HUMAN)
EMANVCGSQR

SEQ ID NO: 186615 - protein, 11 aa, Artificial Sequence
  Description of Artificial Sequence: Synthetic peptide
  Seed: ELAPIGHNRMY (TYRP2_HUMAN)
ESAPIGHNRMR

SEQ ID NO: 186616 - protein, 10 aa, Artificial Sequence
  Description of Artificial Sequence: Synthetic peptide
  Seed: KRFNPPADAW (TYRP2_HUMAN)
KAFNPPADAW

SEQ ID NO: 186617 - protein, 10 aa, Artificial Sequence
  Description of Artificial Sequence: Synthetic peptide
  Seed: FQNSTFSFRN (TYRP2_HUMAN)
FMNSTFSFRY

SEQ ID NO: 186618 - protein, 9 aa, Artificial Sequence
  Description of Artificial Sequence: Synthetic peptide
  Seed: ISRNSRFSS (TYRP2_HUMAN)
IMRNSRFSV

SEQ ID NO: 186619 - protein, 9 aa, Artificial Sequence
  Description of Artificial Sequence: Synthetic peptide
  Seed: EGLLRRNQM (TYRP2_HUMAN)
ERLLRRNQL

SEQ ID NO: 186620 - protein, 10 aa, Artificial Sequence
  Description of Artificial Sequence: Synthetic peptide
  Seed: RPWSGPYILR (TYRP2_HUMAN)
RMWSGPYILK

SEQ ID NO: 186621 - protein, 10 aa, Artificial Sequence
  Description of Artificial Sequence: Synthetic peptide
  Seed: SFTDAIFDEW (TYRP2_HUMAN)
SWTDAIFDEW

SEQ ID NO: 186622 - protein, 9 aa, Artificial Sequence
  Description of Artificial Sequence: Synthetic peptide
  Seed: FVWLHYYSV (TYRP2_HUMAN)
FSWLHYYSY

SEQ ID NO: 186623 - protein, 10 aa, Artificial Sequence
  Description of Artificial Sequence: Synthetic peptide
  Seed: FVLLAFLQYR (TYRP2_HUMAN)
FQLLAFLQYR

SEQ ID NO: 186624 - protein, 11 aa, Artificial Sequence
  Description of Artificial Sequence: Synthetic peptide
  Seed: SVYDFFVWLHY (TYRP2_HUMAN)
SLYDFFVWLHK

SEQ ID NO: 186625 - protein, 9 aa, Artificial Sequence
  Description of Artificial Sequence: Synthetic peptide
  Seed: SLHNLVHSF (TYRP2_HUMAN)
SMHNLVHSV

SEQ ID NO: 186626 - protein, 9 aa, Artificial Sequence
  Description of Artificial Sequence: Synthetic peptide
  Seed: FLLSCLGCK (TYRP2_HUMAN)
FSLSCLGCK

SEQ ID NO: 186627 - protein, 10 aa, Artificial Sequence
  Description of Artificial Sequence: Synthetic peptide
  Seed: RLIGNESFAL (TYRP2_HUMAN)
RMIGNESFAR

SEQ ID NO: 186628 - protein, 9 aa, Artificial Sequence
  Description of Artificial Sequence: Synthetic peptide
  Seed: WMKRFNPPA (TYRP2_HUMAN)
WMKRFNPPV

SEQ ID NO: 186629 - protein, 10 aa, Artificial Sequence
  Description of Artificial Sequence: Synthetic peptide
  Seed: SVYDFFVWLH (TYRP2_HUMAN)
SYYDFFVWLY

SEQ ID NO: 186630 - protein, 10 aa, Artificial Sequence
  Description of Artificial Sequence: Synthetic peptide
  Seed: GTLDSQVMSL (TYRP2_HUMAN)
GVLDSQVMSA

SEQ ID NO: 186631 - protein, 9 aa, Artificial Sequence
  Description of Artificial Sequence: Synthetic peptide
  Seed: RLRKGYTPL (TYRP2_HUMAN)
RLRKGYTPT

SEQ ID NO: 186632 - protein, 9 aa, Artificial Sequence
  Description of Artificial Sequence: Synthetic peptide
  Seed: LVTLCNGTY (TYRP2_HUMAN)
LQTLCNGTM

SEQ ID NO: 186633 - protein, 10 aa, Artificial Sequence
  Description of Artificial Sequence: Synthetic peptide
  Seed: NRMYNMVPFF (TYRP2_HUMAN)
NRMYNMVPFM

SEQ ID NO: 186634 - protein, 9 aa, Artificial Sequence
  Description of Artificial Sequence: Synthetic peptide
  Seed: VLHSFTDAI (TYRP2_HUMAN)
VMHSFTDAY

SEQ ID NO: 186635 - protein, 11 aa, Artificial Sequence
  Description of Artificial Sequence: Synthetic peptide
  Seed: SQVMSLHNLVH (TYRP2_HUMAN)
SMVMSLHNLVY

SEQ ID NO: 186636 - protein, 9 aa, Artificial Sequence
  Description of Artificial Sequence: Synthetic peptide
  Seed: MTVDSLVNK (TYRP2_HUMAN)
MLVDSLVNV

SEQ ID NO: 186637 - protein, 9 aa, Artificial Sequence
  Description of Artificial Sequence: Synthetic peptide
  Seed: AARPDDPTL (TYRP2_HUMAN)
AERPDDPTY

SEQ ID NO: 186638 - protein, 10 aa, Artificial Sequence
  Description of Artificial Sequence: Synthetic peptide
  Seed: DSLDDYNHLV (TYRP2_HUMAN)
DWLDDYNHLV

SEQ ID NO: 186639 - protein, 9 aa, Artificial Sequence
  Description of Artificial Sequence: Synthetic peptide
  Seed: LIGNESFAL (TYRP2_HUMAN)
LLGNESFAM

SEQ ID NO: 186640 - protein, 11 aa, Artificial Sequence
  Description of Artificial Sequence: Synthetic peptide
  Seed: FVVLHSFTDAI (TYRP2_HUMAN)
FIVLHSFTDAV

SEQ ID NO: 186641 - protein, 11 aa, Artificial Sequence
  Description of Artificial Sequence: Synthetic peptide
  Seed: RNSRFSSWETV (TYRP2_HUMAN)
RMSRFSSWETF

SEQ ID NO: 186642 - protein, 10 aa, Artificial Sequence
  Description of Artificial Sequence: Synthetic peptide
  Seed: SPLWWGFLLS (TYRP2_HUMAN)
SHLWWGFLLI

SEQ ID NO: 186643 - protein, 9 aa, Artificial Sequence
  Description of Artificial Sequence: Synthetic peptide
  Seed: WPTTLLVVM (TYRP2_HUMAN)
WRTTLLVVM

SEQ ID NO: 186644 - protein, 9 aa, Artificial Sequence
  Description of Artificial Sequence: Synthetic peptide
  Seed: YAIDLPVSV (TYRP2_HUMAN)
YHIDLPVSI

SEQ ID NO: 186645 - protein, 11 aa, Artificial Sequence
  Description of Artificial Sequence: Synthetic peptide
  Seed: FSHQGPAFVTW (TYRP2_HUMAN)
FTHQGPAFVTF

SEQ ID NO: 186646 - protein, 9 aa, Artificial Sequence
  Description of Artificial Sequence: Synthetic peptide
  Seed: SQVMSLHNL (TYRP2_HUMAN)
SVVMSLHNY

SEQ ID NO: 186647 - protein, 10 aa, Artificial Sequence
  Description of Artificial Sequence: Synthetic peptide
  Seed: NECDVCTDQL (TYRP2_HUMAN)
NHCDVCTDQM

SEQ ID NO: 186648 - protein, 9 aa, Artificial Sequence
  Description of Artificial Sequence: Synthetic peptide
  Seed: FLTSDQLGY (TYRP2_HUMAN)
FPTSDQLGH

SEQ ID NO: 186649 - protein, 10 aa, Artificial Sequence
  Description of Artificial Sequence: Synthetic peptide
  Seed: TRPWSGPYIL (TYRP2_HUMAN)
TLPWSGPYIM

SEQ ID NO: 186650 - protein, 10 aa, Artificial Sequence
  Description of Artificial Sequence: Synthetic peptide
  Seed: QPQFANCSVY (TYRP2_HUMAN)
QLQFANCSVM

SEQ ID NO: 186651 - protein, 9 aa, Artificial Sequence
  Description of Artificial Sequence: Synthetic peptide
  Seed: GWPTTLLVV (TYRP2_HUMAN)
GYPTTLLVI

SEQ ID NO: 186652 - protein, 10 aa, Artificial Sequence
  Description of Artificial Sequence: Synthetic peptide
  Seed: SDQLGYSYAI (TYRP2_HUMAN)
SDQLGYSYAF

SEQ ID NO: 186653 - protein, 10 aa, Artificial Sequence
  Description of Artificial Sequence: Synthetic peptide
  Seed: ESANVCGSQQ (TYRP2_HUMAN)
ETANVCGSQF

SEQ ID NO: 186654 - protein, 11 aa, Artificial Sequence
  Description of Artificial Sequence: Synthetic peptide
  Seed: RADTRPWSGPY (TYRP2_HUMAN)
RNDTRPWSGPF

SEQ ID NO: 186655 - protein, 10 aa, Artificial Sequence
  Description of Artificial Sequence: Synthetic peptide
  Seed: GQFPRVCMTV (TYRP2_HUMAN)
GQFPRVCMTI

SEQ ID NO: 186656 - protein, 10 aa, Artificial Sequence
  Description of Artificial Sequence: Synthetic peptide
  Seed: GTLDSQVMSL (TYRP2_HUMAN)
GVLDSQVMSI

SEQ ID NO: 186657 - protein, 9 aa, Artificial Sequence
  Description of Artificial Sequence: Synthetic peptide
  Seed: HQGPAFVTW (TYRP2_HUMAN)
HPGPAFVTI

SEQ ID NO: 186658 - protein, 10 aa, Artificial Sequence
  Description of Artificial Sequence: Synthetic peptide
  Seed: RRLRKGYTPL (TYRP2_HUMAN)
RTLRKGYTPI

SEQ ID NO: 186659 - protein, 9 aa, Artificial Sequence
  Description of Artificial Sequence: Synthetic peptide
  Seed: SAANDPIFV (TYRP2_HUMAN)
SMANDPIFI

SEQ ID NO: 186660 - protein, 10 aa, Artificial Sequence
  Description of Artificial Sequence: Synthetic peptide
  Seed: FTDAIFDEWM (TYRP2_HUMAN)
FIDAIFDEWY

SEQ ID NO: 186661 - protein, 9 aa, Artificial Sequence
  Description of Artificial Sequence: Synthetic peptide
  Seed: RKFFHRTCK (TYRP2_HUMAN)
RWFFHRTCR

SEQ ID NO: 186662 - protein, 9 aa, Artificial Sequence
  Description of Artificial Sequence: Synthetic peptide
  Seed: LSPQEREQF (TYRP2_HUMAN)
LIPQEREQM

SEQ ID NO: 186663 - protein, 9 aa, Artificial Sequence
  Description of Artificial Sequence: Synthetic peptide
  Seed: ISRNSRFSS (TYRP2_HUMAN)
IVRNSRFSY

SEQ ID NO: 186664 - protein, 10 aa, Artificial Sequence
  Description of Artificial Sequence: Synthetic peptide
  Seed: VVMGTLVALV (TYRP2_HUMAN)
VMMGTLVALH

SEQ ID NO: 186665 - protein, 9 aa, Artificial Sequence
  Description of Artificial Sequence: Synthetic peptide
  Seed: RFNPPADAW (TYRP2_HUMAN)
RQNPPADAI

SEQ ID NO: 186666 - protein, 11 aa, Artificial Sequence
  Description of Artificial Sequence: Synthetic peptide
  Seed: SLDDYNHLVTL (TYRP2_HUMAN)
SVDDYNHLVTL

SEQ ID NO: 186667 - protein, 9 aa, Artificial Sequence
  Description of Artificial Sequence: Synthetic peptide
  Seed: TLLGPGRPY (TYRP2_HUMAN)
TVLGPGRPY

SEQ ID NO: 186668 - protein, 9 aa, Artificial Sequence
  Description of Artificial Sequence: Synthetic peptide
  Seed: RMYNMVPFF (TYRP2_HUMAN)
RCYNMVPFK

SEQ ID NO: 186669 - protein, 10 aa, Artificial Sequence
  Description of Artificial Sequence: Synthetic peptide
  Seed: FPPVTNEELF (TYRP2_HUMAN)
FTPVTNEELY

SEQ ID NO: 186670 - protein, 10 aa, Artificial Sequence
  Description of Artificial Sequence: Synthetic peptide
  Seed: HNRMYNMVPF (TYRP2_HUMAN)
HTRMYNMVPL

SEQ ID NO: 186671 - protein, 9 aa, Artificial Sequence
  Description of Artificial Sequence: Synthetic peptide
  Seed: NALEGFDKA (TYRP2_HUMAN)
NVLEGFDKI

SEQ ID NO: 186672 - protein, 9 aa, Artificial Sequence
  Description of Artificial Sequence: Synthetic peptide
  Seed: FTDAIFDEW (TYRP2_HUMAN)
FQDAIFDEI

SEQ ID NO: 186673 - protein, 9 aa, Artificial Sequence
  Description of Artificial Sequence: Synthetic peptide
  Seed: RPWSGPYIL (TYRP2_HUMAN)
RPWSGPYIA

SEQ ID NO: 186674 - protein, 10 aa, Artificial Sequence
  Description of Artificial Sequence: Synthetic peptide
  Seed: SHQGPAFVTW (TYRP2_HUMAN)
SHQGPAFVTY

SEQ ID NO: 186675 - protein, 10 aa, Artificial Sequence
  Description of Artificial Sequence: Synthetic peptide
  Seed: YDFFVWLHYY (TYRP2_HUMAN)
YYFFVWLHYK

SEQ ID NO: 186676 - protein, 9 aa, Artificial Sequence
  Description of Artificial Sequence: Synthetic peptide
  Seed: FSHQGPAFV (TYRP2_HUMAN)
FLHQGPAFM

SEQ ID NO: 186677 - protein, 10 aa, Artificial Sequence
  Description of Artificial Sequence: Synthetic peptide
  Seed: FSFRNALEGF (TYRP2_HUMAN)
FTFRNALEGF

SEQ ID NO: 186678 - protein, 9 aa, Artificial Sequence
  Description of Artificial Sequence: Synthetic peptide
  Seed: LQKFDNPPF (TYRP2_HUMAN)
LIKFDNPPF

SEQ ID NO: 186679 - protein, 10 aa, Artificial Sequence
  Description of Artificial Sequence: Synthetic peptide
  Seed: RNSMKLPTLK (TYRP2_HUMAN)
RQSMKLPTLK

SEQ ID NO: 186680 - protein, 10 aa, Artificial Sequence
  Description of Artificial Sequence: Synthetic peptide
  Seed: LTSDQLGYSY (TYRP2_HUMAN)
LASDQLGYSW

SEQ ID NO: 186681 - protein, 9 aa, Artificial Sequence
  Description of Artificial Sequence: Synthetic peptide
  Seed: FFQNSTFSF (TYRP2_HUMAN)
FHQNSTFSM

SEQ ID NO: 186682 - protein, 9 aa, Artificial Sequence
  Description of Artificial Sequence: Synthetic peptide
  Seed: YSYAIDLPV (TYRP2_HUMAN)
YNYAIDLPM

SEQ ID NO: 186683 - protein, 10 aa, Artificial Sequence
  Description of Artificial Sequence: Synthetic peptide
  Seed: QPQFANCSVY (TYRP2_HUMAN)
QCQFANCSVF

SEQ ID NO: 186684 - protein, 9 aa, Artificial Sequence
  Description of Artificial Sequence: Synthetic peptide
  Seed: ANDPIFVVL (TYRP2_HUMAN)
ASDPIFVVL

SEQ ID NO: 186685 - protein, 9 aa, Artificial Sequence
  Description of Artificial Sequence: Synthetic peptide
  Seed: WHRYHLLCL (TYRP2_HUMAN)
WLRYHLLCY

SEQ ID NO: 186686 - protein, 9 aa, Artificial Sequence
  Description of Artificial Sequence: Synthetic peptide
  Seed: TLDSQVMSL (TYRP2_HUMAN)
TSDSQVMSI

SEQ ID NO: 186687 - protein, 10 aa, Artificial Sequence
  Description of Artificial Sequence: Synthetic peptide
  Seed: FVVLHSFTDA (TYRP2_HUMAN)
FCVLHSFTDV

SEQ ID NO: 186688 - protein, 9 aa, Artificial Sequence
  Description of Artificial Sequence: Synthetic peptide
  Seed: FVTWHRYHL (TYRP2_HUMAN)
FTTWHRYHA

SEQ ID NO: 186689 - protein, 10 aa, Artificial Sequence
  Description of Artificial Sequence: Synthetic peptide
  Seed: VVMGTLVALV (TYRP2_HUMAN)
VIMGTLVALL

SEQ ID NO: 186690 - protein, 9 aa, Artificial Sequence
  Description of Artificial Sequence: Synthetic peptide
  Seed: DDYNHLVTL (TYRP2_HUMAN)
DAYNHLVTL

SEQ ID NO: 186691 - protein, 9 aa, Artificial Sequence
  Description of Artificial Sequence: Synthetic peptide
  Seed: ALDLAKKRV (TYRP2_HUMAN)
AVDLAKKRM

SEQ ID NO: 186692 - protein, 10 aa, Artificial Sequence
  Description of Artificial Sequence: Synthetic peptide
  Seed: RNSMKLPTLK (TYRP2_HUMAN)
RFSMKLPTLK

SEQ ID NO: 186693 - protein, 11 aa, Artificial Sequence
  Description of Artificial Sequence: Synthetic peptide
  Seed: SQVMSLHNLVH (TYRP2_HUMAN)
SKVMSLHNLVY

SEQ ID NO: 186694 - protein, 10 aa, Artificial Sequence
  Description of Artificial Sequence: Synthetic peptide
  Seed: HYYSVRDTLL (TYRP2_HUMAN)
HYYSVRDTLI

SEQ ID NO: 186695 - protein, 9 aa, Artificial Sequence
  Description of Artificial Sequence: Synthetic peptide
  Seed: VSVEETPGW (TYRP2_HUMAN)
VAVEETPGM

SEQ ID NO: 186696 - protein, 10 aa, Artificial Sequence
  Description of Artificial Sequence: Synthetic peptide
  Seed: SFTDAIFDEW (TYRP2_HUMAN)
SYTDAIFDEI

SEQ ID NO: 186697 - protein, 10 aa, Artificial Sequence
  Description of Artificial Sequence: Synthetic peptide
  Seed: SLDDYNHLVT (TYRP2_HUMAN)
SLDDYNHLVI

SEQ ID NO: 186698 - protein, 9 aa, Artificial Sequence
  Description of Artificial Sequence: Synthetic peptide
  Seed: SPLWWGFLL (TYRP2_HUMAN)
SALWWGFLV

SEQ ID NO: 186699 - protein, 10 aa, Artificial Sequence
  Description of Artificial Sequence: Synthetic peptide
  Seed: VVLHSFTDAI (TYRP2_HUMAN)
VGLHSFTDAL

SEQ ID NO: 186700 - protein, 10 aa, Artificial Sequence
  Description of Artificial Sequence: Synthetic peptide
  Seed: IDFSHQGPAF (TYRP2_HUMAN)
IYFSHQGPAM

SEQ ID NO: 186701 - protein, 9 aa, Artificial Sequence
  Description of Artificial Sequence: Synthetic peptide
  Seed: DFFVWLHYY (TYRP2_HUMAN)
DQFVWLHYY

SEQ ID NO: 186702 - protein, 9 aa, Artificial Sequence
  Description of Artificial Sequence: Synthetic peptide
  Seed: ERKKPPVIR (TYRP2_HUMAN)
EFKKPPVIR

SEQ ID NO: 186703 - protein, 9 aa, Artificial Sequence
  Description of Artificial Sequence: Synthetic peptide
  Seed: RFNPPADAW (TYRP2_HUMAN)
RMNPPADAW

SEQ ID NO: 186704 - protein, 9 aa, Artificial Sequence
  Description of Artificial Sequence: Synthetic peptide
  Seed: VIRQNIHSL (TYRP2_HUMAN)
VYRQNIHSF

SEQ ID NO: 186705 - protein, 9 aa, Artificial Sequence
  Description of Artificial Sequence: Synthetic peptide
  Seed: VVMGTLVAL (TYRP2_HUMAN)
VLMGTLVAL

SEQ ID NO: 186706 - protein, 9 aa, Artificial Sequence
  Description of Artificial Sequence: Synthetic peptide
  Seed: SLDDYNHLV (TYRP2_HUMAN)
SVDDYNHLV

SEQ ID NO: 186707 - protein, 9 aa, Artificial Sequence
  Description of Artificial Sequence: Synthetic peptide
  Seed: FSHQGPAFV (TYRP2_HUMAN)
FFHQGPAFF

SEQ ID NO: 186708 - protein, 9 aa, Artificial Sequence
  Description of Artificial Sequence: Synthetic peptide
  Seed: LAPIGHNRM (TYRP2_HUMAN)
LFPIGHNRL

SEQ ID NO: 186709 - protein, 10 aa, Artificial Sequence
  Description of Artificial Sequence: Synthetic peptide
  Seed: YSYAIDLPVS (TYRP2_HUMAN)
YIYAIDLPVA

SEQ ID NO: 186710 - protein, 9 aa, Artificial Sequence
  Description of Artificial Sequence: Synthetic peptide
  Seed: LSCLGCKIL (TYRP2_HUMAN)
LACLGCKIW

SEQ ID NO: 186711 - protein, 10 aa, Artificial Sequence
  Description of Artificial Sequence: Synthetic peptide
  Seed: GPAFVTWHRY (TYRP2_HUMAN)
GLAFVTWHRY

SEQ ID NO: 186712 - protein, 10 aa, Artificial Sequence
  Description of Artificial Sequence: Synthetic peptide
  Seed: QPQFANCSVY (TYRP2_HUMAN)
QIQFANCSVM

SEQ ID NO: 186713 - protein, 10 aa, Artificial Sequence
  Description of Artificial Sequence: Synthetic peptide
  Seed: QELAPIGHNR (TYRP2_HUMAN)
QTLAPIGHNY

SEQ ID NO: 186714 - protein, 9 aa, Artificial Sequence
  Description of Artificial Sequence: Synthetic peptide
  Seed: RYHLLCLER (TYRP2_HUMAN)
RTHLLCLER

SEQ ID NO: 186715 - protein, 10 aa, Artificial Sequence
  Description of Artificial Sequence: Synthetic peptide
  Seed: ELAPIGHNRM (TYRP2_HUMAN)
EVAPIGHNRF

SEQ ID NO: 186716 - protein, 9 aa, Artificial Sequence
  Description of Artificial Sequence: Synthetic peptide
  Seed: GTLVALVGL (TYRP2_HUMAN)
GSLVALVGY

SEQ ID NO: 186717 - protein, 9 aa, Artificial Sequence
  Description of Artificial Sequence: Synthetic peptide
  Seed: STFSFRNAL (TYRP2_HUMAN)
SSFSFRNAL

SEQ ID NO: 186718 - protein, 9 aa, Artificial Sequence
  Description of Artificial Sequence: Synthetic peptide
  Seed: EGLLRRNQM (TYRP2_HUMAN)
EMLLRRNQM

SEQ ID NO: 186719 - protein, 9 aa, Artificial Sequence
  Description of Artificial Sequence: Synthetic peptide
  Seed: FQNSTFSFR (TYRP2_HUMAN)
FVNSTFSFK

SEQ ID NO: 186720 - protein, 9 aa, Artificial Sequence
  Description of Artificial Sequence: Synthetic peptide
  Seed: IFDEWMKRF (TYRP2_HUMAN)
IWDEWMKRM

SEQ ID NO: 186721 - protein, 9 aa, Artificial Sequence
  Description of Artificial Sequence: Synthetic peptide
  Seed: SFRNALEGF (TYRP2_HUMAN)
SMRNALEGY

SEQ ID NO: 186722 - protein, 10 aa, Artificial Sequence
  Description of Artificial Sequence: Synthetic peptide
  Seed: ADTRPWSGPY (TYRP2_HUMAN)
AQTRPWSGPK

SEQ ID NO: 186723 - protein, 11 aa, Artificial Sequence
  Description of Artificial Sequence: Synthetic peptide
  Seed: YNMVPFFPPVT (TYRP2_HUMAN)
YLMVPFFPPVF

SEQ ID NO: 186724 - protein, 9 aa, Artificial Sequence
  Description of Artificial Sequence: Synthetic peptide
  Seed: ISRNSRFSS (TYRP2_HUMAN)
IIRNSRFSI

SEQ ID NO: 186725 - protein, 9 aa, Artificial Sequence
  Description of Artificial Sequence: Synthetic peptide
  Seed: ETPGWPTTL (TYRP2_HUMAN)
EMPGWPTTF

SEQ ID NO: 186726 - protein, 8 aa, Artificial Sequence
  Description of Artificial Sequence: Synthetic peptide
  Seed: ANDPIFVV (TYRP2_HUMAN)
ATDPIFVL

SEQ ID NO: 186727 - protein, 10 aa, Artificial Sequence
  Description of Artificial Sequence: Synthetic peptide
  Seed: SLQKFDNPPF (TYRP2_HUMAN)
SRQKFDNPPF

SEQ ID NO: 186728 - protein, 9 aa, Artificial Sequence
  Description of Artificial Sequence: Synthetic peptide
  Seed: NRMYNMVPF (TYRP2_HUMAN)
NMMYNMVPF

SEQ ID NO: 186729 - protein, 9 aa, Artificial Sequence
  Description of Artificial Sequence: Synthetic peptide
  Seed: YSYAIDLPV (TYRP2_HUMAN)
YVYAIDLPR

SEQ ID NO: 186730 - protein, 11 aa, Artificial Sequence
  Description of Artificial Sequence: Synthetic peptide
  Seed: MYNMVPFFPPV (TYRP2_HUMAN)
MPNMVPFFPPL

SEQ ID NO: 186731 - protein, 10 aa, Artificial Sequence
  Description of Artificial Sequence: Synthetic peptide
  Seed: RLRKGYTPLM (TYRP2_HUMAN)
RMRKGYTPLL

SEQ ID NO: 186732 - protein, 9 aa, Artificial Sequence
  Description of Artificial Sequence: Synthetic peptide
  Seed: ARPDDPTLI (TYRP2_HUMAN)
AYPDDPTLL

SEQ ID NO: 186733 - protein, 9 aa, Artificial Sequence
  Description of Artificial Sequence: Synthetic peptide
  Seed: HQGPAFVTW (TYRP2_HUMAN)
HFGPAFVTF

SEQ ID NO: 186734 - protein, 10 aa, Artificial Sequence
  Description of Artificial Sequence: Synthetic peptide
  Seed: KADGTLDSQV (TYRP2_HUMAN)
KADGTLDSQF

SEQ ID NO: 186735 - protein, 9 aa, Artificial Sequence
  Description of Artificial Sequence: Synthetic peptide
  Seed: ANDPIFVVL (TYRP2_HUMAN)
ATDPIFVVL

SEQ ID NO: 186736 - protein, 10 aa, Artificial Sequence
  Description of Artificial Sequence: Synthetic peptide
  Seed: LGPGRPYRAI (TYRP2_HUMAN)
LPPGRPYRAL

SEQ ID NO: 186737 - protein, 9 aa, Artificial Sequence
  Description of Artificial Sequence: Synthetic peptide
  Seed: VTWHRYHLL (TYRP2_HUMAN)
VWWHRYHLV

SEQ ID NO: 186738 - protein, 11 aa, Artificial Sequence
  Description of Artificial Sequence: Synthetic peptide
  Seed: YTPLMETHLSS (TYRP2_HUMAN)
YYPLMETHLSL

SEQ ID NO: 186739 - protein, 9 aa, Artificial Sequence
  Description of Artificial Sequence: Synthetic peptide
  Seed: YSYAIDLPV (TYRP2_HUMAN)
YFYAIDLPF

SEQ ID NO: 186740 - protein, 10 aa, Artificial Sequence
  Description of Artificial Sequence: Synthetic peptide
  Seed: TRPWSGPYIL (TYRP2_HUMAN)
TGPWSGPYIF

SEQ ID NO: 186741 - protein, 9 aa, Artificial Sequence
  Description of Artificial Sequence: Synthetic peptide
  Seed: HYYSVRDTL (TYRP2_HUMAN)
HSYSVRDTY

SEQ ID NO: 186742 - protein, 9 aa, Artificial Sequence
  Description of Artificial Sequence: Synthetic peptide
  Seed: RLRKGYTPL (TYRP2_HUMAN)
RPRKGYTPG

SEQ ID NO: 186743 - protein, 10 aa, Artificial Sequence
  Description of Artificial Sequence: Synthetic peptide
  Seed: YNMVPFFPPV (TYRP2_HUMAN)
YVMVPFFPPT

SEQ ID NO: 186744 - protein, 11 aa, Artificial Sequence
  Description of Artificial Sequence: Synthetic peptide
  Seed: RADTRPWSGPY (TYRP2_HUMAN)
REDTRPWSGPK

SEQ ID NO: 186745 - protein, 10 aa, Artificial Sequence
  Description of Artificial Sequence: Synthetic peptide
  Seed: TWHRYHLLCL (TYRP2_HUMAN)
TWHRYHLLCF

SEQ ID NO: 186746 - protein, 10 aa, Artificial Sequence
  Description of Artificial Sequence: Synthetic peptide
  Seed: VVLHSFTDAI (TYRP2_HUMAN)
VCLHSFTDAV

SEQ ID NO: 186747 - protein, 9 aa, Artificial Sequence
  Description of Artificial Sequence: Synthetic peptide
  Seed: ETPGWPTTL (TYRP2_HUMAN)
ETPGWPTTK

SEQ ID NO: 186748 - protein, 9 aa, Artificial Sequence
  Description of Artificial Sequence: Synthetic peptide
  Seed: FTDAIFDEW (TYRP2_HUMAN)
FCDAIFDEI

SEQ ID NO: 186749 - protein, 9 aa, Artificial Sequence
  Description of Artificial Sequence: Synthetic peptide
  Seed: RQNIHSLSP (TYRP2_HUMAN)
RENIHSLSY

SEQ ID NO: 186750 - protein, 9 aa, Artificial Sequence
  Description of Artificial Sequence: Synthetic peptide
  Seed: GTLVALVGL (TYRP2_HUMAN)
GILVALVGV

SEQ ID NO: 186751 - protein, 10 aa, Artificial Sequence
  Description of Artificial Sequence: Synthetic peptide
  Seed: RMYNMVPFFP (TYRP2_HUMAN)
RKYNMVPFFF

SEQ ID NO: 186752 - protein, 9 aa, Artificial Sequence
  Description of Artificial Sequence: Synthetic peptide
  Seed: SLDDYNHLV (TYRP2_HUMAN)
SRDDYNHLY

SEQ ID NO: 186753 - protein, 9 aa, Artificial Sequence
  Description of Artificial Sequence: Synthetic peptide
  Seed: IFDEWMKRF (TYRP2_HUMAN)
ITDEWMKRL

SEQ ID NO: 186754 - protein, 9 aa, Artificial Sequence
  Description of Artificial Sequence: Synthetic peptide
  Seed: RKFFHRTCK (TYRP2_HUMAN)
RIFFHRTCV

SEQ ID NO: 186755 - protein, 10 aa, Artificial Sequence
  Description of Artificial Sequence: Synthetic peptide
  Seed: ESANVCGSQQ (TYRP2_HUMAN)
ELANVCGSQR

SEQ ID NO: 186756 - protein, 10 aa, Artificial Sequence
  Description of Artificial Sequence: Synthetic peptide
  Seed: FANCSVYDFF (TYRP2_HUMAN)
FMNCSVYDFW

SEQ ID NO: 186757 - protein, 10 aa, Artificial Sequence
  Description of Artificial Sequence: Synthetic peptide
  Seed: RLRKGYTPLM (TYRP2_HUMAN)
RVRKGYTPLA

SEQ ID NO: 186758 - protein, 11 aa, Artificial Sequence
  Description of Artificial Sequence: Synthetic peptide
  Seed: RNSRFSSWETV (TYRP2_HUMAN)
RFSRFSSWETF

SEQ ID NO: 186759 - protein, 9 aa, Artificial Sequence
  Description of Artificial Sequence: Synthetic peptide
  Seed: GTYEGLLRR (TYRP2_HUMAN)
GIYEGLLRH

SEQ ID NO: 186760 - protein, 9 aa, Artificial Sequence
  Description of Artificial Sequence: Synthetic peptide
  Seed: RVHPDYVIT (TYRP2_HUMAN)
RYHPDYVIK

SEQ ID NO: 186761 - protein, 9 aa, Artificial Sequence
  Description of Artificial Sequence: Synthetic peptide
  Seed: TSDQLGYSY (TYRP2_HUMAN)
TMDQLGYSI

SEQ ID NO: 186762 - protein, 9 aa, Artificial Sequence
  Description of Artificial Sequence: Synthetic peptide
  Seed: NALEGFDKA (TYRP2_HUMAN)
NTLEGFDKI

SEQ ID NO: 186763 - protein, 10 aa, Artificial Sequence
  Description of Artificial Sequence: Synthetic peptide
  Seed: VGLFVLLAFL (TYRP2_HUMAN)
VDLFVLLAFV

SEQ ID NO: 186764 - protein, 10 aa, Artificial Sequence
  Description of Artificial Sequence: Synthetic peptide
  Seed: YDFFVWLHYY (TYRP2_HUMAN)
YSFFVWLHYM

SEQ ID NO: 186765 - protein, 9 aa, Artificial Sequence
  Description of Artificial Sequence: Synthetic peptide
  Seed: QFPRVCMTV (TYRP2_HUMAN)
QMPRVCMTF

SEQ ID NO: 186766 - protein, 9 aa, Artificial Sequence
  Description of Artificial Sequence: Synthetic peptide
  Seed: SDQLGYSYA (TYRP2_HUMAN)
SEQLGYSYV

SEQ ID NO: 186767 - protein, 10 aa, Artificial Sequence
  Description of Artificial Sequence: Synthetic peptide
  Seed: NSTFSFRNAL (TYRP2_HUMAN)
NRTFSFRNAV

SEQ ID NO: 186768 - protein, 11 aa, Artificial Sequence
  Description of Artificial Sequence: Synthetic peptide
  Seed: YTPLMETHLSS (TYRP2_HUMAN)
YLPLMETHLSI

SEQ ID NO: 186769 - protein, 11 aa, Artificial Sequence
  Description of Artificial Sequence: Synthetic peptide
  Seed: HPDYVITTQHW (TYRP2_HUMAN)
HSDYVITTQHW

SEQ ID NO: 186770 - protein, 9 aa, Artificial Sequence
  Description of Artificial Sequence: Synthetic peptide
  Seed: VTWHRYHLL (TYRP2_HUMAN)
VSWHRYHLW

SEQ ID NO: 186771 - protein, 9 aa, Artificial Sequence
  Description of Artificial Sequence: Synthetic peptide
  Seed: FLLSCLGCK (TYRP2_HUMAN)
FVLSCLGCK

SEQ ID NO: 186772 - protein, 10 aa, Artificial Sequence
  Description of Artificial Sequence: Synthetic peptide
  Seed: FLNGTNALPH (TYRP2_HUMAN)
FANGTNALPY

SEQ ID NO: 186773 - protein, 9 aa, Artificial Sequence
  Description of Artificial Sequence: Synthetic peptide
  Seed: YAIDLPVSV (TYRP2_HUMAN)
YRIDLPVSI

SEQ ID NO: 186774 - protein, 9 aa, Artificial Sequence
  Description of Artificial Sequence: Synthetic peptide
  Seed: TLDSQVMSL (TYRP2_HUMAN)
TADSQVMSV

SEQ ID NO: 186775 - protein, 9 aa, Artificial Sequence
  Description of Artificial Sequence: Synthetic peptide
  Seed: SRFSSWETV (TYRP2_HUMAN)
SHFSSWETM

SEQ ID NO: 186776 - protein, 10 aa, Artificial Sequence
  Description of Artificial Sequence: Synthetic peptide
  Seed: RLRKGYTPLM (TYRP2_HUMAN)
RLRKGYTPLV

SEQ ID NO: 186777 - protein, 10 aa, Artificial Sequence
  Description of Artificial Sequence: Synthetic peptide
  Seed: FSFRNALEGF (TYRP2_HUMAN)
FWFRNALEGW

SEQ ID NO: 186778 - protein, 10 aa, Artificial Sequence
  Description of Artificial Sequence: Synthetic peptide
  Seed: FPPVTNEELF (TYRP2_HUMAN)
FFPVTNEELF

SEQ ID NO: 186779 - protein, 10 aa, Artificial Sequence
  Description of Artificial Sequence: Synthetic peptide
  Seed: HRYHLLCLER (TYRP2_HUMAN)
HSYHLLCLER

SEQ ID NO: 186780 - protein, 9 aa, Artificial Sequence
  Description of Artificial Sequence: Synthetic peptide
  Seed: SPQEREQFL (TYRP2_HUMAN)
SRQEREQFL

SEQ ID NO: 186781 - protein, 9 aa, Artificial Sequence
  Description of Artificial Sequence: Synthetic peptide
  Seed: DDYNHLVTL (TYRP2_HUMAN)
DPYNHLVTM

SEQ ID NO: 186782 - protein, 10 aa, Artificial Sequence
  Description of Artificial Sequence: Synthetic peptide
  Seed: ELAPIGHNRM (TYRP2_HUMAN)
EVAPIGHNRD

SEQ ID NO: 186783 - protein, 11 aa, Artificial Sequence
  Description of Artificial Sequence: Synthetic peptide
  Seed: YSYAIDLPVSV (TYRP2_HUMAN)
YIYAIDLPVSI

SEQ ID NO: 186784 - protein, 11 aa, Artificial Sequence
  Description of Artificial Sequence: Synthetic peptide
  Seed: YNMVPFFPPVT (TYRP2_HUMAN)
YMMVPFFPPVR

SEQ ID NO: 186785 - protein, 9 aa, Artificial Sequence
  Description of Artificial Sequence: Synthetic peptide
  Seed: IFDEWMKRF (TYRP2_HUMAN)
ILDEWMKRL

SEQ ID NO: 186786 - protein, 10 aa, Artificial Sequence
  Description of Artificial Sequence: Synthetic peptide
  Seed: RLRKGYTPLM (TYRP2_HUMAN)
RPRKGYTPLC

SEQ ID NO: 186787 - protein, 10 aa, Artificial Sequence
  Description of Artificial Sequence: Synthetic peptide
  Seed: NPPFFQNSTF (TYRP2_HUMAN)
NWPFFQNSTY

SEQ ID NO: 186788 - protein, 10 aa, Artificial Sequence
  Description of Artificial Sequence: Synthetic peptide
  Seed: HSFLNGTNAL (TYRP2_HUMAN)
HYFLNGTNAY

SEQ ID NO: 186789 - protein, 9 aa, Artificial Sequence
  Description of Artificial Sequence: Synthetic peptide
  Seed: FQNSTFSFR (TYRP2_HUMAN)
FVNSTFSFY

SEQ ID NO: 186790 - protein, 9 aa, Artificial Sequence
  Description of Artificial Sequence: Synthetic peptide
  Seed: YSYAIDLPV (TYRP2_HUMAN)
YRYAIDLPI

SEQ ID NO: 186791 - protein, 10 aa, Artificial Sequence
  Description of Artificial Sequence: Synthetic peptide
  Seed: LHYYSVRDTL (TYRP2_HUMAN)
LAYYSVRDTI

SEQ ID NO: 186792 - protein, 8 aa, Artificial Sequence
  Description of Artificial Sequence: Synthetic peptide
  Seed: FLNGTNAL (TYRP2_HUMAN)
FSNGTNAL

SEQ ID NO: 186793 - protein, 10 aa, Artificial Sequence
  Description of Artificial Sequence: Synthetic peptide
  Seed: RNQMGRNSMK (TYRP2_HUMAN)
RIQMGRNSMR

SEQ ID NO: 186794 - protein, 9 aa, Artificial Sequence
  Description of Artificial Sequence: Synthetic peptide
  Seed: FFQNSTFSF (TYRP2_HUMAN)
FHQNSTFSY

SEQ ID NO: 186795 - protein, 9 aa, Artificial Sequence
  Description of Artificial Sequence: Synthetic peptide
  Seed: TLDSQVMSL (TYRP2_HUMAN)
TYDSQVMSV

SEQ ID NO: 186796 - protein, 9 aa, Artificial Sequence
  Description of Artificial Sequence: Synthetic peptide
  Seed: VTNEELFLT (TYRP2_HUMAN)
VTNEELFLV

SEQ ID NO: 186797 - protein, 10 aa, Artificial Sequence
  Description of Artificial Sequence: Synthetic peptide
  Seed: RRLRKGYTPL (TYRP2_HUMAN)
RALRKGYTPY

SEQ ID NO: 186798 - protein, 10 aa, Artificial Sequence
  Description of Artificial Sequence: Synthetic peptide
  Seed: RLRKGYTPLM (TYRP2_HUMAN)
RTRKGYTPLL

SEQ ID NO: 186799 - protein, 9 aa, Artificial Sequence
  Description of Artificial Sequence: Synthetic peptide
  Seed: HQGPAFVTW (TYRP2_HUMAN)
HDGPAFVTM

SEQ ID NO: 186800 - protein, 10 aa, Artificial Sequence
  Description of Artificial Sequence: Synthetic peptide
  Seed: SDQLGYSYAI (TYRP2_HUMAN)
SLQLGYSYAA

SEQ ID NO: 186801 - protein, 9 aa, Artificial Sequence
  Description of Artificial Sequence: Synthetic peptide
  Seed: NEELFLTSD (TYRP2_HUMAN)
NEELFLTSA

SEQ ID NO: 186802 - protein, 9 aa, Artificial Sequence
  Description of Artificial Sequence: Synthetic peptide
  Seed: RELWPRKFF (TYRP2_HUMAN)
RMLWPRKFF

SEQ ID NO: 186803 - protein, 9 aa, Artificial Sequence
  Description of Artificial Sequence: Synthetic peptide
  Seed: TTQHWLGLL (TYRP2_HUMAN)
TTQHWLGLV

SEQ ID NO: 186804 - protein, 9 aa, Artificial Sequence
  Description of Artificial Sequence: Synthetic peptide
  Seed: AANDPIFVV (TYRP2_HUMAN)
ASNDPIFVF

SEQ ID NO: 186805 - protein, 10 aa, Artificial Sequence
  Description of Artificial Sequence: Synthetic peptide
  Seed: MSPLWWGFLL (TYRP2_HUMAN)
MFPLWWGFLM

SEQ ID NO: 186806 - protein, 10 aa, Artificial Sequence
  Description of Artificial Sequence: Synthetic peptide
  Seed: SDQLGYSYAI (TYRP2_HUMAN)
STQLGYSYAM

SEQ ID NO: 186807 - protein, 9 aa, Artificial Sequence
  Description of Artificial Sequence: Synthetic peptide
  Seed: FFQNSTFSF (TYRP2_HUMAN)
FQQNSTFSH

SEQ ID NO: 186808 - protein, 9 aa, Artificial Sequence
  Description of Artificial Sequence: Synthetic peptide
  Seed: RLRKGYTPL (TYRP2_HUMAN)
RPRKGYTPS

SEQ ID NO: 186809 - protein, 9 aa, Artificial Sequence
  Description of Artificial Sequence: Synthetic peptide
  Seed: TLLGPGRPY (TYRP2_HUMAN)
TPLGPGRPM

SEQ ID NO: 186810 - protein, 10 aa, Artificial Sequence
  Description of Artificial Sequence: Synthetic peptide
  Seed: YNMVPFFPPV (TYRP2_HUMAN)
YFMVPFFPPT

SEQ ID NO: 186811 - protein, 9 aa, Artificial Sequence
  Description of Artificial Sequence: Synthetic peptide
  Seed: LQKFDNPPF (TYRP2_HUMAN)
LKKFDNPPM

SEQ ID NO: 186812 - protein, 9 aa, Artificial Sequence
  Description of Artificial Sequence: Synthetic peptide
  Seed: GTYEGLLRR (TYRP2_HUMAN)
GQYEGLLRR

SEQ ID NO: 186813 - protein, 9 aa, Artificial Sequence
  Description of Artificial Sequence: Synthetic peptide
  Seed: HRYHLLCLE (TYRP2_HUMAN)
HRYHLLCLV

SEQ ID NO: 186814 - protein, 10 aa, Artificial Sequence
  Description of Artificial Sequence: Synthetic peptide
  Seed: QLGYSYAIDL (TYRP2_HUMAN)
QMGYSYAIDV

SEQ ID NO: 186815 - protein, 11 aa, Artificial Sequence
  Description of Artificial Sequence: Synthetic peptide
  Seed: MYNMVPFFPPV (TYRP2_HUMAN)
MDNMVPFFPPI

SEQ ID NO: 186816 - protein, 9 aa, Artificial Sequence
  Description of Artificial Sequence: Synthetic peptide
  Seed: SLDDYNHLV (TYRP2_HUMAN)
SFDDYNHLL

SEQ ID NO: 186817 - protein, 10 aa, Artificial Sequence
  Description of Artificial Sequence: Synthetic peptide
  Seed: GQFPRVCMTV (TYRP2_HUMAN)
GRFPRVCMTF

SEQ ID NO: 186818 - protein, 11 aa, Artificial Sequence
  Description of Artificial Sequence: Synthetic peptide
  Seed: TQPQFANCSVY (TYRP2_HUMAN)
TMPQFANCSVY

SEQ ID NO: 186819 - protein, 9 aa, Artificial Sequence
  Description of Artificial Sequence: Synthetic peptide
  Seed: YSYAIDLPV (TYRP2_HUMAN)
YTYAIDLPR

SEQ ID NO: 186820 - protein, 10 aa, Artificial Sequence
  Description of Artificial Sequence: Synthetic peptide
  Seed: LHYYSVRDTL (TYRP2_HUMAN)
LFYYSVRDTW

SEQ ID NO: 186821 - protein, 9 aa, Artificial Sequence
  Description of Artificial Sequence: Synthetic peptide
  Seed: LLAFLQYRR (TYRP2_HUMAN)
LIAFLQYRR

SEQ ID NO: 186822 - protein, 9 aa, Artificial Sequence
  Description of Artificial Sequence: Synthetic peptide
  Seed: VTWHRYHLL (TYRP2_HUMAN)
VQWHRYHLF

SEQ ID NO: 186823 - protein, 9 aa, Artificial Sequence
  Description of Artificial Sequence: Synthetic peptide
  Seed: DSLDDYNHL (TYRP2_HUMAN)
DTLDDYNHK

SEQ ID NO: 186824 - protein, 9 aa, Artificial Sequence
  Description of Artificial Sequence: Synthetic peptide
  Seed: SAANDPIFV (TYRP2_HUMAN)
SLANDPIFA

SEQ ID NO: 186825 - protein, 9 aa, Artificial Sequence
  Description of Artificial Sequence: Synthetic peptide
  Seed: SVYDFFVWL (TYRP2_HUMAN)
STYDFFVWL

SEQ ID NO: 186826 - protein, 10 aa, Artificial Sequence
  Description of Artificial Sequence: Synthetic peptide
  Seed: GTLDSQVMSL (TYRP2_HUMAN)
GVLDSQVMSL

SEQ ID NO: 186827 - protein, 8 aa, Artificial Sequence
  Description of Artificial Sequence: Synthetic peptide
  Seed: TFSFRNAL (TYRP2_HUMAN)
TYSFRNAL

SEQ ID NO: 186828 - protein, 10 aa, Artificial Sequence
  Description of Artificial Sequence: Synthetic peptide
  Seed: SLQKFDNPPF (TYRP2_HUMAN)
SQQKFDNPPY

SEQ ID NO: 186829 - protein, 9 aa, Artificial Sequence
  Description of Artificial Sequence: Synthetic peptide
  Seed: GTYEGLLRR (TYRP2_HUMAN)
GAYEGLLRM

SEQ ID NO: 186830 - protein, 9 aa, Artificial Sequence
  Description of Artificial Sequence: Synthetic peptide
  Seed: SVYDFFVWL (TYRP2_HUMAN)
STYDFFVWK

SEQ ID NO: 186831 - protein, 11 aa, Artificial Sequence
  Description of Artificial Sequence: Synthetic peptide
  Seed: YNMVPFFPPVT (TYRP2_HUMAN)
YQMVPFFPPVT

SEQ ID NO: 186832 - protein, 10 aa, Artificial Sequence
  Description of Artificial Sequence: Synthetic peptide
  Seed: TLLGPGRPYR (TYRP2_HUMAN)
TWLGPGRPYR

SEQ ID NO: 186833 - protein, 10 aa, Artificial Sequence
  Description of Artificial Sequence: Synthetic peptide
  Seed: MSLHNLVHSF (TYRP2_HUMAN)
MDLHNLVHSF

SEQ ID NO: 186834 - protein, 11 aa, Artificial Sequence
  Description of Artificial Sequence: Synthetic peptide
  Seed: MYNMVPFFPPV (TYRP2_HUMAN)
MKNMVPFFPPV

SEQ ID NO: 186835 - protein, 9 aa, Artificial Sequence
  Description of Artificial Sequence: Synthetic peptide
  Seed: NRMYNMVPF (TYRP2_HUMAN)
NYMYNMVPY

SEQ ID NO: 186836 - protein, 9 aa, Artificial Sequence
  Description of Artificial Sequence: Synthetic peptide
  Seed: SDQLGYSYA (TYRP2_HUMAN)
SEQLGYSYL

SEQ ID NO: 186837 - protein, 10 aa, Artificial Sequence
  Description of Artificial Sequence: Synthetic peptide
  Seed: RLRKGYTPLM (TYRP2_HUMAN)
RYRKGYTPLI

SEQ ID NO: 186838 - protein, 11 aa, Artificial Sequence
  Description of Artificial Sequence: Synthetic peptide
  Seed: RADTRPWSGPY (TYRP2_HUMAN)
RGDTRPWSGPY

SEQ ID NO: 186839 - protein, 10 aa, Artificial Sequence
  Description of Artificial Sequence: Synthetic peptide
  Seed: ELAPIGHNRM (TYRP2_HUMAN)
ETAPIGHNRN

SEQ ID NO: 186840 - protein, 10 aa, Artificial Sequence
  Description of Artificial Sequence: Synthetic peptide
  Seed: ELWPRKFFHR (TYRP2_HUMAN)
EWWPRKFFHR

SEQ ID NO: 186841 - protein, 8 aa, Artificial Sequence
  Description of Artificial Sequence: Synthetic peptide
  Seed: MGTLVALV (TYRP2_HUMAN)
MQTLVALV

SEQ ID NO: 186842 - protein, 9 aa, Artificial Sequence
  Description of Artificial Sequence: Synthetic peptide
  Seed: TLISRNSRF (TYRP2_HUMAN)
TYISRNSRF

SEQ ID NO: 186843 - protein, 9 aa, Artificial Sequence
  Description of Artificial Sequence: Synthetic peptide
  Seed: VVLHSFTDA (TYRP2_HUMAN)
VMLHSFTDV

SEQ ID NO: 186844 - protein, 8 aa, Artificial Sequence
  Description of Artificial Sequence: Synthetic peptide
  Seed: FPRVCMTV (TYRP2_HUMAN)
FPRVCMTM

SEQ ID NO: 186845 - protein, 10 aa, Artificial Sequence
  Description of Artificial Sequence: Synthetic peptide
  Seed: YAIDLPVSVE (TYRP2_HUMAN)
YVIDLPVSVL

SEQ ID NO: 186846 - protein, 9 aa, Artificial Sequence
  Description of Artificial Sequence: Synthetic peptide
  Seed: SRNSRFSSW (TYRP2_HUMAN)
SFNSRFSSF

SEQ ID NO: 186847 - protein, 10 aa, Artificial Sequence
  Description of Artificial Sequence: Synthetic peptide
  Seed: RRLRKGYTPL (TYRP2_HUMAN)
RCLRKGYTPY

SEQ ID NO: 186848 - protein, 10 aa, Artificial Sequence
  Description of Artificial Sequence: Synthetic peptide
  Seed: FFQNSTFSFR (TYRP2_HUMAN)
FWQNSTFSFM

SEQ ID NO: 186849 - protein, 10 aa, Artificial Sequence
  Description of Artificial Sequence: Synthetic peptide
  Seed: REQFLGALDL (TYRP2_HUMAN)
RAQFLGALDY

SEQ ID NO: 186850 - protein, 9 aa, Artificial Sequence
  Description of Artificial Sequence: Synthetic peptide
  Seed: QKFDNPPFF (TYRP2_HUMAN)
QIFDNPPFY

SEQ ID NO: 186851 - protein, 10 aa, Artificial Sequence
  Description of Artificial Sequence: Synthetic peptide
  Seed: FFQNSTFSFR (TYRP2_HUMAN)
FWQNSTFSFW

SEQ ID NO: 186852 - protein, 9 aa, Artificial Sequence
  Description of Artificial Sequence: Synthetic peptide
  Seed: LIGNESFAL (TYRP2_HUMAN)
LMGNESFAA

SEQ ID NO: 186853 - protein, 9 aa, Artificial Sequence
  Description of Artificial Sequence: Synthetic peptide
  Seed: SPLWWGFLL (TYRP2_HUMAN)
SILWWGFLV

SEQ ID NO: 186854 - protein, 9 aa, Artificial Sequence
  Description of Artificial Sequence: Synthetic peptide
  Seed: VIRQNIHSL (TYRP2_HUMAN)
VARQNIHSI

SEQ ID NO: 186855 - protein, 11 aa, Artificial Sequence
  Description of Artificial Sequence: Synthetic peptide
  Seed: YSYAIDLPVSV (TYRP2_HUMAN)
YLYAIDLPVSA

SEQ ID NO: 186856 - protein, 10 aa, Artificial Sequence
  Description of Artificial Sequence: Synthetic peptide
  Seed: KILPGAQGQF (TYRP2_HUMAN)
KQLPGAQGQY

SEQ ID NO: 186857 - protein, 9 aa, Artificial Sequence
  Description of Artificial Sequence: Synthetic peptide
  Seed: SLHNLVHSF (TYRP2_HUMAN)
SVHNLVHSY

SEQ ID NO: 186858 - protein, 9 aa, Artificial Sequence
  Description of Artificial Sequence: Synthetic peptide
  Seed: RMYNMVPFF (TYRP2_HUMAN)
RYYNMVPFR

SEQ ID NO: 186859 - protein, 11 aa, Artificial Sequence
  Description of Artificial Sequence: Synthetic peptide
  Seed: ANCSVYDFFVW (TYRP2_HUMAN)
AYCSVYDFFVW

SEQ ID NO: 186860 - protein, 9 aa, Artificial Sequence
  Description of Artificial Sequence: Synthetic peptide
  Seed: VSVEETPGW (TYRP2_HUMAN)
VAVEETPGW

SEQ ID NO: 186861 - protein, 9 aa, Artificial Sequence
  Description of Artificial Sequence: Synthetic peptide
  Seed: FFQNSTFSF (TYRP2_HUMAN)
FRQNSTFSL

SEQ ID NO: 186862 - protein, 11 aa, Artificial Sequence
  Description of Artificial Sequence: Synthetic peptide
  Seed: YNMVPFFPPVT (TYRP2_HUMAN)
YIMVPFFPPVA

SEQ ID NO: 186863 - protein, 10 aa, Artificial Sequence
  Description of Artificial Sequence: Synthetic peptide
  Seed: RPDDPTLISR (TYRP2_HUMAN)
RIDDPTLISM

SEQ ID NO: 186864 - protein, 10 aa, Artificial Sequence
  Description of Artificial Sequence: Synthetic peptide
  Seed: RRLRKGYTPL (TYRP2_HUMAN)
RWLRKGYTPA

SEQ ID NO: 186865 - protein, 9 aa, Artificial Sequence
  Description of Artificial Sequence: Synthetic peptide
  Seed: TLDSQVMSL (TYRP2_HUMAN)
TFDSQVMSY

SEQ ID NO: 186866 - protein, 11 aa, Artificial Sequence
  Description of Artificial Sequence: Synthetic peptide
  Seed: VTLCNGTYEGL (TYRP2_HUMAN)
VSLCNGTYEGW

SEQ ID NO: 186867 - protein, 9 aa, Artificial Sequence
  Description of Artificial Sequence: Synthetic peptide
  Seed: VHPDYVITT (TYRP2_HUMAN)
VLPDYVITL

SEQ ID NO: 186868 - protein, 9 aa, Artificial Sequence
  Description of Artificial Sequence: Synthetic peptide
  Seed: DDYNHLVTL (TYRP2_HUMAN)
DNYNHLVTY

SEQ ID NO: 186869 - protein, 10 aa, Artificial Sequence
  Description of Artificial Sequence: Synthetic peptide
  Seed: NQDDRELWPR (TYRP2_HUMAN)
NMDDRELWPY

SEQ ID NO: 186870 - protein, 10 aa, Artificial Sequence
  Description of Artificial Sequence: Synthetic peptide
  Seed: FQNSTFSFRN (TYRP2_HUMAN)
FTNSTFSFRK

SEQ ID NO: 186871 - protein, 10 aa, Artificial Sequence
  Description of Artificial Sequence: Synthetic peptide
  Seed: MSPLWWGFLL (TYRP2_HUMAN)
MVPLWWGFLY

SEQ ID NO: 186872 - protein, 9 aa, Artificial Sequence
  Description of Artificial Sequence: Synthetic peptide
  Seed: FSHQGPAFV (TYRP2_HUMAN)
FIHQGPAFY

SEQ ID NO: 186873 - protein, 9 aa, Artificial Sequence
  Description of Artificial Sequence: Synthetic peptide
  Seed: TLLGPGRPY (TYRP2_HUMAN)
TALGPGRPM

SEQ ID NO: 186874 - protein, 10 aa, Artificial Sequence
  Description of Artificial Sequence: Synthetic peptide
  Seed: VVLHSFTDAI (TYRP2_HUMAN)
VHLHSFTDAV

SEQ ID NO: 186875 - protein, 10 aa, Artificial Sequence
  Description of Artificial Sequence: Synthetic peptide
  Seed: YNMVPFFPPV (TYRP2_HUMAN)
YWMVPFFPPI

SEQ ID NO: 186876 - protein, 10 aa, Artificial Sequence
  Description of Artificial Sequence: Synthetic peptide
  Seed: GPAFVTWHRY (TYRP2_HUMAN)
GMAFVTWHRY

SEQ ID NO: 186877 - protein, 10 aa, Artificial Sequence
  Description of Artificial Sequence: Synthetic peptide
  Seed: LGPNGTQPQF (TYRP2_HUMAN)
LIPNGTQPQW

SEQ ID NO: 186878 - protein, 9 aa, Artificial Sequence
  Description of Artificial Sequence: Synthetic peptide
  Seed: GNESFALPY (TYRP2_HUMAN)
GMESFALPY

SEQ ID NO: 186879 - protein, 8 aa, Artificial Sequence
  Description of Artificial Sequence: Synthetic peptide
  Seed: FSHQGPAF (TYRP2_HUMAN)
FWHQGPAL

SEQ ID NO: 186880 - protein, 9 aa, Artificial Sequence
  Description of Artificial Sequence: Synthetic peptide
  Seed: RKFFHRTCK (TYRP2_HUMAN)
RLFFHRTCK

SEQ ID NO: 186881 - protein, 9 aa, Artificial Sequence
  Description of Artificial Sequence: Synthetic peptide
  Seed: ILPGAQGQF (TYRP2_HUMAN)
ILPGAQGQV

SEQ ID NO: 186882 - protein, 9 aa, Artificial Sequence
  Description of Artificial Sequence: Synthetic peptide
  Seed: ALVGLFVLL (TYRP2_HUMAN)
ALVGLFVLR

SEQ ID NO: 186883 - protein, 10 aa, Artificial Sequence
  Description of Artificial Sequence: Synthetic peptide
  Seed: LVVMGTLVAL (TYRP2_HUMAN)
LDVMGTLVAY

SEQ ID NO: 186884 - protein, 9 aa, Artificial Sequence
  Description of Artificial Sequence: Synthetic peptide
  Seed: VLHSFTDAI (TYRP2_HUMAN)
VMHSFTDAL

SEQ ID NO: 186885 - protein, 9 aa, Artificial Sequence
  Description of Artificial Sequence: Synthetic peptide
  Seed: FTDAIFDEW (TYRP2_HUMAN)
FADAIFDEL

SEQ ID NO: 186886 - protein, 10 aa, Artificial Sequence
  Description of Artificial Sequence: Synthetic peptide
  Seed: RNSRFSSWET (TYRP2_HUMAN)
RKSRFSSWEM

SEQ ID NO: 186887 - protein, 10 aa, Artificial Sequence
  Description of Artificial Sequence: Synthetic peptide
  Seed: GYSYAIDLPV (TYRP2_HUMAN)
GISYAIDLPV

SEQ ID NO: 186888 - protein, 9 aa, Artificial Sequence
  Description of Artificial Sequence: Synthetic peptide
  Seed: RLRKGYTPL (TYRP2_HUMAN)
RQRKGYTPI

SEQ ID NO: 186889 - protein, 11 aa, Artificial Sequence
  Description of Artificial Sequence: Synthetic peptide
  Seed: RNSRFSSWETV (TYRP2_HUMAN)
RCSRFSSWETI

SEQ ID NO: 186890 - protein, 9 aa, Artificial Sequence
  Description of Artificial Sequence: Synthetic peptide
  Seed: TLDSQVMSL (TYRP2_HUMAN)
TMDSQVMSI

SEQ ID NO: 186891 - protein, 10 aa, Artificial Sequence
  Description of Artificial Sequence: Synthetic peptide
  Seed: YDFFVWLHYY (TYRP2_HUMAN)
YMFFVWLHYY

SEQ ID NO: 186892 - protein, 9 aa, Artificial Sequence
  Description of Artificial Sequence: Synthetic peptide
  Seed: ANCSVYDFF (TYRP2_HUMAN)
ASCSVYDFW

SEQ ID NO: 186893 - protein, 9 aa, Artificial Sequence
  Description of Artificial Sequence: Synthetic peptide
  Seed: STFSFRNAL (TYRP2_HUMAN)
SAFSFRNAW

SEQ ID NO: 186894 - protein, 9 aa, Artificial Sequence
  Description of Artificial Sequence: Synthetic peptide
  Seed: ITTQHWLGL (TYRP2_HUMAN)
ITTQHWLGI

SEQ ID NO: 186895 - protein, 10 aa, Artificial Sequence
  Description of Artificial Sequence: Synthetic peptide
  Seed: CMTVDSLVNK (TYRP2_HUMAN)
CETVDSLVNR

SEQ ID NO: 186896 - protein, 10 aa, Artificial Sequence
  Description of Artificial Sequence: Synthetic peptide
  Seed: MGTLVALVGL (TYRP2_HUMAN)
MGTLVALVGV

SEQ ID NO: 186897 - protein, 9 aa, Artificial Sequence
  Description of Artificial Sequence: Synthetic peptide
  Seed: TSDQLGYSY (TYRP2_HUMAN)
TADQLGYSF

SEQ ID NO: 186898 - protein, 8 aa, Artificial Sequence
  Description of Artificial Sequence: Synthetic peptide
  Seed: FSHQGPAF (TYRP2_HUMAN)
FGHQGPAY

SEQ ID NO: 186899 - protein, 10 aa, Artificial Sequence
  Description of Artificial Sequence: Synthetic peptide
  Seed: LVVMGTLVAL (TYRP2_HUMAN)
LCVMGTLVAI

SEQ ID NO: 186900 - protein, 10 aa, Artificial Sequence
  Description of Artificial Sequence: Synthetic peptide
  Seed: RRLRKGYTPL (TYRP2_HUMAN)
RSLRKGYTPR

SEQ ID NO: 186901 - protein, 9 aa, Artificial Sequence
  Description of Artificial Sequence: Synthetic peptide
  Seed: ILPGAQGQF (TYRP2_HUMAN)
IMPGAQGQF

SEQ ID NO: 186902 - protein, 9 aa, Artificial Sequence
  Description of Artificial Sequence: Synthetic peptide
  Seed: SFLNGTNAL (TYRP2_HUMAN)
SVLNGTNAM

SEQ ID NO: 186903 - protein, 9 aa, Artificial Sequence
  Description of Artificial Sequence: Synthetic peptide
  Seed: AFLQYRRLR (TYRP2_HUMAN)
AILQYRRLR

SEQ ID NO: 186904 - protein, 10 aa, Artificial Sequence
  Description of Artificial Sequence: Synthetic peptide
  Seed: VVMGTLVALV (TYRP2_HUMAN)
VMMGTLVALG

SEQ ID NO: 186905 - protein, 9 aa, Artificial Sequence
  Description of Artificial Sequence: Synthetic peptide
  Seed: ILPGAQGQF (TYRP2_HUMAN)
IYPGAQGQM

SEQ ID NO: 186906 - protein, 10 aa, Artificial Sequence
  Description of Artificial Sequence: Synthetic peptide
  Seed: RNSRFSSWET (TYRP2_HUMAN)
RPSRFSSWEA

SEQ ID NO: 186907 - protein, 9 aa, Artificial Sequence
  Description of Artificial Sequence: Synthetic peptide
  Seed: SVYDFFVWL (TYRP2_HUMAN)
SVYDFFVWY

SEQ ID NO: 186908 - protein, 10 aa, Artificial Sequence
  Description of Artificial Sequence: Synthetic peptide
  Seed: CMTVDSLVNK (TYRP2_HUMAN)
CPTVDSLVNR

SEQ ID NO: 186909 - protein, 10 aa, Artificial Sequence
  Description of Artificial Sequence: Synthetic peptide
  Seed: SVYDFFVWLH (TYRP2_HUMAN)
SIYDFFVWLY

SEQ ID NO: 186910 - protein, 9 aa, Artificial Sequence
  Description of Artificial Sequence: Synthetic peptide
  Seed: VIRQNIHSL (TYRP2_HUMAN)
VTRQNIHSL

SEQ ID NO: 186911 - protein, 10 aa, Artificial Sequence
  Description of Artificial Sequence: Synthetic peptide
  Seed: NGTYEGLLRR (TYRP2_HUMAN)
NPTYEGLLRK

SEQ ID NO: 186912 - protein, 9 aa, Artificial Sequence
  Description of Artificial Sequence: Synthetic peptide
  Seed: YAIDLPVSV (TYRP2_HUMAN)
YCIDLPVSM

SEQ ID NO: 186913 - protein, 10 aa, Artificial Sequence
  Description of Artificial Sequence: Synthetic peptide
  Seed: SDQLGYSYAI (TYRP2_HUMAN)
SGQLGYSYAI

SEQ ID NO: 186914 - protein, 10 aa, Artificial Sequence
  Description of Artificial Sequence: Synthetic peptide
  Seed: VLHSFTDAIF (TYRP2_HUMAN)
VMHSFTDAIV

SEQ ID NO: 186915 - protein, 11 aa, Artificial Sequence
  Description of Artificial Sequence: Synthetic peptide
  Seed: YNMVPFFPPVT (TYRP2_HUMAN)
YRMVPFFPPVV

SEQ ID NO: 186916 - protein, 8 aa, Artificial Sequence
  Description of Artificial Sequence: Synthetic peptide
  Seed: FSHQGPAF (TYRP2_HUMAN)
FQHQGPAY

SEQ ID NO: 186917 - protein, 10 aa, Artificial Sequence
  Description of Artificial Sequence: Synthetic peptide
  Seed: AIFDEWMKRF (TYRP2_HUMAN)
ATFDEWMKRR

SEQ ID NO: 186918 - protein, 9 aa, Artificial Sequence
  Description of Artificial Sequence: Synthetic peptide
  Seed: YSYAIDLPV (TYRP2_HUMAN)
YEYAIDLPW

SEQ ID NO: 186919 - protein, 10 aa, Artificial Sequence
  Description of Artificial Sequence: Synthetic peptide
  Seed: ELAPIGHNRM (TYRP2_HUMAN)
EIAPIGHNRY

SEQ ID NO: 186920 - protein, 9 aa, Artificial Sequence
  Description of Artificial Sequence: Synthetic peptide
  Seed: SLHNLVHSF (TYRP2_HUMAN)
SSHNLVHSL

SEQ ID NO: 186921 - protein, 9 aa, Artificial Sequence
  Description of Artificial Sequence: Synthetic peptide
  Seed: FVWLHYYSV (TYRP2_HUMAN)
FTWLHYYSR

SEQ ID NO: 186922 - protein, 10 aa, Artificial Sequence
  Description of Artificial Sequence: Synthetic peptide
  Seed: RNSRFSSWET (TYRP2_HUMAN)
RMSRFSSWEM

SEQ ID NO: 186923 - protein, 9 aa, Artificial Sequence
  Description of Artificial Sequence: Synthetic peptide
  Seed: AARPDDPTL (TYRP2_HUMAN)
ALRPDDPTF

SEQ ID NO: 186924 - protein, 8 aa, Artificial Sequence
  Description of Artificial Sequence: Synthetic peptide
  Seed: KFDNPPFF (TYRP2_HUMAN)
KVDNPPFL

SEQ ID NO: 186925 - protein, 11 aa, Artificial Sequence
  Description of Artificial Sequence: Synthetic peptide
  Seed: TQPQFANCSVY (TYRP2_HUMAN)
TGPQFANCSVF

SEQ ID NO: 186926 - protein, 9 aa, Artificial Sequence
  Description of Artificial Sequence: Synthetic peptide
  Seed: AARPDDPTL (TYRP2_HUMAN)
ATRPDDPTW

SEQ ID NO: 186927 - protein, 10 aa, Artificial Sequence
  Description of Artificial Sequence: Synthetic peptide
  Seed: MSPLWWGFLL (TYRP2_HUMAN)
MHPLWWGFLW

SEQ ID NO: 186928 - protein, 9 aa, Artificial Sequence
  Description of Artificial Sequence: Synthetic peptide
  Seed: NALEGFDKA (TYRP2_HUMAN)
NILEGFDKA

SEQ ID NO: 186929 - protein, 9 aa, Artificial Sequence
  Description of Artificial Sequence: Synthetic peptide
  Seed: YYSVRDTLL (TYRP2_HUMAN)
YASVRDTLL

SEQ ID NO: 186930 - protein, 10 aa, Artificial Sequence
  Description of Artificial Sequence: Synthetic peptide
  Seed: LHYYSVRDTL (TYRP2_HUMAN)
LKYYSVRDTW

SEQ ID NO: 186931 - protein, 9 aa, Artificial Sequence
  Description of Artificial Sequence: Synthetic peptide
  Seed: VTWHRYHLL (TYRP2_HUMAN)
VFWHRYHLI

SEQ ID NO: 186932 - protein, 10 aa, Artificial Sequence
  Description of Artificial Sequence: Synthetic peptide
  Seed: FPPVTNEELF (TYRP2_HUMAN)
FSPVTNEELW

SEQ ID NO: 186933 - protein, 10 aa, Artificial Sequence
  Description of Artificial Sequence: Synthetic peptide
  Seed: MGTLVALVGL (TYRP2_HUMAN)
MATLVALVGI

SEQ ID NO: 186934 - protein, 10 aa, Artificial Sequence
  Description of Artificial Sequence: Synthetic peptide
  Seed: NPPFFQNSTF (TYRP2_HUMAN)
NQPFFQNSTY

SEQ ID NO: 186935 - protein, 10 aa, Artificial Sequence
  Description of Artificial Sequence: Synthetic peptide
  Seed: AFVTWHRYHL (TYRP2_HUMAN)
AYVTWHRYHF

SEQ ID NO: 186936 - protein, 9 aa, Artificial Sequence
  Description of Artificial Sequence: Synthetic peptide
  Seed: HQGPAFVTW (TYRP2_HUMAN)
HAGPAFVTL

SEQ ID NO: 186937 - protein, 10 aa, Artificial Sequence
  Description of Artificial Sequence: Synthetic peptide
  Seed: LVVMGTLVAL (TYRP2_HUMAN)
LIVMGTLVAF

SEQ ID NO: 186938 - protein, 11 aa, Artificial Sequence
  Description of Artificial Sequence: Synthetic peptide
  Seed: FQNSTFSFRNA (TYRP2_HUMAN)
FMNSTFSFRNA

SEQ ID NO: 186939 - protein, 10 aa, Artificial Sequence
  Description of Artificial Sequence: Synthetic peptide
  Seed: SLQKFDNPPF (TYRP2_HUMAN)
SFQKFDNPPY

SEQ ID NO: 186940 - protein, 10 aa, Artificial Sequence
  Description of Artificial Sequence: Synthetic peptide
  Seed: YDFFVWLHYY (TYRP2_HUMAN)
YMFFVWLHYE

SEQ ID NO: 186941 - protein, 10 aa, Artificial Sequence
  Description of Artificial Sequence: Synthetic peptide
  Seed: YDFFVWLHYY (TYRP2_HUMAN)
YQFFVWLHYF

SEQ ID NO: 186942 - protein, 9 aa, Artificial Sequence
  Description of Artificial Sequence: Synthetic peptide
  Seed: RVCMTVDSL (TYRP2_HUMAN)
RSCMTVDSF

SEQ ID NO: 186943 - protein, 9 aa, Artificial Sequence
  Description of Artificial Sequence: Synthetic peptide
  Seed: SLDDYNHLV (TYRP2_HUMAN)
SSDDYNHLM

SEQ ID NO: 186944 - protein, 10 aa, Artificial Sequence
  Description of Artificial Sequence: Synthetic peptide
  Seed: FVVLHSFTDA (TYRP2_HUMAN)
FEVLHSFTDV

SEQ ID NO: 186945 - protein, 9 aa, Artificial Sequence
  Description of Artificial Sequence: Synthetic peptide
  Seed: VTNEELFLT (TYRP2_HUMAN)
VMNEELFLA

SEQ ID NO: 186946 - protein, 10 aa, Artificial Sequence
  Description of Artificial Sequence: Synthetic peptide
  Seed: NGTYEGLLRR (TYRP2_HUMAN)
NPTYEGLLRR

SEQ ID NO: 186947 - protein, 10 aa, Artificial Sequence
  Description of Artificial Sequence: Synthetic peptide
  Seed: RMYNMVPFFP (TYRP2_HUMAN)
RIYNMVPFFF

SEQ ID NO: 186948 - protein, 9 aa, Artificial Sequence
  Description of Artificial Sequence: Synthetic peptide
  Seed: FVLLAFLQY (TYRP2_HUMAN)
FVLLAFLQF

SEQ ID NO: 186949 - protein, 9 aa, Artificial Sequence
  Description of Artificial Sequence: Synthetic peptide
  Seed: ARPDDPTLI (TYRP2_HUMAN)
AYPDDPTLY

SEQ ID NO: 186950 - protein, 10 aa, Artificial Sequence
  Description of Artificial Sequence: Synthetic peptide
  Seed: LHYYSVRDTL (TYRP2_HUMAN)
LWYYSVRDTW

SEQ ID NO: 186951 - protein, 10 aa, Artificial Sequence
  Description of Artificial Sequence: Synthetic peptide
  Seed: RMYNMVPFFP (TYRP2_HUMAN)
RLYNMVPFFF

SEQ ID NO: 186952 - protein, 9 aa, Artificial Sequence
  Description of Artificial Sequence: Synthetic peptide
  Seed: GTYEGLLRR (TYRP2_HUMAN)
GNYEGLLRK

SEQ ID NO: 186953 - protein, 9 aa, Artificial Sequence
  Description of Artificial Sequence: Synthetic peptide
  Seed: GYTPLMETH (TYRP2_HUMAN)
GYTPLMETY

SEQ ID NO: 186954 - protein, 10 aa, Artificial Sequence
  Description of Artificial Sequence: Synthetic peptide
  Seed: SPLWWGFLLS (TYRP2_HUMAN)
SQLWWGFLLI

SEQ ID NO: 186955 - protein, 9 aa, Artificial Sequence
  Description of Artificial Sequence: Synthetic peptide
  Seed: VMSLHNLVH (TYRP2_HUMAN)
VLSLHNLVF

SEQ ID NO: 186956 - protein, 9 aa, Artificial Sequence
  Description of Artificial Sequence: Synthetic peptide
  Seed: RLRKGYTPL (TYRP2_HUMAN)
RTRKGYTPT

SEQ ID NO: 186957 - protein, 9 aa, Artificial Sequence
  Description of Artificial Sequence: Synthetic peptide
  Seed: VPFFPPVTN (TYRP2_HUMAN)
VAFFPPVTF

SEQ ID NO: 186958 - protein, 9 aa, Artificial Sequence
  Description of Artificial Sequence: Synthetic peptide
  Seed: QKFDNPPFF (TYRP2_HUMAN)
QHFDNPPFM

SEQ ID NO: 186959 - protein, 11 aa, Artificial Sequence
  Description of Artificial Sequence: Synthetic peptide
  Seed: RADTRPWSGPY (TYRP2_HUMAN)
REDTRPWSGPA

SEQ ID NO: 186960 - protein, 10 aa, Artificial Sequence
  Description of Artificial Sequence: Synthetic peptide
  Seed: ESFALPYWNF (TYRP2_HUMAN)
EWFALPYWNF

SEQ ID NO: 186961 - protein, 9 aa, Artificial Sequence
  Description of Artificial Sequence: Synthetic peptide
  Seed: YSYAIDLPV (TYRP2_HUMAN)
YAYAIDLPF

SEQ ID NO: 186962 - protein, 9 aa, Artificial Sequence
  Description of Artificial Sequence: Synthetic peptide
  Seed: ANDPIFVVL (TYRP2_HUMAN)
AQDPIFVVW

SEQ ID NO: 186963 - protein, 9 aa, Artificial Sequence
  Description of Artificial Sequence: Synthetic peptide
  Seed: ALPYWNFAT (TYRP2_HUMAN)
ALPYWNFAV

SEQ ID NO: 186964 - protein, 11 aa, Artificial Sequence
  Description of Artificial Sequence: Synthetic peptide
  Seed: SLDDYNHLVTL (TYRP2_HUMAN)
SVDDYNHLVTV

SEQ ID NO: 186965 - protein, 10 aa, Artificial Sequence
  Description of Artificial Sequence: Synthetic peptide
  Seed: RNSRFSSWET (TYRP2_HUMAN)
RISRFSSWEM

SEQ ID NO: 186966 - protein, 9 aa, Artificial Sequence
  Description of Artificial Sequence: Synthetic peptide
  Seed: HSAANDPIF (TYRP2_HUMAN)
HQAANDPIY

SEQ ID NO: 186967 - protein, 9 aa, Artificial Sequence
  Description of Artificial Sequence: Synthetic peptide
  Seed: VLHSFTDAI (TYRP2_HUMAN)
VRHSFTDAY

SEQ ID NO: 186968 - protein, 8 aa, Artificial Sequence
  Description of Artificial Sequence: Synthetic peptide
  Seed: MYNMVPFF (TYRP2_HUMAN)
MYNMVPFL

SEQ ID NO: 186969 - protein, 9 aa, Artificial Sequence
  Description of Artificial Sequence: Synthetic peptide
  Seed: FFQNSTFSF (TYRP2_HUMAN)
FAQNSTFSY

SEQ ID NO: 186970 - protein, 9 aa, Artificial Sequence
  Description of Artificial Sequence: Synthetic peptide
  Seed: VMGTLVALV (TYRP2_HUMAN)
VVGTLVALI

SEQ ID NO: 186971 - protein, 9 aa, Artificial Sequence
  Description of Artificial Sequence: Synthetic peptide
  Seed: YAIDLPVSV (TYRP2_HUMAN)
YPIDLPVSW

SEQ ID NO: 186972 - protein, 9 aa, Artificial Sequence
  Description of Artificial Sequence: Synthetic peptide
  Seed: DDYNHLVTL (TYRP2_HUMAN)
DAYNHLVTY

SEQ ID NO: 186973 - protein, 11 aa, Artificial Sequence
  Description of Artificial Sequence: Synthetic peptide
  Seed: QRLIGNESFAL (TYRP2_HUMAN)
QYLIGNESFAI

SEQ ID NO: 186974 - protein, 9 aa, Artificial Sequence
  Description of Artificial Sequence: Synthetic peptide
  Seed: RQNIHSLSP (TYRP2_HUMAN)
RQNIHSLSL

SEQ ID NO: 186975 - protein, 9 aa, Artificial Sequence
  Description of Artificial Sequence: Synthetic peptide
  Seed: RLIGNESFA (TYRP2_HUMAN)
RLIGNESFM

SEQ ID NO: 186976 - protein, 9 aa, Artificial Sequence
  Description of Artificial Sequence: Synthetic peptide
  Seed: VTWHRYHLL (TYRP2_HUMAN)
VIWHRYHLA

SEQ ID NO: 186977 - protein, 10 aa, Artificial Sequence
  Description of Artificial Sequence: Synthetic peptide
  Seed: RLRKGYTPLM (TYRP2_HUMAN)
RPRKGYTPLY

SEQ ID NO: 186978 - protein, 9 aa, Artificial Sequence
  Description of Artificial Sequence: Synthetic peptide
  Seed: AARPDDPTL (TYRP2_HUMAN)
ATRPDDPTK

SEQ ID NO: 186979 - protein, 11 aa, Artificial Sequence
  Description of Artificial Sequence: Synthetic peptide
  Seed: MYNMVPFFPPV (TYRP2_HUMAN)
MMNMVPFFPPV

SEQ ID NO: 186980 - protein, 9 aa, Artificial Sequence
  Description of Artificial Sequence: Synthetic peptide
  Seed: FFPPVTNEE (TYRP2_HUMAN)
FMPPVTNEM

SEQ ID NO: 186981 - protein, 9 aa, Artificial Sequence
  Description of Artificial Sequence: Synthetic peptide
  Seed: AANDPIFVV (TYRP2_HUMAN)
AQNDPIFVL

SEQ ID NO: 186982 - protein, 9 aa, Artificial Sequence
  Description of Artificial Sequence: Synthetic peptide
  Seed: NRMYNMVPF (TYRP2_HUMAN)
NEMYNMVPY

SEQ ID NO: 186983 - protein, 9 aa, Artificial Sequence
  Description of Artificial Sequence: Synthetic peptide
  Seed: SFALPYWNF (TYRP2_HUMAN)
SWALPYWNY

SEQ ID NO: 186984 - protein, 10 aa, Artificial Sequence
  Description of Artificial Sequence: Synthetic peptide
  Seed: RNQMGRNSMK (TYRP2_HUMAN)
RRQMGRNSMR

SEQ ID NO: 186985 - protein, 9 aa, Artificial Sequence
  Description of Artificial Sequence: Synthetic peptide
  Seed: GTLVALVGL (TYRP2_HUMAN)
GLLVALVGL

SEQ ID NO: 186986 - protein, 9 aa, Artificial Sequence
  Description of Artificial Sequence: Synthetic peptide
  Seed: FFQNSTFSF (TYRP2_HUMAN)
FEQNSTFSY

SEQ ID NO: 186987 - protein, 9 aa, Artificial Sequence
  Description of Artificial Sequence: Synthetic peptide
  Seed: HYYSVRDTL (TYRP2_HUMAN)
HAYSVRDTY

SEQ ID NO: 186988 - protein, 9 aa, Artificial Sequence
  Description of Artificial Sequence: Synthetic peptide
  Seed: SLDDYNHLV (TYRP2_HUMAN)
SQDDYNHLW

SEQ ID NO: 186989 - protein, 9 aa, Artificial Sequence
  Description of Artificial Sequence: Synthetic peptide
  Seed: AANDPIFVV (TYRP2_HUMAN)
ALNDPIFVT

SEQ ID NO: 186990 - protein, 10 aa, Artificial Sequence
  Description of Artificial Sequence: Synthetic peptide
  Seed: TRPWSGPYIL (TYRP2_HUMAN)
TEPWSGPYIY

SEQ ID NO: 186991 - protein, 10 aa, Artificial Sequence
  Description of Artificial Sequence: Synthetic peptide
  Seed: FSFRNALEGF (TYRP2_HUMAN)
FSFRNALEGL

SEQ ID NO: 186992 - protein, 9 aa, Artificial Sequence
  Description of Artificial Sequence: Synthetic peptide
  Seed: FFQNSTFSF (TYRP2_HUMAN)
FPQNSTFSY

SEQ ID NO: 186993 - protein, 11 aa, Artificial Sequence
  Description of Artificial Sequence: Synthetic peptide
  Seed: AIDFSHQGPAF (TYRP2_HUMAN)
ATDFSHQGPAL

SEQ ID NO: 186994 - protein, 10 aa, Artificial Sequence
  Description of Artificial Sequence: Synthetic peptide
  Seed: MSPLWWGFLL (TYRP2_HUMAN)
MQPLWWGFLM

SEQ ID NO: 186995 - protein, 9 aa, Artificial Sequence
  Description of Artificial Sequence: Synthetic peptide
  Seed: STFSFRNAL (TYRP2_HUMAN)
SRFSFRNAY

SEQ ID NO: 186996 - protein, 9 aa, Artificial Sequence
  Description of Artificial Sequence: Synthetic peptide
  Seed: QKFDNPPFF (TYRP2_HUMAN)
QQFDNPPFV

SEQ ID NO: 186997 - protein, 9 aa, Artificial Sequence
  Description of Artificial Sequence: Synthetic peptide
  Seed: AQGQFPRVC (TYRP2_HUMAN)
AEGQFPRVI

SEQ ID NO: 186998 - protein, 9 aa, Artificial Sequence
  Description of Artificial Sequence: Synthetic peptide
  Seed: MVPFFPPVT (TYRP2_HUMAN)
MVPFFPPVV

SEQ ID NO: 186999 - protein, 11 aa, Artificial Sequence
  Description of Artificial Sequence: Synthetic peptide
  Seed: YRRLRKGYTPL (TYRP2_HUMAN)
YMRLRKGYTPF

SEQ ID NO: 187000 - protein, 9 aa, Artificial Sequence
  Description of Artificial Sequence: Synthetic peptide
  Seed: TSDQLGYSY (TYRP2_HUMAN)
TTDQLGYSI

SEQ ID NO: 187001 - protein, 9 aa, Artificial Sequence
  Description of Artificial Sequence: Synthetic peptide
  Seed: YVITTQHWL (TYRP2_HUMAN)
YQITTQHWW

SEQ ID NO: 187002 - protein, 10 aa, Artificial Sequence
  Description of Artificial Sequence: Synthetic peptide
  Seed: YNMVPFFPPV (TYRP2_HUMAN)
YLMVPFFPPS

SEQ ID NO: 187003 - protein, 8 aa, Artificial Sequence
  Description of Artificial Sequence: Synthetic peptide
  Seed: LDDYNHLV (TYRP2_HUMAN)
LQDYNHLL

SEQ ID NO: 187004 - protein, 9 aa, Artificial Sequence
  Description of Artificial Sequence: Synthetic peptide
  Seed: VMSLHNLVH (TYRP2_HUMAN)
VTSLHNLVY

SEQ ID NO: 187005 - protein, 10 aa, Artificial Sequence
  Description of Artificial Sequence: Synthetic peptide
  Seed: RLRKGYTPLM (TYRP2_HUMAN)
RQRKGYTPLA

SEQ ID NO: 187006 - protein, 10 aa, Artificial Sequence
  Description of Artificial Sequence: Synthetic peptide
  Seed: TSDQLGYSYA (TYRP2_HUMAN)
TSDQLGYSYY

SEQ ID NO: 187007 - protein, 10 aa, Artificial Sequence
  Description of Artificial Sequence: Synthetic peptide
  Seed: QPQFANCSVY (TYRP2_HUMAN)
QHQFANCSVF

SEQ ID NO: 187008 - protein, 9 aa, Artificial Sequence
  Description of Artificial Sequence: Synthetic peptide
  Seed: HQGPAFVTW (TYRP2_HUMAN)
HRGPAFVTM

SEQ ID NO: 187009 - protein, 9 aa, Artificial Sequence
  Description of Artificial Sequence: Synthetic peptide
  Seed: YAIDLPVSV (TYRP2_HUMAN)
YGIDLPVSF

SEQ ID NO: 187010 - protein, 9 aa, Artificial Sequence
  Description of Artificial Sequence: Synthetic peptide
  Seed: RNSMKLPTL (TYRP2_HUMAN)
RRSMKLPTL

SEQ ID NO: 187011 - protein, 9 aa, Artificial Sequence
  Description of Artificial Sequence: Synthetic peptide
  Seed: RLRKGYTPL (TYRP2_HUMAN)
RPRKGYTPM

SEQ ID NO: 187012 - protein, 10 aa, Artificial Sequence
  Description of Artificial Sequence: Synthetic peptide
  Seed: RELWPRKFFH (TYRP2_HUMAN)
RVLWPRKFFH

SEQ ID NO: 187013 - protein, 9 aa, Artificial Sequence
  Description of Artificial Sequence: Synthetic peptide
  Seed: WMKRFNPPA (TYRP2_HUMAN)
WSKRFNPPK

SEQ ID NO: 187014 - protein, 9 aa, Artificial Sequence
  Description of Artificial Sequence: Synthetic peptide
  Seed: FFQNSTFSF (TYRP2_HUMAN)
FRQNSTFSM

SEQ ID NO: 187015 - protein, 10 aa, Artificial Sequence
  Description of Artificial Sequence: Synthetic peptide
  Seed: RRLRKGYTPL (TYRP2_HUMAN)
RSLRKGYTPF

SEQ ID NO: 187016 - protein, 11 aa, Artificial Sequence
  Description of Artificial Sequence: Synthetic peptide
  Seed: SLDDYNHLVTL (TYRP2_HUMAN)
SVDDYNHLVTF

SEQ ID NO: 187017 - protein, 10 aa, Artificial Sequence
  Description of Artificial Sequence: Synthetic peptide
  Seed: LHYYSVRDTL (TYRP2_HUMAN)
LRYYSVRDTW

SEQ ID NO: 187018 - protein, 9 aa, Artificial Sequence
  Description of Artificial Sequence: Synthetic peptide
  Seed: FFPPVTNEE (TYRP2_HUMAN)
FYPPVTNEY

SEQ ID NO: 187019 - protein, 8 aa, Artificial Sequence
  Description of Artificial Sequence: Synthetic peptide
  Seed: SLDDYNHL (TYRP2_HUMAN)
SADDYNHL

SEQ ID NO: 187020 - protein, 9 aa, Artificial Sequence
  Description of Artificial Sequence: Synthetic peptide
  Seed: FSHQGPAFV (TYRP2_HUMAN)
FTHQGPAFH

SEQ ID NO: 187021 - protein, 9 aa, Artificial Sequence
  Description of Artificial Sequence: Synthetic peptide
  Seed: LVTLCNGTY (TYRP2_HUMAN)
LMTLCNGTY

SEQ ID NO: 187022 - protein, 9 aa, Artificial Sequence
  Description of Artificial Sequence: Synthetic peptide
  Seed: VGLFVLLAF (TYRP2_HUMAN)
VQLFVLLAL

SEQ ID NO: 187023 - protein, 9 aa, Artificial Sequence
  Description of Artificial Sequence: Synthetic peptide
  Seed: RFNPPADAW (TYRP2_HUMAN)
RLNPPADAW

SEQ ID NO: 187024 - protein, 8 aa, Artificial Sequence
  Description of Artificial Sequence: Synthetic peptide
  Seed: FSHQGPAF (TYRP2_HUMAN)
FFHQGPAI

SEQ ID NO: 187025 - protein, 11 aa, Artificial Sequence
  Description of Artificial Sequence: Synthetic peptide
  Seed: ILRNQDDRELW (TYRP2_HUMAN)
IARNQDDRELW

SEQ ID NO: 187026 - protein, 9 aa, Artificial Sequence
  Description of Artificial Sequence: Synthetic peptide
  Seed: VYDFFVWLH (TYRP2_HUMAN)
VQDFFVWLY

SEQ ID NO: 187027 - protein, 10 aa, Artificial Sequence
  Description of Artificial Sequence: Synthetic peptide
  Seed: VVMGTLVALV (TYRP2_HUMAN)
VMMGTLVALL

SEQ ID NO: 187028 - protein, 9 aa, Artificial Sequence
  Description of Artificial Sequence: Synthetic peptide
  Seed: RPWSGPYIL (TYRP2_HUMAN)
RTWSGPYIV

SEQ ID NO: 187029 - protein, 9 aa, Artificial Sequence
  Description of Artificial Sequence: Synthetic peptide
  Seed: RLRKGYTPL (TYRP2_HUMAN)
RSRKGYTPT

SEQ ID NO: 187030 - protein, 9 aa, Artificial Sequence
  Description of Artificial Sequence: Synthetic peptide
  Seed: STFSFRNAL (TYRP2_HUMAN)
SHFSFRNAM

SEQ ID NO: 187031 - protein, 9 aa, Artificial Sequence
  Description of Artificial Sequence: Synthetic peptide
  Seed: NMVPFFPPV (TYRP2_HUMAN)
NIVPFFPPL

SEQ ID NO: 187032 - protein, 11 aa, Artificial Sequence
  Description of Artificial Sequence: Synthetic peptide
  Seed: SLDDYNHLVTL (TYRP2_HUMAN)
SMDDYNHLVTM

SEQ ID NO: 187033 - protein, 8 aa, Artificial Sequence
  Description of Artificial Sequence: Synthetic peptide
  Seed: LLGPGRPY (TYRP2_HUMAN)
LSGPGRPY

SEQ ID NO: 187034 - protein, 10 aa, Artificial Sequence
  Description of Artificial Sequence: Synthetic peptide
  Seed: AIFDEWMKRF (TYRP2_HUMAN)
AYFDEWMKRY

SEQ ID NO: 187035 - protein, 8 aa, Artificial Sequence
  Description of Artificial Sequence: Synthetic peptide
  Seed: NSMKLPTL (TYRP2_HUMAN)
NPMKLPTV

SEQ ID NO: 187036 - protein, 10 aa, Artificial Sequence
  Description of Artificial Sequence: Synthetic peptide
  Seed: RNSRFSSWET (TYRP2_HUMAN)
RLSRFSSWEA

SEQ ID NO: 187037 - protein, 9 aa, Artificial Sequence
  Description of Artificial Sequence: Synthetic peptide
  Seed: YAIDLPVSV (TYRP2_HUMAN)
YHIDLPVSY

SEQ ID NO: 187038 - protein, 9 aa, Artificial Sequence
  Description of Artificial Sequence: Synthetic peptide
  Seed: FSHQGPAFV (TYRP2_HUMAN)
FWHQGPAFL

SEQ ID NO: 187039 - protein, 10 aa, Artificial Sequence
  Description of Artificial Sequence: Synthetic peptide
  Seed: SDQLGYSYAI (TYRP2_HUMAN)
SVQLGYSYAV

SEQ ID NO: 187040 - protein, 9 aa, Artificial Sequence
  Description of Artificial Sequence: Synthetic peptide
  Seed: ALVGLFVLL (TYRP2_HUMAN)
AIVGLFVLY

SEQ ID NO: 187041 - protein, 9 aa, Artificial Sequence
  Description of Artificial Sequence: Synthetic peptide
  Seed: YTPLMETHL (TYRP2_HUMAN)
YRPLMETHM

SEQ ID NO: 187042 - protein, 10 aa, Artificial Sequence
  Description of Artificial Sequence: Synthetic peptide
  Seed: SLQKFDNPPF (TYRP2_HUMAN)
STQKFDNPPF

SEQ ID NO: 187043 - protein, 10 aa, Artificial Sequence
  Description of Artificial Sequence: Synthetic peptide
  Seed: IGNESFALPY (TYRP2_HUMAN)
IQNESFALPW

SEQ ID NO: 187044 - protein, 10 aa, Artificial Sequence
  Description of Artificial Sequence: Synthetic peptide
  Seed: FVLLAFLQYR (TYRP2_HUMAN)
FELLAFLQYR

SEQ ID NO: 187045 - protein, 10 aa, Artificial Sequence
  Description of Artificial Sequence: Synthetic peptide
  Seed: AANDPIFVVL (TYRP2_HUMAN)
AYNDPIFVVM

SEQ ID NO: 187046 - protein, 10 aa, Artificial Sequence
  Description of Artificial Sequence: Synthetic peptide
  Seed: FLGALDLAKK (TYRP2_HUMAN)
FTGALDLAKK

SEQ ID NO: 187047 - protein, 10 aa, Artificial Sequence
  Description of Artificial Sequence: Synthetic peptide
  Seed: LQRLIGNESF (TYRP2_HUMAN)
LMRLIGNESM

SEQ ID NO: 187048 - protein, 10 aa, Artificial Sequence
  Description of Artificial Sequence: Synthetic peptide
  Seed: VVMGTLVALV (TYRP2_HUMAN)
VLMGTLVALS

SEQ ID NO: 187049 - protein, 9 aa, Artificial Sequence
  Description of Artificial Sequence: Synthetic peptide
  Seed: SLHNLVHSF (TYRP2_HUMAN)
SLHNLVHSI

SEQ ID NO: 187050 - protein, 10 aa, Artificial Sequence
  Description of Artificial Sequence: Synthetic peptide
  Seed: ELWPRKFFHR (TYRP2_HUMAN)
ENWPRKFFHR

SEQ ID NO: 187051 - protein, 9 aa, Artificial Sequence
  Description of Artificial Sequence: Synthetic peptide
  Seed: FANCSVYDF (TYRP2_HUMAN)
FPNCSVYDH

SEQ ID NO: 187052 - protein, 10 aa, Artificial Sequence
  Description of Artificial Sequence: Synthetic peptide
  Seed: QELAPIGHNR (TYRP2_HUMAN)
QVLAPIGHNR

SEQ ID NO: 187053 - protein, 11 aa, Artificial Sequence
  Description of Artificial Sequence: Synthetic peptide
  Seed: RNSRFSSWETV (TYRP2_HUMAN)
RGSRFSSWETF

SEQ ID NO: 187054 - protein, 11 aa, Artificial Sequence
  Description of Artificial Sequence: Synthetic peptide
  Seed: TVCDSLDDYNH (TYRP2_HUMAN)
TSCDSLDDYNY

SEQ ID NO: 187055 - protein, 11 aa, Artificial Sequence
  Description of Artificial Sequence: Synthetic peptide
  Seed: FVVLHSFTDAI (TYRP2_HUMAN)
FVVLHSFTDAV

SEQ ID NO: 187056 - protein, 11 aa, Artificial Sequence
  Description of Artificial Sequence: Synthetic peptide
  Seed: YTPLMETHLSS (TYRP2_HUMAN)
YKPLMETHLSL

SEQ ID NO: 187057 - protein, 10 aa, Artificial Sequence
  Description of Artificial Sequence: Synthetic peptide
  Seed: SPLWWGFLLS (TYRP2_HUMAN)
SPLWWGFLLL

SEQ ID NO: 187058 - protein, 10 aa, Artificial Sequence
  Description of Artificial Sequence: Synthetic peptide
  Seed: TSDQLGYSYA (TYRP2_HUMAN)
TMDQLGYSYY

SEQ ID NO: 187059 - protein, 9 aa, Artificial Sequence
  Description of Artificial Sequence: Synthetic peptide
  Seed: ANDPIFVVL (TYRP2_HUMAN)
ACDPIFVVV

SEQ ID NO: 187060 - protein, 9 aa, Artificial Sequence
  Description of Artificial Sequence: Synthetic peptide
  Seed: VLLAFLQYR (TYRP2_HUMAN)
VYLAFLQYR

SEQ ID NO: 187061 - protein, 10 aa, Artificial Sequence
  Description of Artificial Sequence: Synthetic peptide
  Seed: LGPNGTQPQF (TYRP2_HUMAN)
LFPNGTQPQW

SEQ ID NO: 187062 - protein, 9 aa, Artificial Sequence
  Description of Artificial Sequence: Synthetic peptide
  Seed: SLHNLVHSF (TYRP2_HUMAN)
SRHNLVHSY

SEQ ID NO: 187063 - protein, 8 aa, Artificial Sequence
  Description of Artificial Sequence: Synthetic peptide
  Seed: WPQELAPI (TYRP2_HUMAN)
WPQELAPL

SEQ ID NO: 187064 - protein, 8 aa, Artificial Sequence
  Description of Artificial Sequence: Synthetic peptide
  Seed: LERDLQRL (TYRP2_HUMAN)
LQRDLQRV

SEQ ID NO: 187065 - protein, 10 aa, Artificial Sequence
  Description of Artificial Sequence: Synthetic peptide
  Seed: SDQLGYSYAI (TYRP2_HUMAN)
SYQLGYSYAL

SEQ ID NO: 187066 - protein, 9 aa, Artificial Sequence
  Description of Artificial Sequence: Synthetic peptide
  Seed: TSDQLGYSY (TYRP2_HUMAN)
TLDQLGYSY

SEQ ID NO: 187067 - protein, 9 aa, Artificial Sequence
  Description of Artificial Sequence: Synthetic peptide
  Seed: ALDLAKKRV (TYRP2_HUMAN)
ASDLAKKRV

SEQ ID NO: 187068 - protein, 10 aa, Artificial Sequence
  Description of Artificial Sequence: Synthetic peptide
  Seed: RPWSGPYILR (TYRP2_HUMAN)
RIWSGPYILR

SEQ ID NO: 187069 - protein, 10 aa, Artificial Sequence
  Description of Artificial Sequence: Synthetic peptide
  Seed: RNSRFSSWET (TYRP2_HUMAN)
RSSRFSSWEM

SEQ ID NO: 187070 - protein, 9 aa, Artificial Sequence
  Description of Artificial Sequence: Synthetic peptide
  Seed: RQNIHSLSP (TYRP2_HUMAN)
RRNIHSLSM

SEQ ID NO: 187071 - protein, 10 aa, Artificial Sequence
  Description of Artificial Sequence: Synthetic peptide
  Seed: GQFPRVCMTV (TYRP2_HUMAN)
GAFPRVCMTV

SEQ ID NO: 187072 - protein, 9 aa, Artificial Sequence
  Description of Artificial Sequence: Synthetic peptide
  Seed: HQGPAFVTW (TYRP2_HUMAN)
HEGPAFVTW

SEQ ID NO: 187073 - protein, 11 aa, Artificial Sequence
  Description of Artificial Sequence: Synthetic peptide
  Seed: YNMVPFFPPVT (TYRP2_HUMAN)
YVMVPFFPPVT

SEQ ID NO: 187074 - protein, 10 aa, Artificial Sequence
  Description of Artificial Sequence: Synthetic peptide
  Seed: FFPPVTNEEL (TYRP2_HUMAN)
FCPPVTNEEL

SEQ ID NO: 187075 - protein, 9 aa, Artificial Sequence
  Description of Artificial Sequence: Synthetic peptide
  Seed: FFQNSTFSF (TYRP2_HUMAN)
FSQNSTFSF

SEQ ID NO: 187076 - protein, 9 aa, Artificial Sequence
  Description of Artificial Sequence: Synthetic peptide
  Seed: FFQNSTFSF (TYRP2_HUMAN)
FPQNSTFSL

SEQ ID NO: 187077 - protein, 10 aa, Artificial Sequence
  Description of Artificial Sequence: Synthetic peptide
  Seed: HNRMYNMVPF (TYRP2_HUMAN)
HERMYNMVPM

SEQ ID NO: 187078 - protein, 9 aa, Artificial Sequence
  Description of Artificial Sequence: Synthetic peptide
  Seed: NRMYNMVPF (TYRP2_HUMAN)
NMMYNMVPY

SEQ ID NO: 187079 - protein, 10 aa, Artificial Sequence
  Description of Artificial Sequence: Synthetic peptide
  Seed: AARPDDPTLI (TYRP2_HUMAN)
AQRPDDPTLL

SEQ ID NO: 187080 - protein, 9 aa, Artificial Sequence
  Description of Artificial Sequence: Synthetic peptide
  Seed: IFDEWMKRF (TYRP2_HUMAN)
ITDEWMKRI

SEQ ID NO: 187081 - protein, 10 aa, Artificial Sequence
  Description of Artificial Sequence: Synthetic peptide
  Seed: AIFDEWMKRF (TYRP2_HUMAN)
AMFDEWMKRY

SEQ ID NO: 187082 - protein, 9 aa, Artificial Sequence
  Description of Artificial Sequence: Synthetic peptide
  Seed: SRNSRFSSW (TYRP2_HUMAN)
SYNSRFSSM

SEQ ID NO: 187083 - protein, 11 aa, Artificial Sequence
  Description of Artificial Sequence: Synthetic peptide
  Seed: PFFQNSTFSFR (TYRP2_HUMAN)
PLFQNSTFSFR

SEQ ID NO: 187084 - protein, 10 aa, Artificial Sequence
  Description of Artificial Sequence: Synthetic peptide
  Seed: CCPRLGAESA (TYRP2_HUMAN)
CHPRLGAESL

SEQ ID NO: 187085 - protein, 10 aa, Artificial Sequence
  Description of Artificial Sequence: Synthetic peptide
  Seed: LTSDQLGYSY (TYRP2_HUMAN)
LQSDQLGYSM

SEQ ID NO: 187086 - protein, 9 aa, Artificial Sequence
  Description of Artificial Sequence: Synthetic peptide
  Seed: HSAANDPIF (TYRP2_HUMAN)
HAAANDPIF

SEQ ID NO: 187087 - protein, 9 aa, Artificial Sequence
  Description of Artificial Sequence: Synthetic peptide
  Seed: VMGTLVALV (TYRP2_HUMAN)
VLGTLVALR

SEQ ID NO: 187088 - protein, 10 aa, Artificial Sequence
  Description of Artificial Sequence: Synthetic peptide
  Seed: GQFPRVCMTV (TYRP2_HUMAN)
GQFPRVCMTM

SEQ ID NO: 187089 - protein, 10 aa, Artificial Sequence
  Description of Artificial Sequence: Synthetic peptide
  Seed: QELAPIGHNR (TYRP2_HUMAN)
QTLAPIGHNK

SEQ ID NO: 187090 - protein, 10 aa, Artificial Sequence
  Description of Artificial Sequence: Synthetic peptide
  Seed: KILPGAQGQF (TYRP2_HUMAN)
KSLPGAQGQF

SEQ ID NO: 187091 - protein, 10 aa, Artificial Sequence
  Description of Artificial Sequence: Synthetic peptide
  Seed: LVVMGTLVAL (TYRP2_HUMAN)
LLVMGTLVAF

SEQ ID NO: 187092 - protein, 9 aa, Artificial Sequence
  Description of Artificial Sequence: Synthetic peptide
  Seed: FPPVTNEEL (TYRP2_HUMAN)
FRPVTNEEF

SEQ ID NO: 187093 - protein, 9 aa, Artificial Sequence
  Description of Artificial Sequence: Synthetic peptide
  Seed: TSDQLGYSY (TYRP2_HUMAN)
TMDQLGYSF

SEQ ID NO: 187094 - protein, 9 aa, Artificial Sequence
  Description of Artificial Sequence: Synthetic peptide
  Seed: RLRKGYTPL (TYRP2_HUMAN)
RNRKGYTPA

SEQ ID NO: 187095 - protein, 10 aa, Artificial Sequence
  Description of Artificial Sequence: Synthetic peptide
  Seed: FFPPVTNEEL (TYRP2_HUMAN)
FYPPVTNEEY

SEQ ID NO: 187096 - protein, 9 aa, Artificial Sequence
  Description of Artificial Sequence: Synthetic peptide
  Seed: RLRKGYTPL (TYRP2_HUMAN)
RNRKGYTPI

SEQ ID NO: 187097 - protein, 9 aa, Artificial Sequence
  Description of Artificial Sequence: Synthetic peptide
  Seed: YAIDLPVSV (TYRP2_HUMAN)
YMIDLPVSK

SEQ ID NO: 187098 - protein, 9 aa, Artificial Sequence
  Description of Artificial Sequence: Synthetic peptide
  Seed: ETPGWPTTL (TYRP2_HUMAN)
EAPGWPTTV

SEQ ID NO: 187099 - protein, 10 aa, Artificial Sequence
  Description of Artificial Sequence: Synthetic peptide
  Seed: VLHSFTDAIF (TYRP2_HUMAN)
VQHSFTDAIM

SEQ ID NO: 187100 - protein, 9 aa, Artificial Sequence
  Description of Artificial Sequence: Synthetic peptide
  Seed: ANDPIFVVL (TYRP2_HUMAN)
AYDPIFVVM

SEQ ID NO: 187101 - protein, 9 aa, Artificial Sequence
  Description of Artificial Sequence: Synthetic peptide
  Seed: DDYNHLVTL (TYRP2_HUMAN)
DEYNHLVTT

SEQ ID NO: 187102 - protein, 9 aa, Artificial Sequence
  Description of Artificial Sequence: Synthetic peptide
  Seed: RPWSGPYIL (TYRP2_HUMAN)
RAWSGPYIL

SEQ ID NO: 187103 - protein, 9 aa, Artificial Sequence
  Description of Artificial Sequence: Synthetic peptide
  Seed: DSLDDYNHL (TYRP2_HUMAN)
DVLDDYNHK

SEQ ID NO: 187104 - protein, 10 aa, Artificial Sequence
  Description of Artificial Sequence: Synthetic peptide
  Seed: RLIGNESFAL (TYRP2_HUMAN)
RLIGNESFAF

SEQ ID NO: 187105 - protein, 9 aa, Artificial Sequence
  Description of Artificial Sequence: Synthetic peptide
  Seed: FTDAIFDEW (TYRP2_HUMAN)
FNDAIFDEF

SEQ ID NO: 187106 - protein, 11 aa, Artificial Sequence
  Description of Artificial Sequence: Synthetic peptide
  Seed: ANCSVYDFFVW (TYRP2_HUMAN)
ARCSVYDFFVW

SEQ ID NO: 187107 - protein, 9 aa, Artificial Sequence
  Description of Artificial Sequence: Synthetic peptide
  Seed: YAIDLPVSV (TYRP2_HUMAN)
YEIDLPVSF

SEQ ID NO: 187108 - protein, 9 aa, Artificial Sequence
  Description of Artificial Sequence: Synthetic peptide
  Seed: MTVDSLVNK (TYRP2_HUMAN)
MAVDSLVNK

SEQ ID NO: 187109 - protein, 9 aa, Artificial Sequence
  Description of Artificial Sequence: Synthetic peptide
  Seed: TLVALVGLF (TYRP2_HUMAN)
TYVALVGLI

SEQ ID NO: 187110 - protein, 10 aa, Artificial Sequence
  Description of Artificial Sequence: Synthetic peptide
  Seed: MSPLWWGFLL (TYRP2_HUMAN)
MYPLWWGFLA

SEQ ID NO: 187111 - protein, 10 aa, Artificial Sequence
  Description of Artificial Sequence: Synthetic peptide
  Seed: FVWLHYYSVR (TYRP2_HUMAN)
FLWLHYYSVL

SEQ ID NO: 187112 - protein, 10 aa, Artificial Sequence
  Description of Artificial Sequence: Synthetic peptide
  Seed: GTLDSQVMSL (TYRP2_HUMAN)
GMLDSQVMSL

SEQ ID NO: 187113 - protein, 11 aa, Artificial Sequence
  Description of Artificial Sequence: Synthetic peptide
  Seed: RADTRPWSGPY (TYRP2_HUMAN)
RGDTRPWSGPA

SEQ ID NO: 187114 - protein, 9 aa, Artificial Sequence
  Description of Artificial Sequence: Synthetic peptide
  Seed: STFSFRNAL (TYRP2_HUMAN)
SGFSFRNAM

SEQ ID NO: 187115 - protein, 9 aa, Artificial Sequence
  Description of Artificial Sequence: Synthetic peptide
  Seed: QEREQFLGA (TYRP2_HUMAN)
QEREQFLGL

SEQ ID NO: 187116 - protein, 9 aa, Artificial Sequence
  Description of Artificial Sequence: Synthetic peptide
  Seed: AANDPIFVV (TYRP2_HUMAN)
AINDPIFVW

SEQ ID NO: 187117 - protein, 9 aa, Artificial Sequence
  Description of Artificial Sequence: Synthetic peptide
  Seed: TLDSQVMSL (TYRP2_HUMAN)
TFDSQVMSC

SEQ ID NO: 187118 - protein, 9 aa, Artificial Sequence
  Description of Artificial Sequence: Synthetic peptide
  Seed: ISRNSRFSS (TYRP2_HUMAN)
INRNSRFSK

SEQ ID NO: 187119 - protein, 10 aa, Artificial Sequence
  Description of Artificial Sequence: Synthetic peptide
  Seed: VVMGTLVALV (TYRP2_HUMAN)
VVMGTLVALI

SEQ ID NO: 187120 - protein, 10 aa, Artificial Sequence
  Description of Artificial Sequence: Synthetic peptide
  Seed: NSTFSFRNAL (TYRP2_HUMAN)
NTTFSFRNAL

SEQ ID NO: 187121 - protein, 9 aa, Artificial Sequence
  Description of Artificial Sequence: Synthetic peptide
  Seed: YSYAIDLPV (TYRP2_HUMAN)
YLYAIDLPW

SEQ ID NO: 187122 - protein, 8 aa, Artificial Sequence
  Description of Artificial Sequence: Synthetic peptide
  Seed: LDDYNHLV (TYRP2_HUMAN)
LFDYNHLV

SEQ ID NO: 187123 - protein, 10 aa, Artificial Sequence
  Description of Artificial Sequence: Synthetic peptide
  Seed: SLQKFDNPPF (TYRP2_HUMAN)
SGQKFDNPPY

SEQ ID NO: 187124 - protein, 11 aa, Artificial Sequence
  Description of Artificial Sequence: Synthetic peptide
  Seed: YTPLMETHLSS (TYRP2_HUMAN)
YYPLMETHLST

SEQ ID NO: 187125 - protein, 10 aa, Artificial Sequence
  Description of Artificial Sequence: Synthetic peptide
  Seed: FSFRNALEGF (TYRP2_HUMAN)
FFFRNALEGF

SEQ ID NO: 187126 - protein, 10 aa, Artificial Sequence
  Description of Artificial Sequence: Synthetic peptide
  Seed: REQFLGALDL (TYRP2_HUMAN)
RYQFLGALDL

SEQ ID NO: 187127 - protein, 9 aa, Artificial Sequence
  Description of Artificial Sequence: Synthetic peptide
  Seed: FPPVTNEEL (TYRP2_HUMAN)
FIPVTNEEY

SEQ ID NO: 187128 - protein, 9 aa, Artificial Sequence
  Description of Artificial Sequence: Synthetic peptide
  Seed: HSAANDPIF (TYRP2_HUMAN)
HSAANDPIY

SEQ ID NO: 187129 - protein, 9 aa, Artificial Sequence
  Description of Artificial Sequence: Synthetic peptide
  Seed: SRFSSWETV (TYRP2_HUMAN)
SEFSSWETY

SEQ ID NO: 187130 - protein, 10 aa, Artificial Sequence
  Description of Artificial Sequence: Synthetic peptide
  Seed: SLDDYNHLVT (TYRP2_HUMAN)
SNDDYNHLVL

SEQ ID NO: 187131 - protein, 9 aa, Artificial Sequence
  Description of Artificial Sequence: Synthetic peptide
  Seed: SVYDFFVWL (TYRP2_HUMAN)
SVYDFFVWW

SEQ ID NO: 187132 - protein, 10 aa, Artificial Sequence
  Description of Artificial Sequence: Synthetic peptide
  Seed: RLRKGYTPLM (TYRP2_HUMAN)
RIRKGYTPLF

SEQ ID NO: 187133 - protein, 9 aa, Artificial Sequence
  Description of Artificial Sequence: Synthetic peptide
  Seed: VSVEETPGW (TYRP2_HUMAN)
VLVEETPGL

SEQ ID NO: 187134 - protein, 10 aa, Artificial Sequence
  Description of Artificial Sequence: Synthetic peptide
  Seed: HRYHLLCLER (TYRP2_HUMAN)
HRYHLLCLEL

SEQ ID NO: 187135 - protein, 11 aa, Artificial Sequence
  Description of Artificial Sequence: Synthetic peptide
  Seed: YTPLMETHLSS (TYRP2_HUMAN)
YRPLMETHLST

SEQ ID NO: 187136 - protein, 10 aa, Artificial Sequence
  Description of Artificial Sequence: Synthetic peptide
  Seed: REQFLGALDL (TYRP2_HUMAN)
RSQFLGALDY

SEQ ID NO: 187137 - protein, 9 aa, Artificial Sequence
  Description of Artificial Sequence: Synthetic peptide
  Seed: ANDPIFVVL (TYRP2_HUMAN)
ARDPIFVVF

SEQ ID NO: 187138 - protein, 9 aa, Artificial Sequence
  Description of Artificial Sequence: Synthetic peptide
  Seed: TSDQLGYSY (TYRP2_HUMAN)
TYDQLGYSL

SEQ ID NO: 187139 - protein, 9 aa, Artificial Sequence
  Description of Artificial Sequence: Synthetic peptide
  Seed: VHPDYVITT (TYRP2_HUMAN)
VSPDYVITL

SEQ ID NO: 187140 - protein, 10 aa, Artificial Sequence
  Description of Artificial Sequence: Synthetic peptide
  Seed: RTCKCTGNFA (TYRP2_HUMAN)
RTCKCTGNFM

SEQ ID NO: 187141 - protein, 10 aa, Artificial Sequence
  Description of Artificial Sequence: Synthetic peptide
  Seed: FSFRNALEGF (TYRP2_HUMAN)
FVFRNALEGY

SEQ ID NO: 187142 - protein, 9 aa, Artificial Sequence
  Description of Artificial Sequence: Synthetic peptide
  Seed: SLHNLVHSF (TYRP2_HUMAN)
SSHNLVHSY

SEQ ID NO: 187143 - protein, 9 aa, Artificial Sequence
  Description of Artificial Sequence: Synthetic peptide
  Seed: IDFSHQGPA (TYRP2_HUMAN)
IEFSHQGPA

SEQ ID NO: 187144 - protein, 9 aa, Artificial Sequence
  Description of Artificial Sequence: Synthetic peptide
  Seed: AARPDDPTL (TYRP2_HUMAN)
AERPDDPTM

SEQ ID NO: 187145 - protein, 10 aa, Artificial Sequence
  Description of Artificial Sequence: Synthetic peptide
  Seed: RNQMGRNSMK (TYRP2_HUMAN)
RPQMGRNSMR

SEQ ID NO: 187146 - protein, 9 aa, Artificial Sequence
  Description of Artificial Sequence: Synthetic peptide
  Seed: SFLNGTNAL (TYRP2_HUMAN)
SVLNGTNAY

SEQ ID NO: 187147 - protein, 10 aa, Artificial Sequence
  Description of Artificial Sequence: Synthetic peptide
  Seed: RRLRKGYTPL (TYRP2_HUMAN)
RVLRKGYTPV

SEQ ID NO: 187148 - protein, 9 aa, Artificial Sequence
  Description of Artificial Sequence: Synthetic peptide
  Seed: RVHPDYVIT (TYRP2_HUMAN)
RSHPDYVIK

SEQ ID NO: 187149 - protein, 11 aa, Artificial Sequence
  Description of Artificial Sequence: Synthetic peptide
  Seed: FANCSVYDFFV (TYRP2_HUMAN)
FQNCSVYDFFI

SEQ ID NO: 187150 - protein, 9 aa, Artificial Sequence
  Description of Artificial Sequence: Synthetic peptide
  Seed: YYSVRDTLL (TYRP2_HUMAN)
YRSVRDTLF

SEQ ID NO: 187151 - protein, 9 aa, Artificial Sequence
  Description of Artificial Sequence: Synthetic peptide
  Seed: GTYEGLLRR (TYRP2_HUMAN)
GLYEGLLRH

SEQ ID NO: 187152 - protein, 9 aa, Artificial Sequence
  Description of Artificial Sequence: Synthetic peptide
  Seed: VIRQNIHSL (TYRP2_HUMAN)
VARQNIHSH

SEQ ID NO: 187153 - protein, 9 aa, Artificial Sequence
  Description of Artificial Sequence: Synthetic peptide
  Seed: MSPLWWGFL (TYRP2_HUMAN)
MYPLWWGFI

SEQ ID NO: 187154 - protein, 11 aa, Artificial Sequence
  Description of Artificial Sequence: Synthetic peptide
  Seed: RNSRFSSWETV (TYRP2_HUMAN)
RQSRFSSWETM

SEQ ID NO: 187155 - protein, 9 aa, Artificial Sequence
  Description of Artificial Sequence: Synthetic peptide
  Seed: LLSCLGCKI (TYRP2_HUMAN)
LMSCLGCKM

SEQ ID NO: 187156 - protein, 9 aa, Artificial Sequence
  Description of Artificial Sequence: Synthetic peptide
  Seed: SPLWWGFLL (TYRP2_HUMAN)
SVLWWGFLI

SEQ ID NO: 187157 - protein, 9 aa, Artificial Sequence
  Description of Artificial Sequence: Synthetic peptide
  Seed: VLLAFLQYR (TYRP2_HUMAN)
VALAFLQYK

SEQ ID NO: 187158 - protein, 10 aa, Artificial Sequence
  Description of Artificial Sequence: Synthetic peptide
  Seed: CMTVDSLVNK (TYRP2_HUMAN)
CYTVDSLVNK

SEQ ID NO: 187159 - protein, 9 aa, Artificial Sequence
  Description of Artificial Sequence: Synthetic peptide
  Seed: STFSFRNAL (TYRP2_HUMAN)
SVFSFRNAA

SEQ ID NO: 187160 - protein, 9 aa, Artificial Sequence
  Description of Artificial Sequence: Synthetic peptide
  Seed: VIRQNIHSL (TYRP2_HUMAN)
VPRQNIHSY

SEQ ID NO: 187161 - protein, 9 aa, Artificial Sequence
  Description of Artificial Sequence: Synthetic peptide
  Seed: FANCSVYDF (TYRP2_HUMAN)
FPNCSVYDF

SEQ ID NO: 187162 - protein, 10 aa, Artificial Sequence
  Description of Artificial Sequence: Synthetic peptide
  Seed: LLGPGRPYRA (TYRP2_HUMAN)
LLGPGRPYRV

SEQ ID NO: 187163 - protein, 10 aa, Artificial Sequence
  Description of Artificial Sequence: Synthetic peptide
  Seed: MSPLWWGFLL (TYRP2_HUMAN)
MVPLWWGFLW

SEQ ID NO: 187164 - protein, 9 aa, Artificial Sequence
  Description of Artificial Sequence: Synthetic peptide
  Seed: LQKFDNPPF (TYRP2_HUMAN)
LMKFDNPPY

SEQ ID NO: 187165 - protein, 9 aa, Artificial Sequence
  Description of Artificial Sequence: Synthetic peptide
  Seed: RLRKGYTPL (TYRP2_HUMAN)
RIRKGYTPV

SEQ ID NO: 187166 - protein, 9 aa, Artificial Sequence
  Description of Artificial Sequence: Synthetic peptide
  Seed: YAIDLPVSV (TYRP2_HUMAN)
YNIDLPVSV

SEQ ID NO: 187167 - protein, 9 aa, Artificial Sequence
  Description of Artificial Sequence: Synthetic peptide
  Seed: FLGALDLAK (TYRP2_HUMAN)
FTGALDLAY

SEQ ID NO: 187168 - protein, 9 aa, Artificial Sequence
  Description of Artificial Sequence: Synthetic peptide
  Seed: DDYNHLVTL (TYRP2_HUMAN)
DAYNHLVTV

SEQ ID NO: 187169 - protein, 8 aa, Artificial Sequence
  Description of Artificial Sequence: Synthetic peptide
  Seed: RPDDPTLI (TYRP2_HUMAN)
RIDDPTLM

SEQ ID NO: 187170 - protein, 9 aa, Artificial Sequence
  Description of Artificial Sequence: Synthetic peptide
  Seed: FVWLHYYSV (TYRP2_HUMAN)
FPWLHYYSV

SEQ ID NO: 187171 - protein, 9 aa, Artificial Sequence
  Description of Artificial Sequence: Synthetic peptide
  Seed: YVITTQHWL (TYRP2_HUMAN)
YMITTQHWI

SEQ ID NO: 187172 - protein, 10 aa, Artificial Sequence
  Description of Artificial Sequence: Synthetic peptide
  Seed: RNSRFSSWET (TYRP2_HUMAN)
RASRFSSWEI

SEQ ID NO: 187173 - protein, 10 aa, Artificial Sequence
  Description of Artificial Sequence: Synthetic peptide
  Seed: LVGLFVLLAF (TYRP2_HUMAN)
LQGLFVLLAY

SEQ ID NO: 187174 - protein, 9 aa, Artificial Sequence
  Description of Artificial Sequence: Synthetic peptide
  Seed: LHNLVHSFL (TYRP2_HUMAN)
LHNLVHSFY

SEQ ID NO: 187175 - protein, 10 aa, Artificial Sequence
  Description of Artificial Sequence: Synthetic peptide
  Seed: MSPLWWGFLL (TYRP2_HUMAN)
MDPLWWGFLY

SEQ ID NO: 187176 - protein, 10 aa, Artificial Sequence
  Description of Artificial Sequence: Synthetic peptide
  Seed: RNSRFSSWET (TYRP2_HUMAN)
RYSRFSSWES

SEQ ID NO: 187177 - protein, 10 aa, Artificial Sequence
  Description of Artificial Sequence: Synthetic peptide
  Seed: LGPGRPYRAI (TYRP2_HUMAN)
LMPGRPYRAL

SEQ ID NO: 187178 - protein, 10 aa, Artificial Sequence
  Description of Artificial Sequence: Synthetic peptide
  Seed: SLSPQEREQF (TYRP2_HUMAN)
SLSPQEREQL

SEQ ID NO: 187179 - protein, 10 aa, Artificial Sequence
  Description of Artificial Sequence: Synthetic peptide
  Seed: HSFLNGTNAL (TYRP2_HUMAN)
HKFLNGTNAL

SEQ ID NO: 187180 - protein, 10 aa, Artificial Sequence
  Description of Artificial Sequence: Synthetic peptide
  Seed: QLGYSYAIDL (TYRP2_HUMAN)
QLGYSYAIDV

SEQ ID NO: 187181 - protein, 9 aa, Artificial Sequence
  Description of Artificial Sequence: Synthetic peptide
  Seed: AARPDDPTL (TYRP2_HUMAN)
AGRPDDPTY

SEQ ID NO: 187182 - protein, 11 aa, Artificial Sequence
  Description of Artificial Sequence: Synthetic peptide
  Seed: YNMVPFFPPVT (TYRP2_HUMAN)
YIMVPFFPPVT

SEQ ID NO: 187183 - protein, 9 aa, Artificial Sequence
  Description of Artificial Sequence: Synthetic peptide
  Seed: ALDLAKKRV (TYRP2_HUMAN)
ASDLAKKRL

SEQ ID NO: 187184 - protein, 10 aa, Artificial Sequence
  Description of Artificial Sequence: Synthetic peptide
  Seed: VGLFVLLAFL (TYRP2_HUMAN)
VFLFVLLAFL

SEQ ID NO: 187185 - protein, 10 aa, Artificial Sequence
  Description of Artificial Sequence: Synthetic peptide
  Seed: FLLSCLGCKI (TYRP2_HUMAN)
FVLSCLGCKM

SEQ ID NO: 187186 - protein, 9 aa, Artificial Sequence
  Description of Artificial Sequence: Synthetic peptide
  Seed: LLAFLQYRR (TYRP2_HUMAN)
LSAFLQYRK

SEQ ID NO: 187187 - protein, 9 aa, Artificial Sequence
  Description of Artificial Sequence: Synthetic peptide
  Seed: FVWLHYYSV (TYRP2_HUMAN)
FLWLHYYSL

SEQ ID NO: 187188 - protein, 9 aa, Artificial Sequence
  Description of Artificial Sequence: Synthetic peptide
  Seed: RDCLSLQKF (TYRP2_HUMAN)
RQCLSLQKM

SEQ ID NO: 187189 - protein, 9 aa, Artificial Sequence
  Description of Artificial Sequence: Synthetic peptide
  Seed: ISRNSRFSS (TYRP2_HUMAN)
IMRNSRFSA

SEQ ID NO: 187190 - protein, 10 aa, Artificial Sequence
  Description of Artificial Sequence: Synthetic peptide
  Seed: ADTRPWSGPY (TYRP2_HUMAN)
AWTRPWSGPK

SEQ ID NO: 187191 - protein, 10 aa, Artificial Sequence
  Description of Artificial Sequence: Synthetic peptide
  Seed: TLDSQVMSLH (TYRP2_HUMAN)
TSDSQVMSLY

SEQ ID NO: 187192 - protein, 9 aa, Artificial Sequence
  Description of Artificial Sequence: Synthetic peptide
  Seed: EQFLGALDL (TYRP2_HUMAN)
EHFLGALDL

SEQ ID NO: 187193 - protein, 8 aa, Artificial Sequence
  Description of Artificial Sequence: Synthetic peptide
  Seed: FQNSTFSF (TYRP2_HUMAN)
FANSTFSM

SEQ ID NO: 187194 - protein, 9 aa, Artificial Sequence
  Description of Artificial Sequence: Synthetic peptide
  Seed: QFPRVCMTV (TYRP2_HUMAN)
QWPRVCMTF

SEQ ID NO: 187195 - protein, 9 aa, Artificial Sequence
  Description of Artificial Sequence: Synthetic peptide
  Seed: TQHWLGLLG (TYRP2_HUMAN)
THHWLGLLF

SEQ ID NO: 187196 - protein, 9 aa, Artificial Sequence
  Description of Artificial Sequence: Synthetic peptide
  Seed: FFQNSTFSF (TYRP2_HUMAN)
FYQNSTFSY

SEQ ID NO: 187197 - protein, 9 aa, Artificial Sequence
  Description of Artificial Sequence: Synthetic peptide
  Seed: HQGPAFVTW (TYRP2_HUMAN)
HAGPAFVTY

SEQ ID NO: 187198 - protein, 11 aa, Artificial Sequence
  Description of Artificial Sequence: Synthetic peptide
  Seed: CDSLDDYNHLV (TYRP2_HUMAN)
CCSLDDYNHLV

SEQ ID NO: 187199 - protein, 10 aa, Artificial Sequence
  Description of Artificial Sequence: Synthetic peptide
  Seed: KADGTLDSQV (TYRP2_HUMAN)
KVDGTLDSQL

SEQ ID NO: 187200 - protein, 8 aa, Artificial Sequence
  Description of Artificial Sequence: Synthetic peptide
  Seed: MVPFFPPV (TYRP2_HUMAN)
MLPFFPPV

SEQ ID NO: 187201 - protein, 10 aa, Artificial Sequence
  Description of Artificial Sequence: Synthetic peptide
  Seed: SPLWWGFLLS (TYRP2_HUMAN)
SSLWWGFLLI

SEQ ID NO: 187202 - protein, 9 aa, Artificial Sequence
  Description of Artificial Sequence: Synthetic peptide
  Seed: VYDFFVWLH (TYRP2_HUMAN)
VADFFVWLY

SEQ ID NO: 187203 - protein, 9 aa, Artificial Sequence
  Description of Artificial Sequence: Synthetic peptide
  Seed: SLHNLVHSF (TYRP2_HUMAN)
SMHNLVHSL

SEQ ID NO: 187204 - protein, 10 aa, Artificial Sequence
  Description of Artificial Sequence: Synthetic peptide
  Seed: FPPVTNEELF (TYRP2_HUMAN)
FKPVTNEELW

SEQ ID NO: 187205 - protein, 9 aa, Artificial Sequence
  Description of Artificial Sequence: Synthetic peptide
  Seed: SLHNLVHSF (TYRP2_HUMAN)
SMHNLVHSF

SEQ ID NO: 187206 - protein, 9 aa, Artificial Sequence
  Description of Artificial Sequence: Synthetic peptide
  Seed: HYYSVRDTL (TYRP2_HUMAN)
HTYSVRDTY

SEQ ID NO: 187207 - protein, 9 aa, Artificial Sequence
  Description of Artificial Sequence: Synthetic peptide
  Seed: KCTGNFAGY (TYRP2_HUMAN)
KQTGNFAGF

SEQ ID NO: 187208 - protein, 9 aa, Artificial Sequence
  Description of Artificial Sequence: Synthetic peptide
  Seed: STFSFRNAL (TYRP2_HUMAN)
SVFSFRNAL

SEQ ID NO: 187209 - protein, 9 aa, Artificial Sequence
  Description of Artificial Sequence: Synthetic peptide
  Seed: LLGPGRPYR (TYRP2_HUMAN)
LTGPGRPYK

SEQ ID NO: 187210 - protein, 9 aa, Artificial Sequence
  Description of Artificial Sequence: Synthetic peptide
  Seed: RLIGNESFA (TYRP2_HUMAN)
RVIGNESFL

SEQ ID NO: 187211 - protein, 8 aa, Artificial Sequence
  Description of Artificial Sequence: Synthetic peptide
  Seed: FSHQGPAF (TYRP2_HUMAN)
FLHQGPAL

SEQ ID NO: 187212 - protein, 10 aa, Artificial Sequence
  Description of Artificial Sequence: Synthetic peptide
  Seed: EETPGWPTTL (TYRP2_HUMAN)
EHTPGWPTTM

SEQ ID NO: 187213 - protein, 9 aa, Artificial Sequence
  Description of Artificial Sequence: Synthetic peptide
  Seed: ELWPRKFFH (TYRP2_HUMAN)
EIWPRKFFK

SEQ ID NO: 187214 - protein, 10 aa, Artificial Sequence
  Description of Artificial Sequence: Synthetic peptide
  Seed: LHYYSVRDTL (TYRP2_HUMAN)
LHYYSVRDTM

SEQ ID NO: 187215 - protein, 9 aa, Artificial Sequence
  Description of Artificial Sequence: Synthetic peptide
  Seed: SVRDTLLGP (TYRP2_HUMAN)
SSRDTLLGL

SEQ ID NO: 187216 - protein, 9 aa, Artificial Sequence
  Description of Artificial Sequence: Synthetic peptide
  Seed: ANDPIFVVL (TYRP2_HUMAN)
AEDPIFVVI

SEQ ID NO: 187217 - protein, 9 aa, Artificial Sequence
  Description of Artificial Sequence: Synthetic peptide
  Seed: ESANVCGSQ (TYRP2_HUMAN)
EAANVCGSR

SEQ ID NO: 187218 - protein, 9 aa, Artificial Sequence
  Description of Artificial Sequence: Synthetic peptide
  Seed: SVYDFFVWL (TYRP2_HUMAN)
SVYDFFVWI

SEQ ID NO: 187219 - protein, 9 aa, Artificial Sequence
  Description of Artificial Sequence: Synthetic peptide
  Seed: YAIDLPVSV (TYRP2_HUMAN)
YYIDLPVSW

SEQ ID NO: 187220 - protein, 10 aa, Artificial Sequence
  Description of Artificial Sequence: Synthetic peptide
  Seed: QPQFANCSVY (TYRP2_HUMAN)
QEQFANCSVF

SEQ ID NO: 187221 - protein, 10 aa, Artificial Sequence
  Description of Artificial Sequence: Synthetic peptide
  Seed: YAIDLPVSVE (TYRP2_HUMAN)
YLIDLPVSVY

SEQ ID NO: 187222 - protein, 10 aa, Artificial Sequence
  Description of Artificial Sequence: Synthetic peptide
  Seed: NPPFFQNSTF (TYRP2_HUMAN)
NYPFFQNSTW

SEQ ID NO: 187223 - protein, 11 aa, Artificial Sequence
  Description of Artificial Sequence: Synthetic peptide
  Seed: ESFALPYWNFA (TYRP2_HUMAN)
ETFALPYWNFL

SEQ ID NO: 187224 - protein, 8 aa, Artificial Sequence
  Description of Artificial Sequence: Synthetic peptide
  Seed: AIDLPVSV (TYRP2_HUMAN)
AYDLPVSI

SEQ ID NO: 187225 - protein, 9 aa, Artificial Sequence
  Description of Artificial Sequence: Synthetic peptide
  Seed: VVMGTLVAL (TYRP2_HUMAN)
VFMGTLVAY

SEQ ID NO: 187226 - protein, 11 aa, Artificial Sequence
  Description of Artificial Sequence: Synthetic peptide
  Seed: FVVLHSFTDAI (TYRP2_HUMAN)
FQVLHSFTDAV

SEQ ID NO: 187227 - protein, 9 aa, Artificial Sequence
  Description of Artificial Sequence: Synthetic peptide
  Seed: LLRRNQMGR (TYRP2_HUMAN)
LTRRNQMGR

SEQ ID NO: 187228 - protein, 9 aa, Artificial Sequence
  Description of Artificial Sequence: Synthetic peptide
  Seed: RPWSGPYIL (TYRP2_HUMAN)
RTWSGPYII

SEQ ID NO: 187229 - protein, 9 aa, Artificial Sequence
  Description of Artificial Sequence: Synthetic peptide
  Seed: RLRKGYTPL (TYRP2_HUMAN)
RARKGYTPC

SEQ ID NO: 187230 - protein, 9 aa, Artificial Sequence
  Description of Artificial Sequence: Synthetic peptide
  Seed: YDFFVWLHY (TYRP2_HUMAN)
YEFFVWLHM

SEQ ID NO: 187231 - protein, 10 aa, Artificial Sequence
  Description of Artificial Sequence: Synthetic peptide
  Seed: GTLDSQVMSL (TYRP2_HUMAN)
GVLDSQVMSW

SEQ ID NO: 187232 - protein, 9 aa, Artificial Sequence
  Description of Artificial Sequence: Synthetic peptide
  Seed: AARPDDPTL (TYRP2_HUMAN)
AQRPDDPTL

SEQ ID NO: 187233 - protein, 9 aa, Artificial Sequence
  Description of Artificial Sequence: Synthetic peptide
  Seed: NMVPFFPPV (TYRP2_HUMAN)
NVVPFFPPV

SEQ ID NO: 187234 - protein, 9 aa, Artificial Sequence
  Description of Artificial Sequence: Synthetic peptide
  Seed: STFSFRNAL (TYRP2_HUMAN)
SMFSFRNAI

SEQ ID NO: 187235 - protein, 9 aa, Artificial Sequence
  Description of Artificial Sequence: Synthetic peptide
  Seed: ALVGLFVLL (TYRP2_HUMAN)
ALVGLFVLM

SEQ ID NO: 187236 - protein, 10 aa, Artificial Sequence
  Description of Artificial Sequence: Synthetic peptide
  Seed: RLIGNESFAL (TYRP2_HUMAN)
RRIGNESFAY

SEQ ID NO: 187237 - protein, 10 aa, Artificial Sequence
  Description of Artificial Sequence: Synthetic peptide
  Seed: SAANDPIFVV (TYRP2_HUMAN)
SQANDPIFVV

SEQ ID NO: 187238 - protein, 11 aa, Artificial Sequence
  Description of Artificial Sequence: Synthetic peptide
  Seed: RMYNMVPFFPP (TYRP2_HUMAN)
RLYNMVPFFPI

SEQ ID NO: 187239 - protein, 10 aa, Artificial Sequence
  Description of Artificial Sequence: Synthetic peptide
  Seed: TDAIFDEWMK (TYRP2_HUMAN)
TAAIFDEWMR

SEQ ID NO: 187240 - protein, 10 aa, Artificial Sequence
  Description of Artificial Sequence: Synthetic peptide
  Seed: MSLHNLVHSF (TYRP2_HUMAN)
MFLHNLVHSF

SEQ ID NO: 187241 - protein, 10 aa, Artificial Sequence
  Description of Artificial Sequence: Synthetic peptide
  Seed: ELAPIGHNRM (TYRP2_HUMAN)
EAAPIGHNRY

SEQ ID NO: 187242 - protein, 10 aa, Artificial Sequence
  Description of Artificial Sequence: Synthetic peptide
  Seed: RNSRFSSWET (TYRP2_HUMAN)
RISRFSSWEI

SEQ ID NO: 187243 - protein, 9 aa, Artificial Sequence
  Description of Artificial Sequence: Synthetic peptide
  Seed: AARPDDPTL (TYRP2_HUMAN)
APRPDDPTA

SEQ ID NO: 187244 - protein, 11 aa, Artificial Sequence
  Description of Artificial Sequence: Synthetic peptide
  Seed: RELWPRKFFHR (TYRP2_HUMAN)
RSLWPRKFFHR

SEQ ID NO: 187245 - protein, 10 aa, Artificial Sequence
  Description of Artificial Sequence: Synthetic peptide
  Seed: AANDPIFVVL (TYRP2_HUMAN)
ASNDPIFVVL

SEQ ID NO: 187246 - protein, 10 aa, Artificial Sequence
  Description of Artificial Sequence: Synthetic peptide
  Seed: SLDDYNHLVT (TYRP2_HUMAN)
SVDDYNHLVM

SEQ ID NO: 187247 - protein, 9 aa, Artificial Sequence
  Description of Artificial Sequence: Synthetic peptide
  Seed: FPPVTNEEL (TYRP2_HUMAN)
FRPVTNEEM

SEQ ID NO: 187248 - protein, 9 aa, Artificial Sequence
  Description of Artificial Sequence: Synthetic peptide
  Seed: YSYAIDLPV (TYRP2_HUMAN)
YVYAIDLPV

SEQ ID NO: 187249 - protein, 11 aa, Artificial Sequence
  Description of Artificial Sequence: Synthetic peptide
  Seed: FFPPVTNEELF (TYRP2_HUMAN)
FYPPVTNEELF

SEQ ID NO: 187250 - protein, 10 aa, Artificial Sequence
  Description of Artificial Sequence: Synthetic peptide
  Seed: RRLRKGYTPL (TYRP2_HUMAN)
RYLRKGYTPF

SEQ ID NO: 187251 - protein, 9 aa, Artificial Sequence
  Description of Artificial Sequence: Synthetic peptide
  Seed: NRMYNMVPF (TYRP2_HUMAN)
NQMYNMVPA

SEQ ID NO: 187252 - protein, 11 aa, Artificial Sequence
  Description of Artificial Sequence: Synthetic peptide
  Seed: LLVVMGTLVAL (TYRP2_HUMAN)
LMVVMGTLVAA

SEQ ID NO: 187253 - protein, 10 aa, Artificial Sequence
  Description of Artificial Sequence: Synthetic peptide
  Seed: FPRVCMTVDS (TYRP2_HUMAN)
FPRVCMTVDA

SEQ ID NO: 187254 - protein, 10 aa, Artificial Sequence
  Description of Artificial Sequence: Synthetic peptide
  Seed: VGLFVLLAFL (TYRP2_HUMAN)
VMLFVLLAFI

SEQ ID NO: 187255 - protein, 9 aa, Artificial Sequence
  Description of Artificial Sequence: Synthetic peptide
  Seed: SAANDPIFV (TYRP2_HUMAN)
SMANDPIFA

SEQ ID NO: 187256 - protein, 9 aa, Artificial Sequence
  Description of Artificial Sequence: Synthetic peptide
  Seed: GTNALPHSA (TYRP2_HUMAN)
GLNALPHSA

SEQ ID NO: 187257 - protein, 9 aa, Artificial Sequence
  Description of Artificial Sequence: Synthetic peptide
  Seed: GTNALPHSA (TYRP2_HUMAN)
GTNALPHSV

SEQ ID NO: 187258 - protein, 10 aa, Artificial Sequence
  Description of Artificial Sequence: Synthetic peptide
  Seed: ELAPIGHNRM (TYRP2_HUMAN)
EVAPIGHNRQ

SEQ ID NO: 187259 - protein, 10 aa, Artificial Sequence
  Description of Artificial Sequence: Synthetic peptide
  Seed: LPGAQGQFPR (TYRP2_HUMAN)
LVGAQGQFPR

SEQ ID NO: 187260 - protein, 10 aa, Artificial Sequence
  Description of Artificial Sequence: Synthetic peptide
  Seed: RELWPRKFFH (TYRP2_HUMAN)
RRLWPRKFFK

SEQ ID NO: 187261 - protein, 10 aa, Artificial Sequence
  Description of Artificial Sequence: Synthetic peptide
  Seed: GTLDSQVMSL (TYRP2_HUMAN)
GELDSQVMSV

SEQ ID NO: 187262 - protein, 11 aa, Artificial Sequence
  Description of Artificial Sequence: Synthetic peptide
  Seed: HSFTDAIFDEW (TYRP2_HUMAN)
HQFTDAIFDEF

SEQ ID NO: 187263 - protein, 10 aa, Artificial Sequence
  Description of Artificial Sequence: Synthetic peptide
  Seed: RLRKGYTPLM (TYRP2_HUMAN)
RVRKGYTPLL

SEQ ID NO: 187264 - protein, 9 aa, Artificial Sequence
  Description of Artificial Sequence: Synthetic peptide
  Seed: VEETPGWPT (TYRP2_HUMAN)
VEETPGWPV

SEQ ID NO: 187265 - protein, 9 aa, Artificial Sequence
  Description of Artificial Sequence: Synthetic peptide
  Seed: SLHNLVHSF (TYRP2_HUMAN)
SRHNLVHSF

SEQ ID NO: 187266 - protein, 9 aa, Artificial Sequence
  Description of Artificial Sequence: Synthetic peptide
  Seed: YSYAIDLPV (TYRP2_HUMAN)
YIYAIDLPF

SEQ ID NO: 187267 - protein, 9 aa, Artificial Sequence
  Description of Artificial Sequence: Synthetic peptide
  Seed: YSYAIDLPV (TYRP2_HUMAN)
YIYAIDLPI

SEQ ID NO: 187268 - protein, 10 aa, Artificial Sequence
  Description of Artificial Sequence: Synthetic peptide
  Seed: CSVYDFFVWL (TYRP2_HUMAN)
CQVYDFFVWV

SEQ ID NO: 187269 - protein, 9 aa, Artificial Sequence
  Description of Artificial Sequence: Synthetic peptide
  Seed: LVTLCNGTY (TYRP2_HUMAN)
LATLCNGTY

SEQ ID NO: 187270 - protein, 11 aa, Artificial Sequence
  Description of Artificial Sequence: Synthetic peptide
  Seed: KADGTLDSQVM (TYRP2_HUMAN)
KQDGTLDSQVI

SEQ ID NO: 187271 - protein, 9 aa, Artificial Sequence
  Description of Artificial Sequence: Synthetic peptide
  Seed: SLDDYNHLV (TYRP2_HUMAN)
SDDDYNHLL

SEQ ID NO: 187272 - protein, 9 aa, Artificial Sequence
  Description of Artificial Sequence: Synthetic peptide
  Seed: HQGPAFVTW (TYRP2_HUMAN)
HMGPAFVTW

SEQ ID NO: 187273 - protein, 9 aa, Artificial Sequence
  Description of Artificial Sequence: Synthetic peptide
  Seed: YVITTQHWL (TYRP2_HUMAN)
YIITTQHWI

SEQ ID NO: 187274 - protein, 9 aa, Artificial Sequence
  Description of Artificial Sequence: Synthetic peptide
  Seed: FVLLAFLQY (TYRP2_HUMAN)
FILLAFLQK

SEQ ID NO: 187275 - protein, 10 aa, Artificial Sequence
  Description of Artificial Sequence: Synthetic peptide
  Seed: KRFNPPADAW (TYRP2_HUMAN)
KKFNPPADAF

SEQ ID NO: 187276 - protein, 11 aa, Artificial Sequence
  Description of Artificial Sequence: Synthetic peptide
  Seed: HQGPAFVTWHR (TYRP2_HUMAN)
HTGPAFVTWHR

SEQ ID NO: 187277 - protein, 10 aa, Artificial Sequence
  Description of Artificial Sequence: Synthetic peptide
  Seed: TQPQFANCSV (TYRP2_HUMAN)
TIPQFANCSV

SEQ ID NO: 187278 - protein, 9 aa, Artificial Sequence
  Description of Artificial Sequence: Synthetic peptide
  Seed: SVYDFFVWL (TYRP2_HUMAN)
SLYDFFVWK

SEQ ID NO: 187279 - protein, 10 aa, Artificial Sequence
  Description of Artificial Sequence: Synthetic peptide
  Seed: SPLWWGFLLS (TYRP2_HUMAN)
SELWWGFLLA

SEQ ID NO: 187280 - protein, 11 aa, Artificial Sequence
  Description of Artificial Sequence: Synthetic peptide
  Seed: LLVVMGTLVAL (TYRP2_HUMAN)
LIVVMGTLVAV

SEQ ID NO: 187281 - protein, 10 aa, Artificial Sequence
  Description of Artificial Sequence: Synthetic peptide
  Seed: VLHSFTDAIF (TYRP2_HUMAN)
VLHSFTDAIV

SEQ ID NO: 187282 - protein, 10 aa, Artificial Sequence
  Description of Artificial Sequence: Synthetic peptide
  Seed: VVMGTLVALV (TYRP2_HUMAN)
VWMGTLVALL

SEQ ID NO: 187283 - protein, 10 aa, Artificial Sequence
  Description of Artificial Sequence: Synthetic peptide
  Seed: YNMVPFFPPV (TYRP2_HUMAN)
YRMVPFFPPV

SEQ ID NO: 187284 - protein, 10 aa, Artificial Sequence
  Description of Artificial Sequence: Synthetic peptide
  Seed: NCSVYDFFVW (TYRP2_HUMAN)
NESVYDFFVW

SEQ ID NO: 187285 - protein, 9 aa, Artificial Sequence
  Description of Artificial Sequence: Synthetic peptide
  Seed: EETPGWPTT (TYRP2_HUMAN)
EETPGWPTY

SEQ ID NO: 187286 - protein, 10 aa, Artificial Sequence
  Description of Artificial Sequence: Synthetic peptide
  Seed: RNQMGRNSMK (TYRP2_HUMAN)
REQMGRNSMR

SEQ ID NO: 187287 - protein, 9 aa, Artificial Sequence
  Description of Artificial Sequence: Synthetic peptide
  Seed: GTNALPHSA (TYRP2_HUMAN)
GINALPHSL

SEQ ID NO: 187288 - protein, 10 aa, Artificial Sequence
  Description of Artificial Sequence: Synthetic peptide
  Seed: REQFLGALDL (TYRP2_HUMAN)
RPQFLGALDM

SEQ ID NO: 187289 - protein, 10 aa, Artificial Sequence
  Description of Artificial Sequence: Synthetic peptide
  Seed: LHYYSVRDTL (TYRP2_HUMAN)
LYYYSVRDTY

SEQ ID NO: 187290 - protein, 10 aa, Artificial Sequence
  Description of Artificial Sequence: Synthetic peptide
  Seed: YDFFVWLHYY (TYRP2_HUMAN)
YFFFVWLHYP

SEQ ID NO: 187291 - protein, 10 aa, Artificial Sequence
  Description of Artificial Sequence: Synthetic peptide
  Seed: SFTDAIFDEW (TYRP2_HUMAN)
STTDAIFDEW

SEQ ID NO: 187292 - protein, 10 aa, Artificial Sequence
  Description of Artificial Sequence: Synthetic peptide
  Seed: AIFDEWMKRF (TYRP2_HUMAN)
ATFDEWMKRF

SEQ ID NO: 187293 - protein, 9 aa, Artificial Sequence
  Description of Artificial Sequence: Synthetic peptide
  Seed: SQVMSLHNL (TYRP2_HUMAN)
SQVMSLHNW

SEQ ID NO: 187294 - protein, 9 aa, Artificial Sequence
  Description of Artificial Sequence: Synthetic peptide
  Seed: RLRKGYTPL (TYRP2_HUMAN)
RFRKGYTPY

SEQ ID NO: 187295 - protein, 11 aa, Artificial Sequence
  Description of Artificial Sequence: Synthetic peptide
  Seed: RELWPRKFFHR (TYRP2_HUMAN)
RMLWPRKFFHR

SEQ ID NO: 187296 - protein, 10 aa, Artificial Sequence
  Description of Artificial Sequence: Synthetic peptide
  Seed: KILPGAQGQF (TYRP2_HUMAN)
KMLPGAQGQK

SEQ ID NO: 187297 - protein, 10 aa, Artificial Sequence
  Description of Artificial Sequence: Synthetic peptide
  Seed: YDFFVWLHYY (TYRP2_HUMAN)
YLFFVWLHYF

SEQ ID NO: 187298 - protein, 10 aa, Artificial Sequence
  Description of Artificial Sequence: Synthetic peptide
  Seed: TRPWSGPYIL (TYRP2_HUMAN)
TAPWSGPYIY

SEQ ID NO: 187299 - protein, 10 aa, Artificial Sequence
  Description of Artificial Sequence: Synthetic peptide
  Seed: REQFLGALDL (TYRP2_HUMAN)
RWQFLGALDY

SEQ ID NO: 187300 - protein, 10 aa, Artificial Sequence
  Description of Artificial Sequence: Synthetic peptide
  Seed: RTCKCTGNFA (TYRP2_HUMAN)
RTCKCTGNFK

SEQ ID NO: 187301 - protein, 10 aa, Artificial Sequence
  Description of Artificial Sequence: Synthetic peptide
  Seed: MGRNSMKLPT (TYRP2_HUMAN)
MTRNSMKLPM

SEQ ID NO: 187302 - protein, 10 aa, Artificial Sequence
  Description of Artificial Sequence: Synthetic peptide
  Seed: NPPFFQNSTF (TYRP2_HUMAN)
NFPFFQNSTY

SEQ ID NO: 187303 - protein, 9 aa, Artificial Sequence
  Description of Artificial Sequence: Synthetic peptide
  Seed: SWETVCDSL (TYRP2_HUMAN)
SYETVCDSL

SEQ ID NO: 187304 - protein, 9 aa, Artificial Sequence
  Description of Artificial Sequence: Synthetic peptide
  Seed: RLRKGYTPL (TYRP2_HUMAN)
RRRKGYTPY

SEQ ID NO: 187305 - protein, 8 aa, Artificial Sequence
  Description of Artificial Sequence: Synthetic peptide
  Seed: AIDLPVSV (TYRP2_HUMAN)
AFDLPVSL

SEQ ID NO: 187306 - protein, 9 aa, Artificial Sequence
  Description of Artificial Sequence: Synthetic peptide
  Seed: DDYNHLVTL (TYRP2_HUMAN)
DLYNHLVTL

SEQ ID NO: 187307 - protein, 9 aa, Artificial Sequence
  Description of Artificial Sequence: Synthetic peptide
  Seed: VIRQNIHSL (TYRP2_HUMAN)
VMRQNIHSV

SEQ ID NO: 187308 - protein, 10 aa, Artificial Sequence
  Description of Artificial Sequence: Synthetic peptide
  Seed: NLVHSFLNGT (TYRP2_HUMAN)
NLVHSFLNGV

SEQ ID NO: 187309 - protein, 10 aa, Artificial Sequence
  Description of Artificial Sequence: Synthetic peptide
  Seed: YNMVPFFPPV (TYRP2_HUMAN)
YVMVPFFPPI

SEQ ID NO: 187310 - protein, 9 aa, Artificial Sequence
  Description of Artificial Sequence: Synthetic peptide
  Seed: RLGAESANV (TYRP2_HUMAN)
RLGAESANL

SEQ ID NO: 187311 - protein, 10 aa, Artificial Sequence
  Description of Artificial Sequence: Synthetic peptide
  Seed: SDQLGYSYAI (TYRP2_HUMAN)
SYQLGYSYAM

SEQ ID NO: 187312 - protein, 10 aa, Artificial Sequence
  Description of Artificial Sequence: Synthetic peptide
  Seed: YAIDLPVSVE (TYRP2_HUMAN)
YQIDLPVSVS

SEQ ID NO: 187313 - protein, 9 aa, Artificial Sequence
  Description of Artificial Sequence: Synthetic peptide
  Seed: APIGHNRMY (TYRP2_HUMAN)
AKIGHNRMY

SEQ ID NO: 187314 - protein, 10 aa, Artificial Sequence
  Description of Artificial Sequence: Synthetic peptide
  Seed: VGLFVLLAFL (TYRP2_HUMAN)
VTLFVLLAFV

SEQ ID NO: 187315 - protein, 10 aa, Artificial Sequence
  Description of Artificial Sequence: Synthetic peptide
  Seed: ELAPIGHNRM (TYRP2_HUMAN)
ETAPIGHNRG

SEQ ID NO: 187316 - protein, 10 aa, Artificial Sequence
  Description of Artificial Sequence: Synthetic peptide
  Seed: PFFQNSTFSF (TYRP2_HUMAN)
PWFQNSTFSF

SEQ ID NO: 187317 - protein, 8 aa, Artificial Sequence
  Description of Artificial Sequence: Synthetic peptide
  Seed: AIDLPVSV (TYRP2_HUMAN)
AVDLPVSM

SEQ ID NO: 187318 - protein, 10 aa, Artificial Sequence
  Description of Artificial Sequence: Synthetic peptide
  Seed: HNRMYNMVPF (TYRP2_HUMAN)
HQRMYNMVPL

SEQ ID NO: 187319 - protein, 10 aa, Artificial Sequence
  Description of Artificial Sequence: Synthetic peptide
  Seed: RNSRFSSWET (TYRP2_HUMAN)
RHSRFSSWEA

SEQ ID NO: 187320 - protein, 9 aa, Artificial Sequence
  Description of Artificial Sequence: Synthetic peptide
  Seed: WMKRFNPPA (TYRP2_HUMAN)
WAKRFNPPY

SEQ ID NO: 187321 - protein, 11 aa, Artificial Sequence
  Description of Artificial Sequence: Synthetic peptide
  Seed: ARPDDPTLISR (TYRP2_HUMAN)
AYPDDPTLISY

SEQ ID NO: 187322 - protein, 11 aa, Artificial Sequence
  Description of Artificial Sequence: Synthetic peptide
  Seed: ANCSVYDFFVW (TYRP2_HUMAN)
AACSVYDFFVW

SEQ ID NO: 187323 - protein, 10 aa, Artificial Sequence
  Description of Artificial Sequence: Synthetic peptide
  Seed: GQFPRVCMTV (TYRP2_HUMAN)
GLFPRVCMTV

SEQ ID NO: 187324 - protein, 10 aa, Artificial Sequence
  Description of Artificial Sequence: Synthetic peptide
  Seed: RNSRFSSWET (TYRP2_HUMAN)
RVSRFSSWEG

SEQ ID NO: 187325 - protein, 9 aa, Artificial Sequence
  Description of Artificial Sequence: Synthetic peptide
  Seed: RNQMGRNSM (TYRP2_HUMAN)
RSQMGRNSY

SEQ ID NO: 187326 - protein, 10 aa, Artificial Sequence
  Description of Artificial Sequence: Synthetic peptide
  Seed: VLHSFTDAIF (TYRP2_HUMAN)
VKHSFTDAIM

SEQ ID NO: 187327 - protein, 11 aa, Artificial Sequence
  Description of Artificial Sequence: Synthetic peptide
  Seed: RADTRPWSGPY (TYRP2_HUMAN)
RIDTRPWSGPA

SEQ ID NO: 187328 - protein, 10 aa, Artificial Sequence
  Description of Artificial Sequence: Synthetic peptide
  Seed: NGTYEGLLRR (TYRP2_HUMAN)
NMTYEGLLRR

SEQ ID NO: 187329 - protein, 10 aa, Artificial Sequence
  Description of Artificial Sequence: Synthetic peptide
  Seed: QELAPIGHNR (TYRP2_HUMAN)
QYLAPIGHNR

SEQ ID NO: 187330 - protein, 11 aa, Artificial Sequence
  Description of Artificial Sequence: Synthetic peptide
  Seed: VMSLHNLVHSF (TYRP2_HUMAN)
VMSLHNLVHSY

SEQ ID NO: 187331 - protein, 8 aa, Artificial Sequence
  Description of Artificial Sequence: Synthetic peptide
  Seed: RPDDPTLI (TYRP2_HUMAN)
RIDDPTLF

SEQ ID NO: 187332 - protein, 10 aa, Artificial Sequence
  Description of Artificial Sequence: Synthetic peptide
  Seed: NMVPFFPPVT (TYRP2_HUMAN)
NLVPFFPPVL

SEQ ID NO: 187333 - protein, 9 aa, Artificial Sequence
  Description of Artificial Sequence: Synthetic peptide
  Seed: SVYDFFVWL (TYRP2_HUMAN)
SAYDFFVWI

SEQ ID NO: 187334 - protein, 9 aa, Artificial Sequence
  Description of Artificial Sequence: Synthetic peptide
  Seed: AARPDDPTL (TYRP2_HUMAN)
ALRPDDPTY

SEQ ID NO: 187335 - protein, 9 aa, Artificial Sequence
  Description of Artificial Sequence: Synthetic peptide
  Seed: MTVDSLVNK (TYRP2_HUMAN)
MQVDSLVNK

SEQ ID NO: 187336 - protein, 10 aa, Artificial Sequence
  Description of Artificial Sequence: Synthetic peptide
  Seed: CMTVDSLVNK (TYRP2_HUMAN)
CNTVDSLVNK

SEQ ID NO: 187337 - protein, 8 aa, Artificial Sequence
  Description of Artificial Sequence: Synthetic peptide
  Seed: FLNGTNAL (TYRP2_HUMAN)
FFNGTNAF

SEQ ID NO: 187338 - protein, 9 aa, Artificial Sequence
  Description of Artificial Sequence: Synthetic peptide
  Seed: RKFFHRTCK (TYRP2_HUMAN)
RIFFHRTCG

SEQ ID NO: 187339 - protein, 11 aa, Artificial Sequence
  Description of Artificial Sequence: Synthetic peptide
  Seed: YTPLMETHLSS (TYRP2_HUMAN)
YEPLMETHLSV

SEQ ID NO: 187340 - protein, 10 aa, Artificial Sequence
  Description of Artificial Sequence: Synthetic peptide
  Seed: FFQNSTFSFR (TYRP2_HUMAN)
FYQNSTFSFR

SEQ ID NO: 187341 - protein, 9 aa, Artificial Sequence
  Description of Artificial Sequence: Synthetic peptide
  Seed: RELWPRKFF (TYRP2_HUMAN)
RELWPRKFW

SEQ ID NO: 187342 - protein, 8 aa, Artificial Sequence
  Description of Artificial Sequence: Synthetic peptide
  Seed: SLDDYNHL (TYRP2_HUMAN)
SFDDYNHL

SEQ ID NO: 187343 - protein, 10 aa, Artificial Sequence
  Description of Artificial Sequence: Synthetic peptide
  Seed: FGWTGPNCER (TYRP2_HUMAN)
FAWTGPNCEL

SEQ ID NO: 187344 - protein, 9 aa, Artificial Sequence
  Description of Artificial Sequence: Synthetic peptide
  Seed: YSYAIDLPV (TYRP2_HUMAN)
YPYAIDLPI

SEQ ID NO: 187345 - protein, 9 aa, Artificial Sequence
  Description of Artificial Sequence: Synthetic peptide
  Seed: RTCKCTGNF (TYRP2_HUMAN)
RSCKCTGNW

SEQ ID NO: 187346 - protein, 10 aa, Artificial Sequence
  Description of Artificial Sequence: Synthetic peptide
  Seed: KRFNPPADAW (TYRP2_HUMAN)
KTFNPPADAY

SEQ ID NO: 187347 - protein, 9 aa, Artificial Sequence
  Description of Artificial Sequence: Synthetic peptide
  Seed: RLIGNESFA (TYRP2_HUMAN)
RMIGNESFV

SEQ ID NO: 187348 - protein, 9 aa, Artificial Sequence
  Description of Artificial Sequence: Synthetic peptide
  Seed: GLFVLLAFL (TYRP2_HUMAN)
GVFVLLAFV

SEQ ID NO: 187349 - protein, 9 aa, Artificial Sequence
  Description of Artificial Sequence: Synthetic peptide
  Seed: YAIDLPVSV (TYRP2_HUMAN)
YLIDLPVSY

SEQ ID NO: 187350 - protein, 9 aa, Artificial Sequence
  Description of Artificial Sequence: Synthetic peptide
  Seed: IFDEWMKRF (TYRP2_HUMAN)
IYDEWMKRF

SEQ ID NO: 187351 - protein, 9 aa, Artificial Sequence
  Description of Artificial Sequence: Synthetic peptide
  Seed: HQGPAFVTW (TYRP2_HUMAN)
HTGPAFVTW

SEQ ID NO: 187352 - protein, 9 aa, Artificial Sequence
  Description of Artificial Sequence: Synthetic peptide
  Seed: FSHQGPAFV (TYRP2_HUMAN)
FIHQGPAFL

SEQ ID NO: 187353 - protein, 10 aa, Artificial Sequence
  Description of Artificial Sequence: Synthetic peptide
  Seed: SHQGPAFVTW (TYRP2_HUMAN)
SMQGPAFVTF

SEQ ID NO: 187354 - protein, 9 aa, Artificial Sequence
  Description of Artificial Sequence: Synthetic peptide
  Seed: DQLGYSYAI (TYRP2_HUMAN)
DSLGYSYAV

SEQ ID NO: 187355 - protein, 9 aa, Artificial Sequence
  Description of Artificial Sequence: Synthetic peptide
  Seed: SDQLGYSYA (TYRP2_HUMAN)
SEQLGYSYI

SEQ ID NO: 187356 - protein, 9 aa, Artificial Sequence
  Description of Artificial Sequence: Synthetic peptide
  Seed: TLDSQVMSL (TYRP2_HUMAN)
TYDSQVMSI

SEQ ID NO: 187357 - protein, 10 aa, Artificial Sequence
  Description of Artificial Sequence: Synthetic peptide
  Seed: SLDDYNHLVT (TYRP2_HUMAN)
SMDDYNHLVS

SEQ ID NO: 187358 - protein, 9 aa, Artificial Sequence
  Description of Artificial Sequence: Synthetic peptide
  Seed: SQVMSLHNL (TYRP2_HUMAN)
SQVMSLHNA

SEQ ID NO: 187359 - protein, 11 aa, Artificial Sequence
  Description of Artificial Sequence: Synthetic peptide
  Seed: YNMVPFFPPVT (TYRP2_HUMAN)
YLMVPFFPPVW

SEQ ID NO: 187360 - protein, 10 aa, Artificial Sequence
  Description of Artificial Sequence: Synthetic peptide
  Seed: TLCNGTYEGL (TYRP2_HUMAN)
TICNGTYEGV

SEQ ID NO: 187361 - protein, 9 aa, Artificial Sequence
  Description of Artificial Sequence: Synthetic peptide
  Seed: FVLLAFLQY (TYRP2_HUMAN)
FMLLAFLQF

SEQ ID NO: 187362 - protein, 9 aa, Artificial Sequence
  Description of Artificial Sequence: Synthetic peptide
  Seed: FLGALDLAK (TYRP2_HUMAN)
FSGALDLAL

SEQ ID NO: 187363 - protein, 10 aa, Artificial Sequence
  Description of Artificial Sequence: Synthetic peptide
  Seed: HNRMYNMVPF (TYRP2_HUMAN)
HDRMYNMVPF

SEQ ID NO: 187364 - protein, 10 aa, Artificial Sequence
  Description of Artificial Sequence: Synthetic peptide
  Seed: SAANDPIFVV (TYRP2_HUMAN)
SVANDPIFVA

SEQ ID NO: 187365 - protein, 9 aa, Artificial Sequence
  Description of Artificial Sequence: Synthetic peptide
  Seed: SLHNLVHSF (TYRP2_HUMAN)
SSHNLVHSM

SEQ ID NO: 187366 - protein, 10 aa, Artificial Sequence
  Description of Artificial Sequence: Synthetic peptide
  Seed: QGPAFVTWHR (TYRP2_HUMAN)
QYPAFVTWHR

SEQ ID NO: 187367 - protein, 10 aa, Artificial Sequence
  Description of Artificial Sequence: Synthetic peptide
  Seed: RRLRKGYTPL (TYRP2_HUMAN)
RQLRKGYTPM

SEQ ID NO: 187368 - protein, 10 aa, Artificial Sequence
  Description of Artificial Sequence: Synthetic peptide
  Seed: YSYAIDLPVS (TYRP2_HUMAN)
YTYAIDLPVI

SEQ ID NO: 187369 - protein, 11 aa, Artificial Sequence
  Description of Artificial Sequence: Synthetic peptide
  Seed: HQGPAFVTWHR (TYRP2_HUMAN)
HFGPAFVTWHR

SEQ ID NO: 187370 - protein, 9 aa, Artificial Sequence
  Description of Artificial Sequence: Synthetic peptide
  Seed: ANDPIFVVL (TYRP2_HUMAN)
AEDPIFVVM

SEQ ID NO: 187371 - protein, 9 aa, Artificial Sequence
  Description of Artificial Sequence: Synthetic peptide
  Seed: HSAANDPIF (TYRP2_HUMAN)
HPAANDPIW

SEQ ID NO: 187372 - protein, 10 aa, Artificial Sequence
  Description of Artificial Sequence: Synthetic peptide
  Seed: AANDPIFVVL (TYRP2_HUMAN)
AVNDPIFVVV

SEQ ID NO: 187373 - protein, 9 aa, Artificial Sequence
  Description of Artificial Sequence: Synthetic peptide
  Seed: STFSFRNAL (TYRP2_HUMAN)
SQFSFRNAH

SEQ ID NO: 187374 - protein, 10 aa, Artificial Sequence
  Description of Artificial Sequence: Synthetic peptide
  Seed: RPDDPTLISR (TYRP2_HUMAN)
RSDDPTLISL

SEQ ID NO: 187375 - protein, 9 aa, Artificial Sequence
  Description of Artificial Sequence: Synthetic peptide
  Seed: HQGPAFVTW (TYRP2_HUMAN)
HFGPAFVTL

SEQ ID NO: 187376 - protein, 10 aa, Artificial Sequence
  Description of Artificial Sequence: Synthetic peptide
  Seed: NSTFSFRNAL (TYRP2_HUMAN)
NVTFSFRNAL

SEQ ID NO: 187377 - protein, 9 aa, Artificial Sequence
  Description of Artificial Sequence: Synthetic peptide
  Seed: YAIDLPVSV (TYRP2_HUMAN)
YIIDLPVSR

SEQ ID NO: 187378 - protein, 11 aa, Artificial Sequence
  Description of Artificial Sequence: Synthetic peptide
  Seed: FVVLHSFTDAI (TYRP2_HUMAN)
FGVLHSFTDAL

SEQ ID NO: 187379 - protein, 9 aa, Artificial Sequence
  Description of Artificial Sequence: Synthetic peptide
  Seed: NMVPFFPPV (TYRP2_HUMAN)
NTVPFFPPF

SEQ ID NO: 187380 - protein, 9 aa, Artificial Sequence
  Description of Artificial Sequence: Synthetic peptide
  Seed: FSHQGPAFV (TYRP2_HUMAN)
FVHQGPAFY

SEQ ID NO: 187381 - protein, 9 aa, Artificial Sequence
  Description of Artificial Sequence: Synthetic peptide
  Seed: AANDPIFVV (TYRP2_HUMAN)
ARNDPIFVY

SEQ ID NO: 187382 - protein, 9 aa, Artificial Sequence
  Description of Artificial Sequence: Synthetic peptide
  Seed: HRYHLLCLE (TYRP2_HUMAN)
HRYHLLCLK

SEQ ID NO: 187383 - protein, 9 aa, Artificial Sequence
  Description of Artificial Sequence: Synthetic peptide
  Seed: STFSFRNAL (TYRP2_HUMAN)
SPFSFRNAL

SEQ ID NO: 187384 - protein, 10 aa, Artificial Sequence
  Description of Artificial Sequence: Synthetic peptide
  Seed: FFQNSTFSFR (TYRP2_HUMAN)
FYQNSTFSFY

SEQ ID NO: 187385 - protein, 10 aa, Artificial Sequence
  Description of Artificial Sequence: Synthetic peptide
  Seed: YSYAIDLPVS (TYRP2_HUMAN)
YAYAIDLPVV

SEQ ID NO: 187386 - protein, 10 aa, Artificial Sequence
  Description of Artificial Sequence: Synthetic peptide
  Seed: FVWLHYYSVR (TYRP2_HUMAN)
FMWLHYYSVP

SEQ ID NO: 187387 - protein, 9 aa, Artificial Sequence
  Description of Artificial Sequence: Synthetic peptide
  Seed: NMVPFFPPV (TYRP2_HUMAN)
NLVPFFPPR

SEQ ID NO: 187388 - protein, 10 aa, Artificial Sequence
  Description of Artificial Sequence: Synthetic peptide
  Seed: FFQNSTFSFR (TYRP2_HUMAN)
FFQNSTFSFY

SEQ ID NO: 187389 - protein, 10 aa, Artificial Sequence
  Description of Artificial Sequence: Synthetic peptide
  Seed: LHYYSVRDTL (TYRP2_HUMAN)
LDYYSVRDTI

SEQ ID NO: 187390 - protein, 9 aa, Artificial Sequence
  Description of Artificial Sequence: Synthetic peptide
  Seed: YVITTQHWL (TYRP2_HUMAN)
YSITTQHWM

SEQ ID NO: 187391 - protein, 9 aa, Artificial Sequence
  Description of Artificial Sequence: Synthetic peptide
  Seed: AARPDDPTL (TYRP2_HUMAN)
AFRPDDPTY

SEQ ID NO: 187392 - protein, 10 aa, Artificial Sequence
  Description of Artificial Sequence: Synthetic peptide
  Seed: LISRNSRFSS (TYRP2_HUMAN)
LYSRNSRFSA

SEQ ID NO: 187393 - protein, 9 aa, Artificial Sequence
  Description of Artificial Sequence: Synthetic peptide
  Seed: VLHSFTDAI (TYRP2_HUMAN)
VQHSFTDAH

SEQ ID NO: 187394 - protein, 9 aa, Artificial Sequence
  Description of Artificial Sequence: Synthetic peptide
  Seed: VTWHRYHLL (TYRP2_HUMAN)
VHWHRYHLF

SEQ ID NO: 187395 - protein, 9 aa, Artificial Sequence
  Description of Artificial Sequence: Synthetic peptide
  Seed: SLDDYNHLV (TYRP2_HUMAN)
SHDDYNHLY

SEQ ID NO: 187396 - protein, 9 aa, Artificial Sequence
  Description of Artificial Sequence: Synthetic peptide
  Seed: SLDDYNHLV (TYRP2_HUMAN)
SMDDYNHLW

SEQ ID NO: 187397 - protein, 9 aa, Artificial Sequence
  Description of Artificial Sequence: Synthetic peptide
  Seed: NMVPFFPPV (TYRP2_HUMAN)
NAVPFFPPA

SEQ ID NO: 187398 - protein, 9 aa, Artificial Sequence
  Description of Artificial Sequence: Synthetic peptide
  Seed: YAIDLPVSV (TYRP2_HUMAN)
YYIDLPVSV

SEQ ID NO: 187399 - protein, 10 aa, Artificial Sequence
  Description of Artificial Sequence: Synthetic peptide
  Seed: SPLWWGFLLS (TYRP2_HUMAN)
SRLWWGFLLI

SEQ ID NO: 187400 - protein, 9 aa, Artificial Sequence
  Description of Artificial Sequence: Synthetic peptide
  Seed: GFDKADGTL (TYRP2_HUMAN)
GTDKADGTM

SEQ ID NO: 187401 - protein, 9 aa, Artificial Sequence
  Description of Artificial Sequence: Synthetic peptide
  Seed: VVMGTLVAL (TYRP2_HUMAN)
VVMGTLVAF

SEQ ID NO: 187402 - protein, 9 aa, Artificial Sequence
  Description of Artificial Sequence: Synthetic peptide
  Seed: ADAWPQELA (TYRP2_HUMAN)
AEAWPQELL

SEQ ID NO: 187403 - protein, 9 aa, Artificial Sequence
  Description of Artificial Sequence: Synthetic peptide
  Seed: SLHNLVHSF (TYRP2_HUMAN)
SFHNLVHSY

SEQ ID NO: 187404 - protein, 10 aa, Artificial Sequence
  Description of Artificial Sequence: Synthetic peptide
  Seed: TDAIFDEWMK (TYRP2_HUMAN)
TSAIFDEWMR

SEQ ID NO: 187405 - protein, 9 aa, Artificial Sequence
  Description of Artificial Sequence: Synthetic peptide
  Seed: GTLVALVGL (TYRP2_HUMAN)
GMLVALVGM

SEQ ID NO: 187406 - protein, 9 aa, Artificial Sequence
  Description of Artificial Sequence: Synthetic peptide
  Seed: RMYNMVPFF (TYRP2_HUMAN)
RLYNMVPFS

SEQ ID NO: 187407 - protein, 9 aa, Artificial Sequence
  Description of Artificial Sequence: Synthetic peptide
  Seed: HQGPAFVTW (TYRP2_HUMAN)
HQGPAFVTV

SEQ ID NO: 187408 - protein, 10 aa, Artificial Sequence
  Description of Artificial Sequence: Synthetic peptide
  Seed: ELAPIGHNRM (TYRP2_HUMAN)
EVAPIGHNRN

SEQ ID NO: 187409 - protein, 9 aa, Artificial Sequence
  Description of Artificial Sequence: Synthetic peptide
  Seed: VMSLHNLVH (TYRP2_HUMAN)
VQSLHNLVH

SEQ ID NO: 187410 - protein, 11 aa, Artificial Sequence
  Description of Artificial Sequence: Synthetic peptide
  Seed: TQPQFANCSVY (TYRP2_HUMAN)
TSPQFANCSVF

SEQ ID NO: 187411 - protein, 10 aa, Artificial Sequence
  Description of Artificial Sequence: Synthetic peptide
  Seed: ADTRPWSGPY (TYRP2_HUMAN)
AMTRPWSGPY

SEQ ID NO: 187412 - protein, 9 aa, Artificial Sequence
  Description of Artificial Sequence: Synthetic peptide
  Seed: RKFFHRTCK (TYRP2_HUMAN)
RMFFHRTCA

SEQ ID NO: 187413 - protein, 10 aa, Artificial Sequence
  Description of Artificial Sequence: Synthetic peptide
  Seed: FPPVTNEELF (TYRP2_HUMAN)
FMPVTNEELF

SEQ ID NO: 187414 - protein, 10 aa, Artificial Sequence
  Description of Artificial Sequence: Synthetic peptide
  Seed: NPPFFQNSTF (TYRP2_HUMAN)
NMPFFQNSTY

SEQ ID NO: 187415 - protein, 8 aa, Artificial Sequence
  Description of Artificial Sequence: Synthetic peptide
  Seed: REQFLGAL (TYRP2_HUMAN)
REQFLGAI

SEQ ID NO: 187416 - protein, 10 aa, Artificial Sequence
  Description of Artificial Sequence: Synthetic peptide
  Seed: RLIGNESFAL (TYRP2_HUMAN)
RMIGNESFAY

SEQ ID NO: 187417 - protein, 10 aa, Artificial Sequence
  Description of Artificial Sequence: Synthetic peptide
  Seed: RMYNMVPFFP (TYRP2_HUMAN)
RMYNMVPFFK

SEQ ID NO: 187418 - protein, 8 aa, Artificial Sequence
  Description of Artificial Sequence: Synthetic peptide
  Seed: KFDNPPFF (TYRP2_HUMAN)
KLDNPPFL

SEQ ID NO: 187419 - protein, 9 aa, Artificial Sequence
  Description of Artificial Sequence: Synthetic peptide
  Seed: FSHQGPAFV (TYRP2_HUMAN)
FLHQGPAFS

SEQ ID NO: 187420 - protein, 10 aa, Artificial Sequence
  Description of Artificial Sequence: Synthetic peptide
  Seed: SDQLGYSYAI (TYRP2_HUMAN)
SQQLGYSYAI

SEQ ID NO: 187421 - protein, 9 aa, Artificial Sequence
  Description of Artificial Sequence: Synthetic peptide
  Seed: RVCMTVDSL (TYRP2_HUMAN)
RSCMTVDSY

SEQ ID NO: 187422 - protein, 9 aa, Artificial Sequence
  Description of Artificial Sequence: Synthetic peptide
  Seed: TLLGPGRPY (TYRP2_HUMAN)
TGLGPGRPY

SEQ ID NO: 187423 - protein, 11 aa, Artificial Sequence
  Description of Artificial Sequence: Synthetic peptide
  Seed: YTPLMETHLSS (TYRP2_HUMAN)
YAPLMETHLSI

SEQ ID NO: 187424 - protein, 9 aa, Artificial Sequence
  Description of Artificial Sequence: Synthetic peptide
  Seed: ANDPIFVVL (TYRP2_HUMAN)
AADPIFVVM

SEQ ID NO: 187425 - protein, 9 aa, Artificial Sequence
  Description of Artificial Sequence: Synthetic peptide
  Seed: FVWLHYYSV (TYRP2_HUMAN)
FVWLHYYSR

SEQ ID NO: 187426 - protein, 9 aa, Artificial Sequence
  Description of Artificial Sequence: Synthetic peptide
  Seed: SFLNGTNAL (TYRP2_HUMAN)
STLNGTNAF

SEQ ID NO: 187427 - protein, 9 aa, Artificial Sequence
  Description of Artificial Sequence: Synthetic peptide
  Seed: SFLNGTNAL (TYRP2_HUMAN)
STLNGTNAM

SEQ ID NO: 187428 - protein, 9 aa, Artificial Sequence
  Description of Artificial Sequence: Synthetic peptide
  Seed: QFPRVCMTV (TYRP2_HUMAN)
QFPRVCMTM

SEQ ID NO: 187429 - protein, 10 aa, Artificial Sequence
  Description of Artificial Sequence: Synthetic peptide
  Seed: REQFLGALDL (TYRP2_HUMAN)
REQFLGALDA

SEQ ID NO: 187430 - protein, 10 aa, Artificial Sequence
  Description of Artificial Sequence: Synthetic peptide
  Seed: NPPFFQNSTF (TYRP2_HUMAN)
NFPFFQNSTF

SEQ ID NO: 187431 - protein, 10 aa, Artificial Sequence
  Description of Artificial Sequence: Synthetic peptide
  Seed: DIRDCLSLQK (TYRP2_HUMAN)
DYRDCLSLQR

SEQ ID NO: 187432 - protein, 9 aa, Artificial Sequence
  Description of Artificial Sequence: Synthetic peptide
  Seed: FLTSDQLGY (TYRP2_HUMAN)
FWTSDQLGY

SEQ ID NO: 187433 - protein, 9 aa, Artificial Sequence
  Description of Artificial Sequence: Synthetic peptide
  Seed: STFSFRNAL (TYRP2_HUMAN)
SQFSFRNAM

SEQ ID NO: 187434 - protein, 10 aa, Artificial Sequence
  Description of Artificial Sequence: Synthetic peptide
  Seed: YAIDLPVSVE (TYRP2_HUMAN)
YIIDLPVSVI

SEQ ID NO: 187435 - protein, 9 aa, Artificial Sequence
  Description of Artificial Sequence: Synthetic peptide
  Seed: SLHNLVHSF (TYRP2_HUMAN)
SMHNLVHSI

SEQ ID NO: 187436 - protein, 10 aa, Artificial Sequence
  Description of Artificial Sequence: Synthetic peptide
  Seed: DAIFDEWMKR (TYRP2_HUMAN)
DDIFDEWMKR

SEQ ID NO: 187437 - protein, 10 aa, Artificial Sequence
  Description of Artificial Sequence: Synthetic peptide
  Seed: AARPDDPTLI (TYRP2_HUMAN)
AQRPDDPTLW

SEQ ID NO: 187438 - protein, 10 aa, Artificial Sequence
  Description of Artificial Sequence: Synthetic peptide
  Seed: MSPLWWGFLL (TYRP2_HUMAN)
MFPLWWGFLI

SEQ ID NO: 187439 - protein, 9 aa, Artificial Sequence
  Description of Artificial Sequence: Synthetic peptide
  Seed: TLDSQVMSL (TYRP2_HUMAN)
TTDSQVMSW

SEQ ID NO: 187440 - protein, 9 aa, Artificial Sequence
  Description of Artificial Sequence: Synthetic peptide
  Seed: FTDAIFDEW (TYRP2_HUMAN)
FPDAIFDEF

SEQ ID NO: 187441 - protein, 10 aa, Artificial Sequence
  Description of Artificial Sequence: Synthetic peptide
  Seed: RRLRKGYTPL (TYRP2_HUMAN)
RMLRKGYTPF

SEQ ID NO: 187442 - protein, 10 aa, Artificial Sequence
  Description of Artificial Sequence: Synthetic peptide
  Seed: TRPWSGPYIL (TYRP2_HUMAN)
TVPWSGPYIF

SEQ ID NO: 187443 - protein, 10 aa, Artificial Sequence
  Description of Artificial Sequence: Synthetic peptide
  Seed: SLHNLVHSFL (TYRP2_HUMAN)
SIHNLVHSFV

SEQ ID NO: 187444 - protein, 10 aa, Artificial Sequence
  Description of Artificial Sequence: Synthetic peptide
  Seed: FFPPVTNEEL (TYRP2_HUMAN)
FAPPVTNEEV

SEQ ID NO: 187445 - protein, 11 aa, Artificial Sequence
  Description of Artificial Sequence: Synthetic peptide
  Seed: TQPQFANCSVY (TYRP2_HUMAN)
TLPQFANCSVY

SEQ ID NO: 187446 - protein, 8 aa, Artificial Sequence
  Description of Artificial Sequence: Synthetic peptide
  Seed: YVITTQHW (TYRP2_HUMAN)
YTITTQHW

SEQ ID NO: 187447 - protein, 9 aa, Artificial Sequence
  Description of Artificial Sequence: Synthetic peptide
  Seed: HQGPAFVTW (TYRP2_HUMAN)
HRGPAFVTY

SEQ ID NO: 187448 - protein, 9 aa, Artificial Sequence
  Description of Artificial Sequence: Synthetic peptide
  Seed: YTPLMETHL (TYRP2_HUMAN)
YYPLMETHY

SEQ ID NO: 187449 - protein, 9 aa, Artificial Sequence
  Description of Artificial Sequence: Synthetic peptide
  Seed: LIGNESFAL (TYRP2_HUMAN)
LLGNESFAA

SEQ ID NO: 187450 - protein, 9 aa, Artificial Sequence
  Description of Artificial Sequence: Synthetic peptide
  Seed: FTDAIFDEW (TYRP2_HUMAN)
FPDAIFDEY

SEQ ID NO: 187451 - protein, 10 aa, Artificial Sequence
  Description of Artificial Sequence: Synthetic peptide
  Seed: NGTYEGLLRR (TYRP2_HUMAN)
NSTYEGLLRR

SEQ ID NO: 187452 - protein, 10 aa, Artificial Sequence
  Description of Artificial Sequence: Synthetic peptide
  Seed: SDQLGYSYAI (TYRP2_HUMAN)
SPQLGYSYAF

SEQ ID NO: 187453 - protein, 9 aa, Artificial Sequence
  Description of Artificial Sequence: Synthetic peptide
  Seed: FTDAIFDEW (TYRP2_HUMAN)
FADAIFDEF

SEQ ID NO: 187454 - protein, 10 aa, Artificial Sequence
  Description of Artificial Sequence: Synthetic peptide
  Seed: RMYNMVPFFP (TYRP2_HUMAN)
RMYNMVPFFV

SEQ ID NO: 187455 - protein, 10 aa, Artificial Sequence
  Description of Artificial Sequence: Synthetic peptide
  Seed: SLDDYNHLVT (TYRP2_HUMAN)
SADDYNHLVM

SEQ ID NO: 187456 - protein, 10 aa, Artificial Sequence
  Description of Artificial Sequence: Synthetic peptide
  Seed: YSYAIDLPVS (TYRP2_HUMAN)
YLYAIDLPVV

SEQ ID NO: 187457 - protein, 10 aa, Artificial Sequence
  Description of Artificial Sequence: Synthetic peptide
  Seed: YAIDLPVSVE (TYRP2_HUMAN)
YMIDLPVSVY

SEQ ID NO: 187458 - protein, 10 aa, Artificial Sequence
  Description of Artificial Sequence: Synthetic peptide
  Seed: FANCSVYDFF (TYRP2_HUMAN)
FPNCSVYDFM

SEQ ID NO: 187459 - protein, 9 aa, Artificial Sequence
  Description of Artificial Sequence: Synthetic peptide
  Seed: LLGPGRPYR (TYRP2_HUMAN)
LYGPGRPYR

SEQ ID NO: 187460 - protein, 9 aa, Artificial Sequence
  Description of Artificial Sequence: Synthetic peptide
  Seed: NALEGFDKA (TYRP2_HUMAN)
NVLEGFDKV

SEQ ID NO: 187461 - protein, 10 aa, Artificial Sequence
  Description of Artificial Sequence: Synthetic peptide
  Seed: SHQGPAFVTW (TYRP2_HUMAN)
SYQGPAFVTM

SEQ ID NO: 187462 - protein, 9 aa, Artificial Sequence
  Description of Artificial Sequence: Synthetic peptide
  Seed: FVWLHYYSV (TYRP2_HUMAN)
FLWLHYYSV

SEQ ID NO: 187463 - protein, 9 aa, Artificial Sequence
  Description of Artificial Sequence: Synthetic peptide
  Seed: GPAFVTWHR (TYRP2_HUMAN)
GSAFVTWHR

SEQ ID NO: 187464 - protein, 11 aa, Artificial Sequence
  Description of Artificial Sequence: Synthetic peptide
  Seed: LPVSVEETPGW (TYRP2_HUMAN)
LEVSVEETPGW

SEQ ID NO: 187465 - protein, 9 aa, Artificial Sequence
  Description of Artificial Sequence: Synthetic peptide
  Seed: YAIDLPVSV (TYRP2_HUMAN)
YYIDLPVSA

SEQ ID NO: 187466 - protein, 9 aa, Artificial Sequence
  Description of Artificial Sequence: Synthetic peptide
  Seed: ANDPIFVVL (TYRP2_HUMAN)
AWDPIFVVM

SEQ ID NO: 187467 - protein, 9 aa, Artificial Sequence
  Description of Artificial Sequence: Synthetic peptide
  Seed: DDYNHLVTL (TYRP2_HUMAN)
DLYNHLVTY

SEQ ID NO: 187468 - protein, 9 aa, Artificial Sequence
  Description of Artificial Sequence: Synthetic peptide
  Seed: TLDSQVMSL (TYRP2_HUMAN)
TNDSQVMSV

SEQ ID NO: 187469 - protein, 10 aa, Artificial Sequence
  Description of Artificial Sequence: Synthetic peptide
  Seed: DIRDCLSLQK (TYRP2_HUMAN)
DVRDCLSLQK

SEQ ID NO: 187470 - protein, 9 aa, Artificial Sequence
  Description of Artificial Sequence: Synthetic peptide
  Seed: RLRKGYTPL (TYRP2_HUMAN)
RQRKGYTPG

SEQ ID NO: 187471 - protein, 9 aa, Artificial Sequence
  Description of Artificial Sequence: Synthetic peptide
  Seed: ISRNSRFSS (TYRP2_HUMAN)
IIRNSRFSV

SEQ ID NO: 187472 - protein, 9 aa, Artificial Sequence
  Description of Artificial Sequence: Synthetic peptide
  Seed: YAIDLPVSV (TYRP2_HUMAN)
YIIDLPVSV

SEQ ID NO: 187473 - protein, 9 aa, Artificial Sequence
  Description of Artificial Sequence: Synthetic peptide
  Seed: YYSVRDTLL (TYRP2_HUMAN)
YWSVRDTLF

SEQ ID NO: 187474 - protein, 9 aa, Artificial Sequence
  Description of Artificial Sequence: Synthetic peptide
  Seed: RFNPPADAW (TYRP2_HUMAN)
RANPPADAY

SEQ ID NO: 187475 - protein, 9 aa, Artificial Sequence
  Description of Artificial Sequence: Synthetic peptide
  Seed: YSYAIDLPV (TYRP2_HUMAN)
YQYAIDLPY

SEQ ID NO: 187476 - protein, 11 aa, Artificial Sequence
  Description of Artificial Sequence: Synthetic peptide
  Seed: QPQFANCSVYD (TYRP2_HUMAN)
QQQFANCSVYF

SEQ ID NO: 187477 - protein, 9 aa, Artificial Sequence
  Description of Artificial Sequence: Synthetic peptide
  Seed: WPRKFFHRT (TYRP2_HUMAN)
WPRKFFHRL

SEQ ID NO: 187478 - protein, 9 aa, Artificial Sequence
  Description of Artificial Sequence: Synthetic peptide
  Seed: FFQNSTFSF (TYRP2_HUMAN)
FKQNSTFSI

SEQ ID NO: 187479 - protein, 10 aa, Artificial Sequence
  Description of Artificial Sequence: Synthetic peptide
  Seed: LHYYSVRDTL (TYRP2_HUMAN)
LCYYSVRDTI

SEQ ID NO: 187480 - protein, 9 aa, Artificial Sequence
  Description of Artificial Sequence: Synthetic peptide
  Seed: DDYNHLVTL (TYRP2_HUMAN)
DDYNHLVTF

SEQ ID NO: 187481 - protein, 9 aa, Artificial Sequence
  Description of Artificial Sequence: Synthetic peptide
  Seed: LERDLQRLI (TYRP2_HUMAN)
LERDLQRLV

SEQ ID NO: 187482 - protein, 11 aa, Artificial Sequence
  Description of Artificial Sequence: Synthetic peptide
  Seed: SLDDYNHLVTL (TYRP2_HUMAN)
SCDDYNHLVTF

SEQ ID NO: 187483 - protein, 11 aa, Artificial Sequence
  Description of Artificial Sequence: Synthetic peptide
  Seed: SLDDYNHLVTL (TYRP2_HUMAN)
SIDDYNHLVTI

SEQ ID NO: 187484 - protein, 11 aa, Artificial Sequence
  Description of Artificial Sequence: Synthetic peptide
  Seed: YNMVPFFPPVT (TYRP2_HUMAN)
YMMVPFFPPVK

SEQ ID NO: 187485 - protein, 9 aa, Artificial Sequence
  Description of Artificial Sequence: Synthetic peptide
  Seed: MTVDSLVNK (TYRP2_HUMAN)
MVVDSLVNK

SEQ ID NO: 187486 - protein, 10 aa, Artificial Sequence
  Description of Artificial Sequence: Synthetic peptide
  Seed: YNMVPFFPPV (TYRP2_HUMAN)
YEMVPFFPPV

SEQ ID NO: 187487 - protein, 9 aa, Artificial Sequence
  Description of Artificial Sequence: Synthetic peptide
  Seed: ILPGAQGQF (TYRP2_HUMAN)
IYPGAQGQY

SEQ ID NO: 187488 - protein, 10 aa, Artificial Sequence
  Description of Artificial Sequence: Synthetic peptide
  Seed: RMYNMVPFFP (TYRP2_HUMAN)
RTYNMVPFFV

SEQ ID NO: 187489 - protein, 11 aa, Artificial Sequence
  Description of Artificial Sequence: Synthetic peptide
  Seed: PPFFQNSTFSF (TYRP2_HUMAN)
PWFFQNSTFSF

SEQ ID NO: 187490 - protein, 9 aa, Artificial Sequence
  Description of Artificial Sequence: Synthetic peptide
  Seed: VTNEELFLT (TYRP2_HUMAN)
VQNEELFLL

SEQ ID NO: 187491 - protein, 10 aa, Artificial Sequence
  Description of Artificial Sequence: Synthetic peptide
  Seed: GPAFVTWHRY (TYRP2_HUMAN)
GQAFVTWHRY

SEQ ID NO: 187492 - protein, 11 aa, Artificial Sequence
  Description of Artificial Sequence: Synthetic peptide
  Seed: RNQDDRELWPR (TYRP2_HUMAN)
RVQDDRELWPR

SEQ ID NO: 187493 - protein, 9 aa, Artificial Sequence
  Description of Artificial Sequence: Synthetic peptide
  Seed: RQNIHSLSP (TYRP2_HUMAN)
RQNIHSLSW

SEQ ID NO: 187494 - protein, 9 aa, Artificial Sequence
  Description of Artificial Sequence: Synthetic peptide
  Seed: RMYNMVPFF (TYRP2_HUMAN)
RMYNMVPFK

SEQ ID NO: 187495 - protein, 9 aa, Artificial Sequence
  Description of Artificial Sequence: Synthetic peptide
  Seed: RFNPPADAW (TYRP2_HUMAN)
RYNPPADAM

SEQ ID NO: 187496 - protein, 9 aa, Artificial Sequence
  Description of Artificial Sequence: Synthetic peptide
  Seed: SPLWWGFLL (TYRP2_HUMAN)
SPLWWGFLI

SEQ ID NO: 187497 - protein, 10 aa, Artificial Sequence
  Description of Artificial Sequence: Synthetic peptide
  Seed: FVWLHYYSVR (TYRP2_HUMAN)
FMWLHYYSVL

SEQ ID NO: 187498 - protein, 9 aa, Artificial Sequence
  Description of Artificial Sequence: Synthetic peptide
  Seed: DTRPWSGPY (TYRP2_HUMAN)
DTRPWSGPK

SEQ ID NO: 187499 - protein, 9 aa, Artificial Sequence
  Description of Artificial Sequence: Synthetic peptide
  Seed: DTRPWSGPY (TYRP2_HUMAN)
DVRPWSGPK

SEQ ID NO: 187500 - protein, 9 aa, Artificial Sequence
  Description of Artificial Sequence: Synthetic peptide
  Seed: VIRQNIHSL (TYRP2_HUMAN)
VFRQNIHSY

SEQ ID NO: 187501 - protein, 9 aa, Artificial Sequence
  Description of Artificial Sequence: Synthetic peptide
  Seed: QRLIGNESF (TYRP2_HUMAN)
QMLIGNESF

SEQ ID NO: 187502 - protein, 9 aa, Artificial Sequence
  Description of Artificial Sequence: Synthetic peptide
  Seed: LAPIGHNRM (TYRP2_HUMAN)
LYPIGHNRM

SEQ ID NO: 187503 - protein, 10 aa, Artificial Sequence
  Description of Artificial Sequence: Synthetic peptide
  Seed: TVDSLVNKEC (TYRP2_HUMAN)
TLDSLVNKEL

SEQ ID NO: 187504 - protein, 9 aa, Artificial Sequence
  Description of Artificial Sequence: Synthetic peptide
  Seed: YSYAIDLPV (TYRP2_HUMAN)
YVYAIDLPF

SEQ ID NO: 187505 - protein, 9 aa, Artificial Sequence
  Description of Artificial Sequence: Synthetic peptide
  Seed: TQHWLGLLG (TYRP2_HUMAN)
TQHWLGLLF

SEQ ID NO: 187506 - protein, 9 aa, Artificial Sequence
  Description of Artificial Sequence: Synthetic peptide
  Seed: FSHQGPAFV (TYRP2_HUMAN)
FLHQGPAFF

SEQ ID NO: 187507 - protein, 11 aa, Artificial Sequence
  Description of Artificial Sequence: Synthetic peptide
  Seed: RADTRPWSGPY (TYRP2_HUMAN)
RYDTRPWSGPF

SEQ ID NO: 187508 - protein, 10 aa, Artificial Sequence
  Description of Artificial Sequence: Synthetic peptide
  Seed: YNMVPFFPPV (TYRP2_HUMAN)
YAMVPFFPPV

SEQ ID NO: 187509 - protein, 9 aa, Artificial Sequence
  Description of Artificial Sequence: Synthetic peptide
  Seed: RMYNMVPFF (TYRP2_HUMAN)
RYYNMVPFS

SEQ ID NO: 187510 - protein, 10 aa, Artificial Sequence
  Description of Artificial Sequence: Synthetic peptide
  Seed: KILPGAQGQF (TYRP2_HUMAN)
KVLPGAQGQR

SEQ ID NO: 187511 - protein, 10 aa, Artificial Sequence
  Description of Artificial Sequence: Synthetic peptide
  Seed: YAIDLPVSVE (TYRP2_HUMAN)
YMIDLPVSVC

SEQ ID NO: 187512 - protein, 9 aa, Artificial Sequence
  Description of Artificial Sequence: Synthetic peptide
  Seed: YSYAIDLPV (TYRP2_HUMAN)
YGYAIDLPV

SEQ ID NO: 187513 - protein, 9 aa, Artificial Sequence
  Description of Artificial Sequence: Synthetic peptide
  Seed: ANDPIFVVL (TYRP2_HUMAN)
AMDPIFVVM

SEQ ID NO: 187514 - protein, 10 aa, Artificial Sequence
  Description of Artificial Sequence: Synthetic peptide
  Seed: SYAIDLPVSV (TYRP2_HUMAN)
SFAIDLPVSF

SEQ ID NO: 187515 - protein, 9 aa, Artificial Sequence
  Description of Artificial Sequence: Synthetic peptide
  Seed: VTWHRYHLL (TYRP2_HUMAN)
VAWHRYHLF

SEQ ID NO: 187516 - protein, 9 aa, Artificial Sequence
  Description of Artificial Sequence: Synthetic peptide
  Seed: FPPVTNEEL (TYRP2_HUMAN)
FSPVTNEEV

SEQ ID NO: 187517 - protein, 10 aa, Artificial Sequence
  Description of Artificial Sequence: Synthetic peptide
  Seed: GWPTTLLVVM (TYRP2_HUMAN)
GMPTTLLVVM

SEQ ID NO: 187518 - protein, 9 aa, Artificial Sequence
  Description of Artificial Sequence: Synthetic peptide
  Seed: ISRNSRFSS (TYRP2_HUMAN)
IVRNSRFSK

SEQ ID NO: 187519 - protein, 9 aa, Artificial Sequence
  Description of Artificial Sequence: Synthetic peptide
  Seed: RPWSGPYIL (TYRP2_HUMAN)
RQWSGPYIF

SEQ ID NO: 187520 - protein, 8 aa, Artificial Sequence
  Description of Artificial Sequence: Synthetic peptide
  Seed: FLNGTNAL (TYRP2_HUMAN)
FWNGTNAM

SEQ ID NO: 187521 - protein, 10 aa, Artificial Sequence
  Description of Artificial Sequence: Synthetic peptide
  Seed: DPTLISRNSR (TYRP2_HUMAN)
DTTLISRNSK

SEQ ID NO: 187522 - protein, 9 aa, Artificial Sequence
  Description of Artificial Sequence: Synthetic peptide
  Seed: NMVPFFPPV (TYRP2_HUMAN)
NVVPFFPPI

SEQ ID NO: 187523 - protein, 9 aa, Artificial Sequence
  Description of Artificial Sequence: Synthetic peptide
  Seed: HQGPAFVTW (TYRP2_HUMAN)
HSGPAFVTY

SEQ ID NO: 187524 - protein, 11 aa, Artificial Sequence
  Description of Artificial Sequence: Synthetic peptide
  Seed: YSYAIDLPVSV (TYRP2_HUMAN)
YIYAIDLPVSL

SEQ ID NO: 187525 - protein, 9 aa, Artificial Sequence
  Description of Artificial Sequence: Synthetic peptide
  Seed: ITTQHWLGL (TYRP2_HUMAN)
ISTQHWLGF

SEQ ID NO: 187526 - protein, 10 aa, Artificial Sequence
  Description of Artificial Sequence: Synthetic peptide
  Seed: IDFSHQGPAF (TYRP2_HUMAN)
IEFSHQGPAM

SEQ ID NO: 187527 - protein, 10 aa, Artificial Sequence
  Description of Artificial Sequence: Synthetic peptide
  Seed: LHYYSVRDTL (TYRP2_HUMAN)
LMYYSVRDTM

SEQ ID NO: 187528 - protein, 9 aa, Artificial Sequence
  Description of Artificial Sequence: Synthetic peptide
  Seed: AWPQELAPI (TYRP2_HUMAN)
AFPQELAPY

SEQ ID NO: 187529 - protein, 9 aa, Artificial Sequence
  Description of Artificial Sequence: Synthetic peptide
  Seed: AWPQELAPI (TYRP2_HUMAN)
AFPQELAPL

SEQ ID NO: 187530 - protein, 9 aa, Artificial Sequence
  Description of Artificial Sequence: Synthetic peptide
  Seed: LLRRNQMGR (TYRP2_HUMAN)
LSRRNQMGR

SEQ ID NO: 187531 - protein, 10 aa, Artificial Sequence
  Description of Artificial Sequence: Synthetic peptide
  Seed: TRPWSGPYIL (TYRP2_HUMAN)
TFPWSGPYIY

SEQ ID NO: 187532 - protein, 10 aa, Artificial Sequence
  Description of Artificial Sequence: Synthetic peptide
  Seed: KILPGAQGQF (TYRP2_HUMAN)
KTLPGAQGQL

SEQ ID NO: 187533 - protein, 10 aa, Artificial Sequence
  Description of Artificial Sequence: Synthetic peptide
  Seed: VGLFVLLAFL (TYRP2_HUMAN)
VFLFVLLAFV

SEQ ID NO: 187534 - protein, 9 aa, Artificial Sequence
  Description of Artificial Sequence: Synthetic peptide
  Seed: RKFFHRTCK (TYRP2_HUMAN)
RMFFHRTCM

SEQ ID NO: 187535 - protein, 9 aa, Artificial Sequence
  Description of Artificial Sequence: Synthetic peptide
  Seed: RLRKGYTPL (TYRP2_HUMAN)
RPRKGYTPE

SEQ ID NO: 187536 - protein, 10 aa, Artificial Sequence
  Description of Artificial Sequence: Synthetic peptide
  Seed: RNQMGRNSMK (TYRP2_HUMAN)
RGQMGRNSMR

SEQ ID NO: 187537 - protein, 10 aa, Artificial Sequence
  Description of Artificial Sequence: Synthetic peptide
  Seed: QPQFANCSVY (TYRP2_HUMAN)
QWQFANCSVM

SEQ ID NO: 187538 - protein, 9 aa, Artificial Sequence
  Description of Artificial Sequence: Synthetic peptide
  Seed: FVWLHYYSV (TYRP2_HUMAN)
FQWLHYYSA

SEQ ID NO: 187539 - protein, 9 aa, Artificial Sequence
  Description of Artificial Sequence: Synthetic peptide
  Seed: LAFLQYRRL (TYRP2_HUMAN)
LAFLQYRRY

SEQ ID NO: 187540 - protein, 9 aa, Artificial Sequence
  Description of Artificial Sequence: Synthetic peptide
  Seed: RLRKGYTPL (TYRP2_HUMAN)
RLRKGYTPQ

SEQ ID NO: 187541 - protein, 9 aa, Artificial Sequence
  Description of Artificial Sequence: Synthetic peptide
  Seed: VTWHRYHLL (TYRP2_HUMAN)
VLWHRYHLF

SEQ ID NO: 187542 - protein, 10 aa, Artificial Sequence
  Description of Artificial Sequence: Synthetic peptide
  Seed: YDFFVWLHYY (TYRP2_HUMAN)
YFFFVWLHYT

SEQ ID NO: 187543 - protein, 9 aa, Artificial Sequence
  Description of Artificial Sequence: Synthetic peptide
  Seed: SVYDFFVWL (TYRP2_HUMAN)
SNYDFFVWY

SEQ ID NO: 187544 - protein, 10 aa, Artificial Sequence
  Description of Artificial Sequence: Synthetic peptide
  Seed: RLRKGYTPLM (TYRP2_HUMAN)
RTRKGYTPLY

SEQ ID NO: 187545 - protein, 9 aa, Artificial Sequence
  Description of Artificial Sequence: Synthetic peptide
  Seed: MTVDSLVNK (TYRP2_HUMAN)
MVVDSLVNR

SEQ ID NO: 187546 - protein, 9 aa, Artificial Sequence
  Description of Artificial Sequence: Synthetic peptide
  Seed: NSMKLPTLK (TYRP2_HUMAN)
NVMKLPTLK

SEQ ID NO: 187547 - protein, 10 aa, Artificial Sequence
  Description of Artificial Sequence: Synthetic peptide
  Seed: SPLWWGFLLS (TYRP2_HUMAN)
SPLWWGFLLV

SEQ ID NO: 187548 - protein, 9 aa, Artificial Sequence
  Description of Artificial Sequence: Synthetic peptide
  Seed: VVMGTLVAL (TYRP2_HUMAN)
VTMGTLVAV

SEQ ID NO: 187549 - protein, 9 aa, Artificial Sequence
  Description of Artificial Sequence: Synthetic peptide
  Seed: AARPDDPTL (TYRP2_HUMAN)
APRPDDPTY

SEQ ID NO: 187550 - protein, 9 aa, Artificial Sequence
  Description of Artificial Sequence: Synthetic peptide
  Seed: SQVMSLHNL (TYRP2_HUMAN)
SHVMSLHNA

SEQ ID NO: 187551 - protein, 9 aa, Artificial Sequence
  Description of Artificial Sequence: Synthetic peptide
  Seed: FTDAIFDEW (TYRP2_HUMAN)
FSDAIFDEL

SEQ ID NO: 187552 - protein, 11 aa, Artificial Sequence
  Description of Artificial Sequence: Synthetic peptide
  Seed: RADTRPWSGPY (TYRP2_HUMAN)
RPDTRPWSGPK

SEQ ID NO: 187553 - protein, 9 aa, Artificial Sequence
  Description of Artificial Sequence: Synthetic peptide
  Seed: RMYNMVPFF (TYRP2_HUMAN)
RFYNMVPFV

SEQ ID NO: 187554 - protein, 9 aa, Artificial Sequence
  Description of Artificial Sequence: Synthetic peptide
  Seed: SLDDYNHLV (TYRP2_HUMAN)
SMDDYNHLV

SEQ ID NO: 187555 - protein, 9 aa, Artificial Sequence
  Description of Artificial Sequence: Synthetic peptide
  Seed: VLHSFTDAI (TYRP2_HUMAN)
VAHSFTDAL

SEQ ID NO: 187556 - protein, 10 aa, Artificial Sequence
  Description of Artificial Sequence: Synthetic peptide
  Seed: DAIFDEWMKR (TYRP2_HUMAN)
DEIFDEWMKR

SEQ ID NO: 187557 - protein, 10 aa, Artificial Sequence
  Description of Artificial Sequence: Synthetic peptide
  Seed: LHYYSVRDTL (TYRP2_HUMAN)
LNYYSVRDTL

SEQ ID NO: 187558 - protein, 10 aa, Artificial Sequence
  Description of Artificial Sequence: Synthetic peptide
  Seed: KRFNPPADAW (TYRP2_HUMAN)
KQFNPPADAF

SEQ ID NO: 187559 - protein, 9 aa, Artificial Sequence
  Description of Artificial Sequence: Synthetic peptide
  Seed: VTNEELFLT (TYRP2_HUMAN)
VLNEELFLV

SEQ ID NO: 187560 - protein, 10 aa, Artificial Sequence
  Description of Artificial Sequence: Synthetic peptide
  Seed: AFLQYRRLRK (TYRP2_HUMAN)
AMLQYRRLRR

SEQ ID NO: 187561 - protein, 10 aa, Artificial Sequence
  Description of Artificial Sequence: Synthetic peptide
  Seed: VVMGTLVALV (TYRP2_HUMAN)
VLMGTLVALF

SEQ ID NO: 187562 - protein, 8 aa, Artificial Sequence
  Description of Artificial Sequence: Synthetic peptide
  Seed: LDDYNHLV (TYRP2_HUMAN)
LYDYNHLV

SEQ ID NO: 187563 - protein, 9 aa, Artificial Sequence
  Description of Artificial Sequence: Synthetic peptide
  Seed: AIFDEWMKR (TYRP2_HUMAN)
AVFDEWMKY

SEQ ID NO: 187564 - protein, 9 aa, Artificial Sequence
  Description of Artificial Sequence: Synthetic peptide
  Seed: RRLRKGYTP (TYRP2_HUMAN)
RRLRKGYTY

SEQ ID NO: 187565 - protein, 9 aa, Artificial Sequence
  Description of Artificial Sequence: Synthetic peptide
  Seed: FLTSDQLGY (TYRP2_HUMAN)
FSTSDQLGY

SEQ ID NO: 187566 - protein, 11 aa, Artificial Sequence
  Description of Artificial Sequence: Synthetic peptide
  Seed: QPQFANCSVYD (TYRP2_HUMAN)
QKQFANCSVYF

SEQ ID NO: 187567 - protein, 9 aa, Artificial Sequence
  Description of Artificial Sequence: Synthetic peptide
  Seed: DTRPWSGPY (TYRP2_HUMAN)
DSRPWSGPR

SEQ ID NO: 187568 - protein, 9 aa, Artificial Sequence
  Description of Artificial Sequence: Synthetic peptide
  Seed: TLLGPGRPY (TYRP2_HUMAN)
TFLGPGRPV

SEQ ID NO: 187569 - protein, 9 aa, Artificial Sequence
  Description of Artificial Sequence: Synthetic peptide
  Seed: YSYAIDLPV (TYRP2_HUMAN)
YPYAIDLPN

SEQ ID NO: 187570 - protein, 10 aa, Artificial Sequence
  Description of Artificial Sequence: Synthetic peptide
  Seed: FLLSCLGCKI (TYRP2_HUMAN)
FQLSCLGCKI

SEQ ID NO: 187571 - protein, 10 aa, Artificial Sequence
  Description of Artificial Sequence: Synthetic peptide
  Seed: MSLHNLVHSF (TYRP2_HUMAN)
MHLHNLVHSF

SEQ ID NO: 187572 - protein, 11 aa, Artificial Sequence
  Description of Artificial Sequence: Synthetic peptide
  Seed: YNMVPFFPPVT (TYRP2_HUMAN)
YLMVPFFPPVL

SEQ ID NO: 187573 - protein, 9 aa, Artificial Sequence
  Description of Artificial Sequence: Synthetic peptide
  Seed: GFDKADGTL (TYRP2_HUMAN)
GYDKADGTL

SEQ ID NO: 187574 - protein, 10 aa, Artificial Sequence
  Description of Artificial Sequence: Synthetic peptide
  Seed: VGLFVLLAFL (TYRP2_HUMAN)
VWLFVLLAFV

SEQ ID NO: 187575 - protein, 9 aa, Artificial Sequence
  Description of Artificial Sequence: Synthetic peptide
  Seed: QVMSLHNLV (TYRP2_HUMAN)
QSMSLHNLR

SEQ ID NO: 187576 - protein, 9 aa, Artificial Sequence
  Description of Artificial Sequence: Synthetic peptide
  Seed: QVMSLHNLV (TYRP2_HUMAN)
QAMSLHNLV

SEQ ID NO: 187577 - protein, 9 aa, Artificial Sequence
  Description of Artificial Sequence: Synthetic peptide
  Seed: YSYAIDLPV (TYRP2_HUMAN)
YLYAIDLPL

SEQ ID NO: 187578 - protein, 9 aa, Artificial Sequence
  Description of Artificial Sequence: Synthetic peptide
  Seed: ETPGWPTTL (TYRP2_HUMAN)
EVPGWPTTY

SEQ ID NO: 187579 - protein, 9 aa, Artificial Sequence
  Description of Artificial Sequence: Synthetic peptide
  Seed: YAIDLPVSV (TYRP2_HUMAN)
YIIDLPVSL

SEQ ID NO: 187580 - protein, 9 aa, Artificial Sequence
  Description of Artificial Sequence: Synthetic peptide
  Seed: FFQNSTFSF (TYRP2_HUMAN)
FQQNSTFSV

SEQ ID NO: 187581 - protein, 9 aa, Artificial Sequence
  Description of Artificial Sequence: Synthetic peptide
  Seed: GWPTTLLVV (TYRP2_HUMAN)
GYPTTLLVW

SEQ ID NO: 187582 - protein, 10 aa, Artificial Sequence
  Description of Artificial Sequence: Synthetic peptide
  Seed: LGPGRPYRAI (TYRP2_HUMAN)
LEPGRPYRAL

SEQ ID NO: 187583 - protein, 9 aa, Artificial Sequence
  Description of Artificial Sequence: Synthetic peptide
  Seed: EQFLGALDL (TYRP2_HUMAN)
EQFLGALDF

SEQ ID NO: 187584 - protein, 9 aa, Artificial Sequence
  Description of Artificial Sequence: Synthetic peptide
  Seed: VTWHRYHLL (TYRP2_HUMAN)
VMWHRYHLT

SEQ ID NO: 187585 - protein, 9 aa, Artificial Sequence
  Description of Artificial Sequence: Synthetic peptide
  Seed: RQNIHSLSP (TYRP2_HUMAN)
RYNIHSLSM

SEQ ID NO: 187586 - protein, 9 aa, Artificial Sequence
  Description of Artificial Sequence: Synthetic peptide
  Seed: TLDSQVMSL (TYRP2_HUMAN)
TIDSQVMSM

SEQ ID NO: 187587 - protein, 10 aa, Artificial Sequence
  Description of Artificial Sequence: Synthetic peptide
  Seed: REQFLGALDL (TYRP2_HUMAN)
REQFLGALDF

SEQ ID NO: 187588 - protein, 9 aa, Artificial Sequence
  Description of Artificial Sequence: Synthetic peptide
  Seed: LHSFTDAIF (TYRP2_HUMAN)
LQSFTDAIM

SEQ ID NO: 187589 - protein, 9 aa, Artificial Sequence
  Description of Artificial Sequence: Synthetic peptide
  Seed: RLRKGYTPL (TYRP2_HUMAN)
RIRKGYTPI

SEQ ID NO: 187590 - protein, 10 aa, Artificial Sequence
  Description of Artificial Sequence: Synthetic peptide
  Seed: SLQKFDNPPF (TYRP2_HUMAN)
SCQKFDNPPF

SEQ ID NO: 187591 - protein, 9 aa, Artificial Sequence
  Description of Artificial Sequence: Synthetic peptide
  Seed: SLHNLVHSF (TYRP2_HUMAN)
SVHNLVHSA

SEQ ID NO: 187592 - protein, 9 aa, Artificial Sequence
  Description of Artificial Sequence: Synthetic peptide
  Seed: GTNALPHSA (TYRP2_HUMAN)
GLNALPHSV

SEQ ID NO: 187593 - protein, 10 aa, Artificial Sequence
  Description of Artificial Sequence: Synthetic peptide
  Seed: VVLHSFTDAI (TYRP2_HUMAN)
VWLHSFTDAL

SEQ ID NO: 187594 - protein, 9 aa, Artificial Sequence
  Description of Artificial Sequence: Synthetic peptide
  Seed: HQGPAFVTW (TYRP2_HUMAN)
HTGPAFVTL

SEQ ID NO: 187595 - protein, 9 aa, Artificial Sequence
  Description of Artificial Sequence: Synthetic peptide
  Seed: YAIDLPVSV (TYRP2_HUMAN)
YHIDLPVSA

SEQ ID NO: 187596 - protein, 8 aa, Artificial Sequence
  Description of Artificial Sequence: Synthetic peptide
  Seed: AIDLPVSV (TYRP2_HUMAN)
AMDLPVSM

SEQ ID NO: 187597 - protein, 9 aa, Artificial Sequence
  Description of Artificial Sequence: Synthetic peptide
  Seed: AIFDEWMKR (TYRP2_HUMAN)
AVFDEWMKF

SEQ ID NO: 187598 - protein, 9 aa, Artificial Sequence
  Description of Artificial Sequence: Synthetic peptide
  Seed: FANCSVYDF (TYRP2_HUMAN)
FPNCSVYDA

SEQ ID NO: 187599 - protein, 10 aa, Artificial Sequence
  Description of Artificial Sequence: Synthetic peptide
  Seed: TLLGPGRPYR (TYRP2_HUMAN)
TYLGPGRPYR

SEQ ID NO: 187600 - protein, 11 aa, Artificial Sequence
  Description of Artificial Sequence: Synthetic peptide
  Seed: YTPLMETHLSS (TYRP2_HUMAN)
YGPLMETHLSM

SEQ ID NO: 187601 - protein, 9 aa, Artificial Sequence
  Description of Artificial Sequence: Synthetic peptide
  Seed: ANDPIFVVL (TYRP2_HUMAN)
ANDPIFVVV

SEQ ID NO: 187602 - protein, 10 aa, Artificial Sequence
  Description of Artificial Sequence: Synthetic peptide
  Seed: VLLAFLQYRR (TYRP2_HUMAN)
VELAFLQYRK

SEQ ID NO: 187603 - protein, 10 aa, Artificial Sequence
  Description of Artificial Sequence: Synthetic peptide
  Seed: RNSRFSSWET (TYRP2_HUMAN)
RFSRFSSWES

SEQ ID NO: 187604 - protein, 9 aa, Artificial Sequence
  Description of Artificial Sequence: Synthetic peptide
  Seed: LLAFLQYRR (TYRP2_HUMAN)
LFAFLQYRR

SEQ ID NO: 187605 - protein, 9 aa, Artificial Sequence
  Description of Artificial Sequence: Synthetic peptide
  Seed: IGHNRMYNM (TYRP2_HUMAN)
IAHNRMYNF

SEQ ID NO: 187606 - protein, 9 aa, Artificial Sequence
  Description of Artificial Sequence: Synthetic peptide
  Seed: TSDQLGYSY (TYRP2_HUMAN)
TADQLGYSV

SEQ ID NO: 187607 - protein, 10 aa, Artificial Sequence
  Description of Artificial Sequence: Synthetic peptide
  Seed: SLDDYNHLVT (TYRP2_HUMAN)
SGDDYNHLVV

SEQ ID NO: 187608 - protein, 10 aa, Artificial Sequence
  Description of Artificial Sequence: Synthetic peptide
  Seed: HNRMYNMVPF (TYRP2_HUMAN)
HERMYNMVPY

SEQ ID NO: 187609 - protein, 9 aa, Artificial Sequence
  Description of Artificial Sequence: Synthetic peptide
  Seed: FVWLHYYSV (TYRP2_HUMAN)
FLWLHYYSM

SEQ ID NO: 187610 - protein, 9 aa, Artificial Sequence
  Description of Artificial Sequence: Synthetic peptide
  Seed: RMYNMVPFF (TYRP2_HUMAN)
RMYNMVPFC

SEQ ID NO: 187611 - protein, 9 aa, Artificial Sequence
  Description of Artificial Sequence: Synthetic peptide
  Seed: FQNSTFSFR (TYRP2_HUMAN)
FINSTFSFY

SEQ ID NO: 187612 - protein, 9 aa, Artificial Sequence
  Description of Artificial Sequence: Synthetic peptide
  Seed: FLLSCLGCK (TYRP2_HUMAN)
FILSCLGCR

SEQ ID NO: 187613 - protein, 11 aa, Artificial Sequence
  Description of Artificial Sequence: Synthetic peptide
  Seed: MSLHNLVHSFL (TYRP2_HUMAN)
MFLHNLVHSFV

SEQ ID NO: 187614 - protein, 10 aa, Artificial Sequence
  Description of Artificial Sequence: Synthetic peptide
  Seed: ETPGWPTTLL (TYRP2_HUMAN)
EIPGWPTTLR

SEQ ID NO: 187615 - protein, 10 aa, Artificial Sequence
  Description of Artificial Sequence: Synthetic peptide
  Seed: FVVLHSFTDA (TYRP2_HUMAN)
FDVLHSFTDV

SEQ ID NO: 187616 - protein, 10 aa, Artificial Sequence
  Description of Artificial Sequence: Synthetic peptide
  Seed: FANCSVYDFF (TYRP2_HUMAN)
FMNCSVYDFF

SEQ ID NO: 187617 - protein, 9 aa, Artificial Sequence
  Description of Artificial Sequence: Synthetic peptide
  Seed: YSYAIDLPV (TYRP2_HUMAN)
YQYAIDLPA

SEQ ID NO: 187618 - protein, 11 aa, Artificial Sequence
  Description of Artificial Sequence: Synthetic peptide
  Seed: YNMVPFFPPVT (TYRP2_HUMAN)
YLMVPFFPPVI

SEQ ID NO: 187619 - protein, 11 aa, Artificial Sequence
  Description of Artificial Sequence: Synthetic peptide
  Seed: YNMVPFFPPVT (TYRP2_HUMAN)
YTMVPFFPPVN

SEQ ID NO: 187620 - protein, 9 aa, Artificial Sequence
  Description of Artificial Sequence: Synthetic peptide
  Seed: HSFLNGTNA (TYRP2_HUMAN)
HQFLNGTNV

SEQ ID NO: 187621 - protein, 11 aa, Artificial Sequence
  Description of Artificial Sequence: Synthetic peptide
  Seed: WLHYYSVRDTL (TYRP2_HUMAN)
WKHYYSVRDTW

SEQ ID NO: 187622 - protein, 9 aa, Artificial Sequence
  Description of Artificial Sequence: Synthetic peptide
  Seed: VSVEETPGW (TYRP2_HUMAN)
VTVEETPGW

SEQ ID NO: 187623 - protein, 10 aa, Artificial Sequence
  Description of Artificial Sequence: Synthetic peptide
  Seed: IDFSHQGPAF (TYRP2_HUMAN)
IFFSHQGPAL

SEQ ID NO: 187624 - protein, 10 aa, Artificial Sequence
  Description of Artificial Sequence: Synthetic peptide
  Seed: MSPLWWGFLL (TYRP2_HUMAN)
MWPLWWGFLF

SEQ ID NO: 187625 - protein, 9 aa, Artificial Sequence
  Description of Artificial Sequence: Synthetic peptide
  Seed: AFLQYRRLR (TYRP2_HUMAN)
ATLQYRRLK

SEQ ID NO: 187626 - protein, 10 aa, Artificial Sequence
  Description of Artificial Sequence: Synthetic peptide
  Seed: YDFFVWLHYY (TYRP2_HUMAN)
YYFFVWLHYY

SEQ ID NO: 187627 - protein, 11 aa, Artificial Sequence
  Description of Artificial Sequence: Synthetic peptide
  Seed: RNSRFSSWETV (TYRP2_HUMAN)
RHSRFSSWETM

SEQ ID NO: 187628 - protein, 9 aa, Artificial Sequence
  Description of Artificial Sequence: Synthetic peptide
  Seed: RLRKGYTPL (TYRP2_HUMAN)
RMRKGYTPP

SEQ ID NO: 187629 - protein, 8 aa, Artificial Sequence
  Description of Artificial Sequence: Synthetic peptide
  Seed: VPFFPPVT (TYRP2_HUMAN)
VPFFPPVL

SEQ ID NO: 187630 - protein, 9 aa, Artificial Sequence
  Description of Artificial Sequence: Synthetic peptide
  Seed: YTPLMETHL (TYRP2_HUMAN)
YAPLMETHF

SEQ ID NO: 187631 - protein, 10 aa, Artificial Sequence
  Description of Artificial Sequence: Synthetic peptide
  Seed: MSPLWWGFLL (TYRP2_HUMAN)
MGPLWWGFLW

SEQ ID NO: 187632 - protein, 9 aa, Artificial Sequence
  Description of Artificial Sequence: Synthetic peptide
  Seed: WPQELAPIG (TYRP2_HUMAN)
WSQELAPIY

SEQ ID NO: 187633 - protein, 9 aa, Artificial Sequence
  Description of Artificial Sequence: Synthetic peptide
  Seed: QVMSLHNLV (TYRP2_HUMAN)
QTMSLHNLA

SEQ ID NO: 187634 - protein, 10 aa, Artificial Sequence
  Description of Artificial Sequence: Synthetic peptide
  Seed: QPQFANCSVY (TYRP2_HUMAN)
QCQFANCSVY

SEQ ID NO: 187635 - protein, 11 aa, Artificial Sequence
  Description of Artificial Sequence: Synthetic peptide
  Seed: ILRNQDDRELW (TYRP2_HUMAN)
IVRNQDDRELW

SEQ ID NO: 187636 - protein, 9 aa, Artificial Sequence
  Description of Artificial Sequence: Synthetic peptide
  Seed: VVLHSFTDA (TYRP2_HUMAN)
VVLHSFTDV

SEQ ID NO: 187637 - protein, 10 aa, Artificial Sequence
  Description of Artificial Sequence: Synthetic peptide
  Seed: TRPWSGPYIL (TYRP2_HUMAN)
TEPWSGPYIF

SEQ ID NO: 187638 - protein, 9 aa, Artificial Sequence
  Description of Artificial Sequence: Synthetic peptide
  Seed: TLDSQVMSL (TYRP2_HUMAN)
THDSQVMSW

SEQ ID NO: 187639 - protein, 10 aa, Artificial Sequence
  Description of Artificial Sequence: Synthetic peptide
  Seed: SLDDYNHLVT (TYRP2_HUMAN)
SGDDYNHLVL

SEQ ID NO: 187640 - protein, 9 aa, Artificial Sequence
  Description of Artificial Sequence: Synthetic peptide
  Seed: WMKRFNPPA (TYRP2_HUMAN)
WLKRFNPPM

SEQ ID NO: 187641 - protein, 9 aa, Artificial Sequence
  Description of Artificial Sequence: Synthetic peptide
  Seed: RMYNMVPFF (TYRP2_HUMAN)
RGYNMVPFK

SEQ ID NO: 187642 - protein, 9 aa, Artificial Sequence
  Description of Artificial Sequence: Synthetic peptide
  Seed: DDYNHLVTL (TYRP2_HUMAN)
DIYNHLVTI

SEQ ID NO: 187643 - protein, 9 aa, Artificial Sequence
  Description of Artificial Sequence: Synthetic peptide
  Seed: ISRNSRFSS (TYRP2_HUMAN)
ISRNSRFSK

SEQ ID NO: 187644 - protein, 10 aa, Artificial Sequence
  Description of Artificial Sequence: Synthetic peptide
  Seed: SHQGPAFVTW (TYRP2_HUMAN)
SWQGPAFVTL

SEQ ID NO: 187645 - protein, 10 aa, Artificial Sequence
  Description of Artificial Sequence: Synthetic peptide
  Seed: RRLRKGYTPL (TYRP2_HUMAN)
RTLRKGYTPR

SEQ ID NO: 187646 - protein, 10 aa, Artificial Sequence
  Description of Artificial Sequence: Synthetic peptide
  Seed: SDQLGYSYAI (TYRP2_HUMAN)
SEQLGYSYAV

SEQ ID NO: 187647 - protein, 9 aa, Artificial Sequence
  Description of Artificial Sequence: Synthetic peptide
  Seed: YYSVRDTLL (TYRP2_HUMAN)
YFSVRDTLM

SEQ ID NO: 187648 - protein, 10 aa, Artificial Sequence
  Description of Artificial Sequence: Synthetic peptide
  Seed: GQFPRVCMTV (TYRP2_HUMAN)
GRFPRVCMTI

SEQ ID NO: 187649 - protein, 9 aa, Artificial Sequence
  Description of Artificial Sequence: Synthetic peptide
  Seed: EETPGWPTT (TYRP2_HUMAN)
EETPGWPTL

SEQ ID NO: 187650 - protein, 11 aa, Artificial Sequence
  Description of Artificial Sequence: Synthetic peptide
  Seed: YNMVPFFPPVT (TYRP2_HUMAN)
YQMVPFFPPVG

SEQ ID NO: 187651 - protein, 10 aa, Artificial Sequence
  Description of Artificial Sequence: Synthetic peptide
  Seed: LHYYSVRDTL (TYRP2_HUMAN)
LEYYSVRDTF

SEQ ID NO: 187652 - protein, 10 aa, Artificial Sequence
  Description of Artificial Sequence: Synthetic peptide
  Seed: RLRKGYTPLM (TYRP2_HUMAN)
RSRKGYTPLC

SEQ ID NO: 187653 - protein, 11 aa, Artificial Sequence
  Description of Artificial Sequence: Synthetic peptide
  Seed: FANCSVYDFFV (TYRP2_HUMAN)
FLNCSVYDFFL

SEQ ID NO: 187654 - protein, 9 aa, Artificial Sequence
  Description of Artificial Sequence: Synthetic peptide
  Seed: FANCSVYDF (TYRP2_HUMAN)
FPNCSVYDY

SEQ ID NO: 187655 - protein, 10 aa, Artificial Sequence
  Description of Artificial Sequence: Synthetic peptide
  Seed: RELWPRKFFH (TYRP2_HUMAN)
RKLWPRKFFR

SEQ ID NO: 187656 - protein, 9 aa, Artificial Sequence
  Description of Artificial Sequence: Synthetic peptide
  Seed: NRMYNMVPF (TYRP2_HUMAN)
NQMYNMVPM

SEQ ID NO: 187657 - protein, 9 aa, Artificial Sequence
  Description of Artificial Sequence: Synthetic peptide
  Seed: TLLGPGRPY (TYRP2_HUMAN)
TYLGPGRPV

SEQ ID NO: 187658 - protein, 10 aa, Artificial Sequence
  Description of Artificial Sequence: Synthetic peptide
  Seed: KRFNPPADAW (TYRP2_HUMAN)
KLFNPPADAL

SEQ ID NO: 187659 - protein, 9 aa, Artificial Sequence
  Description of Artificial Sequence: Synthetic peptide
  Seed: IFDEWMKRF (TYRP2_HUMAN)
IMDEWMKRY

SEQ ID NO: 187660 - protein, 9 aa, Artificial Sequence
  Description of Artificial Sequence: Synthetic peptide
  Seed: ALVGLFVLL (TYRP2_HUMAN)
AQVGLFVLT

SEQ ID NO: 187661 - protein, 9 aa, Artificial Sequence
  Description of Artificial Sequence: Synthetic peptide
  Seed: WHRYHLLCL (TYRP2_HUMAN)
WHRYHLLCF

SEQ ID NO: 187662 - protein, 9 aa, Artificial Sequence
  Description of Artificial Sequence: Synthetic peptide
  Seed: FFQNSTFSF (TYRP2_HUMAN)
FRQNSTFSI

SEQ ID NO: 187663 - protein, 10 aa, Artificial Sequence
  Description of Artificial Sequence: Synthetic peptide
  Seed: HRYHLLCLER (TYRP2_HUMAN)
HVYHLLCLER

SEQ ID NO: 187664 - protein, 10 aa, Artificial Sequence
  Description of Artificial Sequence: Synthetic peptide
  Seed: YNMVPFFPPV (TYRP2_HUMAN)
YNMVPFFPPL

SEQ ID NO: 187665 - protein, 11 aa, Artificial Sequence
  Description of Artificial Sequence: Synthetic peptide
  Seed: YNMVPFFPPVT (TYRP2_HUMAN)
YVMVPFFPPVP

SEQ ID NO: 187666 - protein, 9 aa, Artificial Sequence
  Description of Artificial Sequence: Synthetic peptide
  Seed: RKFFHRTCK (TYRP2_HUMAN)
RGFFHRTCA

SEQ ID NO: 187667 - protein, 9 aa, Artificial Sequence
  Description of Artificial Sequence: Synthetic peptide
  Seed: ALVGLFVLL (TYRP2_HUMAN)
AMVGLFVLY

SEQ ID NO: 187668 - protein, 10 aa, Artificial Sequence
  Description of Artificial Sequence: Synthetic peptide
  Seed: AFVTWHRYHL (TYRP2_HUMAN)
AFVTWHRYHF

SEQ ID NO: 187669 - protein, 9 aa, Artificial Sequence
  Description of Artificial Sequence: Synthetic peptide
  Seed: GPNGTQPQF (TYRP2_HUMAN)
GINGTQPQY

SEQ ID NO: 187670 - protein, 10 aa, Artificial Sequence
  Description of Artificial Sequence: Synthetic peptide
  Seed: KILPGAQGQF (TYRP2_HUMAN)
KWLPGAQGQY

SEQ ID NO: 187671 - protein, 9 aa, Artificial Sequence
  Description of Artificial Sequence: Synthetic peptide
  Seed: CPRLGAESA (TYRP2_HUMAN)
CPRLGAESL

SEQ ID NO: 187672 - protein, 10 aa, Artificial Sequence
  Description of Artificial Sequence: Synthetic peptide
  Seed: ESANVCGSQQ (TYRP2_HUMAN)
ETANVCGSQR

SEQ ID NO: 187673 - protein, 10 aa, Artificial Sequence
  Description of Artificial Sequence: Synthetic peptide
  Seed: SPLWWGFLLS (TYRP2_HUMAN)
SALWWGFLLL

SEQ ID NO: 187674 - protein, 9 aa, Artificial Sequence
  Description of Artificial Sequence: Synthetic peptide
  Seed: NRMYNMVPF (TYRP2_HUMAN)
NQMYNMVPW

SEQ ID NO: 187675 - protein, 9 aa, Artificial Sequence
  Description of Artificial Sequence: Synthetic peptide
  Seed: RPWSGPYIL (TYRP2_HUMAN)
RPWSGPYIW

SEQ ID NO: 187676 - protein, 10 aa, Artificial Sequence
  Description of Artificial Sequence: Synthetic peptide
  Seed: HLVTLCNGTY (TYRP2_HUMAN)
HQVTLCNGTY

SEQ ID NO: 187677 - protein, 9 aa, Artificial Sequence
  Description of Artificial Sequence: Synthetic peptide
  Seed: VTWHRYHLL (TYRP2_HUMAN)
VYWHRYHLF

SEQ ID NO: 187678 - protein, 9 aa, Artificial Sequence
  Description of Artificial Sequence: Synthetic peptide
  Seed: RFNPPADAW (TYRP2_HUMAN)
RRNPPADAM

SEQ ID NO: 187679 - protein, 10 aa, Artificial Sequence
  Description of Artificial Sequence: Synthetic peptide
  Seed: DSLDDYNHLV (TYRP2_HUMAN)
DFLDDYNHLM

SEQ ID NO: 187680 - protein, 10 aa, Artificial Sequence
  Description of Artificial Sequence: Synthetic peptide
  Seed: SPLWWGFLLS (TYRP2_HUMAN)
SFLWWGFLLL

SEQ ID NO: 187681 - protein, 9 aa, Artificial Sequence
  Description of Artificial Sequence: Synthetic peptide
  Seed: RAIDFSHQG (TYRP2_HUMAN)
RIIDFSHQM

SEQ ID NO: 187682 - protein, 9 aa, Artificial Sequence
  Description of Artificial Sequence: Synthetic peptide
  Seed: RMYNMVPFF (TYRP2_HUMAN)
RTYNMVPFK

SEQ ID NO: 187683 - protein, 10 aa, Artificial Sequence
  Description of Artificial Sequence: Synthetic peptide
  Seed: DPTLISRNSR (TYRP2_HUMAN)
DVTLISRNSR

SEQ ID NO: 187684 - protein, 9 aa, Artificial Sequence
  Description of Artificial Sequence: Synthetic peptide
  Seed: RNSMKLPTL (TYRP2_HUMAN)
RRSMKLPTF

SEQ ID NO: 187685 - protein, 9 aa, Artificial Sequence
  Description of Artificial Sequence: Synthetic peptide
  Seed: TLDSQVMSL (TYRP2_HUMAN)
TADSQVMSI

SEQ ID NO: 187686 - protein, 10 aa, Artificial Sequence
  Description of Artificial Sequence: Synthetic peptide
  Seed: HNRMYNMVPF (TYRP2_HUMAN)
HARMYNMVPM

SEQ ID NO: 187687 - protein, 9 aa, Artificial Sequence
  Description of Artificial Sequence: Synthetic peptide
  Seed: RLRKGYTPL (TYRP2_HUMAN)
RTRKGYTPM

SEQ ID NO: 187688 - protein, 9 aa, Artificial Sequence
  Description of Artificial Sequence: Synthetic peptide
  Seed: YSYAIDLPV (TYRP2_HUMAN)
YPYAIDLPE

SEQ ID NO: 187689 - protein, 9 aa, Artificial Sequence
  Description of Artificial Sequence: Synthetic peptide
  Seed: GTYEGLLRR (TYRP2_HUMAN)
GQYEGLLRY

SEQ ID NO: 187690 - protein, 9 aa, Artificial Sequence
  Description of Artificial Sequence: Synthetic peptide
  Seed: FSHQGPAFV (TYRP2_HUMAN)
FSHQGPAFF

SEQ ID NO: 187691 - protein, 9 aa, Artificial Sequence
  Description of Artificial Sequence: Synthetic peptide
  Seed: QRLIGNESF (TYRP2_HUMAN)
QLLIGNESY

SEQ ID NO: 187692 - protein, 11 aa, Artificial Sequence
  Description of Artificial Sequence: Synthetic peptide
  Seed: YSYAIDLPVSV (TYRP2_HUMAN)
YQYAIDLPVSL

SEQ ID NO: 187693 - protein, 9 aa, Artificial Sequence
  Description of Artificial Sequence: Synthetic peptide
  Seed: NMVPFFPPV (TYRP2_HUMAN)
NKVPFFPPY

SEQ ID NO: 187694 - protein, 10 aa, Artificial Sequence
  Description of Artificial Sequence: Synthetic peptide
  Seed: SDQLGYSYAI (TYRP2_HUMAN)
SWQLGYSYAL

SEQ ID NO: 187695 - protein, 10 aa, Artificial Sequence
  Description of Artificial Sequence: Synthetic peptide
  Seed: LGPNGTQPQF (TYRP2_HUMAN)
LNPNGTQPQW

SEQ ID NO: 187696 - protein, 8 aa, Artificial Sequence
  Description of Artificial Sequence: Synthetic peptide
  Seed: FSHQGPAF (TYRP2_HUMAN)
FVHQGPAF

SEQ ID NO: 187697 - protein, 9 aa, Artificial Sequence
  Description of Artificial Sequence: Synthetic peptide
  Seed: VIRQNIHSL (TYRP2_HUMAN)
VQRQNIHSI

SEQ ID NO: 187698 - protein, 9 aa, Artificial Sequence
  Description of Artificial Sequence: Synthetic peptide
  Seed: FFPPVTNEE (TYRP2_HUMAN)
FIPPVTNEL

SEQ ID NO: 187699 - protein, 10 aa, Artificial Sequence
  Description of Artificial Sequence: Synthetic peptide
  Seed: GQFPRVCMTV (TYRP2_HUMAN)
GLFPRVCMTA

SEQ ID NO: 187700 - protein, 9 aa, Artificial Sequence
  Description of Artificial Sequence: Synthetic peptide
  Seed: GWPTTLLVV (TYRP2_HUMAN)
GFPTTLLVW

SEQ ID NO: 187701 - protein, 10 aa, Artificial Sequence
  Description of Artificial Sequence: Synthetic peptide
  Seed: FLLSCLGCKI (TYRP2_HUMAN)
FYLSCLGCKL

SEQ ID NO: 187702 - protein, 10 aa, Artificial Sequence
  Description of Artificial Sequence: Synthetic peptide
  Seed: NSTFSFRNAL (TYRP2_HUMAN)
NPTFSFRNAV

SEQ ID NO: 187703 - protein, 10 aa, Artificial Sequence
  Description of Artificial Sequence: Synthetic peptide
  Seed: MSPLWWGFLL (TYRP2_HUMAN)
MIPLWWGFLA

SEQ ID NO: 187704 - protein, 10 aa, Artificial Sequence
  Description of Artificial Sequence: Synthetic peptide
  Seed: DIRDCLSLQK (TYRP2_HUMAN)
DARDCLSLQR

SEQ ID NO: 187705 - protein, 9 aa, Artificial Sequence
  Description of Artificial Sequence: Synthetic peptide
  Seed: AANDPIFVV (TYRP2_HUMAN)
ALNDPIFVC

SEQ ID NO: 187706 - protein, 10 aa, Artificial Sequence
  Description of Artificial Sequence: Synthetic peptide
  Seed: SPLWWGFLLS (TYRP2_HUMAN)
SVLWWGFLLV

SEQ ID NO: 187707 - protein, 8 aa, Artificial Sequence
  Description of Artificial Sequence: Synthetic peptide
  Seed: AIDLPVSV (TYRP2_HUMAN)
AYDLPVSL

SEQ ID NO: 187708 - protein, 10 aa, Artificial Sequence
  Description of Artificial Sequence: Synthetic peptide
  Seed: FFQNSTFSFR (TYRP2_HUMAN)
FIQNSTFSFR

SEQ ID NO: 187709 - protein, 9 aa, Artificial Sequence
  Description of Artificial Sequence: Synthetic peptide
  Seed: VVMGTLVAL (TYRP2_HUMAN)
VMMGTLVAW

SEQ ID NO: 187710 - protein, 9 aa, Artificial Sequence
  Description of Artificial Sequence: Synthetic peptide
  Seed: SVYDFFVWL (TYRP2_HUMAN)
SQYDFFVWF

SEQ ID NO: 187711 - protein, 10 aa, Artificial Sequence
  Description of Artificial Sequence: Synthetic peptide
  Seed: RRLRKGYTPL (TYRP2_HUMAN)
RVLRKGYTPS

SEQ ID NO: 187712 - protein, 9 aa, Artificial Sequence
  Description of Artificial Sequence: Synthetic peptide
  Seed: TDQLFGAAR (TYRP2_HUMAN)
TYQLFGAAR

SEQ ID NO: 187713 - protein, 9 aa, Artificial Sequence
  Description of Artificial Sequence: Synthetic peptide
  Seed: FVLLAFLQY (TYRP2_HUMAN)
FRLLAFLQF

SEQ ID NO: 187714 - protein, 11 aa, Artificial Sequence
  Description of Artificial Sequence: Synthetic peptide
  Seed: QFLGALDLAKK (TYRP2_HUMAN)
QTLGALDLAKK

SEQ ID NO: 187715 - protein, 10 aa, Artificial Sequence
  Description of Artificial Sequence: Synthetic peptide
  Seed: RRLRKGYTPL (TYRP2_HUMAN)
RHLRKGYTPY

SEQ ID NO: 187716 - protein, 10 aa, Artificial Sequence
  Description of Artificial Sequence: Synthetic peptide
  Seed: DSLDDYNHLV (TYRP2_HUMAN)
DYLDDYNHLM

SEQ ID NO: 187717 - protein, 10 aa, Artificial Sequence
  Description of Artificial Sequence: Synthetic peptide
  Seed: FPPVTNEELF (TYRP2_HUMAN)
FYPVTNEELW

SEQ ID NO: 187718 - protein, 11 aa, Artificial Sequence
  Description of Artificial Sequence: Synthetic peptide
  Seed: VLLAFLQYRRL (TYRP2_HUMAN)
VMLAFLQYRRI

SEQ ID NO: 187719 - protein, 9 aa, Artificial Sequence
  Description of Artificial Sequence: Synthetic peptide
  Seed: VALVGLFVL (TYRP2_HUMAN)
VLLVGLFVI

SEQ ID NO: 187720 - protein, 9 aa, Artificial Sequence
  Description of Artificial Sequence: Synthetic peptide
  Seed: ISRNSRFSS (TYRP2_HUMAN)
IWRNSRFSK

SEQ ID NO: 187721 - protein, 9 aa, Artificial Sequence
  Description of Artificial Sequence: Synthetic peptide
  Seed: SFRNALEGF (TYRP2_HUMAN)
STRNALEGY

SEQ ID NO: 187722 - protein, 9 aa, Artificial Sequence
  Description of Artificial Sequence: Synthetic peptide
  Seed: HQGPAFVTW (TYRP2_HUMAN)
HLGPAFVTL

SEQ ID NO: 187723 - protein, 10 aa, Artificial Sequence
  Description of Artificial Sequence: Synthetic peptide
  Seed: LGPGRPYRAI (TYRP2_HUMAN)
LQPGRPYRAL

SEQ ID NO: 187724 - protein, 9 aa, Artificial Sequence
  Description of Artificial Sequence: Synthetic peptide
  Seed: GTLVALVGL (TYRP2_HUMAN)
GLLVALVGM

SEQ ID NO: 187725 - protein, 11 aa, Artificial Sequence
  Description of Artificial Sequence: Synthetic peptide
  Seed: SLDDYNHLVTL (TYRP2_HUMAN)
SMDDYNHLVTA

SEQ ID NO: 187726 - protein, 10 aa, Artificial Sequence
  Description of Artificial Sequence: Synthetic peptide
  Seed: SLDDYNHLVT (TYRP2_HUMAN)
SLDDYNHLVF

SEQ ID NO: 187727 - protein, 11 aa, Artificial Sequence
  Description of Artificial Sequence: Synthetic peptide
  Seed: FVVLHSFTDAI (TYRP2_HUMAN)
FDVLHSFTDAV

SEQ ID NO: 187728 - protein, 10 aa, Artificial Sequence
  Description of Artificial Sequence: Synthetic peptide
  Seed: FPPVTNEELF (TYRP2_HUMAN)
FHPVTNEELF

SEQ ID NO: 187729 - protein, 11 aa, Artificial Sequence
  Description of Artificial Sequence: Synthetic peptide
  Seed: SLDDYNHLVTL (TYRP2_HUMAN)
SQDDYNHLVTV

SEQ ID NO: 187730 - protein, 9 aa, Artificial Sequence
  Description of Artificial Sequence: Synthetic peptide
  Seed: RNSMKLPTL (TYRP2_HUMAN)
RPSMKLPTL

SEQ ID NO: 187731 - protein, 10 aa, Artificial Sequence
  Description of Artificial Sequence: Synthetic peptide
  Seed: RLIGNESFAL (TYRP2_HUMAN)
RQIGNESFAM

SEQ ID NO: 187732 - protein, 9 aa, Artificial Sequence
  Description of Artificial Sequence: Synthetic peptide
  Seed: TSDQLGYSY (TYRP2_HUMAN)
TPDQLGYSY

SEQ ID NO: 187733 - protein, 10 aa, Artificial Sequence
  Description of Artificial Sequence: Synthetic peptide
  Seed: MSPLWWGFLL (TYRP2_HUMAN)
MIPLWWGFLV

SEQ ID NO: 187734 - protein, 9 aa, Artificial Sequence
  Description of Artificial Sequence: Synthetic peptide
  Seed: WMKRFNPPA (TYRP2_HUMAN)
WHKRFNPPF

SEQ ID NO: 187735 - protein, 11 aa, Artificial Sequence
  Description of Artificial Sequence: Synthetic peptide
  Seed: SLDDYNHLVTL (TYRP2_HUMAN)
STDDYNHLVTM

SEQ ID NO: 187736 - protein, 9 aa, Artificial Sequence
  Description of Artificial Sequence: Synthetic peptide
  Seed: FFQNSTFSF (TYRP2_HUMAN)
FSQNSTFSY

SEQ ID NO: 187737 - protein, 11 aa, Artificial Sequence
  Description of Artificial Sequence: Synthetic peptide
  Seed: ELAPIGHNRMY (TYRP2_HUMAN)
ETAPIGHNRMK

SEQ ID NO: 187738 - protein, 9 aa, Artificial Sequence
  Description of Artificial Sequence: Synthetic peptide
  Seed: RLRKGYTPL (TYRP2_HUMAN)
RVRKGYTPE

SEQ ID NO: 187739 - protein, 10 aa, Artificial Sequence
  Description of Artificial Sequence: Synthetic peptide
  Seed: IDFSHQGPAF (TYRP2_HUMAN)
IAFSHQGPAY

SEQ ID NO: 187740 - protein, 10 aa, Artificial Sequence
  Description of Artificial Sequence: Synthetic peptide
  Seed: RPDDPTLISR (TYRP2_HUMAN)
RSDDPTLISY

SEQ ID NO: 187741 - protein, 10 aa, Artificial Sequence
  Description of Artificial Sequence: Synthetic peptide
  Seed: HSFLNGTNAL (TYRP2_HUMAN)
HYFLNGTNAF

SEQ ID NO: 187742 - protein, 10 aa, Artificial Sequence
  Description of Artificial Sequence: Synthetic peptide
  Seed: RLRKGYTPLM (TYRP2_HUMAN)
RPRKGYTPLD

SEQ ID NO: 187743 - protein, 10 aa, Artificial Sequence
  Description of Artificial Sequence: Synthetic peptide
  Seed: SDQLGYSYAI (TYRP2_HUMAN)
SLQLGYSYAI

SEQ ID NO: 187744 - protein, 10 aa, Artificial Sequence
  Description of Artificial Sequence: Synthetic peptide
  Seed: MSPLWWGFLL (TYRP2_HUMAN)
MMPLWWGFLT

SEQ ID NO: 187745 - protein, 9 aa, Artificial Sequence
  Description of Artificial Sequence: Synthetic peptide
  Seed: CSVYDFFVW (TYRP2_HUMAN)
CGVYDFFVW

SEQ ID NO: 187746 - protein, 9 aa, Artificial Sequence
  Description of Artificial Sequence: Synthetic peptide
  Seed: VSVEETPGW (TYRP2_HUMAN)
VAVEETPGF

SEQ ID NO: 187747 - protein, 9 aa, Artificial Sequence
  Description of Artificial Sequence: Synthetic peptide
  Seed: ISRNSRFSS (TYRP2_HUMAN)
ISRNSRFSI

SEQ ID NO: 187748 - protein, 10 aa, Artificial Sequence
  Description of Artificial Sequence: Synthetic peptide
  Seed: NPPFFQNSTF (TYRP2_HUMAN)
NPPFFQNSTY

SEQ ID NO: 187749 - protein, 8 aa, Artificial Sequence
  Description of Artificial Sequence: Synthetic peptide
  Seed: ANDPIFVV (TYRP2_HUMAN)
AADPIFVV

SEQ ID NO: 187750 - protein, 11 aa, Artificial Sequence
  Description of Artificial Sequence: Synthetic peptide
  Seed: RNSRFSSWETV (TYRP2_HUMAN)
RVSRFSSWETV

SEQ ID NO: 187751 - protein, 10 aa, Artificial Sequence
  Description of Artificial Sequence: Synthetic peptide
  Seed: TLVALVGLFV (TYRP2_HUMAN)
TLVALVGLFL

SEQ ID NO: 187752 - protein, 10 aa, Artificial Sequence
  Description of Artificial Sequence: Synthetic peptide
  Seed: LGPGRPYRAI (TYRP2_HUMAN)
LYPGRPYRAL

SEQ ID NO: 187753 - protein, 9 aa, Artificial Sequence
  Description of Artificial Sequence: Synthetic peptide
  Seed: SLHNLVHSF (TYRP2_HUMAN)
SGHNLVHSW

SEQ ID NO: 187754 - protein, 10 aa, Artificial Sequence
  Description of Artificial Sequence: Synthetic peptide
  Seed: ETPGWPTTLL (TYRP2_HUMAN)
EVPGWPTTLK

SEQ ID NO: 187755 - protein, 11 aa, Artificial Sequence
  Description of Artificial Sequence: Synthetic peptide
  Seed: HSFTDAIFDEW (TYRP2_HUMAN)
HAFTDAIFDEW

SEQ ID NO: 187756 - protein, 10 aa, Artificial Sequence
  Description of Artificial Sequence: Synthetic peptide
  Seed: RLRKGYTPLM (TYRP2_HUMAN)
RARKGYTPLM

SEQ ID NO: 187757 - protein, 9 aa, Artificial Sequence
  Description of Artificial Sequence: Synthetic peptide
  Seed: STFSFRNAL (TYRP2_HUMAN)
SIFSFRNAY

SEQ ID NO: 187758 - protein, 9 aa, Artificial Sequence
  Description of Artificial Sequence: Synthetic peptide
  Seed: TLVALVGLF (TYRP2_HUMAN)
TWVALVGLY

SEQ ID NO: 187759 - protein, 9 aa, Artificial Sequence
  Description of Artificial Sequence: Synthetic peptide
  Seed: FSHQGPAFV (TYRP2_HUMAN)
FLHQGPAFA

SEQ ID NO: 187760 - protein, 11 aa, Artificial Sequence
  Description of Artificial Sequence: Synthetic peptide
  Seed: RNSRFSSWETV (TYRP2_HUMAN)
RASRFSSWETI

SEQ ID NO: 187761 - protein, 10 aa, Artificial Sequence
  Description of Artificial Sequence: Synthetic peptide
  Seed: RNSMKLPTLK (TYRP2_HUMAN)
RLSMKLPTLY

SEQ ID NO: 187762 - protein, 9 aa, Artificial Sequence
  Description of Artificial Sequence: Synthetic peptide
  Seed: SVYDFFVWL (TYRP2_HUMAN)
SQYDFFVWA

SEQ ID NO: 187763 - protein, 10 aa, Artificial Sequence
  Description of Artificial Sequence: Synthetic peptide
  Seed: RMYNMVPFFP (TYRP2_HUMAN)
RQYNMVPFFM

SEQ ID NO: 187764 - protein, 10 aa, Artificial Sequence
  Description of Artificial Sequence: Synthetic peptide
  Seed: YNMVPFFPPV (TYRP2_HUMAN)
YKMVPFFPPM

SEQ ID NO: 187765 - protein, 11 aa, Artificial Sequence
  Description of Artificial Sequence: Synthetic peptide
  Seed: MYNMVPFFPPV (TYRP2_HUMAN)
MQNMVPFFPPA

SEQ ID NO: 187766 - protein, 10 aa, Artificial Sequence
  Description of Artificial Sequence: Synthetic peptide
  Seed: VVLHSFTDAI (TYRP2_HUMAN)
VPLHSFTDAL

SEQ ID NO: 187767 - protein, 9 aa, Artificial Sequence
  Description of Artificial Sequence: Synthetic peptide
  Seed: DSLDDYNHL (TYRP2_HUMAN)
DTLDDYNHF

SEQ ID NO: 187768 - protein, 9 aa, Artificial Sequence
  Description of Artificial Sequence: Synthetic peptide
  Seed: TSDQLGYSY (TYRP2_HUMAN)
TWDQLGYSL

SEQ ID NO: 187769 - protein, 10 aa, Artificial Sequence
  Description of Artificial Sequence: Synthetic peptide
  Seed: TQPQFANCSV (TYRP2_HUMAN)
TLPQFANCSV

SEQ ID NO: 187770 - protein, 11 aa, Artificial Sequence
  Description of Artificial Sequence: Synthetic peptide
  Seed: YTPLMETHLSS (TYRP2_HUMAN)
YHPLMETHLSI

SEQ ID NO: 187771 - protein, 9 aa, Artificial Sequence
  Description of Artificial Sequence: Synthetic peptide
  Seed: SLHNLVHSF (TYRP2_HUMAN)
SYHNLVHSF

SEQ ID NO: 187772 - protein, 9 aa, Artificial Sequence
  Description of Artificial Sequence: Synthetic peptide
  Seed: RNQMGRNSM (TYRP2_HUMAN)
RQQMGRNSL

SEQ ID NO: 187773 - protein, 11 aa, Artificial Sequence
  Description of Artificial Sequence: Synthetic peptide
  Seed: ANCSVYDFFVW (TYRP2_HUMAN)
ASCSVYDFFVW

SEQ ID NO: 187774 - protein, 9 aa, Artificial Sequence
  Description of Artificial Sequence: Synthetic peptide
  Seed: RQNIHSLSP (TYRP2_HUMAN)
RMNIHSLSW

SEQ ID NO: 187775 - protein, 11 aa, Artificial Sequence
  Description of Artificial Sequence: Synthetic peptide
  Seed: TQPQFANCSVY (TYRP2_HUMAN)
TWPQFANCSVF

SEQ ID NO: 187776 - protein, 9 aa, Artificial Sequence
  Description of Artificial Sequence: Synthetic peptide
  Seed: DFFVWLHYY (TYRP2_HUMAN)
DGFVWLHYR

SEQ ID NO: 187777 - protein, 9 aa, Artificial Sequence
  Description of Artificial Sequence: Synthetic peptide
  Seed: TLLVVMGTL (TYRP2_HUMAN)
TMLVVMGTA

SEQ ID NO: 187778 - protein, 10 aa, Artificial Sequence
  Description of Artificial Sequence: Synthetic peptide
  Seed: SPLWWGFLLS (TYRP2_HUMAN)
SYLWWGFLLI

SEQ ID NO: 187779 - protein, 9 aa, Artificial Sequence
  Description of Artificial Sequence: Synthetic peptide
  Seed: SLDDYNHLV (TYRP2_HUMAN)
STDDYNHLC

SEQ ID NO: 187780 - protein, 9 aa, Artificial Sequence
  Description of Artificial Sequence: Synthetic peptide
  Seed: WHRYHLLCL (TYRP2_HUMAN)
WHRYHLLCY

SEQ ID NO: 187781 - protein, 11 aa, Artificial Sequence
  Description of Artificial Sequence: Synthetic peptide
  Seed: LLVVMGTLVAL (TYRP2_HUMAN)
LAVVMGTLVAV

SEQ ID NO: 187782 - protein, 8 aa, Artificial Sequence
  Description of Artificial Sequence: Synthetic peptide
  Seed: QKFDNPPF (TYRP2_HUMAN)
QQFDNPPF

SEQ ID NO: 187783 - protein, 9 aa, Artificial Sequence
  Description of Artificial Sequence: Synthetic peptide
  Seed: LRKGYTPLM (TYRP2_HUMAN)
LAKGYTPLF

SEQ ID NO: 187784 - protein, 9 aa, Artificial Sequence
  Description of Artificial Sequence: Synthetic peptide
  Seed: FFPPVTNEE (TYRP2_HUMAN)
FYPPVTNEI

SEQ ID NO: 187785 - protein, 10 aa, Artificial Sequence
  Description of Artificial Sequence: Synthetic peptide
  Seed: VVMGTLVALV (TYRP2_HUMAN)
VVMGTLVALA

SEQ ID NO: 187786 - protein, 10 aa, Artificial Sequence
  Description of Artificial Sequence: Synthetic peptide
  Seed: RLIGNESFAL (TYRP2_HUMAN)
RIIGNESFAI

SEQ ID NO: 187787 - protein, 10 aa, Artificial Sequence
  Description of Artificial Sequence: Synthetic peptide
  Seed: RLIGNESFAL (TYRP2_HUMAN)
RVIGNESFAF

SEQ ID NO: 187788 - protein, 10 aa, Artificial Sequence
  Description of Artificial Sequence: Synthetic peptide
  Seed: AANDPIFVVL (TYRP2_HUMAN)
AQNDPIFVVI

SEQ ID NO: 187789 - protein, 9 aa, Artificial Sequence
  Description of Artificial Sequence: Synthetic peptide
  Seed: ISRNSRFSS (TYRP2_HUMAN)
ILRNSRFSK

SEQ ID NO: 187790 - protein, 10 aa, Artificial Sequence
  Description of Artificial Sequence: Synthetic peptide
  Seed: HSAANDPIFV (TYRP2_HUMAN)
HTAANDPIFV

SEQ ID NO: 187791 - protein, 9 aa, Artificial Sequence
  Description of Artificial Sequence: Synthetic peptide
  Seed: STFSFRNAL (TYRP2_HUMAN)
SPFSFRNAC

SEQ ID NO: 187792 - protein, 10 aa, Artificial Sequence
  Description of Artificial Sequence: Synthetic peptide
  Seed: HNRMYNMVPF (TYRP2_HUMAN)
HRRMYNMVPF

SEQ ID NO: 187793 - protein, 9 aa, Artificial Sequence
  Description of Artificial Sequence: Synthetic peptide
  Seed: ISRNSRFSS (TYRP2_HUMAN)
ITRNSRFSF

SEQ ID NO: 187794 - protein, 9 aa, Artificial Sequence
  Description of Artificial Sequence: Synthetic peptide
  Seed: VVMGTLVAL (TYRP2_HUMAN)
VKMGTLVAM

SEQ ID NO: 187795 - protein, 11 aa, Artificial Sequence
  Description of Artificial Sequence: Synthetic peptide
  Seed: YTPLMETHLSS (TYRP2_HUMAN)
YRPLMETHLSV

SEQ ID NO: 187796 - protein, 11 aa, Artificial Sequence
  Description of Artificial Sequence: Synthetic peptide
  Seed: FVVLHSFTDAI (TYRP2_HUMAN)
FLVLHSFTDAL

SEQ ID NO: 187797 - protein, 9 aa, Artificial Sequence
  Description of Artificial Sequence: Synthetic peptide
  Seed: FVWLHYYSV (TYRP2_HUMAN)
FLWLHYYSS

SEQ ID NO: 187798 - protein, 10 aa, Artificial Sequence
  Description of Artificial Sequence: Synthetic peptide
  Seed: LHYYSVRDTL (TYRP2_HUMAN)
LAYYSVRDTF

SEQ ID NO: 187799 - protein, 11 aa, Artificial Sequence
  Description of Artificial Sequence: Synthetic peptide
  Seed: RNSRFSSWETV (TYRP2_HUMAN)
RWSRFSSWETM

SEQ ID NO: 187800 - protein, 9 aa, Artificial Sequence
  Description of Artificial Sequence: Synthetic peptide
  Seed: AANDPIFVV (TYRP2_HUMAN)
AMNDPIFVL

SEQ ID NO: 187801 - protein, 9 aa, Artificial Sequence
  Description of Artificial Sequence: Synthetic peptide
  Seed: SRNSRFSSW (TYRP2_HUMAN)
SKNSRFSSF

SEQ ID NO: 187802 - protein, 9 aa, Artificial Sequence
  Description of Artificial Sequence: Synthetic peptide
  Seed: VVMGTLVAL (TYRP2_HUMAN)
VKMGTLVAW

SEQ ID NO: 187803 - protein, 9 aa, Artificial Sequence
  Description of Artificial Sequence: Synthetic peptide
  Seed: DAIFDEWMK (TYRP2_HUMAN)
DVIFDEWMR

SEQ ID NO: 187804 - protein, 10 aa, Artificial Sequence
  Description of Artificial Sequence: Synthetic peptide
  Seed: FFVWLHYYSV (TYRP2_HUMAN)
FTVWLHYYSI

SEQ ID NO: 187805 - protein, 10 aa, Artificial Sequence
  Description of Artificial Sequence: Synthetic peptide
  Seed: VVLHSFTDAI (TYRP2_HUMAN)
VLLHSFTDAV

SEQ ID NO: 187806 - protein, 9 aa, Artificial Sequence
  Description of Artificial Sequence: Synthetic peptide
  Seed: AARPDDPTL (TYRP2_HUMAN)
ASRPDDPTY

SEQ ID NO: 187807 - protein, 9 aa, Artificial Sequence
  Description of Artificial Sequence: Synthetic peptide
  Seed: YYSVRDTLL (TYRP2_HUMAN)
YYSVRDTLV

SEQ ID NO: 187808 - protein, 9 aa, Artificial Sequence
  Description of Artificial Sequence: Synthetic peptide
  Seed: ESANVCGSQ (TYRP2_HUMAN)
EVANVCGSK

SEQ ID NO: 187809 - protein, 9 aa, Artificial Sequence
  Description of Artificial Sequence: Synthetic peptide
  Seed: QKFDNPPFF (TYRP2_HUMAN)
QHFDNPPFF

SEQ ID NO: 187810 - protein, 8 aa, Artificial Sequence
  Description of Artificial Sequence: Synthetic peptide
  Seed: RPDDPTLI (TYRP2_HUMAN)
RTDDPTLL

SEQ ID NO: 187811 - protein, 9 aa, Artificial Sequence
  Description of Artificial Sequence: Synthetic peptide
  Seed: VGLFVLLAF (TYRP2_HUMAN)
VSLFVLLAW

SEQ ID NO: 187812 - protein, 9 aa, Artificial Sequence
  Description of Artificial Sequence: Synthetic peptide
  Seed: NRMYNMVPF (TYRP2_HUMAN)
NWMYNMVPL

SEQ ID NO: 187813 - protein, 9 aa, Artificial Sequence
  Description of Artificial Sequence: Synthetic peptide
  Seed: VVMGTLVAL (TYRP2_HUMAN)
VMMGTLVAA

SEQ ID NO: 187814 - protein, 9 aa, Artificial Sequence
  Description of Artificial Sequence: Synthetic peptide
  Seed: VTNEELFLT (TYRP2_HUMAN)
VQNEELFLA

SEQ ID NO: 187815 - protein, 10 aa, Artificial Sequence
  Description of Artificial Sequence: Synthetic peptide
  Seed: RMYNMVPFFP (TYRP2_HUMAN)
RTYNMVPFFF

SEQ ID NO: 187816 - protein, 10 aa, Artificial Sequence
  Description of Artificial Sequence: Synthetic peptide
  Seed: LVVMGTLVAL (TYRP2_HUMAN)
LPVMGTLVAV

SEQ ID NO: 187817 - protein, 10 aa, Artificial Sequence
  Description of Artificial Sequence: Synthetic peptide
  Seed: RRLRKGYTPL (TYRP2_HUMAN)
RILRKGYTPI

SEQ ID NO: 187818 - protein, 11 aa, Artificial Sequence
  Description of Artificial Sequence: Synthetic peptide
  Seed: YNMVPFFPPVT (TYRP2_HUMAN)
YTMVPFFPPVI

SEQ ID NO: 187819 - protein, 10 aa, Artificial Sequence
  Description of Artificial Sequence: Synthetic peptide
  Seed: AFLQYRRLRK (TYRP2_HUMAN)
ASLQYRRLRR

SEQ ID NO: 187820 - protein, 11 aa, Artificial Sequence
  Description of Artificial Sequence: Synthetic peptide
  Seed: HPDYVITTQHW (TYRP2_HUMAN)
HCDYVITTQHF

SEQ ID NO: 187821 - protein, 10 aa, Artificial Sequence
  Description of Artificial Sequence: Synthetic peptide
  Seed: SDQLGYSYAI (TYRP2_HUMAN)
SCQLGYSYAL

SEQ ID NO: 187822 - protein, 9 aa, Artificial Sequence
  Description of Artificial Sequence: Synthetic peptide
  Seed: AANDPIFVV (TYRP2_HUMAN)
ASNDPIFVW

SEQ ID NO: 187823 - protein, 9 aa, Artificial Sequence
  Description of Artificial Sequence: Synthetic peptide
  Seed: QKFDNPPFF (TYRP2_HUMAN)
QKFDNPPFY

SEQ ID NO: 187824 - protein, 10 aa, Artificial Sequence
  Description of Artificial Sequence: Synthetic peptide
  Seed: YEGLLRRNQM (TYRP2_HUMAN)
YLGLLRRNQM

SEQ ID NO: 187825 - protein, 9 aa, Artificial Sequence
  Description of Artificial Sequence: Synthetic peptide
  Seed: SLDDYNHLV (TYRP2_HUMAN)
SGDDYNHLM

SEQ ID NO: 187826 - protein, 11 aa, Artificial Sequence
  Description of Artificial Sequence: Synthetic peptide
  Seed: QRLIGNESFAL (TYRP2_HUMAN)
QILIGNESFAV

SEQ ID NO: 187827 - protein, 10 aa, Artificial Sequence
  Description of Artificial Sequence: Synthetic peptide
  Seed: REQFLGALDL (TYRP2_HUMAN)
RMQFLGALDF

SEQ ID NO: 187828 - protein, 10 aa, Artificial Sequence
  Description of Artificial Sequence: Synthetic peptide
  Seed: VVMGTLVALV (TYRP2_HUMAN)
VMMGTLVALP

SEQ ID NO: 187829 - protein, 10 aa, Artificial Sequence
  Description of Artificial Sequence: Synthetic peptide
  Seed: WPRKFFHRTC (TYRP2_HUMAN)
WPRKFFHRTV

SEQ ID NO: 187830 - protein, 9 aa, Artificial Sequence
  Description of Artificial Sequence: Synthetic peptide
  Seed: SLDDYNHLV (TYRP2_HUMAN)
SNDDYNHLV

SEQ ID NO: 187831 - protein, 9 aa, Artificial Sequence
  Description of Artificial Sequence: Synthetic peptide
  Seed: TLLGPGRPY (TYRP2_HUMAN)
TYLGPGRPI

SEQ ID NO: 187832 - protein, 8 aa, Artificial Sequence
  Description of Artificial Sequence: Synthetic peptide
  Seed: VMGTLVAL (TYRP2_HUMAN)
VAGTLVAL

SEQ ID NO: 187833 - protein, 9 aa, Artificial Sequence
  Description of Artificial Sequence: Synthetic peptide
  Seed: HYYSVRDTL (TYRP2_HUMAN)
HQYSVRDTL

SEQ ID NO: 187834 - protein, 9 aa, Artificial Sequence
  Description of Artificial Sequence: Synthetic peptide
  Seed: RLRKGYTPL (TYRP2_HUMAN)
RPRKGYTPT

SEQ ID NO: 187835 - protein, 9 aa, Artificial Sequence
  Description of Artificial Sequence: Synthetic peptide
  Seed: DDYNHLVTL (TYRP2_HUMAN)
DSYNHLVTL

SEQ ID NO: 187836 - protein, 11 aa, Artificial Sequence
  Description of Artificial Sequence: Synthetic peptide
  Seed: TQPQFANCSVY (TYRP2_HUMAN)
TFPQFANCSVF

SEQ ID NO: 187837 - protein, 11 aa, Artificial Sequence
  Description of Artificial Sequence: Synthetic peptide
  Seed: SVYDFFVWLHY (TYRP2_HUMAN)
STYDFFVWLHK

SEQ ID NO: 187838 - protein, 9 aa, Artificial Sequence
  Description of Artificial Sequence: Synthetic peptide
  Seed: HQGPAFVTW (TYRP2_HUMAN)
HCGPAFVTY

SEQ ID NO: 187839 - protein, 9 aa, Artificial Sequence
  Description of Artificial Sequence: Synthetic peptide
  Seed: VGLFVLLAF (TYRP2_HUMAN)
VSLFVLLAY

SEQ ID NO: 187840 - protein, 10 aa, Artificial Sequence
  Description of Artificial Sequence: Synthetic peptide
  Seed: QGPAFVTWHR (TYRP2_HUMAN)
QVPAFVTWHK

SEQ ID NO: 187841 - protein, 9 aa, Artificial Sequence
  Description of Artificial Sequence: Synthetic peptide
  Seed: SVYDFFVWL (TYRP2_HUMAN)
SVYDFFVWM

SEQ ID NO: 187842 - protein, 8 aa, Artificial Sequence
  Description of Artificial Sequence: Synthetic peptide
  Seed: FQNSTFSF (TYRP2_HUMAN)
FANSTFSL

SEQ ID NO: 187843 - protein, 10 aa, Artificial Sequence
  Description of Artificial Sequence: Synthetic peptide
  Seed: RLRKGYTPLM (TYRP2_HUMAN)
RTRKGYTPLF

SEQ ID NO: 187844 - protein, 9 aa, Artificial Sequence
  Description of Artificial Sequence: Synthetic peptide
  Seed: SQVMSLHNL (TYRP2_HUMAN)
SMVMSLHNI

SEQ ID NO: 187845 - protein, 9 aa, Artificial Sequence
  Description of Artificial Sequence: Synthetic peptide
  Seed: FVWLHYYSV (TYRP2_HUMAN)
FTWLHYYSV

SEQ ID NO: 187846 - protein, 9 aa, Artificial Sequence
  Description of Artificial Sequence: Synthetic peptide
  Seed: RFNPPADAW (TYRP2_HUMAN)
RYNPPADAL

SEQ ID NO: 187847 - protein, 9 aa, Artificial Sequence
  Description of Artificial Sequence: Synthetic peptide
  Seed: DDYNHLVTL (TYRP2_HUMAN)
DSYNHLVTF

SEQ ID NO: 187848 - protein, 10 aa, Artificial Sequence
  Description of Artificial Sequence: Synthetic peptide
  Seed: NSTFSFRNAL (TYRP2_HUMAN)
NETFSFRNAL

SEQ ID NO: 187849 - protein, 9 aa, Artificial Sequence
  Description of Artificial Sequence: Synthetic peptide
  Seed: TQHWLGLLG (TYRP2_HUMAN)
THHWLGLLY

SEQ ID NO: 187850 - protein, 10 aa, Artificial Sequence
  Description of Artificial Sequence: Synthetic peptide
  Seed: SVYDFFVWLH (TYRP2_HUMAN)
SQYDFFVWLK

SEQ ID NO: 187851 - protein, 9 aa, Artificial Sequence
  Description of Artificial Sequence: Synthetic peptide
  Seed: IFDEWMKRF (TYRP2_HUMAN)
IQDEWMKRL

SEQ ID NO: 187852 - protein, 10 aa, Artificial Sequence
  Description of Artificial Sequence: Synthetic peptide
  Seed: RRNQMGRNSM (TYRP2_HUMAN)
RQNQMGRNSM

SEQ ID NO: 187853 - protein, 10 aa, Artificial Sequence
  Description of Artificial Sequence: Synthetic peptide
  Seed: SVYDFFVWLH (TYRP2_HUMAN)
SNYDFFVWLK

SEQ ID NO: 187854 - protein, 11 aa, Artificial Sequence
  Description of Artificial Sequence: Synthetic peptide
  Seed: YNMVPFFPPVT (TYRP2_HUMAN)
YLMVPFFPPVK

SEQ ID NO: 187855 - protein, 9 aa, Artificial Sequence
  Description of Artificial Sequence: Synthetic peptide
  Seed: SVYDFFVWL (TYRP2_HUMAN)
SAYDFFVWR

SEQ ID NO: 187856 - protein, 10 aa, Artificial Sequence
  Description of Artificial Sequence: Synthetic peptide
  Seed: AIFDEWMKRF (TYRP2_HUMAN)
ALFDEWMKRY

SEQ ID NO: 187857 - protein, 10 aa, Artificial Sequence
  Description of Artificial Sequence: Synthetic peptide
  Seed: FSFRNALEGF (TYRP2_HUMAN)
FAFRNALEGV

SEQ ID NO: 187858 - protein, 11 aa, Artificial Sequence
  Description of Artificial Sequence: Synthetic peptide
  Seed: YNMVPFFPPVT (TYRP2_HUMAN)
YVMVPFFPPVI

SEQ ID NO: 187859 - protein, 9 aa, Artificial Sequence
  Description of Artificial Sequence: Synthetic peptide
  Seed: ALDLAKKRV (TYRP2_HUMAN)
ATDLAKKRM

SEQ ID NO: 187860 - protein, 10 aa, Artificial Sequence
  Description of Artificial Sequence: Synthetic peptide
  Seed: FFQNSTFSFR (TYRP2_HUMAN)
FEQNSTFSFR

SEQ ID NO: 187861 - protein, 9 aa, Artificial Sequence
  Description of Artificial Sequence: Synthetic peptide
  Seed: FVLLAFLQY (TYRP2_HUMAN)
FSLLAFLQL

SEQ ID NO: 187862 - protein, 10 aa, Artificial Sequence
  Description of Artificial Sequence: Synthetic peptide
  Seed: FLTSDQLGYS (TYRP2_HUMAN)
FCTSDQLGYV

SEQ ID NO: 187863 - protein, 9 aa, Artificial Sequence
  Description of Artificial Sequence: Synthetic peptide
  Seed: HSAANDPIF (TYRP2_HUMAN)
HPAANDPIL

SEQ ID NO: 187864 - protein, 9 aa, Artificial Sequence
  Description of Artificial Sequence: Synthetic peptide
  Seed: VVMGTLVAL (TYRP2_HUMAN)
VPMGTLVAY

SEQ ID NO: 187865 - protein, 10 aa, Artificial Sequence
  Description of Artificial Sequence: Synthetic peptide
  Seed: RNSMKLPTLK (TYRP2_HUMAN)
RMSMKLPTLR

SEQ ID NO: 187866 - protein, 9 aa, Artificial Sequence
  Description of Artificial Sequence: Synthetic peptide
  Seed: YSYAIDLPV (TYRP2_HUMAN)
YTYAIDLPY

SEQ ID NO: 187867 - protein, 11 aa, Artificial Sequence
  Description of Artificial Sequence: Synthetic peptide
  Seed: RNQDDRELWPR (TYRP2_HUMAN)
RLQDDRELWPR

SEQ ID NO: 187868 - protein, 8 aa, Artificial Sequence
  Description of Artificial Sequence: Synthetic peptide
  Seed: FSHQGPAF (TYRP2_HUMAN)
FSHQGPAL

SEQ ID NO: 187869 - protein, 9 aa, Artificial Sequence
  Description of Artificial Sequence: Synthetic peptide
  Seed: FFQNSTFSF (TYRP2_HUMAN)
FYQNSTFSM

SEQ ID NO: 187870 - protein, 10 aa, Artificial Sequence
  Description of Artificial Sequence: Synthetic peptide
  Seed: MGTLVALVGL (TYRP2_HUMAN)
MSTLVALVGI

SEQ ID NO: 187871 - protein, 10 aa, Artificial Sequence
  Description of Artificial Sequence: Synthetic peptide
  Seed: RTCKCTGNFA (TYRP2_HUMAN)
RVCKCTGNFI

SEQ ID NO: 187872 - protein, 10 aa, Artificial Sequence
  Description of Artificial Sequence: Synthetic peptide
  Seed: ELWPRKFFHR (TYRP2_HUMAN)
EFWPRKFFHK

SEQ ID NO: 187873 - protein, 9 aa, Artificial Sequence
  Description of Artificial Sequence: Synthetic peptide
  Seed: WPQELAPIG (TYRP2_HUMAN)
WMQELAPIY

SEQ ID NO: 187874 - protein, 10 aa, Artificial Sequence
  Description of Artificial Sequence: Synthetic peptide
  Seed: FVLLAFLQYR (TYRP2_HUMAN)
FHLLAFLQYR

SEQ ID NO: 187875 - protein, 10 aa, Artificial Sequence
  Description of Artificial Sequence: Synthetic peptide
  Seed: KRFNPPADAW (TYRP2_HUMAN)
KMFNPPADAL

SEQ ID NO: 187876 - protein, 10 aa, Artificial Sequence
  Description of Artificial Sequence: Synthetic peptide
  Seed: RTCKCTGNFA (TYRP2_HUMAN)
RSCKCTGNFK

SEQ ID NO: 187877 - protein, 10 aa, Artificial Sequence
  Description of Artificial Sequence: Synthetic peptide
  Seed: LISRNSRFSS (TYRP2_HUMAN)
LNSRNSRFSK

SEQ ID NO: 187878 - protein, 9 aa, Artificial Sequence
  Description of Artificial Sequence: Synthetic peptide
  Seed: AANDPIFVV (TYRP2_HUMAN)
AHNDPIFVF

SEQ ID NO: 187879 - protein, 9 aa, Artificial Sequence
  Description of Artificial Sequence: Synthetic peptide
  Seed: QKFDNPPFF (TYRP2_HUMAN)
QYFDNPPFY

SEQ ID NO: 187880 - protein, 10 aa, Artificial Sequence
  Description of Artificial Sequence: Synthetic peptide
  Seed: FFPPVTNEEL (TYRP2_HUMAN)
FSPPVTNEEM

SEQ ID NO: 187881 - protein, 9 aa, Artificial Sequence
  Description of Artificial Sequence: Synthetic peptide
  Seed: RLRKGYTPL (TYRP2_HUMAN)
RTRKGYTPK

SEQ ID NO: 187882 - protein, 11 aa, Artificial Sequence
  Description of Artificial Sequence: Synthetic peptide
  Seed: VCDSLDDYNHL (TYRP2_HUMAN)
VSDSLDDYNHL

SEQ ID NO: 187883 - protein, 11 aa, Artificial Sequence
  Description of Artificial Sequence: Synthetic peptide
  Seed: ESFALPYWNFA (TYRP2_HUMAN)
ESFALPYWNFV

SEQ ID NO: 187884 - protein, 10 aa, Artificial Sequence
  Description of Artificial Sequence: Synthetic peptide
  Seed: RNSMKLPTLK (TYRP2_HUMAN)
RYSMKLPTLK

SEQ ID NO: 187885 - protein, 9 aa, Artificial Sequence
  Description of Artificial Sequence: Synthetic peptide
  Seed: SRNSRFSSW (TYRP2_HUMAN)
SMNSRFSSL

SEQ ID NO: 187886 - protein, 10 aa, Artificial Sequence
  Description of Artificial Sequence: Synthetic peptide
  Seed: KRFNPPADAW (TYRP2_HUMAN)
KRFNPPADAM

SEQ ID NO: 187887 - protein, 9 aa, Artificial Sequence
  Description of Artificial Sequence: Synthetic peptide
  Seed: FLTSDQLGY (TYRP2_HUMAN)
FITSDQLGY

SEQ ID NO: 187888 - protein, 10 aa, Artificial Sequence
  Description of Artificial Sequence: Synthetic peptide
  Seed: AARPDDPTLI (TYRP2_HUMAN)
AVRPDDPTLY

SEQ ID NO: 187889 - protein, 9 aa, Artificial Sequence
  Description of Artificial Sequence: Synthetic peptide
  Seed: YAIDLPVSV (TYRP2_HUMAN)
YGIDLPVSH

SEQ ID NO: 187890 - protein, 10 aa, Artificial Sequence
  Description of Artificial Sequence: Synthetic peptide
  Seed: YDFFVWLHYY (TYRP2_HUMAN)
YAFFVWLHYY

SEQ ID NO: 187891 - protein, 10 aa, Artificial Sequence
  Description of Artificial Sequence: Synthetic peptide
  Seed: KILPGAQGQF (TYRP2_HUMAN)
KQLPGAQGQM

SEQ ID NO: 187892 - protein, 10 aa, Artificial Sequence
  Description of Artificial Sequence: Synthetic peptide
  Seed: FVWLHYYSVR (TYRP2_HUMAN)
FLWLHYYSVD

SEQ ID NO: 187893 - protein, 10 aa, Artificial Sequence
  Description of Artificial Sequence: Synthetic peptide
  Seed: FPPVTNEELF (TYRP2_HUMAN)
FDPVTNEELF

SEQ ID NO: 187894 - protein, 10 aa, Artificial Sequence
  Description of Artificial Sequence: Synthetic peptide
  Seed: FFQNSTFSFR (TYRP2_HUMAN)
FVQNSTFSFK

SEQ ID NO: 187895 - protein, 11 aa, Artificial Sequence
  Description of Artificial Sequence: Synthetic peptide
  Seed: FFPPVTNEELF (TYRP2_HUMAN)
FQPPVTNEELW

SEQ ID NO: 187896 - protein, 10 aa, Artificial Sequence
  Description of Artificial Sequence: Synthetic peptide
  Seed: RMYNMVPFFP (TYRP2_HUMAN)
RVYNMVPFFL

SEQ ID NO: 187897 - protein, 9 aa, Artificial Sequence
  Description of Artificial Sequence: Synthetic peptide
  Seed: VVMGTLVAL (TYRP2_HUMAN)
VPMGTLVAI

SEQ ID NO: 187898 - protein, 9 aa, Artificial Sequence
  Description of Artificial Sequence: Synthetic peptide
  Seed: LSPQEREQF (TYRP2_HUMAN)
LFPQEREQF

SEQ ID NO: 187899 - protein, 9 aa, Artificial Sequence
  Description of Artificial Sequence: Synthetic peptide
  Seed: FPPVTNEEL (TYRP2_HUMAN)
FVPVTNEEY

SEQ ID NO: 187900 - protein, 8 aa, Artificial Sequence
  Description of Artificial Sequence: Synthetic peptide
  Seed: SLDDYNHL (TYRP2_HUMAN)
SSDDYNHV

SEQ ID NO: 187901 - protein, 10 aa, Artificial Sequence
  Description of Artificial Sequence: Synthetic peptide
  Seed: YSYAIDLPVS (TYRP2_HUMAN)
YQYAIDLPVT

SEQ ID NO: 187902 - protein, 9 aa, Artificial Sequence
  Description of Artificial Sequence: Synthetic peptide
  Seed: YAIDLPVSV (TYRP2_HUMAN)
YAIDLPVST

SEQ ID NO: 187903 - protein, 10 aa, Artificial Sequence
  Description of Artificial Sequence: Synthetic peptide
  Seed: QGPAFVTWHR (TYRP2_HUMAN)
QNPAFVTWHR

SEQ ID NO: 187904 - protein, 10 aa, Artificial Sequence
  Description of Artificial Sequence: Synthetic peptide
  Seed: FPPVTNEELF (TYRP2_HUMAN)
FIPVTNEELY

SEQ ID NO: 187905 - protein, 10 aa, Artificial Sequence
  Description of Artificial Sequence: Synthetic peptide
  Seed: SPLWWGFLLS (TYRP2_HUMAN)
SDLWWGFLLL

SEQ ID NO: 187906 - protein, 9 aa, Artificial Sequence
  Description of Artificial Sequence: Synthetic peptide
  Seed: STFSFRNAL (TYRP2_HUMAN)
SFFSFRNAV

SEQ ID NO: 187907 - protein, 9 aa, Artificial Sequence
  Description of Artificial Sequence: Synthetic peptide
  Seed: YVITTQHWL (TYRP2_HUMAN)
YVITTQHWY

SEQ ID NO: 187908 - protein, 9 aa, Artificial Sequence
  Description of Artificial Sequence: Synthetic peptide
  Seed: ARPDDPTLI (TYRP2_HUMAN)
AMPDDPTLL

SEQ ID NO: 187909 - protein, 9 aa, Artificial Sequence
  Description of Artificial Sequence: Synthetic peptide
  Seed: YYSVRDTLL (TYRP2_HUMAN)
YTSVRDTLY

SEQ ID NO: 187910 - protein, 9 aa, Artificial Sequence
  Description of Artificial Sequence: Synthetic peptide
  Seed: AANDPIFVV (TYRP2_HUMAN)
AHNDPIFVM

SEQ ID NO: 187911 - protein, 9 aa, Artificial Sequence
  Description of Artificial Sequence: Synthetic peptide
  Seed: HQGPAFVTW (TYRP2_HUMAN)
HSGPAFVTW

SEQ ID NO: 187912 - protein, 9 aa, Artificial Sequence
  Description of Artificial Sequence: Synthetic peptide
  Seed: TLLGPGRPY (TYRP2_HUMAN)
TFLGPGRPM

SEQ ID NO: 187913 - protein, 10 aa, Artificial Sequence
  Description of Artificial Sequence: Synthetic peptide
  Seed: AIFDEWMKRF (TYRP2_HUMAN)
AIFDEWMKRW

SEQ ID NO: 187914 - protein, 11 aa, Artificial Sequence
  Description of Artificial Sequence: Synthetic peptide
  Seed: VLLAFLQYRRL (TYRP2_HUMAN)
VLLAFLQYRRV

SEQ ID NO: 187915 - protein, 10 aa, Artificial Sequence
  Description of Artificial Sequence: Synthetic peptide
  Seed: ADTRPWSGPY (TYRP2_HUMAN)
AQTRPWSGPY

SEQ ID NO: 187916 - protein, 11 aa, Artificial Sequence
  Description of Artificial Sequence: Synthetic peptide
  Seed: SLSPQEREQFL (TYRP2_HUMAN)
SMSPQEREQFL

SEQ ID NO: 187917 - protein, 10 aa, Artificial Sequence
  Description of Artificial Sequence: Synthetic peptide
  Seed: DSLDDYNHLV (TYRP2_HUMAN)
DLLDDYNHLV

SEQ ID NO: 187918 - protein, 10 aa, Artificial Sequence
  Description of Artificial Sequence: Synthetic peptide
  Seed: RLIGNESFAL (TYRP2_HUMAN)
RIIGNESFAR

SEQ ID NO: 187919 - protein, 10 aa, Artificial Sequence
  Description of Artificial Sequence: Synthetic peptide
  Seed: RNSRFSSWET (TYRP2_HUMAN)
RFSRFSSWEA

SEQ ID NO: 187920 - protein, 9 aa, Artificial Sequence
  Description of Artificial Sequence: Synthetic peptide
  Seed: STFSFRNAL (TYRP2_HUMAN)
SHFSFRNAV

SEQ ID NO: 187921 - protein, 9 aa, Artificial Sequence
  Description of Artificial Sequence: Synthetic peptide
  Seed: VVMGTLVAL (TYRP2_HUMAN)
VGMGTLVAY

SEQ ID NO: 187922 - protein, 9 aa, Artificial Sequence
  Description of Artificial Sequence: Synthetic peptide
  Seed: YSYAIDLPV (TYRP2_HUMAN)
YLYAIDLPV

SEQ ID NO: 187923 - protein, 10 aa, Artificial Sequence
  Description of Artificial Sequence: Synthetic peptide
  Seed: LISRNSRFSS (TYRP2_HUMAN)
LASRNSRFSK

SEQ ID NO: 187924 - protein, 10 aa, Artificial Sequence
  Description of Artificial Sequence: Synthetic peptide
  Seed: NSTFSFRNAL (TYRP2_HUMAN)
NNTFSFRNAV

SEQ ID NO: 187925 - protein, 9 aa, Artificial Sequence
  Description of Artificial Sequence: Synthetic peptide
  Seed: LVHSFLNGT (TYRP2_HUMAN)
LTHSFLNGV

SEQ ID NO: 187926 - protein, 9 aa, Artificial Sequence
  Description of Artificial Sequence: Synthetic peptide
  Seed: DAIFDEWMK (TYRP2_HUMAN)
DSIFDEWMR

SEQ ID NO: 187927 - protein, 10 aa, Artificial Sequence
  Description of Artificial Sequence: Synthetic peptide
  Seed: RVCMTVDSLV (TYRP2_HUMAN)
RLCMTVDSLL

SEQ ID NO: 187928 - protein, 9 aa, Artificial Sequence
  Description of Artificial Sequence: Synthetic peptide
  Seed: SLDDYNHLV (TYRP2_HUMAN)
SLDDYNHLI

SEQ ID NO: 187929 - protein, 9 aa, Artificial Sequence
  Description of Artificial Sequence: Synthetic peptide
  Seed: VHPDYVITT (TYRP2_HUMAN)
VNPDYVITL

SEQ ID NO: 187930 - protein, 9 aa, Artificial Sequence
  Description of Artificial Sequence: Synthetic peptide
  Seed: RFNPPADAW (TYRP2_HUMAN)
RMNPPADAI

SEQ ID NO: 187931 - protein, 10 aa, Artificial Sequence
  Description of Artificial Sequence: Synthetic peptide
  Seed: ADTRPWSGPY (TYRP2_HUMAN)
ALTRPWSGPK

SEQ ID NO: 187932 - protein, 9 aa, Artificial Sequence
  Description of Artificial Sequence: Synthetic peptide
  Seed: ALVGLFVLL (TYRP2_HUMAN)
AVVGLFVLV

SEQ ID NO: 187933 - protein, 9 aa, Artificial Sequence
  Description of Artificial Sequence: Synthetic peptide
  Seed: QKFDNPPFF (TYRP2_HUMAN)
QVFDNPPFF

SEQ ID NO: 187934 - protein, 9 aa, Artificial Sequence
  Description of Artificial Sequence: Synthetic peptide
  Seed: PQFANCSVY (TYRP2_HUMAN)
PQFANCSVF

SEQ ID NO: 187935 - protein, 9 aa, Artificial Sequence
  Description of Artificial Sequence: Synthetic peptide
  Seed: FSHQGPAFV (TYRP2_HUMAN)
FAHQGPAFH

SEQ ID NO: 187936 - protein, 11 aa, Artificial Sequence
  Description of Artificial Sequence: Synthetic peptide
  Seed: YTPLMETHLSS (TYRP2_HUMAN)
YCPLMETHLSL

SEQ ID NO: 187937 - protein, 8 aa, Artificial Sequence
  Description of Artificial Sequence: Synthetic peptide
  Seed: FLNGTNAL (TYRP2_HUMAN)
FANGTNAY

SEQ ID NO: 187938 - protein, 11 aa, Artificial Sequence
  Description of Artificial Sequence: Synthetic peptide
  Seed: MYNMVPFFPPV (TYRP2_HUMAN)
MINMVPFFPPV

SEQ ID NO: 187939 - protein, 8 aa, Artificial Sequence
  Description of Artificial Sequence: Synthetic peptide
  Seed: LDDYNHLV (TYRP2_HUMAN)
LADYNHLF

SEQ ID NO: 187940 - protein, 8 aa, Artificial Sequence
  Description of Artificial Sequence: Synthetic peptide
  Seed: SLDDYNHL (TYRP2_HUMAN)
SSDDYNHI

SEQ ID NO: 187941 - protein, 8 aa, Artificial Sequence
  Description of Artificial Sequence: Synthetic peptide
  Seed: LDDYNHLV (TYRP2_HUMAN)
LLDYNHLV

SEQ ID NO: 187942 - protein, 10 aa, Artificial Sequence
  Description of Artificial Sequence: Synthetic peptide
  Seed: MSPLWWGFLL (TYRP2_HUMAN)
MVPLWWGFLV

SEQ ID NO: 187943 - protein, 11 aa, Artificial Sequence
  Description of Artificial Sequence: Synthetic peptide
  Seed: QPQFANCSVYD (TYRP2_HUMAN)
QYQFANCSVYY

SEQ ID NO: 187944 - protein, 10 aa, Artificial Sequence
  Description of Artificial Sequence: Synthetic peptide
  Seed: RRLRKGYTPL (TYRP2_HUMAN)
RKLRKGYTPY

SEQ ID NO: 187945 - protein, 9 aa, Artificial Sequence
  Description of Artificial Sequence: Synthetic peptide
  Seed: TPGWPTTLL (TYRP2_HUMAN)
TPGWPTTLM

SEQ ID NO: 187946 - protein, 9 aa, Artificial Sequence
  Description of Artificial Sequence: Synthetic peptide
  Seed: ETHLSSKRY (TYRP2_HUMAN)
EVHLSSKRR

SEQ ID NO: 187947 - protein, 9 aa, Artificial Sequence
  Description of Artificial Sequence: Synthetic peptide
  Seed: HQGPAFVTW (TYRP2_HUMAN)
HVGPAFVTW

SEQ ID NO: 187948 - protein, 8 aa, Artificial Sequence
  Description of Artificial Sequence: Synthetic peptide
  Seed: SLDDYNHL (TYRP2_HUMAN)
SADDYNHF

SEQ ID NO: 187949 - protein, 10 aa, Artificial Sequence
  Description of Artificial Sequence: Synthetic peptide
  Seed: MSLHNLVHSF (TYRP2_HUMAN)
MPLHNLVHSL

SEQ ID NO: 187950 - protein, 9 aa, Artificial Sequence
  Description of Artificial Sequence: Synthetic peptide
  Seed: RQNIHSLSP (TYRP2_HUMAN)
RMNIHSLSI

SEQ ID NO: 187951 - protein, 9 aa, Artificial Sequence
  Description of Artificial Sequence: Synthetic peptide
  Seed: GQFPRVCMT (TYRP2_HUMAN)
GTFPRVCMV

SEQ ID NO: 187952 - protein, 10 aa, Artificial Sequence
  Description of Artificial Sequence: Synthetic peptide
  Seed: NSTFSFRNAL (TYRP2_HUMAN)
NKTFSFRNAI

SEQ ID NO: 187953 - protein, 10 aa, Artificial Sequence
  Description of Artificial Sequence: Synthetic peptide
  Seed: TRPWSGPYIL (TYRP2_HUMAN)
TWPWSGPYIF

SEQ ID NO: 187954 - protein, 9 aa, Artificial Sequence
  Description of Artificial Sequence: Synthetic peptide
  Seed: VLLAFLQYR (TYRP2_HUMAN)
VMLAFLQYR

SEQ ID NO: 187955 - protein, 9 aa, Artificial Sequence
  Description of Artificial Sequence: Synthetic peptide
  Seed: FFPPVTNEE (TYRP2_HUMAN)
FWPPVTNEY

SEQ ID NO: 187956 - protein, 10 aa, Artificial Sequence
  Description of Artificial Sequence: Synthetic peptide
  Seed: FFQNSTFSFR (TYRP2_HUMAN)
FYQNSTFSFC

SEQ ID NO: 187957 - protein, 10 aa, Artificial Sequence
  Description of Artificial Sequence: Synthetic peptide
  Seed: SLSPQEREQF (TYRP2_HUMAN)
SMSPQEREQY

SEQ ID NO: 187958 - protein, 9 aa, Artificial Sequence
  Description of Artificial Sequence: Synthetic peptide
  Seed: FFQNSTFSF (TYRP2_HUMAN)
FGQNSTFSY

SEQ ID NO: 187959 - protein, 9 aa, Artificial Sequence
  Description of Artificial Sequence: Synthetic peptide
  Seed: GQFPRVCMT (TYRP2_HUMAN)
GIFPRVCML

SEQ ID NO: 187960 - protein, 9 aa, Artificial Sequence
  Description of Artificial Sequence: Synthetic peptide
  Seed: SRFSSWETV (TYRP2_HUMAN)
SMFSSWETI

SEQ ID NO: 187961 - protein, 10 aa, Artificial Sequence
  Description of Artificial Sequence: Synthetic peptide
  Seed: ADTRPWSGPY (TYRP2_HUMAN)
AFTRPWSGPK

SEQ ID NO: 187962 - protein, 10 aa, Artificial Sequence
  Description of Artificial Sequence: Synthetic peptide
  Seed: LISRNSRFSS (TYRP2_HUMAN)
LVSRNSRFSK

SEQ ID NO: 187963 - protein, 10 aa, Artificial Sequence
  Description of Artificial Sequence: Synthetic peptide
  Seed: FFVWLHYYSV (TYRP2_HUMAN)
FLVWLHYYSL

SEQ ID NO: 187964 - protein, 9 aa, Artificial Sequence
  Description of Artificial Sequence: Synthetic peptide
  Seed: FQNSTFSFR (TYRP2_HUMAN)
FYNSTFSFK

SEQ ID NO: 187965 - protein, 10 aa, Artificial Sequence
  Description of Artificial Sequence: Synthetic peptide
  Seed: LVVMGTLVAL (TYRP2_HUMAN)
LQVMGTLVAL

SEQ ID NO: 187966 - protein, 9 aa, Artificial Sequence
  Description of Artificial Sequence: Synthetic peptide
  Seed: GRNSMKLPT (TYRP2_HUMAN)
GRNSMKLPL

SEQ ID NO: 187967 - protein, 9 aa, Artificial Sequence
  Description of Artificial Sequence: Synthetic peptide
  Seed: LHNLVHSFL (TYRP2_HUMAN)
LANLVHSFY

SEQ ID NO: 187968 - protein, 9 aa, Artificial Sequence
  Description of Artificial Sequence: Synthetic peptide
  Seed: FVWLHYYSV (TYRP2_HUMAN)
FIWLHYYSA

SEQ ID NO: 187969 - protein, 9 aa, Artificial Sequence
  Description of Artificial Sequence: Synthetic peptide
  Seed: VTWHRYHLL (TYRP2_HUMAN)
VYWHRYHLL

SEQ ID NO: 187970 - protein, 11 aa, Artificial Sequence
  Description of Artificial Sequence: Synthetic peptide
  Seed: RNSRFSSWETV (TYRP2_HUMAN)
RKSRFSSWETI

SEQ ID NO: 187971 - protein, 10 aa, Artificial Sequence
  Description of Artificial Sequence: Synthetic peptide
  Seed: RMYNMVPFFP (TYRP2_HUMAN)
RMYNMVPFFL

SEQ ID NO: 187972 - protein, 10 aa, Artificial Sequence
  Description of Artificial Sequence: Synthetic peptide
  Seed: TDAIFDEWMK (TYRP2_HUMAN)
TYAIFDEWMR

SEQ ID NO: 187973 - protein, 9 aa, Artificial Sequence
  Description of Artificial Sequence: Synthetic peptide
  Seed: SLHNLVHSF (TYRP2_HUMAN)
SKHNLVHSY

SEQ ID NO: 187974 - protein, 8 aa, Artificial Sequence
  Description of Artificial Sequence: Synthetic peptide
  Seed: TFSFRNAL (TYRP2_HUMAN)
TYSFRNAM

SEQ ID NO: 187975 - protein, 11 aa, Artificial Sequence
  Description of Artificial Sequence: Synthetic peptide
  Seed: RNSRFSSWETV (TYRP2_HUMAN)
RPSRFSSWETV

SEQ ID NO: 187976 - protein, 11 aa, Artificial Sequence
  Description of Artificial Sequence: Synthetic peptide
  Seed: ARPDDPTLISR (TYRP2_HUMAN)
ARPDDPTLISM

SEQ ID NO: 187977 - protein, 9 aa, Artificial Sequence
  Description of Artificial Sequence: Synthetic peptide
  Seed: LRKGYTPLM (TYRP2_HUMAN)
LHKGYTPLY

SEQ ID NO: 187978 - protein, 10 aa, Artificial Sequence
  Description of Artificial Sequence: Synthetic peptide
  Seed: NMVPFFPPVT (TYRP2_HUMAN)
NMVPFFPPVI

SEQ ID NO: 187979 - protein, 9 aa, Artificial Sequence
  Description of Artificial Sequence: Synthetic peptide
  Seed: YSVRDTLLG (TYRP2_HUMAN)
YSVRDTLLF

SEQ ID NO: 187980 - protein, 10 aa, Artificial Sequence
  Description of Artificial Sequence: Synthetic peptide
  Seed: FGWTGPNCER (TYRP2_HUMAN)
FSWTGPNCER

SEQ ID NO: 187981 - protein, 9 aa, Artificial Sequence
  Description of Artificial Sequence: Synthetic peptide
  Seed: NMVPFFPPV (TYRP2_HUMAN)
NQVPFFPPW

SEQ ID NO: 187982 - protein, 9 aa, Artificial Sequence
  Description of Artificial Sequence: Synthetic peptide
  Seed: ITTQHWLGL (TYRP2_HUMAN)
ITTQHWLGF

SEQ ID NO: 187983 - protein, 9 aa, Artificial Sequence
  Description of Artificial Sequence: Synthetic peptide
  Seed: NMVPFFPPV (TYRP2_HUMAN)
NAVPFFPPV

SEQ ID NO: 187984 - protein, 9 aa, Artificial Sequence
  Description of Artificial Sequence: Synthetic peptide
  Seed: RKFFHRTCK (TYRP2_HUMAN)
RTFFHRTCM

SEQ ID NO: 187985 - protein, 9 aa, Artificial Sequence
  Description of Artificial Sequence: Synthetic peptide
  Seed: FFQNSTFSF (TYRP2_HUMAN)
FQQNSTFSA

SEQ ID NO: 187986 - protein, 9 aa, Artificial Sequence
  Description of Artificial Sequence: Synthetic peptide
  Seed: RDCLSLQKF (TYRP2_HUMAN)
RVCLSLQKW

SEQ ID NO: 187987 - protein, 9 aa, Artificial Sequence
  Description of Artificial Sequence: Synthetic peptide
  Seed: NRMYNMVPF (TYRP2_HUMAN)
NAMYNMVPY

SEQ ID NO: 187988 - protein, 9 aa, Artificial Sequence
  Description of Artificial Sequence: Synthetic peptide
  Seed: FFPPVTNEE (TYRP2_HUMAN)
FFPPVTNEV

SEQ ID NO: 187989 - protein, 9 aa, Artificial Sequence
  Description of Artificial Sequence: Synthetic peptide
  Seed: RLRKGYTPL (TYRP2_HUMAN)
RNRKGYTPV

SEQ ID NO: 187990 - protein, 10 aa, Artificial Sequence
  Description of Artificial Sequence: Synthetic peptide
  Seed: SDQLGYSYAI (TYRP2_HUMAN)
SNQLGYSYAV

SEQ ID NO: 187991 - protein, 10 aa, Artificial Sequence
  Description of Artificial Sequence: Synthetic peptide
  Seed: REQFLGALDL (TYRP2_HUMAN)
RMQFLGALDL

SEQ ID NO: 187992 - protein, 10 aa, Artificial Sequence
  Description of Artificial Sequence: Synthetic peptide
  Seed: FLTSDQLGYS (TYRP2_HUMAN)
FATSDQLGYV

SEQ ID NO: 187993 - protein, 9 aa, Artificial Sequence
  Description of Artificial Sequence: Synthetic peptide
  Seed: QKFDNPPFF (TYRP2_HUMAN)
QYFDNPPFF

SEQ ID NO: 187994 - protein, 9 aa, Artificial Sequence
  Description of Artificial Sequence: Synthetic peptide
  Seed: RQNIHSLSP (TYRP2_HUMAN)
RHNIHSLSL

SEQ ID NO: 187995 - protein, 10 aa, Artificial Sequence
  Description of Artificial Sequence: Synthetic peptide
  Seed: SSWETVCDSL (TYRP2_HUMAN)
STWETVCDSV

SEQ ID NO: 187996 - protein, 9 aa, Artificial Sequence
  Description of Artificial Sequence: Synthetic peptide
  Seed: DDYNHLVTL (TYRP2_HUMAN)
DQYNHLVTM

SEQ ID NO: 187997 - protein, 11 aa, Artificial Sequence
  Description of Artificial Sequence: Synthetic peptide
  Seed: SLDDYNHLVTL (TYRP2_HUMAN)
SSDDYNHLVTM

SEQ ID NO: 187998 - protein, 9 aa, Artificial Sequence
  Description of Artificial Sequence: Synthetic peptide
  Seed: SRFSSWETV (TYRP2_HUMAN)
SYFSSWETL

SEQ ID NO: 187999 - protein, 10 aa, Artificial Sequence
  Description of Artificial Sequence: Synthetic peptide
  Seed: RRLRKGYTPL (TYRP2_HUMAN)
RLLRKGYTPV

SEQ ID NO: 188000 - protein, 9 aa, Artificial Sequence
  Description of Artificial Sequence: Synthetic peptide
  Seed: TSDQLGYSY (TYRP2_HUMAN)
TGDQLGYSV

SEQ ID NO: 188001 - protein, 10 aa, Artificial Sequence
  Description of Artificial Sequence: Synthetic peptide
  Seed: LHYYSVRDTL (TYRP2_HUMAN)
LRYYSVRDTF

SEQ ID NO: 188002 - protein, 11 aa, Artificial Sequence
  Description of Artificial Sequence: Synthetic peptide
  Seed: YTPLMETHLSS (TYRP2_HUMAN)
YWPLMETHLSL

SEQ ID NO: 188003 - protein, 9 aa, Artificial Sequence
  Description of Artificial Sequence: Synthetic peptide
  Seed: YAIDLPVSV (TYRP2_HUMAN)
YFIDLPVSI

SEQ ID NO: 188004 - protein, 9 aa, Artificial Sequence
  Description of Artificial Sequence: Synthetic peptide
  Seed: HYYSVRDTL (TYRP2_HUMAN)
HTYSVRDTL

SEQ ID NO: 188005 - protein, 10 aa, Artificial Sequence
  Description of Artificial Sequence: Synthetic peptide
  Seed: FFPPVTNEEL (TYRP2_HUMAN)
FYPPVTNEEM

SEQ ID NO: 188006 - protein, 9 aa, Artificial Sequence
  Description of Artificial Sequence: Synthetic peptide
  Seed: RVHPDYVIT (TYRP2_HUMAN)
RAHPDYVIK

SEQ ID NO: 188007 - protein, 9 aa, Artificial Sequence
  Description of Artificial Sequence: Synthetic peptide
  Seed: VIRQNIHSL (TYRP2_HUMAN)
VYRQNIHSY

SEQ ID NO: 188008 - protein, 9 aa, Artificial Sequence
  Description of Artificial Sequence: Synthetic peptide
  Seed: GAQGQFPRV (TYRP2_HUMAN)
GLQGQFPRV

SEQ ID NO: 188009 - protein, 9 aa, Artificial Sequence
  Description of Artificial Sequence: Synthetic peptide
  Seed: YAIDLPVSV (TYRP2_HUMAN)
YHIDLPVSC

SEQ ID NO: 188010 - protein, 11 aa, Artificial Sequence
  Description of Artificial Sequence: Synthetic peptide
  Seed: YTPLMETHLSS (TYRP2_HUMAN)
YMPLMETHLSA

SEQ ID NO: 188011 - protein, 9 aa, Artificial Sequence
  Description of Artificial Sequence: Synthetic peptide
  Seed: AWPQELAPI (TYRP2_HUMAN)
AFPQELAPM

SEQ ID NO: 188012 - protein, 11 aa, Artificial Sequence
  Description of Artificial Sequence: Synthetic peptide
  Seed: FSHQGPAFVTW (TYRP2_HUMAN)
FTHQGPAFVTW

SEQ ID NO: 188013 - protein, 10 aa, Artificial Sequence
  Description of Artificial Sequence: Synthetic peptide
  Seed: GTLDSQVMSL (TYRP2_HUMAN)
GMLDSQVMSF

SEQ ID NO: 188014 - protein, 9 aa, Artificial Sequence
  Description of Artificial Sequence: Synthetic peptide
  Seed: SLHNLVHSF (TYRP2_HUMAN)
SMHNLVHSW

SEQ ID NO: 188015 - protein, 11 aa, Artificial Sequence
  Description of Artificial Sequence: Synthetic peptide
  Seed: LPVSVEETPGW (TYRP2_HUMAN)
LNVSVEETPGW

SEQ ID NO: 188016 - protein, 10 aa, Artificial Sequence
  Description of Artificial Sequence: Synthetic peptide
  Seed: HSFLNGTNAL (TYRP2_HUMAN)
HCFLNGTNAM

SEQ ID NO: 188017 - protein, 11 aa, Artificial Sequence
  Description of Artificial Sequence: Synthetic peptide
  Seed: FTDAIFDEWMK (TYRP2_HUMAN)
FSDAIFDEWMY

SEQ ID NO: 188018 - protein, 9 aa, Artificial Sequence
  Description of Artificial Sequence: Synthetic peptide
  Seed: RLRKGYTPL (TYRP2_HUMAN)
RFRKGYTPQ

SEQ ID NO: 188019 - protein, 10 aa, Artificial Sequence
  Description of Artificial Sequence: Synthetic peptide
  Seed: YNMVPFFPPV (TYRP2_HUMAN)
YSMVPFFPPV

SEQ ID NO: 188020 - protein, 9 aa, Artificial Sequence
  Description of Artificial Sequence: Synthetic peptide
  Seed: HQGPAFVTW (TYRP2_HUMAN)
HSGPAFVTV

SEQ ID NO: 188021 - protein, 11 aa, Artificial Sequence
  Description of Artificial Sequence: Synthetic peptide
  Seed: RELWPRKFFHR (TYRP2_HUMAN)
RLLWPRKFFHR

SEQ ID NO: 188022 - protein, 10 aa, Artificial Sequence
  Description of Artificial Sequence: Synthetic peptide
  Seed: HSAANDPIFV (TYRP2_HUMAN)
HLAANDPIFI

SEQ ID NO: 188023 - protein, 10 aa, Artificial Sequence
  Description of Artificial Sequence: Synthetic peptide
  Seed: RNSRFSSWET (TYRP2_HUMAN)
RRSRFSSWEI

SEQ ID NO: 188024 - protein, 9 aa, Artificial Sequence
  Description of Artificial Sequence: Synthetic peptide
  Seed: SRNSRFSSW (TYRP2_HUMAN)
SHNSRFSSM

SEQ ID NO: 188025 - protein, 11 aa, Artificial Sequence
  Description of Artificial Sequence: Synthetic peptide
  Seed: FVVLHSFTDAI (TYRP2_HUMAN)
FFVLHSFTDAV

SEQ ID NO: 188026 - protein, 10 aa, Artificial Sequence
  Description of Artificial Sequence: Synthetic peptide
  Seed: IGNESFALPY (TYRP2_HUMAN)
IINESFALPY

SEQ ID NO: 188027 - protein, 10 aa, Artificial Sequence
  Description of Artificial Sequence: Synthetic peptide
  Seed: YAIDLPVSVE (TYRP2_HUMAN)
YMIDLPVSVQ

SEQ ID NO: 188028 - protein, 9 aa, Artificial Sequence
  Description of Artificial Sequence: Synthetic peptide
  Seed: LAFLQYRRL (TYRP2_HUMAN)
LSFLQYRRY

SEQ ID NO: 188029 - protein, 9 aa, Artificial Sequence
  Description of Artificial Sequence: Synthetic peptide
  Seed: SRNSRFSSW (TYRP2_HUMAN)
SHNSRFSSY

SEQ ID NO: 188030 - protein, 9 aa, Artificial Sequence
  Description of Artificial Sequence: Synthetic peptide
  Seed: ARPDDPTLI (TYRP2_HUMAN)
ARPDDPTLL

SEQ ID NO: 188031 - protein, 9 aa, Artificial Sequence
  Description of Artificial Sequence: Synthetic peptide
  Seed: FLNGTNALP (TYRP2_HUMAN)
FMNGTNALT

SEQ ID NO: 188032 - protein, 10 aa, Artificial Sequence
  Description of Artificial Sequence: Synthetic peptide
  Seed: KILPGAQGQF (TYRP2_HUMAN)
KTLPGAQGQR

SEQ ID NO: 188033 - protein, 10 aa, Artificial Sequence
  Description of Artificial Sequence: Synthetic peptide
  Seed: IDFSHQGPAF (TYRP2_HUMAN)
IFFSHQGPAM

SEQ ID NO: 188034 - protein, 10 aa, Artificial Sequence
  Description of Artificial Sequence: Synthetic peptide
  Seed: NSRFSSWETV (TYRP2_HUMAN)
NSRFSSWETL

SEQ ID NO: 188035 - protein, 9 aa, Artificial Sequence
  Description of Artificial Sequence: Synthetic peptide
  Seed: VTWHRYHLL (TYRP2_HUMAN)
VIWHRYHLY

SEQ ID NO: 188036 - protein, 9 aa, Artificial Sequence
  Description of Artificial Sequence: Synthetic peptide
  Seed: FSHQGPAFV (TYRP2_HUMAN)
FRHQGPAFI

SEQ ID NO: 188037 - protein, 11 aa, Artificial Sequence
  Description of Artificial Sequence: Synthetic peptide
  Seed: RMYNMVPFFPP (TYRP2_HUMAN)
RVYNMVPFFPI

SEQ ID NO: 188038 - protein, 9 aa, Artificial Sequence
  Description of Artificial Sequence: Synthetic peptide
  Seed: TLKDIRDCL (TYRP2_HUMAN)
TMKDIRDCF

SEQ ID NO: 188039 - protein, 9 aa, Artificial Sequence
  Description of Artificial Sequence: Synthetic peptide
  Seed: FQNSTFSFR (TYRP2_HUMAN)
FFNSTFSFK

SEQ ID NO: 188040 - protein, 11 aa, Artificial Sequence
  Description of Artificial Sequence: Synthetic peptide
  Seed: YNMVPFFPPVT (TYRP2_HUMAN)
YMMVPFFPPVD

SEQ ID NO: 188041 - protein, 9 aa, Artificial Sequence
  Description of Artificial Sequence: Synthetic peptide
  Seed: FVLLAFLQY (TYRP2_HUMAN)
FILLAFLQF

SEQ ID NO: 188042 - protein, 9 aa, Artificial Sequence
  Description of Artificial Sequence: Synthetic peptide
  Seed: RLRKGYTPL (TYRP2_HUMAN)
RFRKGYTPS

SEQ ID NO: 188043 - protein, 9 aa, Artificial Sequence
  Description of Artificial Sequence: Synthetic peptide
  Seed: SFLNGTNAL (TYRP2_HUMAN)
SRLNGTNAY

SEQ ID NO: 188044 - protein, 11 aa, Artificial Sequence
  Description of Artificial Sequence: Synthetic peptide
  Seed: ESFALPYWNFA (TYRP2_HUMAN)
ETFALPYWNFI

SEQ ID NO: 188045 - protein, 10 aa, Artificial Sequence
  Description of Artificial Sequence: Synthetic peptide
  Seed: LVVMGTLVAL (TYRP2_HUMAN)
LNVMGTLVAA

SEQ ID NO: 188046 - protein, 9 aa, Artificial Sequence
  Description of Artificial Sequence: Synthetic peptide
  Seed: SQVMSLHNL (TYRP2_HUMAN)
SLVMSLHNF

SEQ ID NO: 188047 - protein, 9 aa, Artificial Sequence
  Description of Artificial Sequence: Synthetic peptide
  Seed: METHLSSKR (TYRP2_HUMAN)
MMTHLSSKR

SEQ ID NO: 188048 - protein, 11 aa, Artificial Sequence
  Description of Artificial Sequence: Synthetic peptide
  Seed: KRFNPPADAWP (TYRP2_HUMAN)
KRFNPPADAWF

SEQ ID NO: 188049 - protein, 8 aa, Artificial Sequence
  Description of Artificial Sequence: Synthetic peptide
  Seed: SDQLGYSY (TYRP2_HUMAN)
SDQLGYSL

SEQ ID NO: 188050 - protein, 9 aa, Artificial Sequence
  Description of Artificial Sequence: Synthetic peptide
  Seed: FVLLAFLQY (TYRP2_HUMAN)
FQLLAFLQM

SEQ ID NO: 188051 - protein, 9 aa, Artificial Sequence
  Description of Artificial Sequence: Synthetic peptide
  Seed: YTPLMETHL (TYRP2_HUMAN)
YFPLMETHL

SEQ ID NO: 188052 - protein, 9 aa, Artificial Sequence
  Description of Artificial Sequence: Synthetic peptide
  Seed: SVRDTLLGP (TYRP2_HUMAN)
SMRDTLLGK

SEQ ID NO: 188053 - protein, 10 aa, Artificial Sequence
  Description of Artificial Sequence: Synthetic peptide
  Seed: SPLWWGFLLS (TYRP2_HUMAN)
SSLWWGFLLA

SEQ ID NO: 188054 - protein, 9 aa, Artificial Sequence
  Description of Artificial Sequence: Synthetic peptide
  Seed: AIFDEWMKR (TYRP2_HUMAN)
AQFDEWMKY

SEQ ID NO: 188055 - protein, 11 aa, Artificial Sequence
  Description of Artificial Sequence: Synthetic peptide
  Seed: KADGTLDSQVM (TYRP2_HUMAN)
KQDGTLDSQVF

SEQ ID NO: 188056 - protein, 9 aa, Artificial Sequence
  Description of Artificial Sequence: Synthetic peptide
  Seed: YSYAIDLPV (TYRP2_HUMAN)
YPYAIDLPP

SEQ ID NO: 188057 - protein, 9 aa, Artificial Sequence
  Description of Artificial Sequence: Synthetic peptide
  Seed: SVRDTLLGP (TYRP2_HUMAN)
SARDTLLGA

SEQ ID NO: 188058 - protein, 10 aa, Artificial Sequence
  Description of Artificial Sequence: Synthetic peptide
  Seed: LHYYSVRDTL (TYRP2_HUMAN)
LQYYSVRDTF

SEQ ID NO: 188059 - protein, 9 aa, Artificial Sequence
  Description of Artificial Sequence: Synthetic peptide
  Seed: RAIDFSHQG (TYRP2_HUMAN)
RTIDFSHQF

SEQ ID NO: 188060 - protein, 9 aa, Artificial Sequence
  Description of Artificial Sequence: Synthetic peptide
  Seed: RKFFHRTCK (TYRP2_HUMAN)
RTFFHRTCL

SEQ ID NO: 188061 - protein, 11 aa, Artificial Sequence
  Description of Artificial Sequence: Synthetic peptide
  Seed: WLHYYSVRDTL (TYRP2_HUMAN)
WMHYYSVRDTW

SEQ ID NO: 188062 - protein, 9 aa, Artificial Sequence
  Description of Artificial Sequence: Synthetic peptide
  Seed: DQLGYSYAI (TYRP2_HUMAN)
DHLGYSYAA

SEQ ID NO: 188063 - protein, 10 aa, Artificial Sequence
  Description of Artificial Sequence: Synthetic peptide
  Seed: FQNSTFSFRN (TYRP2_HUMAN)
FTNSTFSFRR

SEQ ID NO: 188064 - protein, 9 aa, Artificial Sequence
  Description of Artificial Sequence: Synthetic peptide
  Seed: NALEGFDKA (TYRP2_HUMAN)
NVLEGFDKL

SEQ ID NO: 188065 - protein, 11 aa, Artificial Sequence
  Description of Artificial Sequence: Synthetic peptide
  Seed: QPQFANCSVYD (TYRP2_HUMAN)
QSQFANCSVYY

SEQ ID NO: 188066 - protein, 10 aa, Artificial Sequence
  Description of Artificial Sequence: Synthetic peptide
  Seed: MGTLVALVGL (TYRP2_HUMAN)
MSTLVALVGV

SEQ ID NO: 188067 - protein, 9 aa, Artificial Sequence
  Description of Artificial Sequence: Synthetic peptide
  Seed: RMYNMVPFF (TYRP2_HUMAN)
RHYNMVPFK

SEQ ID NO: 188068 - protein, 9 aa, Artificial Sequence
  Description of Artificial Sequence: Synthetic peptide
  Seed: FPPVTNEEL (TYRP2_HUMAN)
FSPVTNEEF

SEQ ID NO: 188069 - protein, 9 aa, Artificial Sequence
  Description of Artificial Sequence: Synthetic peptide
  Seed: VIRQNIHSL (TYRP2_HUMAN)
VRRQNIHSF

SEQ ID NO: 188070 - protein, 10 aa, Artificial Sequence
  Description of Artificial Sequence: Synthetic peptide
  Seed: FLLSCLGCKI (TYRP2_HUMAN)
FLLSCLGCKL

SEQ ID NO: 188071 - protein, 10 aa, Artificial Sequence
  Description of Artificial Sequence: Synthetic peptide
  Seed: HSFLNGTNAL (TYRP2_HUMAN)
HQFLNGTNAW

SEQ ID NO: 188072 - protein, 9 aa, Artificial Sequence
  Description of Artificial Sequence: Synthetic peptide
  Seed: YYSVRDTLL (TYRP2_HUMAN)
YYSVRDTLI

SEQ ID NO: 188073 - protein, 10 aa, Artificial Sequence
  Description of Artificial Sequence: Synthetic peptide
  Seed: GTLDSQVMSL (TYRP2_HUMAN)
GRLDSQVMSV

SEQ ID NO: 188074 - protein, 10 aa, Artificial Sequence
  Description of Artificial Sequence: Synthetic peptide
  Seed: TRPWSGPYIL (TYRP2_HUMAN)
TKPWSGPYIF

SEQ ID NO: 188075 - protein, 9 aa, Artificial Sequence
  Description of Artificial Sequence: Synthetic peptide
  Seed: LVTLCNGTY (TYRP2_HUMAN)
LKTLCNGTM

SEQ ID NO: 188076 - protein, 10 aa, Artificial Sequence
  Description of Artificial Sequence: Synthetic peptide
  Seed: FFVWLHYYSV (TYRP2_HUMAN)
FNVWLHYYSV

SEQ ID NO: 188077 - protein, 11 aa, Artificial Sequence
  Description of Artificial Sequence: Synthetic peptide
  Seed: MYNMVPFFPPV (TYRP2_HUMAN)
MHNMVPFFPPL

SEQ ID NO: 188078 - protein, 9 aa, Artificial Sequence
  Description of Artificial Sequence: Synthetic peptide
  Seed: SLDDYNHLV (TYRP2_HUMAN)
SIDDYNHLV

SEQ ID NO: 188079 - protein, 9 aa, Artificial Sequence
  Description of Artificial Sequence: Synthetic peptide
  Seed: TLDSQVMSL (TYRP2_HUMAN)
TADSQVMSL

SEQ ID NO: 188080 - protein, 8 aa, Artificial Sequence
  Description of Artificial Sequence: Synthetic peptide
  Seed: AIDLPVSV (TYRP2_HUMAN)
ATDLPVSF

SEQ ID NO: 188081 - protein, 9 aa, Artificial Sequence
  Description of Artificial Sequence: Synthetic peptide
  Seed: ITTQHWLGL (TYRP2_HUMAN)
IATQHWLGW

SEQ ID NO: 188082 - protein, 9 aa, Artificial Sequence
  Description of Artificial Sequence: Synthetic peptide
  Seed: FSHQGPAFV (TYRP2_HUMAN)
FSHQGPAFH

SEQ ID NO: 188083 - protein, 11 aa, Artificial Sequence
  Description of Artificial Sequence: Synthetic peptide
  Seed: SVYDFFVWLHY (TYRP2_HUMAN)
SMYDFFVWLHY

SEQ ID NO: 188084 - protein, 10 aa, Artificial Sequence
  Description of Artificial Sequence: Synthetic peptide
  Seed: TLLGPGRPYR (TYRP2_HUMAN)
TILGPGRPYR

SEQ ID NO: 188085 - protein, 11 aa, Artificial Sequence
  Description of Artificial Sequence: Synthetic peptide
  Seed: WLHYYSVRDTL (TYRP2_HUMAN)
WFHYYSVRDTF

SEQ ID NO: 188086 - protein, 9 aa, Artificial Sequence
  Description of Artificial Sequence: Synthetic peptide
  Seed: SVYDFFVWL (TYRP2_HUMAN)
SMYDFFVWY

SEQ ID NO: 188087 - protein, 10 aa, Artificial Sequence
  Description of Artificial Sequence: Synthetic peptide
  Seed: YNMVPFFPPV (TYRP2_HUMAN)
YWMVPFFPPV

SEQ ID NO: 188088 - protein, 9 aa, Artificial Sequence
  Description of Artificial Sequence: Synthetic peptide
  Seed: ARPDDPTLI (TYRP2_HUMAN)
AHPDDPTLI

SEQ ID NO: 188089 - protein, 11 aa, Artificial Sequence
  Description of Artificial Sequence: Synthetic peptide
  Seed: MSLHNLVHSFL (TYRP2_HUMAN)
MALHNLVHSFW

SEQ ID NO: 188090 - protein, 10 aa, Artificial Sequence
  Description of Artificial Sequence: Synthetic peptide
  Seed: REQFLGALDL (TYRP2_HUMAN)
RRQFLGALDV

SEQ ID NO: 188091 - protein, 9 aa, Artificial Sequence
  Description of Artificial Sequence: Synthetic peptide
  Seed: GPNGTQPQF (TYRP2_HUMAN)
GLNGTQPQY

SEQ ID NO: 188092 - protein, 10 aa, Artificial Sequence
  Description of Artificial Sequence: Synthetic peptide
  Seed: QVMSLHNLVH (TYRP2_HUMAN)
QAMSLHNLVK

SEQ ID NO: 188093 - protein, 10 aa, Artificial Sequence
  Description of Artificial Sequence: Synthetic peptide
  Seed: ETPGWPTTLL (TYRP2_HUMAN)
ETPGWPTTLF

SEQ ID NO: 188094 - protein, 10 aa, Artificial Sequence
  Description of Artificial Sequence: Synthetic peptide
  Seed: RELWPRKFFH (TYRP2_HUMAN)
RQLWPRKFFY

SEQ ID NO: 188095 - protein, 10 aa, Artificial Sequence
  Description of Artificial Sequence: Synthetic peptide
  Seed: HSFLNGTNAL (TYRP2_HUMAN)
HQFLNGTNAI

SEQ ID NO: 188096 - protein, 9 aa, Artificial Sequence
  Description of Artificial Sequence: Synthetic peptide
  Seed: FTDAIFDEW (TYRP2_HUMAN)
FMDAIFDEL

SEQ ID NO: 188097 - protein, 10 aa, Artificial Sequence
  Description of Artificial Sequence: Synthetic peptide
  Seed: HSFLNGTNAL (TYRP2_HUMAN)
HVFLNGTNAW

SEQ ID NO: 188098 - protein, 9 aa, Artificial Sequence
  Description of Artificial Sequence: Synthetic peptide
  Seed: PADAWPQEL (TYRP2_HUMAN)
PWDAWPQEL

SEQ ID NO: 188099 - protein, 9 aa, Artificial Sequence
  Description of Artificial Sequence: Synthetic peptide
  Seed: AIFDEWMKR (TYRP2_HUMAN)
AYFDEWMKY

SEQ ID NO: 188100 - protein, 9 aa, Artificial Sequence
  Description of Artificial Sequence: Synthetic peptide
  Seed: STFSFRNAL (TYRP2_HUMAN)
SLFSFRNAF

SEQ ID NO: 188101 - protein, 10 aa, Artificial Sequence
  Description of Artificial Sequence: Synthetic peptide
  Seed: LAPIGHNRMY (TYRP2_HUMAN)
LQPIGHNRMY

SEQ ID NO: 188102 - protein, 9 aa, Artificial Sequence
  Description of Artificial Sequence: Synthetic peptide
  Seed: ETPGWPTTL (TYRP2_HUMAN)
EVPGWPTTI

SEQ ID NO: 188103 - protein, 11 aa, Artificial Sequence
  Description of Artificial Sequence: Synthetic peptide
  Seed: YNMVPFFPPVT (TYRP2_HUMAN)
YTMVPFFPPVV

SEQ ID NO: 188104 - protein, 10 aa, Artificial Sequence
  Description of Artificial Sequence: Synthetic peptide
  Seed: ETPGWPTTLL (TYRP2_HUMAN)
EVPGWPTTLV

SEQ ID NO: 188105 - protein, 10 aa, Artificial Sequence
  Description of Artificial Sequence: Synthetic peptide
  Seed: SLDDYNHLVT (TYRP2_HUMAN)
SADDYNHLVF

SEQ ID NO: 188106 - protein, 11 aa, Artificial Sequence
  Description of Artificial Sequence: Synthetic peptide
  Seed: RELWPRKFFHR (TYRP2_HUMAN)
RQLWPRKFFHR

SEQ ID NO: 188107 - protein, 9 aa, Artificial Sequence
  Description of Artificial Sequence: Synthetic peptide
  Seed: SAANDPIFV (TYRP2_HUMAN)
SAANDPIFM

SEQ ID NO: 188108 - protein, 9 aa, Artificial Sequence
  Description of Artificial Sequence: Synthetic peptide
  Seed: LVGLFVLLA (TYRP2_HUMAN)
LIGLFVLLV

SEQ ID NO: 188109 - protein, 10 aa, Artificial Sequence
  Description of Artificial Sequence: Synthetic peptide
  Seed: NSTFSFRNAL (TYRP2_HUMAN)
NHTFSFRNAI

SEQ ID NO: 188110 - protein, 10 aa, Artificial Sequence
  Description of Artificial Sequence: Synthetic peptide
  Seed: NPPFFQNSTF (TYRP2_HUMAN)
NWPFFQNSTW

SEQ ID NO: 188111 - protein, 10 aa, Artificial Sequence
  Description of Artificial Sequence: Synthetic peptide
  Seed: LHYYSVRDTL (TYRP2_HUMAN)
LRYYSVRDTM

SEQ ID NO: 188112 - protein, 9 aa, Artificial Sequence
  Description of Artificial Sequence: Synthetic peptide
  Seed: VVMGTLVAL (TYRP2_HUMAN)
VGMGTLVAV

SEQ ID NO: 188113 - protein, 9 aa, Artificial Sequence
  Description of Artificial Sequence: Synthetic peptide
  Seed: LLAFLQYRR (TYRP2_HUMAN)
LFAFLQYRK

SEQ ID NO: 188114 - protein, 10 aa, Artificial Sequence
  Description of Artificial Sequence: Synthetic peptide
  Seed: RPWSGPYILR (TYRP2_HUMAN)
RCWSGPYILR

SEQ ID NO: 188115 - protein, 10 aa, Artificial Sequence
  Description of Artificial Sequence: Synthetic peptide
  Seed: FVWLHYYSVR (TYRP2_HUMAN)
FMWLHYYSVR

SEQ ID NO: 188116 - protein, 9 aa, Artificial Sequence
  Description of Artificial Sequence: Synthetic peptide
  Seed: IFDEWMKRF (TYRP2_HUMAN)
IWDEWMKRF

SEQ ID NO: 188117 - protein, 9 aa, Artificial Sequence
  Description of Artificial Sequence: Synthetic peptide
  Seed: PADAWPQEL (TYRP2_HUMAN)
PLDAWPQEM

SEQ ID NO: 188118 - protein, 9 aa, Artificial Sequence
  Description of Artificial Sequence: Synthetic peptide
  Seed: VYDFFVWLH (TYRP2_HUMAN)
VYDFFVWLY

SEQ ID NO: 188119 - protein, 9 aa, Artificial Sequence
  Description of Artificial Sequence: Synthetic peptide
  Seed: ANDPIFVVL (TYRP2_HUMAN)
AVDPIFVVM

SEQ ID NO: 188120 - protein, 11 aa, Artificial Sequence
  Description of Artificial Sequence: Synthetic peptide
  Seed: YNMVPFFPPVT (TYRP2_HUMAN)
YIMVPFFPPVN

SEQ ID NO: 188121 - protein, 10 aa, Artificial Sequence
  Description of Artificial Sequence: Synthetic peptide
  Seed: MSPLWWGFLL (TYRP2_HUMAN)
MEPLWWGFLV

SEQ ID NO: 188122 - protein, 10 aa, Artificial Sequence
  Description of Artificial Sequence: Synthetic peptide
  Seed: SYAIDLPVSV (TYRP2_HUMAN)
SMAIDLPVSA

SEQ ID NO: 188123 - protein, 9 aa, Artificial Sequence
  Description of Artificial Sequence: Synthetic peptide
  Seed: YAIDLPVSV (TYRP2_HUMAN)
YSIDLPVSV

SEQ ID NO: 188124 - protein, 10 aa, Artificial Sequence
  Description of Artificial Sequence: Synthetic peptide
  Seed: RLRKGYTPLM (TYRP2_HUMAN)
RSRKGYTPLY

SEQ ID NO: 188125 - protein, 10 aa, Artificial Sequence
  Description of Artificial Sequence: Synthetic peptide
  Seed: NGTYEGLLRR (TYRP2_HUMAN)
NSTYEGLLRK

SEQ ID NO: 188126 - protein, 10 aa, Artificial Sequence
  Description of Artificial Sequence: Synthetic peptide
  Seed: FSFRNALEGF (TYRP2_HUMAN)
FQFRNALEGY

SEQ ID NO: 188127 - protein, 10 aa, Artificial Sequence
  Description of Artificial Sequence: Synthetic peptide
  Seed: HSFLNGTNAL (TYRP2_HUMAN)
HGFLNGTNAM

SEQ ID NO: 188128 - protein, 10 aa, Artificial Sequence
  Description of Artificial Sequence: Synthetic peptide
  Seed: QPQFANCSVY (TYRP2_HUMAN)
QWQFANCSVY

SEQ ID NO: 188129 - protein, 9 aa, Artificial Sequence
  Description of Artificial Sequence: Synthetic peptide
  Seed: SFLNGTNAL (TYRP2_HUMAN)
SILNGTNAM

SEQ ID NO: 188130 - protein, 11 aa, Artificial Sequence
  Description of Artificial Sequence: Synthetic peptide
  Seed: YRRLRKGYTPL (TYRP2_HUMAN)
YLRLRKGYTPF

SEQ ID NO: 188131 - protein, 9 aa, Artificial Sequence
  Description of Artificial Sequence: Synthetic peptide
  Seed: YSYAIDLPV (TYRP2_HUMAN)
YPYAIDLPT

SEQ ID NO: 188132 - protein, 8 aa, Artificial Sequence
  Description of Artificial Sequence: Synthetic peptide
  Seed: NSMKLPTL (TYRP2_HUMAN)
NRMKLPTL

SEQ ID NO: 188133 - protein, 8 aa, Artificial Sequence
  Description of Artificial Sequence: Synthetic peptide
  Seed: SLDDYNHL (TYRP2_HUMAN)
SMDDYNHL

SEQ ID NO: 188134 - protein, 9 aa, Artificial Sequence
  Description of Artificial Sequence: Synthetic peptide
  Seed: FFQNSTFSF (TYRP2_HUMAN)
FIQNSTFSL

SEQ ID NO: 188135 - protein, 9 aa, Artificial Sequence
  Description of Artificial Sequence: Synthetic peptide
  Seed: VVMGTLVAL (TYRP2_HUMAN)
VQMGTLVAV

SEQ ID NO: 188136 - protein, 10 aa, Artificial Sequence
  Description of Artificial Sequence: Synthetic peptide
  Seed: TVDSLVNKEC (TYRP2_HUMAN)
TADSLVNKEM

SEQ ID NO: 188137 - protein, 11 aa, Artificial Sequence
  Description of Artificial Sequence: Synthetic peptide
  Seed: FFPPVTNEELF (TYRP2_HUMAN)
FIPPVTNEELW

SEQ ID NO: 188138 - protein, 11 aa, Artificial Sequence
  Description of Artificial Sequence: Synthetic peptide
  Seed: YTPLMETHLSS (TYRP2_HUMAN)
YTPLMETHLSV

SEQ ID NO: 188139 - protein, 9 aa, Artificial Sequence
  Description of Artificial Sequence: Synthetic peptide
  Seed: MSPLWWGFL (TYRP2_HUMAN)
MWPLWWGFM

SEQ ID NO: 188140 - protein, 10 aa, Artificial Sequence
  Description of Artificial Sequence: Synthetic peptide
  Seed: AANDPIFVVL (TYRP2_HUMAN)
AINDPIFVVY

SEQ ID NO: 188141 - protein, 10 aa, Artificial Sequence
  Description of Artificial Sequence: Synthetic peptide
  Seed: NCSVYDFFVW (TYRP2_HUMAN)
NDSVYDFFVW

SEQ ID NO: 188142 - protein, 9 aa, Artificial Sequence
  Description of Artificial Sequence: Synthetic peptide
  Seed: MSPLWWGFL (TYRP2_HUMAN)
MFPLWWGFL

SEQ ID NO: 188143 - protein, 11 aa, Artificial Sequence
  Description of Artificial Sequence: Synthetic peptide
  Seed: LPVSVEETPGW (TYRP2_HUMAN)
LSVSVEETPGF

SEQ ID NO: 188144 - protein, 9 aa, Artificial Sequence
  Description of Artificial Sequence: Synthetic peptide
  Seed: QFPRVCMTV (TYRP2_HUMAN)
QFPRVCMTF

SEQ ID NO: 188145 - protein, 9 aa, Artificial Sequence
  Description of Artificial Sequence: Synthetic peptide
  Seed: RLRKGYTPL (TYRP2_HUMAN)
RLRKGYTPN

SEQ ID NO: 188146 - protein, 9 aa, Artificial Sequence
  Description of Artificial Sequence: Synthetic peptide
  Seed: FSHQGPAFV (TYRP2_HUMAN)
FSHQGPAFL

SEQ ID NO: 188147 - protein, 10 aa, Artificial Sequence
  Description of Artificial Sequence: Synthetic peptide
  Seed: NLVHSFLNGT (TYRP2_HUMAN)
NLVHSFLNGL

SEQ ID NO: 188148 - protein, 10 aa, Artificial Sequence
  Description of Artificial Sequence: Synthetic peptide
  Seed: FFQNSTFSFR (TYRP2_HUMAN)
FLQNSTFSFK

SEQ ID NO: 188149 - protein, 10 aa, Artificial Sequence
  Description of Artificial Sequence: Synthetic peptide
  Seed: KILPGAQGQF (TYRP2_HUMAN)
KNLPGAQGQY

SEQ ID NO: 188150 - protein, 9 aa, Artificial Sequence
  Description of Artificial Sequence: Synthetic peptide
  Seed: RQNIHSLSP (TYRP2_HUMAN)
RGNIHSLSF

SEQ ID NO: 188151 - protein, 10 aa, Artificial Sequence
  Description of Artificial Sequence: Synthetic peptide
  Seed: NGTYEGLLRR (TYRP2_HUMAN)
NDTYEGLLRK

SEQ ID NO: 188152 - protein, 10 aa, Artificial Sequence
  Description of Artificial Sequence: Synthetic peptide
  Seed: RLRKGYTPLM (TYRP2_HUMAN)
RIRKGYTPLY

SEQ ID NO: 188153 - protein, 11 aa, Artificial Sequence
  Description of Artificial Sequence: Synthetic peptide
  Seed: CDSLDDYNHLV (TYRP2_HUMAN)
CNSLDDYNHLV

SEQ ID NO: 188154 - protein, 10 aa, Artificial Sequence
  Description of Artificial Sequence: Synthetic peptide
  Seed: LGPGRPYRAI (TYRP2_HUMAN)
LDPGRPYRAL

SEQ ID NO: 188155 - protein, 10 aa, Artificial Sequence
  Description of Artificial Sequence: Synthetic peptide
  Seed: PFFQNSTFSF (TYRP2_HUMAN)
PYFQNSTFSL

SEQ ID NO: 188156 - protein, 9 aa, Artificial Sequence
  Description of Artificial Sequence: Synthetic peptide
  Seed: FQNSTFSFR (TYRP2_HUMAN)
FLNSTFSFY

SEQ ID NO: 188157 - protein, 9 aa, Artificial Sequence
  Description of Artificial Sequence: Synthetic peptide
  Seed: FPPVTNEEL (TYRP2_HUMAN)
FLPVTNEEF

SEQ ID NO: 188158 - protein, 9 aa, Artificial Sequence
  Description of Artificial Sequence: Synthetic peptide
  Seed: FLTSDQLGY (TYRP2_HUMAN)
FPTSDQLGL

SEQ ID NO: 188159 - protein, 10 aa, Artificial Sequence
  Description of Artificial Sequence: Synthetic peptide
  Seed: FPPVTNEELF (TYRP2_HUMAN)
FFPVTNEELW

SEQ ID NO: 188160 - protein, 10 aa, Artificial Sequence
  Description of Artificial Sequence: Synthetic peptide
  Seed: LHYYSVRDTL (TYRP2_HUMAN)
LDYYSVRDTF

SEQ ID NO: 188161 - protein, 9 aa, Artificial Sequence
  Description of Artificial Sequence: Synthetic peptide
  Seed: SLHNLVHSF (TYRP2_HUMAN)
SQHNLVHSY

SEQ ID NO: 188162 - protein, 10 aa, Artificial Sequence
  Description of Artificial Sequence: Synthetic peptide
  Seed: SQVMSLHNLV (TYRP2_HUMAN)
SIVMSLHNLV

SEQ ID NO: 188163 - protein, 10 aa, Artificial Sequence
  Description of Artificial Sequence: Synthetic peptide
  Seed: VGLFVLLAFL (TYRP2_HUMAN)
VVLFVLLAFV

SEQ ID NO: 188164 - protein, 9 aa, Artificial Sequence
  Description of Artificial Sequence: Synthetic peptide
  Seed: LVHSFLNGT (TYRP2_HUMAN)
LTHSFLNGL

SEQ ID NO: 188165 - protein, 10 aa, Artificial Sequence
  Description of Artificial Sequence: Synthetic peptide
  Seed: IDFSHQGPAF (TYRP2_HUMAN)
IEFSHQGPAW

SEQ ID NO: 188166 - protein, 9 aa, Artificial Sequence
  Description of Artificial Sequence: Synthetic peptide
  Seed: HYYSVRDTL (TYRP2_HUMAN)
HQYSVRDTY

SEQ ID NO: 188167 - protein, 9 aa, Artificial Sequence
  Description of Artificial Sequence: Synthetic peptide
  Seed: RFNPPADAW (TYRP2_HUMAN)
RYNPPADAY

SEQ ID NO: 188168 - protein, 11 aa, Artificial Sequence
  Description of Artificial Sequence: Synthetic peptide
  Seed: WLHYYSVRDTL (TYRP2_HUMAN)
WLHYYSVRDTW

SEQ ID NO: 188169 - protein, 9 aa, Artificial Sequence
  Description of Artificial Sequence: Synthetic peptide
  Seed: HYYSVRDTL (TYRP2_HUMAN)
HTYSVRDTM

SEQ ID NO: 188170 - protein, 10 aa, Artificial Sequence
  Description of Artificial Sequence: Synthetic peptide
  Seed: SQVMSLHNLV (TYRP2_HUMAN)
SYVMSLHNLV

SEQ ID NO: 188171 - protein, 9 aa, Artificial Sequence
  Description of Artificial Sequence: Synthetic peptide
  Seed: FVWLHYYSV (TYRP2_HUMAN)
FMWLHYYSA

SEQ ID NO: 188172 - protein, 10 aa, Artificial Sequence
  Description of Artificial Sequence: Synthetic peptide
  Seed: RPWSGPYILR (TYRP2_HUMAN)
RWWSGPYILR

SEQ ID NO: 188173 - protein, 10 aa, Artificial Sequence
  Description of Artificial Sequence: Synthetic peptide
  Seed: VVMGTLVALV (TYRP2_HUMAN)
VLMGTLVALL

SEQ ID NO: 188174 - protein, 9 aa, Artificial Sequence
  Description of Artificial Sequence: Synthetic peptide
  Seed: FLTSDQLGY (TYRP2_HUMAN)
FSTSDQLGM

SEQ ID NO: 188175 - protein, 9 aa, Artificial Sequence
  Description of Artificial Sequence: Synthetic peptide
  Seed: HQGPAFVTW (TYRP2_HUMAN)
HPGPAFVTF

SEQ ID NO: 188176 - protein, 9 aa, Artificial Sequence
  Description of Artificial Sequence: Synthetic peptide
  Seed: VTNEELFLT (TYRP2_HUMAN)
VANEELFLL

SEQ ID NO: 188177 - protein, 9 aa, Artificial Sequence
  Description of Artificial Sequence: Synthetic peptide
  Seed: HYYSVRDTL (TYRP2_HUMAN)
HWYSVRDTI

SEQ ID NO: 188178 - protein, 11 aa, Artificial Sequence
  Description of Artificial Sequence: Synthetic peptide
  Seed: LLVVMGTLVAL (TYRP2_HUMAN)
LQVVMGTLVAI

SEQ ID NO: 188179 - protein, 10 aa, Artificial Sequence
  Description of Artificial Sequence: Synthetic peptide
  Seed: LISRNSRFSS (TYRP2_HUMAN)
LRSRNSRFSK

SEQ ID NO: 188180 - protein, 9 aa, Artificial Sequence
  Description of Artificial Sequence: Synthetic peptide
  Seed: FFQNSTFSF (TYRP2_HUMAN)
FMQNSTFSW

SEQ ID NO: 188181 - protein, 9 aa, Artificial Sequence
  Description of Artificial Sequence: Synthetic peptide
  Seed: DFFVWLHYY (TYRP2_HUMAN)
DMFVWLHYK

SEQ ID NO: 188182 - protein, 10 aa, Artificial Sequence
  Description of Artificial Sequence: Synthetic peptide
  Seed: RLRKGYTPLM (TYRP2_HUMAN)
RTRKGYTPLG

SEQ ID NO: 188183 - protein, 10 aa, Artificial Sequence
  Description of Artificial Sequence: Synthetic peptide
  Seed: ESANVCGSQQ (TYRP2_HUMAN)
EVANVCGSQL

SEQ ID NO: 188184 - protein, 10 aa, Artificial Sequence
  Description of Artificial Sequence: Synthetic peptide
  Seed: MGRNSMKLPT (TYRP2_HUMAN)
MSRNSMKLPI

SEQ ID NO: 188185 - protein, 9 aa, Artificial Sequence
  Description of Artificial Sequence: Synthetic peptide
  Seed: FFQNSTFSF (TYRP2_HUMAN)
FVQNSTFSY

SEQ ID NO: 188186 - protein, 9 aa, Artificial Sequence
  Description of Artificial Sequence: Synthetic peptide
  Seed: WHRYHLLCL (TYRP2_HUMAN)
WARYHLLCM

SEQ ID NO: 188187 - protein, 9 aa, Artificial Sequence
  Description of Artificial Sequence: Synthetic peptide
  Seed: AFLQYRRLR (TYRP2_HUMAN)
ASLQYRRLR

SEQ ID NO: 188188 - protein, 10 aa, Artificial Sequence
  Description of Artificial Sequence: Synthetic peptide
  Seed: LVVMGTLVAL (TYRP2_HUMAN)
LQVMGTLVAY

SEQ ID NO: 188189 - protein, 11 aa, Artificial Sequence
  Description of Artificial Sequence: Synthetic peptide
  Seed: LLVVMGTLVAL (TYRP2_HUMAN)
LGVVMGTLVAV

SEQ ID NO: 188190 - protein, 11 aa, Artificial Sequence
  Description of Artificial Sequence: Synthetic peptide
  Seed: SLDDYNHLVTL (TYRP2_HUMAN)
SIDDYNHLVTF

SEQ ID NO: 188191 - protein, 9 aa, Artificial Sequence
  Description of Artificial Sequence: Synthetic peptide
  Seed: FSHQGPAFV (TYRP2_HUMAN)
FGHQGPAFY

SEQ ID NO: 188192 - protein, 10 aa, Artificial Sequence
  Description of Artificial Sequence: Synthetic peptide
  Seed: VLLAFLQYRR (TYRP2_HUMAN)
VSLAFLQYRR

SEQ ID NO: 188193 - protein, 10 aa, Artificial Sequence
  Description of Artificial Sequence: Synthetic peptide
  Seed: RLRKGYTPLM (TYRP2_HUMAN)
RARKGYTPLY

SEQ ID NO: 188194 - protein, 10 aa, Artificial Sequence
  Description of Artificial Sequence: Synthetic peptide
  Seed: MSPLWWGFLL (TYRP2_HUMAN)
MQPLWWGFLL

SEQ ID NO: 188195 - protein, 10 aa, Artificial Sequence
  Description of Artificial Sequence: Synthetic peptide
  Seed: HLVTLCNGTY (TYRP2_HUMAN)
HQVTLCNGTF

SEQ ID NO: 188196 - protein, 9 aa, Artificial Sequence
  Description of Artificial Sequence: Synthetic peptide
  Seed: RLRKGYTPL (TYRP2_HUMAN)
RMRKGYTPA

SEQ ID NO: 188197 - protein, 10 aa, Artificial Sequence
  Description of Artificial Sequence: Synthetic peptide
  Seed: RRLRKGYTPL (TYRP2_HUMAN)
RGLRKGYTPF

SEQ ID NO: 188198 - protein, 11 aa, Artificial Sequence
  Description of Artificial Sequence: Synthetic peptide
  Seed: SVYDFFVWLHY (TYRP2_HUMAN)
SLYDFFVWLHY

SEQ ID NO: 188199 - protein, 11 aa, Artificial Sequence
  Description of Artificial Sequence: Synthetic peptide
  Seed: QPQFANCSVYD (TYRP2_HUMAN)
QFQFANCSVYY

SEQ ID NO: 188200 - protein, 9 aa, Artificial Sequence
  Description of Artificial Sequence: Synthetic peptide
  Seed: NRMYNMVPF (TYRP2_HUMAN)
NWMYNMVPY

SEQ ID NO: 188201 - protein, 9 aa, Artificial Sequence
  Description of Artificial Sequence: Synthetic peptide
  Seed: HSAANDPIF (TYRP2_HUMAN)
HAAANDPIL

SEQ ID NO: 188202 - protein, 10 aa, Artificial Sequence
  Description of Artificial Sequence: Synthetic peptide
  Seed: KRFNPPADAW (TYRP2_HUMAN)
KRFNPPADAY

SEQ ID NO: 188203 - protein, 9 aa, Artificial Sequence
  Description of Artificial Sequence: Synthetic peptide
  Seed: FVWLHYYSV (TYRP2_HUMAN)
FLWLHYYSI

SEQ ID NO: 188204 - protein, 9 aa, Artificial Sequence
  Description of Artificial Sequence: Synthetic peptide
  Seed: HSAANDPIF (TYRP2_HUMAN)
HAAANDPIM

SEQ ID NO: 188205 - protein, 10 aa, Artificial Sequence
  Description of Artificial Sequence: Synthetic peptide
  Seed: LVVMGTLVAL (TYRP2_HUMAN)
LFVMGTLVAA

SEQ ID NO: 188206 - protein, 9 aa, Artificial Sequence
  Description of Artificial Sequence: Synthetic peptide
  Seed: RKFFHRTCK (TYRP2_HUMAN)
RMFFHRTCY

SEQ ID NO: 188207 - protein, 9 aa, Artificial Sequence
  Description of Artificial Sequence: Synthetic peptide
  Seed: AARPDDPTL (TYRP2_HUMAN)
AVRPDDPTF

SEQ ID NO: 188208 - protein, 11 aa, Artificial Sequence
  Description of Artificial Sequence: Synthetic peptide
  Seed: PFFPPVTNEEL (TYRP2_HUMAN)
PYFPPVTNEEF

SEQ ID NO: 188209 - protein, 9 aa, Artificial Sequence
  Description of Artificial Sequence: Synthetic peptide
  Seed: SQVMSLHNL (TYRP2_HUMAN)
STVMSLHNL

SEQ ID NO: 188210 - protein, 9 aa, Artificial Sequence
  Description of Artificial Sequence: Synthetic peptide
  Seed: TTLLVVMGT (TYRP2_HUMAN)
TTLLVVMGL

SEQ ID NO: 188211 - protein, 10 aa, Artificial Sequence
  Description of Artificial Sequence: Synthetic peptide
  Seed: FVWLHYYSVR (TYRP2_HUMAN)
FLWLHYYSVW

SEQ ID NO: 188212 - protein, 9 aa, Artificial Sequence
  Description of Artificial Sequence: Synthetic peptide
  Seed: FFQNSTFSF (TYRP2_HUMAN)
FRQNSTFSV

SEQ ID NO: 188213 - protein, 10 aa, Artificial Sequence
  Description of Artificial Sequence: Synthetic peptide
  Seed: SVYDFFVWLH (TYRP2_HUMAN)
SWYDFFVWLK

SEQ ID NO: 188214 - protein, 9 aa, Artificial Sequence
  Description of Artificial Sequence: Synthetic peptide
  Seed: AANDPIFVV (TYRP2_HUMAN)
AVNDPIFVL

SEQ ID NO: 188215 - protein, 10 aa, Artificial Sequence
  Description of Artificial Sequence: Synthetic peptide
  Seed: RLRKGYTPLM (TYRP2_HUMAN)
RPRKGYTPLM

SEQ ID NO: 188216 - protein, 9 aa, Artificial Sequence
  Description of Artificial Sequence: Synthetic peptide
  Seed: RNSMKLPTL (TYRP2_HUMAN)
RASMKLPTV

SEQ ID NO: 188217 - protein, 10 aa, Artificial Sequence
  Description of Artificial Sequence: Synthetic peptide
  Seed: RRLRKGYTPL (TYRP2_HUMAN)
RILRKGYTPV

SEQ ID NO: 188218 - protein, 10 aa, Artificial Sequence
  Description of Artificial Sequence: Synthetic peptide
  Seed: VVLHSFTDAI (TYRP2_HUMAN)
VYLHSFTDAL

SEQ ID NO: 188219 - protein, 10 aa, Artificial Sequence
  Description of Artificial Sequence: Synthetic peptide
  Seed: RMYNMVPFFP (TYRP2_HUMAN)
RLYNMVPFFY

SEQ ID NO: 188220 - protein, 9 aa, Artificial Sequence
  Description of Artificial Sequence: Synthetic peptide
  Seed: RMYNMVPFF (TYRP2_HUMAN)
RGYNMVPFA

SEQ ID NO: 188221 - protein, 9 aa, Artificial Sequence
  Description of Artificial Sequence: Synthetic peptide
  Seed: SVRDTLLGP (TYRP2_HUMAN)
SSRDTLLGV

SEQ ID NO: 188222 - protein, 9 aa, Artificial Sequence
  Description of Artificial Sequence: Synthetic peptide
  Seed: STFSFRNAL (TYRP2_HUMAN)
SFFSFRNAM

SEQ ID NO: 188223 - protein, 9 aa, Artificial Sequence
  Description of Artificial Sequence: Synthetic peptide
  Seed: APIGHNRMY (TYRP2_HUMAN)
AIIGHNRMY

SEQ ID NO: 188224 - protein, 9 aa, Artificial Sequence
  Description of Artificial Sequence: Synthetic peptide
  Seed: FSHQGPAFV (TYRP2_HUMAN)
FIHQGPAFA

SEQ ID NO: 188225 - protein, 9 aa, Artificial Sequence
  Description of Artificial Sequence: Synthetic peptide
  Seed: NMVPFFPPV (TYRP2_HUMAN)
NMVPFFPPM

SEQ ID NO: 188226 - protein, 9 aa, Artificial Sequence
  Description of Artificial Sequence: Synthetic peptide
  Seed: RLRKGYTPL (TYRP2_HUMAN)
RPRKGYTPV

SEQ ID NO: 188227 - protein, 9 aa, Artificial Sequence
  Description of Artificial Sequence: Synthetic peptide
  Seed: NSMKLPTLK (TYRP2_HUMAN)
NAMKLPTLK

SEQ ID NO: 188228 - protein, 10 aa, Artificial Sequence
  Description of Artificial Sequence: Synthetic peptide
  Seed: FLNGTNALPH (TYRP2_HUMAN)
FVNGTNALPY

SEQ ID NO: 188229 - protein, 9 aa, Artificial Sequence
  Description of Artificial Sequence: Synthetic peptide
  Seed: QRLIGNESF (TYRP2_HUMAN)
QLLIGNESF

SEQ ID NO: 188230 - protein, 10 aa, Artificial Sequence
  Description of Artificial Sequence: Synthetic peptide
  Seed: SSWETVCDSL (TYRP2_HUMAN)
SVWETVCDSV

SEQ ID NO: 188231 - protein, 9 aa, Artificial Sequence
  Description of Artificial Sequence: Synthetic peptide
  Seed: TLLVVMGTL (TYRP2_HUMAN)
TQLVVMGTV

SEQ ID NO: 188232 - protein, 9 aa, Artificial Sequence
  Description of Artificial Sequence: Synthetic peptide
  Seed: LLAFLQYRR (TYRP2_HUMAN)
LSAFLQYRR

SEQ ID NO: 188233 - protein, 10 aa, Artificial Sequence
  Description of Artificial Sequence: Synthetic peptide
  Seed: RRNQMGRNSM (TYRP2_HUMAN)
RQNQMGRNSF

SEQ ID NO: 188234 - protein, 10 aa, Artificial Sequence
  Description of Artificial Sequence: Synthetic peptide
  Seed: YAIDLPVSVE (TYRP2_HUMAN)
YMIDLPVSVR

SEQ ID NO: 188235 - protein, 9 aa, Artificial Sequence
  Description of Artificial Sequence: Synthetic peptide
  Seed: NMVPFFPPV (TYRP2_HUMAN)
NTVPFFPPK

SEQ ID NO: 188236 - protein, 9 aa, Artificial Sequence
  Description of Artificial Sequence: Synthetic peptide
  Seed: YSYAIDLPV (TYRP2_HUMAN)
YWYAIDLPM

SEQ ID NO: 188237 - protein, 10 aa, Artificial Sequence
  Description of Artificial Sequence: Synthetic peptide
  Seed: CKCTGNFAGY (TYRP2_HUMAN)
CMCTGNFAGY

SEQ ID NO: 188238 - protein, 9 aa, Artificial Sequence
  Description of Artificial Sequence: Synthetic peptide
  Seed: VSVEETPGW (TYRP2_HUMAN)
VAVEETPGL

SEQ ID NO: 188239 - protein, 9 aa, Artificial Sequence
  Description of Artificial Sequence: Synthetic peptide
  Seed: NRMYNMVPF (TYRP2_HUMAN)
NQMYNMVPV

SEQ ID NO: 188240 - protein, 9 aa, Artificial Sequence
  Description of Artificial Sequence: Synthetic peptide
  Seed: FLTSDQLGY (TYRP2_HUMAN)
FKTSDQLGF

SEQ ID NO: 188241 - protein, 11 aa, Artificial Sequence
  Description of Artificial Sequence: Synthetic peptide
  Seed: YNMVPFFPPVT (TYRP2_HUMAN)
YQMVPFFPPVW

SEQ ID NO: 188242 - protein, 9 aa, Artificial Sequence
  Description of Artificial Sequence: Synthetic peptide
  Seed: ESANVCGSQ (TYRP2_HUMAN)
ESANVCGSK

SEQ ID NO: 188243 - protein, 9 aa, Artificial Sequence
  Description of Artificial Sequence: Synthetic peptide
  Seed: RLRKGYTPL (TYRP2_HUMAN)
RSRKGYTPQ

SEQ ID NO: 188244 - protein, 10 aa, Artificial Sequence
  Description of Artificial Sequence: Synthetic peptide
  Seed: QPQFANCSVY (TYRP2_HUMAN)
QYQFANCSVF

SEQ ID NO: 188245 - protein, 9 aa, Artificial Sequence
  Description of Artificial Sequence: Synthetic peptide
  Seed: YVITTQHWL (TYRP2_HUMAN)
YTITTQHWL

SEQ ID NO: 188246 - protein, 11 aa, Artificial Sequence
  Description of Artificial Sequence: Synthetic peptide
  Seed: YNMVPFFPPVT (TYRP2_HUMAN)
YMMVPFFPPVI

SEQ ID NO: 188247 - protein, 11 aa, Artificial Sequence
  Description of Artificial Sequence: Synthetic peptide
  Seed: TQPQFANCSVY (TYRP2_HUMAN)
THPQFANCSVM

SEQ ID NO: 188248 - protein, 10 aa, Artificial Sequence
  Description of Artificial Sequence: Synthetic peptide
  Seed: VVLHSFTDAI (TYRP2_HUMAN)
VVLHSFTDAL

SEQ ID NO: 188249 - protein, 8 aa, Artificial Sequence
  Description of Artificial Sequence: Synthetic peptide
  Seed: NQMGRNSM (TYRP2_HUMAN)
NMMGRNSM

SEQ ID NO: 188250 - protein, 9 aa, Artificial Sequence
  Description of Artificial Sequence: Synthetic peptide
  Seed: AWPQELAPI (TYRP2_HUMAN)
AFPQELAPF

SEQ ID NO: 188251 - protein, 10 aa, Artificial Sequence
  Description of Artificial Sequence: Synthetic peptide
  Seed: SHQGPAFVTW (TYRP2_HUMAN)
SWQGPAFVTI

SEQ ID NO: 188252 - protein, 10 aa, Artificial Sequence
  Description of Artificial Sequence: Synthetic peptide
  Seed: RNSRFSSWET (TYRP2_HUMAN)
RQSRFSSWEL

SEQ ID NO: 188253 - protein, 10 aa, Artificial Sequence
  Description of Artificial Sequence: Synthetic peptide
  Seed: YAIDLPVSVE (TYRP2_HUMAN)
YQIDLPVSVA

SEQ ID NO: 188254 - protein, 9 aa, Artificial Sequence
  Description of Artificial Sequence: Synthetic peptide
  Seed: RDCLSLQKF (TYRP2_HUMAN)
RGCLSLQKW

SEQ ID NO: 188255 - protein, 10 aa, Artificial Sequence
  Description of Artificial Sequence: Synthetic peptide
  Seed: QPQFANCSVY (TYRP2_HUMAN)
QVQFANCSVY

SEQ ID NO: 188256 - protein, 9 aa, Artificial Sequence
  Description of Artificial Sequence: Synthetic peptide
  Seed: LGYSYAIDL (TYRP2_HUMAN)
LAYSYAIDL

SEQ ID NO: 188257 - protein, 10 aa, Artificial Sequence
  Description of Artificial Sequence: Synthetic peptide
  Seed: FFPPVTNEEL (TYRP2_HUMAN)
FYPPVTNEEF

SEQ ID NO: 188258 - protein, 9 aa, Artificial Sequence
  Description of Artificial Sequence: Synthetic peptide
  Seed: YAIDLPVSV (TYRP2_HUMAN)
YVIDLPVSA

SEQ ID NO: 188259 - protein, 9 aa, Artificial Sequence
  Description of Artificial Sequence: Synthetic peptide
  Seed: SRNSRFSSW (TYRP2_HUMAN)
SLNSRFSSM

SEQ ID NO: 188260 - protein, 11 aa, Artificial Sequence
  Description of Artificial Sequence: Synthetic peptide
  Seed: CDSLDDYNHLV (TYRP2_HUMAN)
CPSLDDYNHLV

SEQ ID NO: 188261 - protein, 9 aa, Artificial Sequence
  Description of Artificial Sequence: Synthetic peptide
  Seed: VMGTLVALV (TYRP2_HUMAN)
VLGTLVALI

SEQ ID NO: 188262 - protein, 9 aa, Artificial Sequence
  Description of Artificial Sequence: Synthetic peptide
  Seed: QHWLGLLGP (TYRP2_HUMAN)
QHWLGLLGV

SEQ ID NO: 188263 - protein, 9 aa, Artificial Sequence
  Description of Artificial Sequence: Synthetic peptide
  Seed: TLDSQVMSL (TYRP2_HUMAN)
TSDSQVMSV

SEQ ID NO: 188264 - protein, 9 aa, Artificial Sequence
  Description of Artificial Sequence: Synthetic peptide
  Seed: NESFALPYW (TYRP2_HUMAN)
NASFALPYW

SEQ ID NO: 188265 - protein, 9 aa, Artificial Sequence
  Description of Artificial Sequence: Synthetic peptide
  Seed: RNSMKLPTL (TYRP2_HUMAN)
RQSMKLPTL

SEQ ID NO: 188266 - protein, 9 aa, Artificial Sequence
  Description of Artificial Sequence: Synthetic peptide
  Seed: SLHNLVHSF (TYRP2_HUMAN)
SCHNLVHSW

SEQ ID NO: 188267 - protein, 10 aa, Artificial Sequence
  Description of Artificial Sequence: Synthetic peptide
  Seed: REQFLGALDL (TYRP2_HUMAN)
RVQFLGALDY

SEQ ID NO: 188268 - protein, 10 aa, Artificial Sequence
  Description of Artificial Sequence: Synthetic peptide
  Seed: TRPWSGPYIL (TYRP2_HUMAN)
TPPWSGPYIF

SEQ ID NO: 188269 - protein, 10 aa, Artificial Sequence
  Description of Artificial Sequence: Synthetic peptide
  Seed: GPAFVTWHRY (TYRP2_HUMAN)
GSAFVTWHRY

SEQ ID NO: 188270 - protein, 10 aa, Artificial Sequence
  Description of Artificial Sequence: Synthetic peptide
  Seed: FVWLHYYSVR (TYRP2_HUMAN)
FMWLHYYSVQ

SEQ ID NO: 188271 - protein, 9 aa, Artificial Sequence
  Description of Artificial Sequence: Synthetic peptide
  Seed: VALVGLFVL (TYRP2_HUMAN)
VTLVGLFVF

SEQ ID NO: 188272 - protein, 10 aa, Artificial Sequence
  Description of Artificial Sequence: Synthetic peptide
  Seed: CMTVDSLVNK (TYRP2_HUMAN)
CATVDSLVNR

SEQ ID NO: 188273 - protein, 9 aa, Artificial Sequence
  Description of Artificial Sequence: Synthetic peptide
  Seed: FVLLAFLQY (TYRP2_HUMAN)
FLLLAFLQF

SEQ ID NO: 188274 - protein, 9 aa, Artificial Sequence
  Description of Artificial Sequence: Synthetic peptide
  Seed: QKFDNPPFF (TYRP2_HUMAN)
QMFDNPPFY

SEQ ID NO: 188275 - protein, 9 aa, Artificial Sequence
  Description of Artificial Sequence: Synthetic peptide
  Seed: DFFVWLHYY (TYRP2_HUMAN)
DHFVWLHYR

SEQ ID NO: 188276 - protein, 9 aa, Artificial Sequence
  Description of Artificial Sequence: Synthetic peptide
  Seed: RMYNMVPFF (TYRP2_HUMAN)
RLYNMVPFR

SEQ ID NO: 188277 - protein, 9 aa, Artificial Sequence
  Description of Artificial Sequence: Synthetic peptide
  Seed: YVITTQHWL (TYRP2_HUMAN)
YQITTQHWF

SEQ ID NO: 188278 - protein, 10 aa, Artificial Sequence
  Description of Artificial Sequence: Synthetic peptide
  Seed: LQRLIGNESF (TYRP2_HUMAN)
LLRLIGNESY

SEQ ID NO: 188279 - protein, 10 aa, Artificial Sequence
  Description of Artificial Sequence: Synthetic peptide
  Seed: RNQMGRNSMK (TYRP2_HUMAN)
RRQMGRNSMM

SEQ ID NO: 188280 - protein, 9 aa, Artificial Sequence
  Description of Artificial Sequence: Synthetic peptide
  Seed: VLHSFTDAI (TYRP2_HUMAN)
VLHSFTDAA

SEQ ID NO: 188281 - protein, 9 aa, Artificial Sequence
  Description of Artificial Sequence: Synthetic peptide
  Seed: YVITTQHWL (TYRP2_HUMAN)
YMITTQHWA

SEQ ID NO: 188282 - protein, 9 aa, Artificial Sequence
  Description of Artificial Sequence: Synthetic peptide
  Seed: ALVGLFVLL (TYRP2_HUMAN)
AVVGLFVLR

SEQ ID NO: 188283 - protein, 10 aa, Artificial Sequence
  Description of Artificial Sequence: Synthetic peptide
  Seed: VVMGTLVALV (TYRP2_HUMAN)
VHMGTLVALV

SEQ ID NO: 188284 - protein, 9 aa, Artificial Sequence
  Description of Artificial Sequence: Synthetic peptide
  Seed: HQGPAFVTW (TYRP2_HUMAN)
HEGPAFVTI

SEQ ID NO: 188285 - protein, 9 aa, Artificial Sequence
  Description of Artificial Sequence: Synthetic peptide
  Seed: VTWHRYHLL (TYRP2_HUMAN)
VVWHRYHLV

SEQ ID NO: 188286 - protein, 11 aa, Artificial Sequence
  Description of Artificial Sequence: Synthetic peptide
  Seed: YNMVPFFPPVT (TYRP2_HUMAN)
YVMVPFFPPVV

SEQ ID NO: 188287 - protein, 9 aa, Artificial Sequence
  Description of Artificial Sequence: Synthetic peptide
  Seed: VTWHRYHLL (TYRP2_HUMAN)
VVWHRYHLK

SEQ ID NO: 188288 - protein, 11 aa, Artificial Sequence
  Description of Artificial Sequence: Synthetic peptide
  Seed: RNSRFSSWETV (TYRP2_HUMAN)
RDSRFSSWETI

SEQ ID NO: 188289 - protein, 10 aa, Artificial Sequence
  Description of Artificial Sequence: Synthetic peptide
  Seed: GLFVLLAFLQ (TYRP2_HUMAN)
GMFVLLAFLI

SEQ ID NO: 188290 - protein, 9 aa, Artificial Sequence
  Description of Artificial Sequence: Synthetic peptide
  Seed: GTLVALVGL (TYRP2_HUMAN)
GALVALVGV

SEQ ID NO: 188291 - protein, 10 aa, Artificial Sequence
  Description of Artificial Sequence: Synthetic peptide
  Seed: MSPLWWGFLL (TYRP2_HUMAN)
MMPLWWGFLM

SEQ ID NO: 188292 - protein, 10 aa, Artificial Sequence
  Description of Artificial Sequence: Synthetic peptide
  Seed: VVMGTLVALV (TYRP2_HUMAN)
VMMGTLVALY

SEQ ID NO: 188293 - protein, 9 aa, Artificial Sequence
  Description of Artificial Sequence: Synthetic peptide
  Seed: GWPTTLLVV (TYRP2_HUMAN)
GFPTTLLVF

SEQ ID NO: 188294 - protein, 10 aa, Artificial Sequence
  Description of Artificial Sequence: Synthetic peptide
  Seed: REQFLGALDL (TYRP2_HUMAN)
RRQFLGALDI

SEQ ID NO: 188295 - protein, 9 aa, Artificial Sequence
  Description of Artificial Sequence: Synthetic peptide
  Seed: GTYEGLLRR (TYRP2_HUMAN)
GMYEGLLRY

SEQ ID NO: 188296 - protein, 9 aa, Artificial Sequence
  Description of Artificial Sequence: Synthetic peptide
  Seed: VMSLHNLVH (TYRP2_HUMAN)
VRSLHNLVY

SEQ ID NO: 188297 - protein, 9 aa, Artificial Sequence
  Description of Artificial Sequence: Synthetic peptide
  Seed: FVWLHYYSV (TYRP2_HUMAN)
FSWLHYYSM

SEQ ID NO: 188298 - protein, 9 aa, Artificial Sequence
  Description of Artificial Sequence: Synthetic peptide
  Seed: FPPVTNEEL (TYRP2_HUMAN)
FAPVTNEEI

SEQ ID NO: 188299 - protein, 10 aa, Artificial Sequence
  Description of Artificial Sequence: Synthetic peptide
  Seed: PFFQNSTFSF (TYRP2_HUMAN)
PWFQNSTFSY

SEQ ID NO: 188300 - protein, 9 aa, Artificial Sequence
  Description of Artificial Sequence: Synthetic peptide
  Seed: FSHQGPAFV (TYRP2_HUMAN)
FVHQGPAFI

SEQ ID NO: 188301 - protein, 9 aa, Artificial Sequence
  Description of Artificial Sequence: Synthetic peptide
  Seed: NMVPFFPPV (TYRP2_HUMAN)
NTVPFFPPI

SEQ ID NO: 188302 - protein, 10 aa, Artificial Sequence
  Description of Artificial Sequence: Synthetic peptide
  Seed: NSTFSFRNAL (TYRP2_HUMAN)
NQTFSFRNAI

SEQ ID NO: 188303 - protein, 9 aa, Artificial Sequence
  Description of Artificial Sequence: Synthetic peptide
  Seed: LLVVMGTLV (TYRP2_HUMAN)
LVVVMGTLV

SEQ ID NO: 188304 - protein, 10 aa, Artificial Sequence
  Description of Artificial Sequence: Synthetic peptide
  Seed: LGPNGTQPQF (TYRP2_HUMAN)
LLPNGTQPQM

SEQ ID NO: 188305 - protein, 9 aa, Artificial Sequence
  Description of Artificial Sequence: Synthetic peptide
  Seed: RRLRKGYTP (TYRP2_HUMAN)
RRLRKGYTF

SEQ ID NO: 188306 - protein, 11 aa, Artificial Sequence
  Description of Artificial Sequence: Synthetic peptide
  Seed: MYNMVPFFPPV (TYRP2_HUMAN)
MYNMVPFFPPL

SEQ ID NO: 188307 - protein, 9 aa, Artificial Sequence
  Description of Artificial Sequence: Synthetic peptide
  Seed: VVMGTLVAL (TYRP2_HUMAN)
VIMGTLVAK

SEQ ID NO: 188308 - protein, 9 aa, Artificial Sequence
  Description of Artificial Sequence: Synthetic peptide
  Seed: FSHQGPAFV (TYRP2_HUMAN)
FTHQGPAFV

SEQ ID NO: 188309 - protein, 10 aa, Artificial Sequence
  Description of Artificial Sequence: Synthetic peptide
  Seed: HNRMYNMVPF (TYRP2_HUMAN)
HYRMYNMVPF

SEQ ID NO: 188310 - protein, 10 aa, Artificial Sequence
  Description of Artificial Sequence: Synthetic peptide
  Seed: NPPFFQNSTF (TYRP2_HUMAN)
NLPFFQNSTW

SEQ ID NO: 188311 - protein, 9 aa, Artificial Sequence
  Description of Artificial Sequence: Synthetic peptide
  Seed: ISRNSRFSS (TYRP2_HUMAN)
ITRNSRFSL

SEQ ID NO: 188312 - protein, 9 aa, Artificial Sequence
  Description of Artificial Sequence: Synthetic peptide
  Seed: VMSLHNLVH (TYRP2_HUMAN)
VASLHNLVF

SEQ ID NO: 188313 - protein, 9 aa, Artificial Sequence
  Description of Artificial Sequence: Synthetic peptide
  Seed: NALEGFDKA (TYRP2_HUMAN)
NMLEGFDKM

SEQ ID NO: 188314 - protein, 9 aa, Artificial Sequence
  Description of Artificial Sequence: Synthetic peptide
  Seed: RVCMTVDSL (TYRP2_HUMAN)
RTCMTVDSF

SEQ ID NO: 188315 - protein, 10 aa, Artificial Sequence
  Description of Artificial Sequence: Synthetic peptide
  Seed: ELAPIGHNRM (TYRP2_HUMAN)
EAAPIGHNRL

SEQ ID NO: 188316 - protein, 11 aa, Artificial Sequence
  Description of Artificial Sequence: Synthetic peptide
  Seed: FPRVCMTVDSL (TYRP2_HUMAN)
FPRVCMTVDSM

SEQ ID NO: 188317 - protein, 10 aa, Artificial Sequence
  Description of Artificial Sequence: Synthetic peptide
  Seed: HNRMYNMVPF (TYRP2_HUMAN)
HQRMYNMVPY

SEQ ID NO: 188318 - protein, 10 aa, Artificial Sequence
  Description of Artificial Sequence: Synthetic peptide
  Seed: RLRKGYTPLM (TYRP2_HUMAN)
RPRKGYTPLR

SEQ ID NO: 188319 - protein, 10 aa, Artificial Sequence
  Description of Artificial Sequence: Synthetic peptide
  Seed: VLLAFLQYRR (TYRP2_HUMAN)
VRLAFLQYRR

SEQ ID NO: 188320 - protein, 10 aa, Artificial Sequence
  Description of Artificial Sequence: Synthetic peptide
  Seed: NMVPFFPPVT (TYRP2_HUMAN)
NIVPFFPPVV

SEQ ID NO: 188321 - protein, 8 aa, Artificial Sequence
  Description of Artificial Sequence: Synthetic peptide
  Seed: SLDDYNHL (TYRP2_HUMAN)
SLDDYNHI

SEQ ID NO: 188322 - protein, 10 aa, Artificial Sequence
  Description of Artificial Sequence: Synthetic peptide
  Seed: RELWPRKFFH (TYRP2_HUMAN)
RNLWPRKFFK

SEQ ID NO: 188323 - protein, 11 aa, Artificial Sequence
  Description of Artificial Sequence: Synthetic peptide
  Seed: ELAPIGHNRMY (TYRP2_HUMAN)
EAAPIGHNRMK

SEQ ID NO: 188324 - protein, 9 aa, Artificial Sequence
  Description of Artificial Sequence: Synthetic peptide
  Seed: RLRKGYTPL (TYRP2_HUMAN)
RIRKGYTPY

SEQ ID NO: 188325 - protein, 11 aa, Artificial Sequence
  Description of Artificial Sequence: Synthetic peptide
  Seed: YNMVPFFPPVT (TYRP2_HUMAN)
YQMVPFFPPVF

SEQ ID NO: 188326 - protein, 9 aa, Artificial Sequence
  Description of Artificial Sequence: Synthetic peptide
  Seed: RLRKGYTPL (TYRP2_HUMAN)
RVRKGYTPL

SEQ ID NO: 188327 - protein, 10 aa, Artificial Sequence
  Description of Artificial Sequence: Synthetic peptide
  Seed: FTDAIFDEWM (TYRP2_HUMAN)
FADAIFDEWY

SEQ ID NO: 188328 - protein, 11 aa, Artificial Sequence
  Description of Artificial Sequence: Synthetic peptide
  Seed: RNSRFSSWETV (TYRP2_HUMAN)
RYSRFSSWETF

SEQ ID NO: 188329 - protein, 9 aa, Artificial Sequence
  Description of Artificial Sequence: Synthetic peptide
  Seed: ALVGLFVLL (TYRP2_HUMAN)
AVVGLFVLI

SEQ ID NO: 188330 - protein, 10 aa, Artificial Sequence
  Description of Artificial Sequence: Synthetic peptide
  Seed: MSLHNLVHSF (TYRP2_HUMAN)
MQLHNLVHSY

SEQ ID NO: 188331 - protein, 9 aa, Artificial Sequence
  Description of Artificial Sequence: Synthetic peptide
  Seed: SVYDFFVWL (TYRP2_HUMAN)
SMYDFFVWG

SEQ ID NO: 188332 - protein, 10 aa, Artificial Sequence
  Description of Artificial Sequence: Synthetic peptide
  Seed: YNMVPFFPPV (TYRP2_HUMAN)
YNMVPFFPPA

SEQ ID NO: 188333 - protein, 11 aa, Artificial Sequence
  Description of Artificial Sequence: Synthetic peptide
  Seed: RMYNMVPFFPP (TYRP2_HUMAN)
RMYNMVPFFPA

SEQ ID NO: 188334 - protein, 9 aa, Artificial Sequence
  Description of Artificial Sequence: Synthetic peptide
  Seed: DDYNHLVTL (TYRP2_HUMAN)
DNYNHLVTL

SEQ ID NO: 188335 - protein, 10 aa, Artificial Sequence
  Description of Artificial Sequence: Synthetic peptide
  Seed: SYAIDLPVSV (TYRP2_HUMAN)
SYAIDLPVSY

SEQ ID NO: 188336 - protein, 9 aa, Artificial Sequence
  Description of Artificial Sequence: Synthetic peptide
  Seed: FLGALDLAK (TYRP2_HUMAN)
FAGALDLAY

SEQ ID NO: 188337 - protein, 10 aa, Artificial Sequence
  Description of Artificial Sequence: Synthetic peptide
  Seed: RLRKGYTPLM (TYRP2_HUMAN)
RVRKGYTPLV

SEQ ID NO: 188338 - protein, 10 aa, Artificial Sequence
  Description of Artificial Sequence: Synthetic peptide
  Seed: KKRVHPDYVI (TYRP2_HUMAN)
KRRVHPDYVL

SEQ ID NO: 188339 - protein, 9 aa, Artificial Sequence
  Description of Artificial Sequence: Synthetic peptide
  Seed: RKFFHRTCK (TYRP2_HUMAN)
RAFFHRTCR

SEQ ID NO: 188340 - protein, 9 aa, Artificial Sequence
  Description of Artificial Sequence: Synthetic peptide
  Seed: HQGPAFVTW (TYRP2_HUMAN)
HQGPAFVTL

SEQ ID NO: 188341 - protein, 9 aa, Artificial Sequence
  Description of Artificial Sequence: Synthetic peptide
  Seed: FVWLHYYSV (TYRP2_HUMAN)
FIWLHYYSL

SEQ ID NO: 188342 - protein, 9 aa, Artificial Sequence
  Description of Artificial Sequence: Synthetic peptide
  Seed: HQGPAFVTW (TYRP2_HUMAN)
HGGPAFVTY

SEQ ID NO: 188343 - protein, 9 aa, Artificial Sequence
  Description of Artificial Sequence: Synthetic peptide
  Seed: RLRKGYTPL (TYRP2_HUMAN)
RLRKGYTPA

SEQ ID NO: 188344 - protein, 10 aa, Artificial Sequence
  Description of Artificial Sequence: Synthetic peptide
  Seed: SLDDYNHLVT (TYRP2_HUMAN)
SCDDYNHLVM

SEQ ID NO: 188345 - protein, 9 aa, Artificial Sequence
  Description of Artificial Sequence: Synthetic peptide
  Seed: SLDDYNHLV (TYRP2_HUMAN)
STDDYNHLL

SEQ ID NO: 188346 - protein, 10 aa, Artificial Sequence
  Description of Artificial Sequence: Synthetic peptide
  Seed: SLDDYNHLVT (TYRP2_HUMAN)
SQDDYNHLVM

SEQ ID NO: 188347 - protein, 9 aa, Artificial Sequence
  Description of Artificial Sequence: Synthetic peptide
  Seed: RLRKGYTPL (TYRP2_HUMAN)
RYRKGYTPR

SEQ ID NO: 188348 - protein, 10 aa, Artificial Sequence
  Description of Artificial Sequence: Synthetic peptide
  Seed: QGPAFVTWHR (TYRP2_HUMAN)
QAPAFVTWHK

SEQ ID NO: 188349 - protein, 10 aa, Artificial Sequence
  Description of Artificial Sequence: Synthetic peptide
  Seed: NSRFSSWETV (TYRP2_HUMAN)
NKRFSSWETL

SEQ ID NO: 188350 - protein, 9 aa, Artificial Sequence
  Description of Artificial Sequence: Synthetic peptide
  Seed: AANDPIFVV (TYRP2_HUMAN)
AQNDPIFVY

SEQ ID NO: 188351 - protein, 9 aa, Artificial Sequence
  Description of Artificial Sequence: Synthetic peptide
  Seed: VMGTLVALV (TYRP2_HUMAN)
VMGTLVALL

SEQ ID NO: 188352 - protein, 10 aa, Artificial Sequence
  Description of Artificial Sequence: Synthetic peptide
  Seed: HNRMYNMVPF (TYRP2_HUMAN)
HKRMYNMVPF

SEQ ID NO: 188353 - protein, 11 aa, Artificial Sequence
  Description of Artificial Sequence: Synthetic peptide
  Seed: LPVSVEETPGW (TYRP2_HUMAN)
LWVSVEETPGW

SEQ ID NO: 188354 - protein, 9 aa, Artificial Sequence
  Description of Artificial Sequence: Synthetic peptide
  Seed: YSYAIDLPV (TYRP2_HUMAN)
YIYAIDLPA

SEQ ID NO: 188355 - protein, 8 aa, Artificial Sequence
  Description of Artificial Sequence: Synthetic peptide
  Seed: AIDLPVSV (TYRP2_HUMAN)
AWDLPVSF

SEQ ID NO: 188356 - protein, 10 aa, Artificial Sequence
  Description of Artificial Sequence: Synthetic peptide
  Seed: LISRNSRFSS (TYRP2_HUMAN)
LDSRNSRFSK

SEQ ID NO: 188357 - protein, 10 aa, Artificial Sequence
  Description of Artificial Sequence: Synthetic peptide
  Seed: QPQFANCSVY (TYRP2_HUMAN)
QMQFANCSVF

SEQ ID NO: 188358 - protein, 9 aa, Artificial Sequence
  Description of Artificial Sequence: Synthetic peptide
  Seed: WHRYHLLCL (TYRP2_HUMAN)
WMRYHLLCV

SEQ ID NO: 188359 - protein, 10 aa, Artificial Sequence
  Description of Artificial Sequence: Synthetic peptide
  Seed: KILPGAQGQF (TYRP2_HUMAN)
KMLPGAQGQL

SEQ ID NO: 188360 - protein, 9 aa, Artificial Sequence
  Description of Artificial Sequence: Synthetic peptide
  Seed: AANDPIFVV (TYRP2_HUMAN)
ATNDPIFVM

SEQ ID NO: 188361 - protein, 11 aa, Artificial Sequence
  Description of Artificial Sequence: Synthetic peptide
  Seed: LVVMGTLVALV (TYRP2_HUMAN)
LFVMGTLVALV

SEQ ID NO: 188362 - protein, 9 aa, Artificial Sequence
  Description of Artificial Sequence: Synthetic peptide
  Seed: YSYAIDLPV (TYRP2_HUMAN)
YMYAIDLPF

SEQ ID NO: 188363 - protein, 10 aa, Artificial Sequence
  Description of Artificial Sequence: Synthetic peptide
  Seed: FFQNSTFSFR (TYRP2_HUMAN)
FYQNSTFSFM

SEQ ID NO: 188364 - protein, 9 aa, Artificial Sequence
  Description of Artificial Sequence: Synthetic peptide
  Seed: GFDKADGTL (TYRP2_HUMAN)
GTDKADGTL

SEQ ID NO: 188365 - protein, 9 aa, Artificial Sequence
  Description of Artificial Sequence: Synthetic peptide
  Seed: SLHNLVHSF (TYRP2_HUMAN)
SPHNLVHSL

SEQ ID NO: 188366 - protein, 9 aa, Artificial Sequence
  Description of Artificial Sequence: Synthetic peptide
  Seed: TLISRNSRF (TYRP2_HUMAN)
TVISRNSRY

SEQ ID NO: 188367 - protein, 9 aa, Artificial Sequence
  Description of Artificial Sequence: Synthetic peptide
  Seed: SLHNLVHSF (TYRP2_HUMAN)
SSHNLVHSR

SEQ ID NO: 188368 - protein, 10 aa, Artificial Sequence
  Description of Artificial Sequence: Synthetic peptide
  Seed: LVVMGTLVAL (TYRP2_HUMAN)
LVVMGTLVAM

SEQ ID NO: 188369 - protein, 11 aa, Artificial Sequence
  Description of Artificial Sequence: Synthetic peptide
  Seed: LVVMGTLVALV (TYRP2_HUMAN)
LLVMGTLVALV

SEQ ID NO: 188370 - protein, 10 aa, Artificial Sequence
  Description of Artificial Sequence: Synthetic peptide
  Seed: NSTFSFRNAL (TYRP2_HUMAN)
NMTFSFRNAI

SEQ ID NO: 188371 - protein, 9 aa, Artificial Sequence
  Description of Artificial Sequence: Synthetic peptide
  Seed: APIGHNRMY (TYRP2_HUMAN)
AAIGHNRMF

SEQ ID NO: 188372 - protein, 9 aa, Artificial Sequence
  Description of Artificial Sequence: Synthetic peptide
  Seed: YVITTQHWL (TYRP2_HUMAN)
YMITTQHWR

SEQ ID NO: 188373 - protein, 8 aa, Artificial Sequence
  Description of Artificial Sequence: Synthetic peptide
  Seed: IRQNIHSL (TYRP2_HUMAN)
IHQNIHSV

SEQ ID NO: 188374 - protein, 9 aa, Artificial Sequence
  Description of Artificial Sequence: Synthetic peptide
  Seed: YSYAIDLPV (TYRP2_HUMAN)
YLYAIDLPT

SEQ ID NO: 188375 - protein, 9 aa, Artificial Sequence
  Description of Artificial Sequence: Synthetic peptide
  Seed: AANDPIFVV (TYRP2_HUMAN)
ARNDPIFVL

SEQ ID NO: 188376 - protein, 10 aa, Artificial Sequence
  Description of Artificial Sequence: Synthetic peptide
  Seed: AANDPIFVVL (TYRP2_HUMAN)
AYNDPIFVVL

SEQ ID NO: 188377 - protein, 10 aa, Artificial Sequence
  Description of Artificial Sequence: Synthetic peptide
  Seed: LGPNGTQPQF (TYRP2_HUMAN)
LMPNGTQPQM

SEQ ID NO: 188378 - protein, 10 aa, Artificial Sequence
  Description of Artificial Sequence: Synthetic peptide
  Seed: YSYAIDLPVS (TYRP2_HUMAN)
YLYAIDLPVT

SEQ ID NO: 188379 - protein, 9 aa, Artificial Sequence
  Description of Artificial Sequence: Synthetic peptide
  Seed: SLHNLVHSF (TYRP2_HUMAN)
SYHNLVHSV

SEQ ID NO: 188380 - protein, 9 aa, Artificial Sequence
  Description of Artificial Sequence: Synthetic peptide
  Seed: NMVPFFPPV (TYRP2_HUMAN)
NSVPFFPPY

SEQ ID NO: 188381 - protein, 10 aa, Artificial Sequence
  Description of Artificial Sequence: Synthetic peptide
  Seed: FVLLAFLQYR (TYRP2_HUMAN)
FTLLAFLQYK

SEQ ID NO: 188382 - protein, 10 aa, Artificial Sequence
  Description of Artificial Sequence: Synthetic peptide
  Seed: LHYYSVRDTL (TYRP2_HUMAN)
LCYYSVRDTL

SEQ ID NO: 188383 - protein, 10 aa, Artificial Sequence
  Description of Artificial Sequence: Synthetic peptide
  Seed: REQFLGALDL (TYRP2_HUMAN)
RPQFLGALDY

SEQ ID NO: 188384 - protein, 9 aa, Artificial Sequence
  Description of Artificial Sequence: Synthetic peptide
  Seed: GFDKADGTL (TYRP2_HUMAN)
GADKADGTL

SEQ ID NO: 188385 - protein, 8 aa, Artificial Sequence
  Description of Artificial Sequence: Synthetic peptide
  Seed: HSLSPQER (TYRP2_HUMAN)
HALSPQEL

SEQ ID NO: 188386 - protein, 9 aa, Artificial Sequence
  Description of Artificial Sequence: Synthetic peptide
  Seed: AANDPIFVV (TYRP2_HUMAN)
ALNDPIFVA

SEQ ID NO: 188387 - protein, 9 aa, Artificial Sequence
  Description of Artificial Sequence: Synthetic peptide
  Seed: DDYNHLVTL (TYRP2_HUMAN)
DHYNHLVTV

SEQ ID NO: 188388 - protein, 9 aa, Artificial Sequence
  Description of Artificial Sequence: Synthetic peptide
  Seed: DDYNHLVTL (TYRP2_HUMAN)
DHYNHLVTF

SEQ ID NO: 188389 - protein, 9 aa, Artificial Sequence
  Description of Artificial Sequence: Synthetic peptide
  Seed: GTYEGLLRR (TYRP2_HUMAN)
GLYEGLLRM

SEQ ID NO: 188390 - protein, 10 aa, Artificial Sequence
  Description of Artificial Sequence: Synthetic peptide
  Seed: RMYNMVPFFP (TYRP2_HUMAN)
RTYNMVPFFA

SEQ ID NO: 188391 - protein, 10 aa, Artificial Sequence
  Description of Artificial Sequence: Synthetic peptide
  Seed: KILPGAQGQF (TYRP2_HUMAN)
KALPGAQGQW

SEQ ID NO: 188392 - protein, 10 aa, Artificial Sequence
  Description of Artificial Sequence: Synthetic peptide
  Seed: FFQNSTFSFR (TYRP2_HUMAN)
FYQNSTFSFV

SEQ ID NO: 188393 - protein, 11 aa, Artificial Sequence
  Description of Artificial Sequence: Synthetic peptide
  Seed: QPQFANCSVYD (TYRP2_HUMAN)
QYQFANCSVYF

SEQ ID NO: 188394 - protein, 9 aa, Artificial Sequence
  Description of Artificial Sequence: Synthetic peptide
  Seed: FSHQGPAFV (TYRP2_HUMAN)
FSHQGPAFY

SEQ ID NO: 188395 - protein, 10 aa, Artificial Sequence
  Description of Artificial Sequence: Synthetic peptide
  Seed: FPPVTNEELF (TYRP2_HUMAN)
FVPVTNEELF

SEQ ID NO: 188396 - protein, 9 aa, Artificial Sequence
  Description of Artificial Sequence: Synthetic peptide
  Seed: VMSLHNLVH (TYRP2_HUMAN)
VMSLHNLVL

SEQ ID NO: 188397 - protein, 11 aa, Artificial Sequence
  Description of Artificial Sequence: Synthetic peptide
  Seed: LPVSVEETPGW (TYRP2_HUMAN)
LYVSVEETPGW

SEQ ID NO: 188398 - protein, 10 aa, Artificial Sequence
  Description of Artificial Sequence: Synthetic peptide
  Seed: SHQGPAFVTW (TYRP2_HUMAN)
SFQGPAFVTI

SEQ ID NO: 188399 - protein, 9 aa, Artificial Sequence
  Description of Artificial Sequence: Synthetic peptide
  Seed: VIRQNIHSL (TYRP2_HUMAN)
VPRQNIHSM

SEQ ID NO: 188400 - protein, 9 aa, Artificial Sequence
  Description of Artificial Sequence: Synthetic peptide
  Seed: TLDSQVMSL (TYRP2_HUMAN)
TVDSQVMSF

SEQ ID NO: 188401 - protein, 9 aa, Artificial Sequence
  Description of Artificial Sequence: Synthetic peptide
  Seed: FVWLHYYSV (TYRP2_HUMAN)
FPWLHYYSM

SEQ ID NO: 188402 - protein, 10 aa, Artificial Sequence
  Description of Artificial Sequence: Synthetic peptide
  Seed: HLVTLCNGTY (TYRP2_HUMAN)
HAVTLCNGTY

SEQ ID NO: 188403 - protein, 10 aa, Artificial Sequence
  Description of Artificial Sequence: Synthetic peptide
  Seed: FPPVTNEELF (TYRP2_HUMAN)
FNPVTNEELY

SEQ ID NO: 188404 - protein, 11 aa, Artificial Sequence
  Description of Artificial Sequence: Synthetic peptide
  Seed: FLTSDQLGYSY (TYRP2_HUMAN)
FFTSDQLGYSY

SEQ ID NO: 188405 - protein, 10 aa, Artificial Sequence
  Description of Artificial Sequence: Synthetic peptide
  Seed: SPLWWGFLLS (TYRP2_HUMAN)
SFLWWGFLLV

SEQ ID NO: 188406 - protein, 9 aa, Artificial Sequence
  Description of Artificial Sequence: Synthetic peptide
  Seed: VIRQNIHSL (TYRP2_HUMAN)
VIRQNIHSW

SEQ ID NO: 188407 - protein, 9 aa, Artificial Sequence
  Description of Artificial Sequence: Synthetic peptide
  Seed: YTPLMETHL (TYRP2_HUMAN)
YQPLMETHV

SEQ ID NO: 188408 - protein, 10 aa, Artificial Sequence
  Description of Artificial Sequence: Synthetic peptide
  Seed: SYAIDLPVSV (TYRP2_HUMAN)
SMAIDLPVSM

SEQ ID NO: 188409 - protein, 10 aa, Artificial Sequence
  Description of Artificial Sequence: Synthetic peptide
  Seed: VGLFVLLAFL (TYRP2_HUMAN)
VMLFVLLAFV

SEQ ID NO: 188410 - protein, 10 aa, Artificial Sequence
  Description of Artificial Sequence: Synthetic peptide
  Seed: NSTFSFRNAL (TYRP2_HUMAN)
NGTFSFRNAI

SEQ ID NO: 188411 - protein, 9 aa, Artificial Sequence
  Description of Artificial Sequence: Synthetic peptide
  Seed: SLDDYNHLV (TYRP2_HUMAN)
SVDDYNHLC

SEQ ID NO: 188412 - protein, 9 aa, Artificial Sequence
  Description of Artificial Sequence: Synthetic peptide
  Seed: TLVALVGLF (TYRP2_HUMAN)
TMVALVGLF

SEQ ID NO: 188413 - protein, 9 aa, Artificial Sequence
  Description of Artificial Sequence: Synthetic peptide
  Seed: GTYEGLLRR (TYRP2_HUMAN)
GWYEGLLRR

SEQ ID NO: 188414 - protein, 9 aa, Artificial Sequence
  Description of Artificial Sequence: Synthetic peptide
  Seed: ESANVCGSQ (TYRP2_HUMAN)
ELANVCGSR

SEQ ID NO: 188415 - protein, 10 aa, Artificial Sequence
  Description of Artificial Sequence: Synthetic peptide
  Seed: AFVTWHRYHL (TYRP2_HUMAN)
AYVTWHRYHM

SEQ ID NO: 188416 - protein, 9 aa, Artificial Sequence
  Description of Artificial Sequence: Synthetic peptide
  Seed: IDFSHQGPA (TYRP2_HUMAN)
IEFSHQGPI

SEQ ID NO: 188417 - protein, 9 aa, Artificial Sequence
  Description of Artificial Sequence: Synthetic peptide
  Seed: DFSHQGPAF (TYRP2_HUMAN)
DLSHQGPAY

SEQ ID NO: 188418 - protein, 9 aa, Artificial Sequence
  Description of Artificial Sequence: Synthetic peptide
  Seed: FQNSTFSFR (TYRP2_HUMAN)
FWNSTFSFK

SEQ ID NO: 188419 - protein, 9 aa, Artificial Sequence
  Description of Artificial Sequence: Synthetic peptide
  Seed: PADAWPQEL (TYRP2_HUMAN)
PIDAWPQEL

SEQ ID NO: 188420 - protein, 9 aa, Artificial Sequence
  Description of Artificial Sequence: Synthetic peptide
  Seed: YSVRDTLLG (TYRP2_HUMAN)
YTVRDTLLY

SEQ ID NO: 188421 - protein, 9 aa, Artificial Sequence
  Description of Artificial Sequence: Synthetic peptide
  Seed: VMSLHNLVH (TYRP2_HUMAN)
VHSLHNLVF

SEQ ID NO: 188422 - protein, 9 aa, Artificial Sequence
  Description of Artificial Sequence: Synthetic peptide
  Seed: GTYEGLLRR (TYRP2_HUMAN)
GNYEGLLRY

SEQ ID NO: 188423 - protein, 11 aa, Artificial Sequence
  Description of Artificial Sequence: Synthetic peptide
  Seed: VCMTVDSLVNK (TYRP2_HUMAN)
VSMTVDSLVNK

SEQ ID NO: 188424 - protein, 9 aa, Artificial Sequence
  Description of Artificial Sequence: Synthetic peptide
  Seed: FANCSVYDF (TYRP2_HUMAN)
FFNCSVYDL

SEQ ID NO: 188425 - protein, 9 aa, Artificial Sequence
  Description of Artificial Sequence: Synthetic peptide
  Seed: FSHQGPAFV (TYRP2_HUMAN)
FFHQGPAFM

SEQ ID NO: 188426 - protein, 10 aa, Artificial Sequence
  Description of Artificial Sequence: Synthetic peptide
  Seed: FFVWLHYYSV (TYRP2_HUMAN)
FQVWLHYYSI

SEQ ID NO: 188427 - protein, 9 aa, Artificial Sequence
  Description of Artificial Sequence: Synthetic peptide
  Seed: RAIDFSHQG (TYRP2_HUMAN)
RAIDFSHQL

SEQ ID NO: 188428 - protein, 9 aa, Artificial Sequence
  Description of Artificial Sequence: Synthetic peptide
  Seed: NRMYNMVPF (TYRP2_HUMAN)
NKMYNMVPM

SEQ ID NO: 188429 - protein, 10 aa, Artificial Sequence
  Description of Artificial Sequence: Synthetic peptide
  Seed: DAWPQELAPI (TYRP2_HUMAN)
DVWPQELAPV

SEQ ID NO: 188430 - protein, 9 aa, Artificial Sequence
  Description of Artificial Sequence: Synthetic peptide
  Seed: DSLDDYNHL (TYRP2_HUMAN)
DVLDDYNHY

SEQ ID NO: 188431 - protein, 11 aa, Artificial Sequence
  Description of Artificial Sequence: Synthetic peptide
  Seed: HPDYVITTQHW (TYRP2_HUMAN)
HKDYVITTQHF

SEQ ID NO: 188432 - protein, 10 aa, Artificial Sequence
  Description of Artificial Sequence: Synthetic peptide
  Seed: FLTSDQLGYS (TYRP2_HUMAN)
FQTSDQLGYL

SEQ ID NO: 188433 - protein, 9 aa, Artificial Sequence
  Description of Artificial Sequence: Synthetic peptide
  Seed: ISRNSRFSS (TYRP2_HUMAN)
IMRNSRFSL

SEQ ID NO: 188434 - protein, 9 aa, Artificial Sequence
  Description of Artificial Sequence: Synthetic peptide
  Seed: RMYNMVPFF (TYRP2_HUMAN)
RLYNMVPFH

SEQ ID NO: 188435 - protein, 10 aa, Artificial Sequence
  Description of Artificial Sequence: Synthetic peptide
  Seed: IDFSHQGPAF (TYRP2_HUMAN)
IEFSHQGPAV

SEQ ID NO: 188436 - protein, 10 aa, Artificial Sequence
  Description of Artificial Sequence: Synthetic peptide
  Seed: DIRDCLSLQK (TYRP2_HUMAN)
DFRDCLSLQR

SEQ ID NO: 188437 - protein, 9 aa, Artificial Sequence
  Description of Artificial Sequence: Synthetic peptide
  Seed: VVMGTLVAL (TYRP2_HUMAN)
VFMGTLVAI

SEQ ID NO: 188438 - protein, 10 aa, Artificial Sequence
  Description of Artificial Sequence: Synthetic peptide
  Seed: FTDAIFDEWM (TYRP2_HUMAN)
FQDAIFDEWV

SEQ ID NO: 188439 - protein, 10 aa, Artificial Sequence
  Description of Artificial Sequence: Synthetic peptide
  Seed: MGTLVALVGL (TYRP2_HUMAN)
MTTLVALVGL

SEQ ID NO: 188440 - protein, 8 aa, Artificial Sequence
  Description of Artificial Sequence: Synthetic peptide
  Seed: QFANCSVY (TYRP2_HUMAN)
QMANCSVF

SEQ ID NO: 188441 - protein, 9 aa, Artificial Sequence
  Description of Artificial Sequence: Synthetic peptide
  Seed: DDRELWPRK (TYRP2_HUMAN)
DARELWPRK

SEQ ID NO: 188442 - protein, 10 aa, Artificial Sequence
  Description of Artificial Sequence: Synthetic peptide
  Seed: HRYHLLCLER (TYRP2_HUMAN)
HFYHLLCLEK

SEQ ID NO: 188443 - protein, 10 aa, Artificial Sequence
  Description of Artificial Sequence: Synthetic peptide
  Seed: VVMGTLVALV (TYRP2_HUMAN)
VLMGTLVALH

SEQ ID NO: 188444 - protein, 9 aa, Artificial Sequence
  Description of Artificial Sequence: Synthetic peptide
  Seed: GTLVALVGL (TYRP2_HUMAN)
GMLVALVGI

SEQ ID NO: 188445 - protein, 10 aa, Artificial Sequence
  Description of Artificial Sequence: Synthetic peptide
  Seed: NGTYEGLLRR (TYRP2_HUMAN)
NWTYEGLLRK

SEQ ID NO: 188446 - protein, 9 aa, Artificial Sequence
  Description of Artificial Sequence: Synthetic peptide
  Seed: SHQGPAFVT (TYRP2_HUMAN)
SHQGPAFVI

SEQ ID NO: 188447 - protein, 9 aa, Artificial Sequence
  Description of Artificial Sequence: Synthetic peptide
  Seed: MTVDSLVNK (TYRP2_HUMAN)
MTVDSLVNY

SEQ ID NO: 188448 - protein, 8 aa, Artificial Sequence
  Description of Artificial Sequence: Synthetic peptide
  Seed: QKFDNPPF (TYRP2_HUMAN)
QQFDNPPY

SEQ ID NO: 188449 - protein, 10 aa, Artificial Sequence
  Description of Artificial Sequence: Synthetic peptide
  Seed: RMYNMVPFFP (TYRP2_HUMAN)
RQYNMVPFFV

SEQ ID NO: 188450 - protein, 9 aa, Artificial Sequence
  Description of Artificial Sequence: Synthetic peptide
  Seed: RQNIHSLSP (TYRP2_HUMAN)
RSNIHSLSY

SEQ ID NO: 188451 - protein, 9 aa, Artificial Sequence
  Description of Artificial Sequence: Synthetic peptide
  Seed: ANDPIFVVL (TYRP2_HUMAN)
AVDPIFVVL

SEQ ID NO: 188452 - protein, 10 aa, Artificial Sequence
  Description of Artificial Sequence: Synthetic peptide
  Seed: FFQNSTFSFR (TYRP2_HUMAN)
FFQNSTFSFW

SEQ ID NO: 188453 - protein, 9 aa, Artificial Sequence
  Description of Artificial Sequence: Synthetic peptide
  Seed: QVMSLHNLV (TYRP2_HUMAN)
QIMSLHNLR

SEQ ID NO: 188454 - protein, 8 aa, Artificial Sequence
  Description of Artificial Sequence: Synthetic peptide
  Seed: AIDLPVSV (TYRP2_HUMAN)
AIDLPVSM

SEQ ID NO: 188455 - protein, 9 aa, Artificial Sequence
  Description of Artificial Sequence: Synthetic peptide
  Seed: TLLGPGRPY (TYRP2_HUMAN)
TALGPGRPH

SEQ ID NO: 188456 - protein, 9 aa, Artificial Sequence
  Description of Artificial Sequence: Synthetic peptide
  Seed: FPPVTNEEL (TYRP2_HUMAN)
FRPVTNEEL

SEQ ID NO: 188457 - protein, 11 aa, Artificial Sequence
  Description of Artificial Sequence: Synthetic peptide
  Seed: RRLRKGYTPLM (TYRP2_HUMAN)
RRLRKGYTPLV

SEQ ID NO: 188458 - protein, 9 aa, Artificial Sequence
  Description of Artificial Sequence: Synthetic peptide
  Seed: TLLVVMGTL (TYRP2_HUMAN)
TMLVVMGTY

SEQ ID NO: 188459 - protein, 9 aa, Artificial Sequence
  Description of Artificial Sequence: Synthetic peptide
  Seed: ALVGLFVLL (TYRP2_HUMAN)
ATVGLFVLK

SEQ ID NO: 188460 - protein, 9 aa, Artificial Sequence
  Description of Artificial Sequence: Synthetic peptide
  Seed: ISRNSRFSS (TYRP2_HUMAN)
IVRNSRFSI

SEQ ID NO: 188461 - protein, 9 aa, Artificial Sequence
  Description of Artificial Sequence: Synthetic peptide
  Seed: ANDPIFVVL (TYRP2_HUMAN)
ALDPIFVVW

SEQ ID NO: 188462 - protein, 11 aa, Artificial Sequence
  Description of Artificial Sequence: Synthetic peptide
  Seed: FVVLHSFTDAI (TYRP2_HUMAN)
FPVLHSFTDAV

SEQ ID NO: 188463 - protein, 9 aa, Artificial Sequence
  Description of Artificial Sequence: Synthetic peptide
  Seed: LSPQEREQF (TYRP2_HUMAN)
LLPQEREQM

SEQ ID NO: 188464 - protein, 10 aa, Artificial Sequence
  Description of Artificial Sequence: Synthetic peptide
  Seed: HSFLNGTNAL (TYRP2_HUMAN)
HPFLNGTNAY

SEQ ID NO: 188465 - protein, 10 aa, Artificial Sequence
  Description of Artificial Sequence: Synthetic peptide
  Seed: HNRMYNMVPF (TYRP2_HUMAN)
HIRMYNMVPL

SEQ ID NO: 188466 - protein, 9 aa, Artificial Sequence
  Description of Artificial Sequence: Synthetic peptide
  Seed: RMYNMVPFF (TYRP2_HUMAN)
RFYNMVPFK

SEQ ID NO: 188467 - protein, 8 aa, Artificial Sequence
  Description of Artificial Sequence: Synthetic peptide
  Seed: RPWSGPYI (TYRP2_HUMAN)
RPWSGPYL

SEQ ID NO: 188468 - protein, 10 aa, Artificial Sequence
  Description of Artificial Sequence: Synthetic peptide
  Seed: RLRKGYTPLM (TYRP2_HUMAN)
RTRKGYTPLR

SEQ ID NO: 188469 - protein, 10 aa, Artificial Sequence
  Description of Artificial Sequence: Synthetic peptide
  Seed: QELAPIGHNR (TYRP2_HUMAN)
QMLAPIGHNR

SEQ ID NO: 188470 - protein, 10 aa, Artificial Sequence
  Description of Artificial Sequence: Synthetic peptide
  Seed: LTSDQLGYSY (TYRP2_HUMAN)
LNSDQLGYSY

SEQ ID NO: 188471 - protein, 10 aa, Artificial Sequence
  Description of Artificial Sequence: Synthetic peptide
  Seed: REQFLGALDL (TYRP2_HUMAN)
RFQFLGALDM

SEQ ID NO: 188472 - protein, 10 aa, Artificial Sequence
  Description of Artificial Sequence: Synthetic peptide
  Seed: TVDSLVNKEC (TYRP2_HUMAN)
TADSLVNKEL

SEQ ID NO: 188473 - protein, 9 aa, Artificial Sequence
  Description of Artificial Sequence: Synthetic peptide
  Seed: STFSFRNAL (TYRP2_HUMAN)
STFSFRNAF

SEQ ID NO: 188474 - protein, 10 aa, Artificial Sequence
  Description of Artificial Sequence: Synthetic peptide
  Seed: KILPGAQGQF (TYRP2_HUMAN)
KSLPGAQGQM

SEQ ID NO: 188475 - protein, 10 aa, Artificial Sequence
  Description of Artificial Sequence: Synthetic peptide
  Seed: GTLDSQVMSL (TYRP2_HUMAN)
GHLDSQVMSV

SEQ ID NO: 188476 - protein, 10 aa, Artificial Sequence
  Description of Artificial Sequence: Synthetic peptide
  Seed: YHLLCLERDL (TYRP2_HUMAN)
YMLLCLERDL

SEQ ID NO: 188477 - protein, 9 aa, Artificial Sequence
  Description of Artificial Sequence: Synthetic peptide
  Seed: ITTQHWLGL (TYRP2_HUMAN)
ISTQHWLGY

SEQ ID NO: 188478 - protein, 10 aa, Artificial Sequence
  Description of Artificial Sequence: Synthetic peptide
  Seed: LAFLQYRRLR (TYRP2_HUMAN)
LTFLQYRRLR

SEQ ID NO: 188479 - protein, 9 aa, Artificial Sequence
  Description of Artificial Sequence: Synthetic peptide
  Seed: RPWSGPYIL (TYRP2_HUMAN)
RSWSGPYII

SEQ ID NO: 188480 - protein, 9 aa, Artificial Sequence
  Description of Artificial Sequence: Synthetic peptide
  Seed: TLVALVGLF (TYRP2_HUMAN)
TVVALVGLY

SEQ ID NO: 188481 - protein, 9 aa, Artificial Sequence
  Description of Artificial Sequence: Synthetic peptide
  Seed: VVMGTLVAL (TYRP2_HUMAN)
VQMGTLVAR

SEQ ID NO: 188482 - protein, 9 aa, Artificial Sequence
  Description of Artificial Sequence: Synthetic peptide
  Seed: GTYEGLLRR (TYRP2_HUMAN)
GMYEGLLRL

SEQ ID NO: 188483 - protein, 9 aa, Artificial Sequence
  Description of Artificial Sequence: Synthetic peptide
  Seed: LLAFLQYRR (TYRP2_HUMAN)
LWAFLQYRR

SEQ ID NO: 188484 - protein, 10 aa, Artificial Sequence
  Description of Artificial Sequence: Synthetic peptide
  Seed: FANCSVYDFF (TYRP2_HUMAN)
FSNCSVYDFW

SEQ ID NO: 188485 - protein, 11 aa, Artificial Sequence
  Description of Artificial Sequence: Synthetic peptide
  Seed: FFPPVTNEELF (TYRP2_HUMAN)
FCPPVTNEELY

SEQ ID NO: 188486 - protein, 9 aa, Artificial Sequence
  Description of Artificial Sequence: Synthetic peptide
  Seed: YYSVRDTLL (TYRP2_HUMAN)
YYSVRDTLY

SEQ ID NO: 188487 - protein, 9 aa, Artificial Sequence
  Description of Artificial Sequence: Synthetic peptide
  Seed: APIGHNRMY (TYRP2_HUMAN)
AMIGHNRMF

SEQ ID NO: 188488 - protein, 11 aa, Artificial Sequence
  Description of Artificial Sequence: Synthetic peptide
  Seed: FFPPVTNEELF (TYRP2_HUMAN)
FNPPVTNEELY

SEQ ID NO: 188489 - protein, 9 aa, Artificial Sequence
  Description of Artificial Sequence: Synthetic peptide
  Seed: FVLLAFLQY (TYRP2_HUMAN)
FILLAFLQY

SEQ ID NO: 188490 - protein, 9 aa, Artificial Sequence
  Description of Artificial Sequence: Synthetic peptide
  Seed: RDCLSLQKF (TYRP2_HUMAN)
RICLSLQKL

SEQ ID NO: 188491 - protein, 11 aa, Artificial Sequence
  Description of Artificial Sequence: Synthetic peptide
  Seed: RADTRPWSGPY (TYRP2_HUMAN)
RGDTRPWSGPF

SEQ ID NO: 188492 - protein, 9 aa, Artificial Sequence
  Description of Artificial Sequence: Synthetic peptide
  Seed: FVLLAFLQY (TYRP2_HUMAN)
FALLAFLQM

SEQ ID NO: 188493 - protein, 9 aa, Artificial Sequence
  Description of Artificial Sequence: Synthetic peptide
  Seed: TLVALVGLF (TYRP2_HUMAN)
TKVALVGLY

SEQ ID NO: 188494 - protein, 10 aa, Artificial Sequence
  Description of Artificial Sequence: Synthetic peptide
  Seed: VVLHSFTDAI (TYRP2_HUMAN)
VYLHSFTDAI

SEQ ID NO: 188495 - protein, 11 aa, Artificial Sequence
  Description of Artificial Sequence: Synthetic peptide
  Seed: VCMTVDSLVNK (TYRP2_HUMAN)
VTMTVDSLVNK

SEQ ID NO: 188496 - protein, 9 aa, Artificial Sequence
  Description of Artificial Sequence: Synthetic peptide
  Seed: RKFFHRTCK (TYRP2_HUMAN)
RFFFHRTCM

SEQ ID NO: 188497 - protein, 9 aa, Artificial Sequence
  Description of Artificial Sequence: Synthetic peptide
  Seed: TLISRNSRF (TYRP2_HUMAN)
TYISRNSRL

SEQ ID NO: 188498 - protein, 9 aa, Artificial Sequence
  Description of Artificial Sequence: Synthetic peptide
  Seed: RVCMTVDSL (TYRP2_HUMAN)
RVCMTVDSW

SEQ ID NO: 188499 - protein, 9 aa, Artificial Sequence
  Description of Artificial Sequence: Synthetic peptide
  Seed: SVYDFFVWL (TYRP2_HUMAN)
SMYDFFVWS

SEQ ID NO: 188500 - protein, 10 aa, Artificial Sequence
  Description of Artificial Sequence: Synthetic peptide
  Seed: FTDAIFDEWM (TYRP2_HUMAN)
FVDAIFDEWY

SEQ ID NO: 188501 - protein, 10 aa, Artificial Sequence
  Description of Artificial Sequence: Synthetic peptide
  Seed: HSFLNGTNAL (TYRP2_HUMAN)
HHFLNGTNAM

SEQ ID NO: 188502 - protein, 10 aa, Artificial Sequence
  Description of Artificial Sequence: Synthetic peptide
  Seed: GNESFALPYW (TYRP2_HUMAN)
GGESFALPYW

SEQ ID NO: 188503 - protein, 10 aa, Artificial Sequence
  Description of Artificial Sequence: Synthetic peptide
  Seed: RMYNMVPFFP (TYRP2_HUMAN)
RKYNMVPFFY

SEQ ID NO: 188504 - protein, 9 aa, Artificial Sequence
  Description of Artificial Sequence: Synthetic peptide
  Seed: GLFVLLAFL (TYRP2_HUMAN)
GIFVLLAFL

SEQ ID NO: 188505 - protein, 9 aa, Artificial Sequence
  Description of Artificial Sequence: Synthetic peptide
  Seed: FVWLHYYSV (TYRP2_HUMAN)
FMWLHYYSV

SEQ ID NO: 188506 - protein, 10 aa, Artificial Sequence
  Description of Artificial Sequence: Synthetic peptide
  Seed: LISRNSRFSS (TYRP2_HUMAN)
LRSRNSRFSV

SEQ ID NO: 188507 - protein, 9 aa, Artificial Sequence
  Description of Artificial Sequence: Synthetic peptide
  Seed: QFPRVCMTV (TYRP2_HUMAN)
QWPRVCMTW

SEQ ID NO: 188508 - protein, 10 aa, Artificial Sequence
  Description of Artificial Sequence: Synthetic peptide
  Seed: RNSMKLPTLK (TYRP2_HUMAN)
RKSMKLPTLK

SEQ ID NO: 188509 - protein, 11 aa, Artificial Sequence
  Description of Artificial Sequence: Synthetic peptide
  Seed: RELWPRKFFHR (TYRP2_HUMAN)
RVLWPRKFFHR

SEQ ID NO: 188510 - protein, 10 aa, Artificial Sequence
  Description of Artificial Sequence: Synthetic peptide
  Seed: EETPGWPTTL (TYRP2_HUMAN)
EETPGWPTTY

SEQ ID NO: 188511 - protein, 9 aa, Artificial Sequence
  Description of Artificial Sequence: Synthetic peptide
  Seed: GFDKADGTL (TYRP2_HUMAN)
GYDKADGTF

SEQ ID NO: 188512 - protein, 9 aa, Artificial Sequence
  Description of Artificial Sequence: Synthetic peptide
  Seed: SVYDFFVWL (TYRP2_HUMAN)
SFYDFFVWV

SEQ ID NO: 188513 - protein, 9 aa, Artificial Sequence
  Description of Artificial Sequence: Synthetic peptide
  Seed: ALPYWNFAT (TYRP2_HUMAN)
AQPYWNFAI

SEQ ID NO: 188514 - protein, 10 aa, Artificial Sequence
  Description of Artificial Sequence: Synthetic peptide
  Seed: MSPLWWGFLL (TYRP2_HUMAN)
MFPLWWGFLY

SEQ ID NO: 188515 - protein, 9 aa, Artificial Sequence
  Description of Artificial Sequence: Synthetic peptide
  Seed: VPFFPPVTN (TYRP2_HUMAN)
VPFFPPVTC

SEQ ID NO: 188516 - protein, 11 aa, Artificial Sequence
  Description of Artificial Sequence: Synthetic peptide
  Seed: PPFFQNSTFSF (TYRP2_HUMAN)
PKFFQNSTFSF

SEQ ID NO: 188517 - protein, 10 aa, Artificial Sequence
  Description of Artificial Sequence: Synthetic peptide
  Seed: YDFFVWLHYY (TYRP2_HUMAN)
YRFFVWLHYY

SEQ ID NO: 188518 - protein, 9 aa, Artificial Sequence
  Description of Artificial Sequence: Synthetic peptide
  Seed: YDFFVWLHY (TYRP2_HUMAN)
YQFFVWLHF

SEQ ID NO: 188519 - protein, 9 aa, Artificial Sequence
  Description of Artificial Sequence: Synthetic peptide
  Seed: RLRKGYTPL (TYRP2_HUMAN)
RVRKGYTPI

SEQ ID NO: 188520 - protein, 9 aa, Artificial Sequence
  Description of Artificial Sequence: Synthetic peptide
  Seed: FPPVTNEEL (TYRP2_HUMAN)
FFPVTNEEF

SEQ ID NO: 188521 - protein, 10 aa, Artificial Sequence
  Description of Artificial Sequence: Synthetic peptide
  Seed: YAIDLPVSVE (TYRP2_HUMAN)
YQIDLPVSVM

SEQ ID NO: 188522 - protein, 11 aa, Artificial Sequence
  Description of Artificial Sequence: Synthetic peptide
  Seed: YTPLMETHLSS (TYRP2_HUMAN)
YFPLMETHLSM

SEQ ID NO: 188523 - protein, 10 aa, Artificial Sequence
  Description of Artificial Sequence: Synthetic peptide
  Seed: VLLAFLQYRR (TYRP2_HUMAN)
VTLAFLQYRK

SEQ ID NO: 188524 - protein, 9 aa, Artificial Sequence
  Description of Artificial Sequence: Synthetic peptide
  Seed: SLDDYNHLV (TYRP2_HUMAN)
SLDDYNHLC

SEQ ID NO: 188525 - protein, 11 aa, Artificial Sequence
  Description of Artificial Sequence: Synthetic peptide
  Seed: YTPLMETHLSS (TYRP2_HUMAN)
YAPLMETHLSV

SEQ ID NO: 188526 - protein, 9 aa, Artificial Sequence
  Description of Artificial Sequence: Synthetic peptide
  Seed: YSYAIDLPV (TYRP2_HUMAN)
YQYAIDLPW

SEQ ID NO: 188527 - protein, 10 aa, Artificial Sequence
  Description of Artificial Sequence: Synthetic peptide
  Seed: FFPPVTNEEL (TYRP2_HUMAN)
FYPPVTNEEW

SEQ ID NO: 188528 - protein, 9 aa, Artificial Sequence
  Description of Artificial Sequence: Synthetic peptide
  Seed: RLRKGYTPL (TYRP2_HUMAN)
RSRKGYTPE

SEQ ID NO: 188529 - protein, 9 aa, Artificial Sequence
  Description of Artificial Sequence: Synthetic peptide
  Seed: ESANVCGSQ (TYRP2_HUMAN)
ELANVCGSK

SEQ ID NO: 188530 - protein, 9 aa, Artificial Sequence
  Description of Artificial Sequence: Synthetic peptide
  Seed: GFDKADGTL (TYRP2_HUMAN)
GIDKADGTL

SEQ ID NO: 188531 - protein, 10 aa, Artificial Sequence
  Description of Artificial Sequence: Synthetic peptide
  Seed: LVVMGTLVAL (TYRP2_HUMAN)
LHVMGTLVAV

SEQ ID NO: 188532 - protein, 8 aa, Artificial Sequence
  Description of Artificial Sequence: Synthetic peptide
  Seed: SLDDYNHL (TYRP2_HUMAN)
SADDYNHM

SEQ ID NO: 188533 - protein, 9 aa, Artificial Sequence
  Description of Artificial Sequence: Synthetic peptide
  Seed: VHPDYVITT (TYRP2_HUMAN)
VHPDYVITI

SEQ ID NO: 188534 - protein, 11 aa, Artificial Sequence
  Description of Artificial Sequence: Synthetic peptide
  Seed: MYNMVPFFPPV (TYRP2_HUMAN)
MSNMVPFFPPI

SEQ ID NO: 188535 - protein, 9 aa, Artificial Sequence
  Description of Artificial Sequence: Synthetic peptide
  Seed: HQGPAFVTW (TYRP2_HUMAN)
HQGPAFVTI

SEQ ID NO: 188536 - protein, 10 aa, Artificial Sequence
  Description of Artificial Sequence: Synthetic peptide
  Seed: YNMVPFFPPV (TYRP2_HUMAN)
YHMVPFFPPL

SEQ ID NO: 188537 - protein, 9 aa, Artificial Sequence
  Description of Artificial Sequence: Synthetic peptide
  Seed: AIFDEWMKR (TYRP2_HUMAN)
ALFDEWMKK

SEQ ID NO: 188538 - protein, 10 aa, Artificial Sequence
  Description of Artificial Sequence: Synthetic peptide
  Seed: FLLSCLGCKI (TYRP2_HUMAN)
FLLSCLGCKA

SEQ ID NO: 188539 - protein, 11 aa, Artificial Sequence
  Description of Artificial Sequence: Synthetic peptide
  Seed: RADTRPWSGPY (TYRP2_HUMAN)
RADTRPWSGPW

SEQ ID NO: 188540 - protein, 10 aa, Artificial Sequence
  Description of Artificial Sequence: Synthetic peptide
  Seed: SPLWWGFLLS (TYRP2_HUMAN)
SWLWWGFLLI

SEQ ID NO: 188541 - protein, 9 aa, Artificial Sequence
  Description of Artificial Sequence: Synthetic peptide
  Seed: RPWSGPYIL (TYRP2_HUMAN)
RSWSGPYIL

SEQ ID NO: 188542 - protein, 10 aa, Artificial Sequence
  Description of Artificial Sequence: Synthetic peptide
  Seed: FSFRNALEGF (TYRP2_HUMAN)
FKFRNALEGM

SEQ ID NO: 188543 - protein, 10 aa, Artificial Sequence
  Description of Artificial Sequence: Synthetic peptide
  Seed: MSPLWWGFLL (TYRP2_HUMAN)
MPPLWWGFLY

SEQ ID NO: 188544 - protein, 10 aa, Artificial Sequence
  Description of Artificial Sequence: Synthetic peptide
  Seed: RRLRKGYTPL (TYRP2_HUMAN)
RSLRKGYTPL

SEQ ID NO: 188545 - protein, 9 aa, Artificial Sequence
  Description of Artificial Sequence: Synthetic peptide
  Seed: GTYEGLLRR (TYRP2_HUMAN)
GMYEGLLRF

SEQ ID NO: 188546 - protein, 10 aa, Artificial Sequence
  Description of Artificial Sequence: Synthetic peptide
  Seed: MSPLWWGFLL (TYRP2_HUMAN)
MLPLWWGFLT

SEQ ID NO: 188547 - protein, 9 aa, Artificial Sequence
  Description of Artificial Sequence: Synthetic peptide
  Seed: TSDQLGYSY (TYRP2_HUMAN)
TFDQLGYSV

SEQ ID NO: 188548 - protein, 11 aa, Artificial Sequence
  Description of Artificial Sequence: Synthetic peptide
  Seed: MSLHNLVHSFL (TYRP2_HUMAN)
MGLHNLVHSFW

SEQ ID NO: 188549 - protein, 10 aa, Artificial Sequence
  Description of Artificial Sequence: Synthetic peptide
  Seed: SVYDFFVWLH (TYRP2_HUMAN)
SLYDFFVWLR

SEQ ID NO: 188550 - protein, 9 aa, Artificial Sequence
  Description of Artificial Sequence: Synthetic peptide
  Seed: SLDDYNHLV (TYRP2_HUMAN)
SLDDYNHLT

SEQ ID NO: 188551 - protein, 11 aa, Artificial Sequence
  Description of Artificial Sequence: Synthetic peptide
  Seed: HQGPAFVTWHR (TYRP2_HUMAN)
HSGPAFVTWHR

SEQ ID NO: 188552 - protein, 9 aa, Artificial Sequence
  Description of Artificial Sequence: Synthetic peptide
  Seed: ELWPRKFFH (TYRP2_HUMAN)
EMWPRKFFK

SEQ ID NO: 188553 - protein, 9 aa, Artificial Sequence
  Description of Artificial Sequence: Synthetic peptide
  Seed: RQNIHSLSP (TYRP2_HUMAN)
RENIHSLSF

SEQ ID NO: 188554 - protein, 9 aa, Artificial Sequence
  Description of Artificial Sequence: Synthetic peptide
  Seed: FFPPVTNEE (TYRP2_HUMAN)
FWPPVTNEM

SEQ ID NO: 188555 - protein, 11 aa, Artificial Sequence
  Description of Artificial Sequence: Synthetic peptide
  Seed: RRNQMGRNSMK (TYRP2_HUMAN)
RLNQMGRNSMK

SEQ ID NO: 188556 - protein, 9 aa, Artificial Sequence
  Description of Artificial Sequence: Synthetic peptide
  Seed: IFDEWMKRF (TYRP2_HUMAN)
IVDEWMKRW

SEQ ID NO: 188557 - protein, 9 aa, Artificial Sequence
  Description of Artificial Sequence: Synthetic peptide
  Seed: FVWLHYYSV (TYRP2_HUMAN)
FAWLHYYSV

SEQ ID NO: 188558 - protein, 10 aa, Artificial Sequence
  Description of Artificial Sequence: Synthetic peptide
  Seed: RELWPRKFFH (TYRP2_HUMAN)
RTLWPRKFFK

SEQ ID NO: 188559 - protein, 9 aa, Artificial Sequence
  Description of Artificial Sequence: Synthetic peptide
  Seed: FFPPVTNEE (TYRP2_HUMAN)
FLPPVTNEL

SEQ ID NO: 188560 - protein, 10 aa, Artificial Sequence
  Description of Artificial Sequence: Synthetic peptide
  Seed: LLVVMGTLVA (TYRP2_HUMAN)
LMVVMGTLVV

SEQ ID NO: 188561 - protein, 9 aa, Artificial Sequence
  Description of Artificial Sequence: Synthetic peptide
  Seed: IFDEWMKRF (TYRP2_HUMAN)
IGDEWMKRV

SEQ ID NO: 188562 - protein, 9 aa, Artificial Sequence
  Description of Artificial Sequence: Synthetic peptide
  Seed: SLDDYNHLV (TYRP2_HUMAN)
SIDDYNHLL

SEQ ID NO: 188563 - protein, 9 aa, Artificial Sequence
  Description of Artificial Sequence: Synthetic peptide
  Seed: YDFFVWLHY (TYRP2_HUMAN)
YWFFVWLHY

SEQ ID NO: 188564 - protein, 11 aa, Artificial Sequence
  Description of Artificial Sequence: Synthetic peptide
  Seed: TQPQFANCSVY (TYRP2_HUMAN)
TAPQFANCSVY

SEQ ID NO: 188565 - protein, 9 aa, Artificial Sequence
  Description of Artificial Sequence: Synthetic peptide
  Seed: FLTSDQLGY (TYRP2_HUMAN)
FQTSDQLGF

SEQ ID NO: 188566 - protein, 9 aa, Artificial Sequence
  Description of Artificial Sequence: Synthetic peptide
  Seed: SLDDYNHLV (TYRP2_HUMAN)
SADDYNHLI

SEQ ID NO: 188567 - protein, 9 aa, Artificial Sequence
  Description of Artificial Sequence: Synthetic peptide
  Seed: DFFVWLHYY (TYRP2_HUMAN)
DTFVWLHYY

SEQ ID NO: 188568 - protein, 9 aa, Artificial Sequence
  Description of Artificial Sequence: Synthetic peptide
  Seed: RTCKCTGNF (TYRP2_HUMAN)
RVCKCTGNY

SEQ ID NO: 188569 - protein, 10 aa, Artificial Sequence
  Description of Artificial Sequence: Synthetic peptide
  Seed: KILPGAQGQF (TYRP2_HUMAN)
KFLPGAQGQF

SEQ ID NO: 188570 - protein, 10 aa, Artificial Sequence
  Description of Artificial Sequence: Synthetic peptide
  Seed: REQFLGALDL (TYRP2_HUMAN)
RIQFLGALDF

SEQ ID NO: 188571 - protein, 8 aa, Artificial Sequence
  Description of Artificial Sequence: Synthetic peptide
  Seed: LDDYNHLV (TYRP2_HUMAN)
LGDYNHLL

SEQ ID NO: 188572 - protein, 9 aa, Artificial Sequence
  Description of Artificial Sequence: Synthetic peptide
  Seed: RQNIHSLSP (TYRP2_HUMAN)
RSNIHSLSM

SEQ ID NO: 188573 - protein, 9 aa, Artificial Sequence
  Description of Artificial Sequence: Synthetic peptide
  Seed: AARPDDPTL (TYRP2_HUMAN)
AVRPDDPTK

SEQ ID NO: 188574 - protein, 9 aa, Artificial Sequence
  Description of Artificial Sequence: Synthetic peptide
  Seed: HQGPAFVTW (TYRP2_HUMAN)
HIGPAFVTV

SEQ ID NO: 188575 - protein, 9 aa, Artificial Sequence
  Description of Artificial Sequence: Synthetic peptide
  Seed: AFLQYRRLR (TYRP2_HUMAN)
AWLQYRRLR

SEQ ID NO: 188576 - protein, 10 aa, Artificial Sequence
  Description of Artificial Sequence: Synthetic peptide
  Seed: DSLDDYNHLV (TYRP2_HUMAN)
DALDDYNHLV

SEQ ID NO: 188577 - protein, 9 aa, Artificial Sequence
  Description of Artificial Sequence: Synthetic peptide
  Seed: DQLGYSYAI (TYRP2_HUMAN)
DLLGYSYAL

SEQ ID NO: 188578 - protein, 9 aa, Artificial Sequence
  Description of Artificial Sequence: Synthetic peptide
  Seed: AIFDEWMKR (TYRP2_HUMAN)
ASFDEWMKL

SEQ ID NO: 188579 - protein, 10 aa, Artificial Sequence
  Description of Artificial Sequence: Synthetic peptide
  Seed: ELWPRKFFHR (TYRP2_HUMAN)
ETWPRKFFHR

SEQ ID NO: 188580 - protein, 9 aa, Artificial Sequence
  Description of Artificial Sequence: Synthetic peptide
  Seed: TLLGPGRPY (TYRP2_HUMAN)
TTLGPGRPF

SEQ ID NO: 188581 - protein, 9 aa, Artificial Sequence
  Description of Artificial Sequence: Synthetic peptide
  Seed: ILPGAQGQF (TYRP2_HUMAN)
IAPGAQGQF

SEQ ID NO: 188582 - protein, 9 aa, Artificial Sequence
  Description of Artificial Sequence: Synthetic peptide
  Seed: NRMYNMVPF (TYRP2_HUMAN)
NRMYNMVPI

SEQ ID NO: 188583 - protein, 9 aa, Artificial Sequence
  Description of Artificial Sequence: Synthetic peptide
  Seed: LQKFDNPPF (TYRP2_HUMAN)
LMKFDNPPM

SEQ ID NO: 188584 - protein, 10 aa, Artificial Sequence
  Description of Artificial Sequence: Synthetic peptide
  Seed: AIFDEWMKRF (TYRP2_HUMAN)
AQFDEWMKRW

SEQ ID NO: 188585 - protein, 9 aa, Artificial Sequence
  Description of Artificial Sequence: Synthetic peptide
  Seed: SLHNLVHSF (TYRP2_HUMAN)
SGHNLVHSY

SEQ ID NO: 188586 - protein, 9 aa, Artificial Sequence
  Description of Artificial Sequence: Synthetic peptide
  Seed: FSHQGPAFV (TYRP2_HUMAN)
FMHQGPAFF

SEQ ID NO: 188587 - protein, 10 aa, Artificial Sequence
  Description of Artificial Sequence: Synthetic peptide
  Seed: RLIGNESFAL (TYRP2_HUMAN)
RLIGNESFAM

SEQ ID NO: 188588 - protein, 10 aa, Artificial Sequence
  Description of Artificial Sequence: Synthetic peptide
  Seed: VVMGTLVALV (TYRP2_HUMAN)
VTMGTLVALV

SEQ ID NO: 188589 - protein, 10 aa, Artificial Sequence
  Description of Artificial Sequence: Synthetic peptide
  Seed: FANCSVYDFF (TYRP2_HUMAN)
FSNCSVYDFF

SEQ ID NO: 188590 - protein, 10 aa, Artificial Sequence
  Description of Artificial Sequence: Synthetic peptide
  Seed: LQKFDNPPFF (TYRP2_HUMAN)
LLKFDNPPFF

SEQ ID NO: 188591 - protein, 9 aa, Artificial Sequence
  Description of Artificial Sequence: Synthetic peptide
  Seed: SLHNLVHSF (TYRP2_HUMAN)
SIHNLVHSL

SEQ ID NO: 188592 - protein, 9 aa, Artificial Sequence
  Description of Artificial Sequence: Synthetic peptide
  Seed: NMVPFFPPV (TYRP2_HUMAN)
NAVPFFPPL

SEQ ID NO: 188593 - protein, 10 aa, Artificial Sequence
  Description of Artificial Sequence: Synthetic peptide
  Seed: LQKFDNPPFF (TYRP2_HUMAN)
LQKFDNPPFM

SEQ ID NO: 188594 - protein, 9 aa, Artificial Sequence
  Description of Artificial Sequence: Synthetic peptide
  Seed: HSFLNGTNA (TYRP2_HUMAN)
HAFLNGTNY

SEQ ID NO: 188595 - protein, 9 aa, Artificial Sequence
  Description of Artificial Sequence: Synthetic peptide
  Seed: AWPQELAPI (TYRP2_HUMAN)
AFPQELAPW

SEQ ID NO: 188596 - protein, 9 aa, Artificial Sequence
  Description of Artificial Sequence: Synthetic peptide
  Seed: LHSFTDAIF (TYRP2_HUMAN)
LQSFTDAIF

SEQ ID NO: 188597 - protein, 9 aa, Artificial Sequence
  Description of Artificial Sequence: Synthetic peptide
  Seed: TLLGPGRPY (TYRP2_HUMAN)
TSLGPGRPV

SEQ ID NO: 188598 - protein, 9 aa, Artificial Sequence
  Description of Artificial Sequence: Synthetic peptide
  Seed: LAPIGHNRM (TYRP2_HUMAN)
LMPIGHNRL

SEQ ID NO: 188599 - protein, 10 aa, Artificial Sequence
  Description of Artificial Sequence: Synthetic peptide
  Seed: RLRKGYTPLM (TYRP2_HUMAN)
RYRKGYTPLM

SEQ ID NO: 188600 - protein, 10 aa, Artificial Sequence
  Description of Artificial Sequence: Synthetic peptide
  Seed: RRLRKGYTPL (TYRP2_HUMAN)
RLLRKGYTPK

SEQ ID NO: 188601 - protein, 9 aa, Artificial Sequence
  Description of Artificial Sequence: Synthetic peptide
  Seed: RMYNMVPFF (TYRP2_HUMAN)
RLYNMVPFK

SEQ ID NO: 188602 - protein, 9 aa, Artificial Sequence
  Description of Artificial Sequence: Synthetic peptide
  Seed: RMYNMVPFF (TYRP2_HUMAN)
RSYNMVPFK

SEQ ID NO: 188603 - protein, 10 aa, Artificial Sequence
  Description of Artificial Sequence: Synthetic peptide
  Seed: VLLAFLQYRR (TYRP2_HUMAN)
VMLAFLQYRR

SEQ ID NO: 188604 - protein, 11 aa, Artificial Sequence
  Description of Artificial Sequence: Synthetic peptide
  Seed: CDSLDDYNHLV (TYRP2_HUMAN)
CGSLDDYNHLV

SEQ ID NO: 188605 - protein, 9 aa, Artificial Sequence
  Description of Artificial Sequence: Synthetic peptide
  Seed: GPAFVTWHR (TYRP2_HUMAN)
GYAFVTWHR

SEQ ID NO: 188606 - protein, 10 aa, Artificial Sequence
  Description of Artificial Sequence: Synthetic peptide
  Seed: YDFFVWLHYY (TYRP2_HUMAN)
YFFFVWLHYL

SEQ ID NO: 188607 - protein, 10 aa, Artificial Sequence
  Description of Artificial Sequence: Synthetic peptide
  Seed: SLDDYNHLVT (TYRP2_HUMAN)
SIDDYNHLVL

SEQ ID NO: 188608 - protein, 10 aa, Artificial Sequence
  Description of Artificial Sequence: Synthetic peptide
  Seed: IDFSHQGPAF (TYRP2_HUMAN)
IMFSHQGPAM

SEQ ID NO: 188609 - protein, 10 aa, Artificial Sequence
  Description of Artificial Sequence: Synthetic peptide
  Seed: MTVDSLVNKE (TYRP2_HUMAN)
MSVDSLVNKR

SEQ ID NO: 188610 - protein, 9 aa, Artificial Sequence
  Description of Artificial Sequence: Synthetic peptide
  Seed: TLLGPGRPY (TYRP2_HUMAN)
TVLGPGRPM

SEQ ID NO: 188611 - protein, 9 aa, Artificial Sequence
  Description of Artificial Sequence: Synthetic peptide
  Seed: FPPVTNEEL (TYRP2_HUMAN)
FVPVTNEEI

SEQ ID NO: 188612 - protein, 9 aa, Artificial Sequence
  Description of Artificial Sequence: Synthetic peptide
  Seed: SLDDYNHLV (TYRP2_HUMAN)
SGDDYNHLY

SEQ ID NO: 188613 - protein, 10 aa, Artificial Sequence
  Description of Artificial Sequence: Synthetic peptide
  Seed: HNRMYNMVPF (TYRP2_HUMAN)
HVRMYNMVPY

SEQ ID NO: 188614 - protein, 10 aa, Artificial Sequence
  Description of Artificial Sequence: Synthetic peptide
  Seed: LGPNGTQPQF (TYRP2_HUMAN)
LYPNGTQPQW

SEQ ID NO: 188615 - protein, 9 aa, Artificial Sequence
  Description of Artificial Sequence: Synthetic peptide
  Seed: SLHNLVHSF (TYRP2_HUMAN)
SVHNLVHSF

SEQ ID NO: 188616 - protein, 9 aa, Artificial Sequence
  Description of Artificial Sequence: Synthetic peptide
  Seed: RKFFHRTCK (TYRP2_HUMAN)
RSFFHRTCL

SEQ ID NO: 188617 - protein, 10 aa, Artificial Sequence
  Description of Artificial Sequence: Synthetic peptide
  Seed: NESFALPYWN (TYRP2_HUMAN)
NESFALPYWY

SEQ ID NO: 188618 - protein, 11 aa, Artificial Sequence
  Description of Artificial Sequence: Synthetic peptide
  Seed: QRLIGNESFAL (TYRP2_HUMAN)
QFLIGNESFAL

SEQ ID NO: 188619 - protein, 8 aa, Artificial Sequence
  Description of Artificial Sequence: Synthetic peptide
  Seed: KFDNPPFF (TYRP2_HUMAN)
KIDNPPFM

SEQ ID NO: 188620 - protein, 10 aa, Artificial Sequence
  Description of Artificial Sequence: Synthetic peptide
  Seed: SDQLGYSYAI (TYRP2_HUMAN)
SSQLGYSYAI

SEQ ID NO: 188621 - protein, 9 aa, Artificial Sequence
  Description of Artificial Sequence: Synthetic peptide
  Seed: DIRDCLSLQ (TYRP2_HUMAN)
DTRDCLSLK

SEQ ID NO: 188622 - protein, 10 aa, Artificial Sequence
  Description of Artificial Sequence: Synthetic peptide
  Seed: FSFRNALEGF (TYRP2_HUMAN)
FTFRNALEGW

SEQ ID NO: 188623 - protein, 9 aa, Artificial Sequence
  Description of Artificial Sequence: Synthetic peptide
  Seed: NALEGFDKA (TYRP2_HUMAN)
NQLEGFDKI

SEQ ID NO: 188624 - protein, 8 aa, Artificial Sequence
  Description of Artificial Sequence: Synthetic peptide
  Seed: FSHQGPAF (TYRP2_HUMAN)
FMHQGPAL

SEQ ID NO: 188625 - protein, 10 aa, Artificial Sequence
  Description of Artificial Sequence: Synthetic peptide
  Seed: VVLHSFTDAI (TYRP2_HUMAN)
VILHSFTDAV

SEQ ID NO: 188626 - protein, 10 aa, Artificial Sequence
  Description of Artificial Sequence: Synthetic peptide
  Seed: YNMVPFFPPV (TYRP2_HUMAN)
YDMVPFFPPV

SEQ ID NO: 188627 - protein, 9 aa, Artificial Sequence
  Description of Artificial Sequence: Synthetic peptide
  Seed: ALPYWNFAT (TYRP2_HUMAN)
AQPYWNFAL

SEQ ID NO: 188628 - protein, 11 aa, Artificial Sequence
  Description of Artificial Sequence: Synthetic peptide
  Seed: FSHQGPAFVTW (TYRP2_HUMAN)
FAHQGPAFVTY

SEQ ID NO: 188629 - protein, 9 aa, Artificial Sequence
  Description of Artificial Sequence: Synthetic peptide
  Seed: FQNSTFSFR (TYRP2_HUMAN)
FVNSTFSFR

SEQ ID NO: 188630 - protein, 9 aa, Artificial Sequence
  Description of Artificial Sequence: Synthetic peptide
  Seed: FSHQGPAFV (TYRP2_HUMAN)
FTHQGPAFW

SEQ ID NO: 188631 - protein, 9 aa, Artificial Sequence
  Description of Artificial Sequence: Synthetic peptide
  Seed: RKFFHRTCK (TYRP2_HUMAN)
RSFFHRTCI

SEQ ID NO: 188632 - protein, 9 aa, Artificial Sequence
  Description of Artificial Sequence: Synthetic peptide
  Seed: HQGPAFVTW (TYRP2_HUMAN)
HDGPAFVTF

SEQ ID NO: 188633 - protein, 9 aa, Artificial Sequence
  Description of Artificial Sequence: Synthetic peptide
  Seed: VYDFFVWLH (TYRP2_HUMAN)
VWDFFVWLY

SEQ ID NO: 188634 - protein, 10 aa, Artificial Sequence
  Description of Artificial Sequence: Synthetic peptide
  Seed: WPRKFFHRTC (TYRP2_HUMAN)
WPRKFFHRTL

SEQ ID NO: 188635 - protein, 10 aa, Artificial Sequence
  Description of Artificial Sequence: Synthetic peptide
  Seed: SLQKFDNPPF (TYRP2_HUMAN)
SMQKFDNPPY

SEQ ID NO: 188636 - protein, 9 aa, Artificial Sequence
  Description of Artificial Sequence: Synthetic peptide
  Seed: VLLAFLQYR (TYRP2_HUMAN)
VWLAFLQYK

SEQ ID NO: 188637 - protein, 9 aa, Artificial Sequence
  Description of Artificial Sequence: Synthetic peptide
  Seed: VTWHRYHLL (TYRP2_HUMAN)
VWWHRYHLF

SEQ ID NO: 188638 - protein, 10 aa, Artificial Sequence
  Description of Artificial Sequence: Synthetic peptide
  Seed: FLLSCLGCKI (TYRP2_HUMAN)
FWLSCLGCKV

SEQ ID NO: 188639 - protein, 11 aa, Artificial Sequence
  Description of Artificial Sequence: Synthetic peptide
  Seed: AIDFSHQGPAF (TYRP2_HUMAN)
ASDFSHQGPAY

SEQ ID NO: 188640 - protein, 10 aa, Artificial Sequence
  Description of Artificial Sequence: Synthetic peptide
  Seed: LRNQDDRELW (TYRP2_HUMAN)
LTNQDDRELW

SEQ ID NO: 188641 - protein, 10 aa, Artificial Sequence
  Description of Artificial Sequence: Synthetic peptide
  Seed: TVDSLVNKEC (TYRP2_HUMAN)
TTDSLVNKEM

SEQ ID NO: 188642 - protein, 9 aa, Artificial Sequence
  Description of Artificial Sequence: Synthetic peptide
  Seed: VVMGTLVAL (TYRP2_HUMAN)
VAMGTLVAR

SEQ ID NO: 188643 - protein, 9 aa, Artificial Sequence
  Description of Artificial Sequence: Synthetic peptide
  Seed: VIRQNIHSL (TYRP2_HUMAN)
VIRQNIHSM

SEQ ID NO: 188644 - protein, 9 aa, Artificial Sequence
  Description of Artificial Sequence: Synthetic peptide
  Seed: VYDFFVWLH (TYRP2_HUMAN)
VFDFFVWLY

SEQ ID NO: 188645 - protein, 9 aa, Artificial Sequence
  Description of Artificial Sequence: Synthetic peptide
  Seed: ISRNSRFSS (TYRP2_HUMAN)
ISRNSRFSL

SEQ ID NO: 188646 - protein, 9 aa, Artificial Sequence
  Description of Artificial Sequence: Synthetic peptide
  Seed: FVWLHYYSV (TYRP2_HUMAN)
FPWLHYYSL

SEQ ID NO: 188647 - protein, 10 aa, Artificial Sequence
  Description of Artificial Sequence: Synthetic peptide
  Seed: IDFSHQGPAF (TYRP2_HUMAN)
IYFSHQGPAL

SEQ ID NO: 188648 - protein, 10 aa, Artificial Sequence
  Description of Artificial Sequence: Synthetic peptide
  Seed: YAIDLPVSVE (TYRP2_HUMAN)
YLIDLPVSVF

SEQ ID NO: 188649 - protein, 9 aa, Artificial Sequence
  Description of Artificial Sequence: Synthetic peptide
  Seed: FLQYRRLRK (TYRP2_HUMAN)
FFQYRRLRR

SEQ ID NO: 188650 - protein, 9 aa, Artificial Sequence
  Description of Artificial Sequence: Synthetic peptide
  Seed: HSAANDPIF (TYRP2_HUMAN)
HTAANDPIW

SEQ ID NO: 188651 - protein, 9 aa, Artificial Sequence
  Description of Artificial Sequence: Synthetic peptide
  Seed: TVCDSLDDY (TYRP2_HUMAN)
TPCDSLDDY

SEQ ID NO: 188652 - protein, 11 aa, Artificial Sequence
  Description of Artificial Sequence: Synthetic peptide
  Seed: FQNSTFSFRNA (TYRP2_HUMAN)
FLNSTFSFRNV

SEQ ID NO: 188653 - protein, 10 aa, Artificial Sequence
  Description of Artificial Sequence: Synthetic peptide
  Seed: EETPGWPTTL (TYRP2_HUMAN)
EHTPGWPTTL

SEQ ID NO: 188654 - protein, 9 aa, Artificial Sequence
  Description of Artificial Sequence: Synthetic peptide
  Seed: WMKRFNPPA (TYRP2_HUMAN)
WMKRFNPPM

SEQ ID NO: 188655 - protein, 10 aa, Artificial Sequence
  Description of Artificial Sequence: Synthetic peptide
  Seed: ALVGLFVLLA (TYRP2_HUMAN)
AMVGLFVLLA

SEQ ID NO: 188656 - protein, 9 aa, Artificial Sequence
  Description of Artificial Sequence: Synthetic peptide
  Seed: FTDAIFDEW (TYRP2_HUMAN)
FADAIFDEI

SEQ ID NO: 188657 - protein, 10 aa, Artificial Sequence
  Description of Artificial Sequence: Synthetic peptide
  Seed: RNSMKLPTLK (TYRP2_HUMAN)
RSSMKLPTLK

SEQ ID NO: 188658 - protein, 9 aa, Artificial Sequence
  Description of Artificial Sequence: Synthetic peptide
  Seed: TLKDIRDCL (TYRP2_HUMAN)
TMKDIRDCV

SEQ ID NO: 188659 - protein, 9 aa, Artificial Sequence
  Description of Artificial Sequence: Synthetic peptide
  Seed: YSYAIDLPV (TYRP2_HUMAN)
YPYAIDLPA

SEQ ID NO: 188660 - protein, 9 aa, Artificial Sequence
  Description of Artificial Sequence: Synthetic peptide
  Seed: NSMKLPTLK (TYRP2_HUMAN)
NIMKLPTLK

SEQ ID NO: 188661 - protein, 10 aa, Artificial Sequence
  Description of Artificial Sequence: Synthetic peptide
  Seed: CTDQLFGAAR (TYRP2_HUMAN)
CLDQLFGAAY

SEQ ID NO: 188662 - protein, 9 aa, Artificial Sequence
  Description of Artificial Sequence: Synthetic peptide
  Seed: TSDQLGYSY (TYRP2_HUMAN)
TTDQLGYSL

SEQ ID NO: 188663 - protein, 9 aa, Artificial Sequence
  Description of Artificial Sequence: Synthetic peptide
  Seed: AARPDDPTL (TYRP2_HUMAN)
AARPDDPTM

SEQ ID NO: 188664 - protein, 11 aa, Artificial Sequence
  Description of Artificial Sequence: Synthetic peptide
  Seed: MSLHNLVHSFL (TYRP2_HUMAN)
MLLHNLVHSFV

SEQ ID NO: 188665 - protein, 11 aa, Artificial Sequence
  Description of Artificial Sequence: Synthetic peptide
  Seed: KADGTLDSQVM (TYRP2_HUMAN)
KQDGTLDSQVM

SEQ ID NO: 188666 - protein, 10 aa, Artificial Sequence
  Description of Artificial Sequence: Synthetic peptide
  Seed: FFQNSTFSFR (TYRP2_HUMAN)
FWQNSTFSFR

SEQ ID NO: 188667 - protein, 10 aa, Artificial Sequence
  Description of Artificial Sequence: Synthetic peptide
  Seed: MGTLVALVGL (TYRP2_HUMAN)
MLTLVALVGV

SEQ ID NO: 188668 - protein, 9 aa, Artificial Sequence
  Description of Artificial Sequence: Synthetic peptide
  Seed: DDRELWPRK (TYRP2_HUMAN)
DSRELWPRR

SEQ ID NO: 188669 - protein, 9 aa, Artificial Sequence
  Description of Artificial Sequence: Synthetic peptide
  Seed: GFDKADGTL (TYRP2_HUMAN)
GLDKADGTM

SEQ ID NO: 188670 - protein, 9 aa, Artificial Sequence
  Description of Artificial Sequence: Synthetic peptide
  Seed: YVITTQHWL (TYRP2_HUMAN)
YLITTQHWA

SEQ ID NO: 188671 - protein, 9 aa, Artificial Sequence
  Description of Artificial Sequence: Synthetic peptide
  Seed: FVLLAFLQY (TYRP2_HUMAN)
FMLLAFLQR

SEQ ID NO: 188672 - protein, 9 aa, Artificial Sequence
  Description of Artificial Sequence: Synthetic peptide
  Seed: YDFFVWLHY (TYRP2_HUMAN)
YMFFVWLHY

SEQ ID NO: 188673 - protein, 10 aa, Artificial Sequence
  Description of Artificial Sequence: Synthetic peptide
  Seed: GQFPRVCMTV (TYRP2_HUMAN)
GQFPRVCMTY

SEQ ID NO: 188674 - protein, 9 aa, Artificial Sequence
  Description of Artificial Sequence: Synthetic peptide
  Seed: HYYSVRDTL (TYRP2_HUMAN)
HRYSVRDTV

SEQ ID NO: 188675 - protein, 11 aa, Artificial Sequence
  Description of Artificial Sequence: Synthetic peptide
  Seed: RMYNMVPFFPP (TYRP2_HUMAN)
RLYNMVPFFPA

SEQ ID NO: 188676 - protein, 11 aa, Artificial Sequence
  Description of Artificial Sequence: Synthetic peptide
  Seed: RADTRPWSGPY (TYRP2_HUMAN)
RDDTRPWSGPW

SEQ ID NO: 188677 - protein, 10 aa, Artificial Sequence
  Description of Artificial Sequence: Synthetic peptide
  Seed: QPQFANCSVY (TYRP2_HUMAN)
QVQFANCSVM

SEQ ID NO: 188678 - protein, 10 aa, Artificial Sequence
  Description of Artificial Sequence: Synthetic peptide
  Seed: TDAIFDEWMK (TYRP2_HUMAN)
TQAIFDEWMR

SEQ ID NO: 188679 - protein, 10 aa, Artificial Sequence
  Description of Artificial Sequence: Synthetic peptide
  Seed: VLLAFLQYRR (TYRP2_HUMAN)
VLLAFLQYRK

SEQ ID NO: 188680 - protein, 9 aa, Artificial Sequence
  Description of Artificial Sequence: Synthetic peptide
  Seed: TLLGPGRPY (TYRP2_HUMAN)
TVLGPGRPL

SEQ ID NO: 188681 - protein, 10 aa, Artificial Sequence
  Description of Artificial Sequence: Synthetic peptide
  Seed: RELWPRKFFH (TYRP2_HUMAN)
RNLWPRKFFR

SEQ ID NO: 188682 - protein, 9 aa, Artificial Sequence
  Description of Artificial Sequence: Synthetic peptide
  Seed: AIFDEWMKR (TYRP2_HUMAN)
AAFDEWMKR

SEQ ID NO: 188683 - protein, 9 aa, Artificial Sequence
  Description of Artificial Sequence: Synthetic peptide
  Seed: GTLVALVGL (TYRP2_HUMAN)
GLLVALVGA

SEQ ID NO: 188684 - protein, 9 aa, Artificial Sequence
  Description of Artificial Sequence: Synthetic peptide
  Seed: KRVHPDYVI (TYRP2_HUMAN)
KRVHPDYVY

SEQ ID NO: 188685 - protein, 9 aa, Artificial Sequence
  Description of Artificial Sequence: Synthetic peptide
  Seed: YAIDLPVSV (TYRP2_HUMAN)
YLIDLPVST

SEQ ID NO: 188686 - protein, 10 aa, Artificial Sequence
  Description of Artificial Sequence: Synthetic peptide
  Seed: HRYHLLCLER (TYRP2_HUMAN)
HAYHLLCLER

SEQ ID NO: 188687 - protein, 8 aa, Artificial Sequence
  Description of Artificial Sequence: Synthetic peptide
  Seed: AIDLPVSV (TYRP2_HUMAN)
AIDLPVSL

SEQ ID NO: 188688 - protein, 10 aa, Artificial Sequence
  Description of Artificial Sequence: Synthetic peptide
  Seed: KILPGAQGQF (TYRP2_HUMAN)
KQLPGAQGQI

SEQ ID NO: 188689 - protein, 9 aa, Artificial Sequence
  Description of Artificial Sequence: Synthetic peptide
  Seed: SRFSSWETV (TYRP2_HUMAN)
SKFSSWETF

SEQ ID NO: 188690 - protein, 9 aa, Artificial Sequence
  Description of Artificial Sequence: Synthetic peptide
  Seed: GTYEGLLRR (TYRP2_HUMAN)
GAYEGLLRL

SEQ ID NO: 188691 - protein, 11 aa, Artificial Sequence
  Description of Artificial Sequence: Synthetic peptide
  Seed: SLDDYNHLVTL (TYRP2_HUMAN)
SMDDYNHLVTW

SEQ ID NO: 188692 - protein, 8 aa, Artificial Sequence
  Description of Artificial Sequence: Synthetic peptide
  Seed: AIDLPVSV (TYRP2_HUMAN)
AADLPVSM

SEQ ID NO: 188693 - protein, 9 aa, Artificial Sequence
  Description of Artificial Sequence: Synthetic peptide
  Seed: RNSMKLPTL (TYRP2_HUMAN)
RQSMKLPTF

SEQ ID NO: 188694 - protein, 10 aa, Artificial Sequence
  Description of Artificial Sequence: Synthetic peptide
  Seed: SDQLGYSYAI (TYRP2_HUMAN)
SDQLGYSYAL

SEQ ID NO: 188695 - protein, 9 aa, Artificial Sequence
  Description of Artificial Sequence: Synthetic peptide
  Seed: QFPRVCMTV (TYRP2_HUMAN)
QWPRVCMTI

SEQ ID NO: 188696 - protein, 11 aa, Artificial Sequence
  Description of Artificial Sequence: Synthetic peptide
  Seed: MYNMVPFFPPV (TYRP2_HUMAN)
MVNMVPFFPPL

SEQ ID NO: 188697 - protein, 9 aa, Artificial Sequence
  Description of Artificial Sequence: Synthetic peptide
  Seed: RNQMGRNSM (TYRP2_HUMAN)
REQMGRNSF

SEQ ID NO: 188698 - protein, 9 aa, Artificial Sequence
  Description of Artificial Sequence: Synthetic peptide
  Seed: VPFFPPVTN (TYRP2_HUMAN)
VSFFPPVTY

SEQ ID NO: 188699 - protein, 9 aa, Artificial Sequence
  Description of Artificial Sequence: Synthetic peptide
  Seed: ELWPRKFFH (TYRP2_HUMAN)
EYWPRKFFK

SEQ ID NO: 188700 - protein, 9 aa, Artificial Sequence
  Description of Artificial Sequence: Synthetic peptide
  Seed: YYSVRDTLL (TYRP2_HUMAN)
YYSVRDTLM

SEQ ID NO: 188701 - protein, 10 aa, Artificial Sequence
  Description of Artificial Sequence: Synthetic peptide
  Seed: SVYDFFVWLH (TYRP2_HUMAN)
SEYDFFVWLY

SEQ ID NO: 188702 - protein, 10 aa, Artificial Sequence
  Description of Artificial Sequence: Synthetic peptide
  Seed: VVMGTLVALV (TYRP2_HUMAN)
VQMGTLVALA

SEQ ID NO: 188703 - protein, 10 aa, Artificial Sequence
  Description of Artificial Sequence: Synthetic peptide
  Seed: REQFLGALDL (TYRP2_HUMAN)
RNQFLGALDF

SEQ ID NO: 188704 - protein, 10 aa, Artificial Sequence
  Description of Artificial Sequence: Synthetic peptide
  Seed: CMTVDSLVNK (TYRP2_HUMAN)
CVTVDSLVNK

SEQ ID NO: 188705 - protein, 10 aa, Artificial Sequence
  Description of Artificial Sequence: Synthetic peptide
  Seed: TDAIFDEWMK (TYRP2_HUMAN)
TNAIFDEWMR

SEQ ID NO: 188706 - protein, 9 aa, Artificial Sequence
  Description of Artificial Sequence: Synthetic peptide
  Seed: LLGPGRPYR (TYRP2_HUMAN)
LSGPGRPYK

SEQ ID NO: 188707 - protein, 11 aa, Artificial Sequence
  Description of Artificial Sequence: Synthetic peptide
  Seed: TQPQFANCSVY (TYRP2_HUMAN)
TAPQFANCSVF

SEQ ID NO: 188708 - protein, 9 aa, Artificial Sequence
  Description of Artificial Sequence: Synthetic peptide
  Seed: AARPDDPTL (TYRP2_HUMAN)
ATRPDDPTY

SEQ ID NO: 188709 - protein, 11 aa, Artificial Sequence
  Description of Artificial Sequence: Synthetic peptide
  Seed: HPDYVITTQHW (TYRP2_HUMAN)
HADYVITTQHF

SEQ ID NO: 188710 - protein, 9 aa, Artificial Sequence
  Description of Artificial Sequence: Synthetic peptide
  Seed: ALVGLFVLL (TYRP2_HUMAN)
AAVGLFVLY

SEQ ID NO: 188711 - protein, 10 aa, Artificial Sequence
  Description of Artificial Sequence: Synthetic peptide
  Seed: KILPGAQGQF (TYRP2_HUMAN)
KVLPGAQGQY

SEQ ID NO: 188712 - protein, 9 aa, Artificial Sequence
  Description of Artificial Sequence: Synthetic peptide
  Seed: TLDSQVMSL (TYRP2_HUMAN)
TTDSQVMSC

SEQ ID NO: 188713 - protein, 9 aa, Artificial Sequence
  Description of Artificial Sequence: Synthetic peptide
  Seed: WMKRFNPPA (TYRP2_HUMAN)
WMKRFNPPF

SEQ ID NO: 188714 - protein, 9 aa, Artificial Sequence
  Description of Artificial Sequence: Synthetic peptide
  Seed: GWPTTLLVV (TYRP2_HUMAN)
GFPTTLLVM

SEQ ID NO: 188715 - protein, 10 aa, Artificial Sequence
  Description of Artificial Sequence: Synthetic peptide
  Seed: EETPGWPTTL (TYRP2_HUMAN)
EHTPGWPTTI

SEQ ID NO: 188716 - protein, 11 aa, Artificial Sequence
  Description of Artificial Sequence: Synthetic peptide
  Seed: KADGTLDSQVM (TYRP2_HUMAN)
KMDGTLDSQVW

SEQ ID NO: 188717 - protein, 8 aa, Artificial Sequence
  Description of Artificial Sequence: Synthetic peptide
  Seed: AIDLPVSV (TYRP2_HUMAN)
AADLPVSF

SEQ ID NO: 188718 - protein, 9 aa, Artificial Sequence
  Description of Artificial Sequence: Synthetic peptide
  Seed: RNSMKLPTL (TYRP2_HUMAN)
RSSMKLPTV

SEQ ID NO: 188719 - protein, 9 aa, Artificial Sequence
  Description of Artificial Sequence: Synthetic peptide
  Seed: YSYAIDLPV (TYRP2_HUMAN)
YPYAIDLPL

SEQ ID NO: 188720 - protein, 10 aa, Artificial Sequence
  Description of Artificial Sequence: Synthetic peptide
  Seed: KRFNPPADAW (TYRP2_HUMAN)
KGFNPPADAW

SEQ ID NO: 188721 - protein, 9 aa, Artificial Sequence
  Description of Artificial Sequence: Synthetic peptide
  Seed: TLDSQVMSL (TYRP2_HUMAN)
TIDSQVMSL

SEQ ID NO: 188722 - protein, 10 aa, Artificial Sequence
  Description of Artificial Sequence: Synthetic peptide
  Seed: HNRMYNMVPF (TYRP2_HUMAN)
HFRMYNMVPL

SEQ ID NO: 188723 - protein, 9 aa, Artificial Sequence
  Description of Artificial Sequence: Synthetic peptide
  Seed: RDCLSLQKF (TYRP2_HUMAN)
RTCLSLQKL

SEQ ID NO: 188724 - protein, 9 aa, Artificial Sequence
  Description of Artificial Sequence: Synthetic peptide
  Seed: LVHSFLNGT (TYRP2_HUMAN)
LVHSFLNGI

SEQ ID NO: 188725 - protein, 10 aa, Artificial Sequence
  Description of Artificial Sequence: Synthetic peptide
  Seed: VLLAFLQYRR (TYRP2_HUMAN)
VTLAFLQYRR

SEQ ID NO: 188726 - protein, 10 aa, Artificial Sequence
  Description of Artificial Sequence: Synthetic peptide
  Seed: YNMVPFFPPV (TYRP2_HUMAN)
YMMVPFFPPC

SEQ ID NO: 188727 - protein, 10 aa, Artificial Sequence
  Description of Artificial Sequence: Synthetic peptide
  Seed: HNRMYNMVPF (TYRP2_HUMAN)
HRRMYNMVPM

SEQ ID NO: 188728 - protein, 9 aa, Artificial Sequence
  Description of Artificial Sequence: Synthetic peptide
  Seed: TSDQLGYSY (TYRP2_HUMAN)
TADQLGYSM

SEQ ID NO: 188729 - protein, 10 aa, Artificial Sequence
  Description of Artificial Sequence: Synthetic peptide
  Seed: RLRKGYTPLM (TYRP2_HUMAN)
RMRKGYTPLA

SEQ ID NO: 188730 - protein, 9 aa, Artificial Sequence
  Description of Artificial Sequence: Synthetic peptide
  Seed: VLHSFTDAI (TYRP2_HUMAN)
VAHSFTDAM

SEQ ID NO: 188731 - protein, 9 aa, Artificial Sequence
  Description of Artificial Sequence: Synthetic peptide
  Seed: KDIRDCLSL (TYRP2_HUMAN)
KQIRDCLSM

SEQ ID NO: 188732 - protein, 11 aa, Artificial Sequence
  Description of Artificial Sequence: Synthetic peptide
  Seed: RNSRFSSWETV (TYRP2_HUMAN)
RESRFSSWETF

SEQ ID NO: 188733 - protein, 10 aa, Artificial Sequence
  Description of Artificial Sequence: Synthetic peptide
  Seed: FFPPVTNEEL (TYRP2_HUMAN)
FWPPVTNEEF

SEQ ID NO: 188734 - protein, 10 aa, Artificial Sequence
  Description of Artificial Sequence: Synthetic peptide
  Seed: GLFVLLAFLQ (TYRP2_HUMAN)
GLFVLLAFLV

SEQ ID NO: 188735 - protein, 9 aa, Artificial Sequence
  Description of Artificial Sequence: Synthetic peptide
  Seed: RLRKGYTPL (TYRP2_HUMAN)
RQRKGYTPS

SEQ ID NO: 188736 - protein, 11 aa, Artificial Sequence
  Description of Artificial Sequence: Synthetic peptide
  Seed: LPVSVEETPGW (TYRP2_HUMAN)
LGVSVEETPGW

SEQ ID NO: 188737 - protein, 9 aa, Artificial Sequence
  Description of Artificial Sequence: Synthetic peptide
  Seed: AARPDDPTL (TYRP2_HUMAN)
ASRPDDPTF

SEQ ID NO: 188738 - protein, 9 aa, Artificial Sequence
  Description of Artificial Sequence: Synthetic peptide
  Seed: ANCSVYDFF (TYRP2_HUMAN)
AACSVYDFW

SEQ ID NO: 188739 - protein, 10 aa, Artificial Sequence
  Description of Artificial Sequence: Synthetic peptide
  Seed: MGTLVALVGL (TYRP2_HUMAN)
MITLVALVGV

SEQ ID NO: 188740 - protein, 9 aa, Artificial Sequence
  Description of Artificial Sequence: Synthetic peptide
  Seed: VALVGLFVL (TYRP2_HUMAN)
VMLVGLFVL

SEQ ID NO: 188741 - protein, 9 aa, Artificial Sequence
  Description of Artificial Sequence: Synthetic peptide
  Seed: QVMSLHNLV (TYRP2_HUMAN)
QVMSLHNLR

SEQ ID NO: 188742 - protein, 10 aa, Artificial Sequence
  Description of Artificial Sequence: Synthetic peptide
  Seed: TQPQFANCSV (TYRP2_HUMAN)
TNPQFANCSL

SEQ ID NO: 188743 - protein, 10 aa, Artificial Sequence
  Description of Artificial Sequence: Synthetic peptide
  Seed: RLRKGYTPLM (TYRP2_HUMAN)
RARKGYTPLR

SEQ ID NO: 188744 - protein, 9 aa, Artificial Sequence
  Description of Artificial Sequence: Synthetic peptide
  Seed: SPLWWGFLL (TYRP2_HUMAN)
STLWWGFLV

SEQ ID NO: 188745 - protein, 9 aa, Artificial Sequence
  Description of Artificial Sequence: Synthetic peptide
  Seed: LSPQEREQF (TYRP2_HUMAN)
LMPQEREQY

SEQ ID NO: 188746 - protein, 11 aa, Artificial Sequence
  Description of Artificial Sequence: Synthetic peptide
  Seed: WLHYYSVRDTL (TYRP2_HUMAN)
WAHYYSVRDTF

SEQ ID NO: 188747 - protein, 9 aa, Artificial Sequence
  Description of Artificial Sequence: Synthetic peptide
  Seed: TLDSQVMSL (TYRP2_HUMAN)
TVDSQVMSW

SEQ ID NO: 188748 - protein, 9 aa, Artificial Sequence
  Description of Artificial Sequence: Synthetic peptide
  Seed: FSHQGPAFV (TYRP2_HUMAN)
FQHQGPAFA

SEQ ID NO: 188749 - protein, 9 aa, Artificial Sequence
  Description of Artificial Sequence: Synthetic peptide
  Seed: DIRDCLSLQ (TYRP2_HUMAN)
DVRDCLSLR

SEQ ID NO: 188750 - protein, 10 aa, Artificial Sequence
  Description of Artificial Sequence: Synthetic peptide
  Seed: SDQLGYSYAI (TYRP2_HUMAN)
SMQLGYSYAF

SEQ ID NO: 188751 - protein, 9 aa, Artificial Sequence
  Description of Artificial Sequence: Synthetic peptide
  Seed: RDCLSLQKF (TYRP2_HUMAN)
RVCLSLQKF

SEQ ID NO: 188752 - protein, 9 aa, Artificial Sequence
  Description of Artificial Sequence: Synthetic peptide
  Seed: HPDYVITTQ (TYRP2_HUMAN)
HPDYVITTL

SEQ ID NO: 188753 - protein, 8 aa, Artificial Sequence
  Description of Artificial Sequence: Synthetic peptide
  Seed: ANDPIFVV (TYRP2_HUMAN)
ALDPIFVL

SEQ ID NO: 188754 - protein, 9 aa, Artificial Sequence
  Description of Artificial Sequence: Synthetic peptide
  Seed: FSHQGPAFV (TYRP2_HUMAN)
FIHQGPAFI

SEQ ID NO: 188755 - protein, 10 aa, Artificial Sequence
  Description of Artificial Sequence: Synthetic peptide
  Seed: LHYYSVRDTL (TYRP2_HUMAN)
LIYYSVRDTW

SEQ ID NO: 188756 - protein, 10 aa, Artificial Sequence
  Description of Artificial Sequence: Synthetic peptide
  Seed: YAIDLPVSVE (TYRP2_HUMAN)
YSIDLPVSVV

SEQ ID NO: 188757 - protein, 9 aa, Artificial Sequence
  Description of Artificial Sequence: Synthetic peptide
  Seed: LSPQEREQF (TYRP2_HUMAN)
LYPQEREQF

SEQ ID NO: 188758 - protein, 10 aa, Artificial Sequence
  Description of Artificial Sequence: Synthetic peptide
  Seed: NSTFSFRNAL (TYRP2_HUMAN)
NATFSFRNAI

SEQ ID NO: 188759 - protein, 10 aa, Artificial Sequence
  Description of Artificial Sequence: Synthetic peptide
  Seed: DAIFDEWMKR (TYRP2_HUMAN)
DHIFDEWMKR

SEQ ID NO: 188760 - protein, 11 aa, Artificial Sequence
  Description of Artificial Sequence: Synthetic peptide
  Seed: RDTLLGPGRPY (TYRP2_HUMAN)
RQTLLGPGRPM

SEQ ID NO: 188761 - protein, 9 aa, Artificial Sequence
  Description of Artificial Sequence: Synthetic peptide
  Seed: SLDDYNHLV (TYRP2_HUMAN)
STDDYNHLV

SEQ ID NO: 188762 - protein, 9 aa, Artificial Sequence
  Description of Artificial Sequence: Synthetic peptide
  Seed: QFPRVCMTV (TYRP2_HUMAN)
QFPRVCMTL

SEQ ID NO: 188763 - protein, 11 aa, Artificial Sequence
  Description of Artificial Sequence: Synthetic peptide
  Seed: FVVLHSFTDAI (TYRP2_HUMAN)
FSVLHSFTDAI

SEQ ID NO: 188764 - protein, 10 aa, Artificial Sequence
  Description of Artificial Sequence: Synthetic peptide
  Seed: METHLSSKRY (TYRP2_HUMAN)
MQTHLSSKRM

SEQ ID NO: 188765 - protein, 9 aa, Artificial Sequence
  Description of Artificial Sequence: Synthetic peptide
  Seed: YDFFVWLHY (TYRP2_HUMAN)
YYFFVWLHM

SEQ ID NO: 188766 - protein, 9 aa, Artificial Sequence
  Description of Artificial Sequence: Synthetic peptide
  Seed: AIFDEWMKR (TYRP2_HUMAN)
AAFDEWMKM

SEQ ID NO: 188767 - protein, 9 aa, Artificial Sequence
  Description of Artificial Sequence: Synthetic peptide
  Seed: LLSCLGCKI (TYRP2_HUMAN)
LISCLGCKV

SEQ ID NO: 188768 - protein, 9 aa, Artificial Sequence
  Description of Artificial Sequence: Synthetic peptide
  Seed: PADAWPQEL (TYRP2_HUMAN)
PFDAWPQEV

SEQ ID NO: 188769 - protein, 8 aa, Artificial Sequence
  Description of Artificial Sequence: Synthetic peptide
  Seed: YYSVRDTL (TYRP2_HUMAN)
YASVRDTL

SEQ ID NO: 188770 - protein, 10 aa, Artificial Sequence
  Description of Artificial Sequence: Synthetic peptide
  Seed: SQVMSLHNLV (TYRP2_HUMAN)
SEVMSLHNLV

SEQ ID NO: 188771 - protein, 10 aa, Artificial Sequence
  Description of Artificial Sequence: Synthetic peptide
  Seed: AANDPIFVVL (TYRP2_HUMAN)
AFNDPIFVVF

SEQ ID NO: 188772 - protein, 9 aa, Artificial Sequence
  Description of Artificial Sequence: Synthetic peptide
  Seed: APIGHNRMY (TYRP2_HUMAN)
APIGHNRMM

SEQ ID NO: 188773 - protein, 10 aa, Artificial Sequence
  Description of Artificial Sequence: Synthetic peptide
  Seed: FPPVTNEELF (TYRP2_HUMAN)
FEPVTNEELF

SEQ ID NO: 188774 - protein, 9 aa, Artificial Sequence
  Description of Artificial Sequence: Synthetic peptide
  Seed: HQGPAFVTW (TYRP2_HUMAN)
HLGPAFVTM

SEQ ID NO: 188775 - protein, 9 aa, Artificial Sequence
  Description of Artificial Sequence: Synthetic peptide
  Seed: RDCLSLQKF (TYRP2_HUMAN)
RQCLSLQKW

SEQ ID NO: 188776 - protein, 9 aa, Artificial Sequence
  Description of Artificial Sequence: Synthetic peptide
  Seed: SLDDYNHLV (TYRP2_HUMAN)
SHDDYNHLL

SEQ ID NO: 188777 - protein, 9 aa, Artificial Sequence
  Description of Artificial Sequence: Synthetic peptide
  Seed: RFNPPADAW (TYRP2_HUMAN)
RLNPPADAY

SEQ ID NO: 188778 - protein, 9 aa, Artificial Sequence
  Description of Artificial Sequence: Synthetic peptide
  Seed: IFDEWMKRF (TYRP2_HUMAN)
IADEWMKRF

SEQ ID NO: 188779 - protein, 10 aa, Artificial Sequence
  Description of Artificial Sequence: Synthetic peptide
  Seed: QFLGALDLAK (TYRP2_HUMAN)
QTLGALDLAR

SEQ ID NO: 188780 - protein, 9 aa, Artificial Sequence
  Description of Artificial Sequence: Synthetic peptide
  Seed: DQLGYSYAI (TYRP2_HUMAN)
DTLGYSYAM

SEQ ID NO: 188781 - protein, 11 aa, Artificial Sequence
  Description of Artificial Sequence: Synthetic peptide
  Seed: YRRLRKGYTPL (TYRP2_HUMAN)
YLRLRKGYTPI

SEQ ID NO: 188782 - protein, 8 aa, Artificial Sequence
  Description of Artificial Sequence: Synthetic peptide
  Seed: ANDPIFVV (TYRP2_HUMAN)
AMDPIFVL

SEQ ID NO: 188783 - protein, 11 aa, Artificial Sequence
  Description of Artificial Sequence: Synthetic peptide
  Seed: FSHQGPAFVTW (TYRP2_HUMAN)
FPHQGPAFVTW

SEQ ID NO: 188784 - protein, 9 aa, Artificial Sequence
  Description of Artificial Sequence: Synthetic peptide
  Seed: RNQDDRELW (TYRP2_HUMAN)
RTQDDRELF

SEQ ID NO: 188785 - protein, 11 aa, Artificial Sequence
  Description of Artificial Sequence: Synthetic peptide
  Seed: CDSLDDYNHLV (TYRP2_HUMAN)
CTSLDDYNHLV

SEQ ID NO: 188786 - protein, 10 aa, Artificial Sequence
  Description of Artificial Sequence: Synthetic peptide
  Seed: MGRNSMKLPT (TYRP2_HUMAN)
MYRNSMKLPK

SEQ ID NO: 188787 - protein, 10 aa, Artificial Sequence
  Description of Artificial Sequence: Synthetic peptide
  Seed: VLLAFLQYRR (TYRP2_HUMAN)
VALAFLQYRK

SEQ ID NO: 188788 - protein, 9 aa, Artificial Sequence
  Description of Artificial Sequence: Synthetic peptide
  Seed: YVITTQHWL (TYRP2_HUMAN)
YIITTQHWM

SEQ ID NO: 188789 - protein, 10 aa, Artificial Sequence
  Description of Artificial Sequence: Synthetic peptide
  Seed: LVVMGTLVAL (TYRP2_HUMAN)
LDVMGTLVAI

SEQ ID NO: 188790 - protein, 10 aa, Artificial Sequence
  Description of Artificial Sequence: Synthetic peptide
  Seed: ELAPIGHNRM (TYRP2_HUMAN)
ETAPIGHNRV

SEQ ID NO: 188791 - protein, 9 aa, Artificial Sequence
  Description of Artificial Sequence: Synthetic peptide
  Seed: WMKRFNPPA (TYRP2_HUMAN)
WMKRFNPPI

SEQ ID NO: 188792 - protein, 9 aa, Artificial Sequence
  Description of Artificial Sequence: Synthetic peptide
  Seed: FPPVTNEEL (TYRP2_HUMAN)
FHPVTNEEL

SEQ ID NO: 188793 - protein, 9 aa, Artificial Sequence
  Description of Artificial Sequence: Synthetic peptide
  Seed: GPAFVTWHR (TYRP2_HUMAN)
GTAFVTWHK

SEQ ID NO: 188794 - protein, 10 aa, Artificial Sequence
  Description of Artificial Sequence: Synthetic peptide
  Seed: CMTVDSLVNK (TYRP2_HUMAN)
CATVDSLVNK

SEQ ID NO: 188795 - protein, 9 aa, Artificial Sequence
  Description of Artificial Sequence: Synthetic peptide
  Seed: LVHSFLNGT (TYRP2_HUMAN)
LMHSFLNGA

SEQ ID NO: 188796 - protein, 9 aa, Artificial Sequence
  Description of Artificial Sequence: Synthetic peptide
  Seed: YSYAIDLPV (TYRP2_HUMAN)
YSYAIDLPM

SEQ ID NO: 188797 - protein, 10 aa, Artificial Sequence
  Description of Artificial Sequence: Synthetic peptide
  Seed: LVVMGTLVAL (TYRP2_HUMAN)
LLVMGTLVAM

SEQ ID NO: 188798 - protein, 9 aa, Artificial Sequence
  Description of Artificial Sequence: Synthetic peptide
  Seed: RFNPPADAW (TYRP2_HUMAN)
RINPPADAI

SEQ ID NO: 188799 - protein, 9 aa, Artificial Sequence
  Description of Artificial Sequence: Synthetic peptide
  Seed: SLHNLVHSF (TYRP2_HUMAN)
SQHNLVHSW

SEQ ID NO: 188800 - protein, 11 aa, Artificial Sequence
  Description of Artificial Sequence: Synthetic peptide
  Seed: RADTRPWSGPY (TYRP2_HUMAN)
RGDTRPWSGPK

SEQ ID NO: 188801 - protein, 10 aa, Artificial Sequence
  Description of Artificial Sequence: Synthetic peptide
  Seed: YNMVPFFPPV (TYRP2_HUMAN)
YWMVPFFPPL

SEQ ID NO: 188802 - protein, 9 aa, Artificial Sequence
  Description of Artificial Sequence: Synthetic peptide
  Seed: ANDPIFVVL (TYRP2_HUMAN)
AADPIFVVC

SEQ ID NO: 188803 - protein, 10 aa, Artificial Sequence
  Description of Artificial Sequence: Synthetic peptide
  Seed: SDQLGYSYAI (TYRP2_HUMAN)
SEQLGYSYAY

SEQ ID NO: 188804 - protein, 10 aa, Artificial Sequence
  Description of Artificial Sequence: Synthetic peptide
  Seed: TWHRYHLLCL (TYRP2_HUMAN)
TYHRYHLLCL

SEQ ID NO: 188805 - protein, 9 aa, Artificial Sequence
  Description of Artificial Sequence: Synthetic peptide
  Seed: HYYSVRDTL (TYRP2_HUMAN)
HLYSVRDTY

SEQ ID NO: 188806 - protein, 10 aa, Artificial Sequence
  Description of Artificial Sequence: Synthetic peptide
  Seed: FTDAIFDEWM (TYRP2_HUMAN)
FVDAIFDEWV

SEQ ID NO: 188807 - protein, 9 aa, Artificial Sequence
  Description of Artificial Sequence: Synthetic peptide
  Seed: QKFDNPPFF (TYRP2_HUMAN)
QQFDNPPFW

SEQ ID NO: 188808 - protein, 9 aa, Artificial Sequence
  Description of Artificial Sequence: Synthetic peptide
  Seed: VGLFVLLAF (TYRP2_HUMAN)
VKLFVLLAM

SEQ ID NO: 188809 - protein, 9 aa, Artificial Sequence
  Description of Artificial Sequence: Synthetic peptide
  Seed: FFQNSTFSF (TYRP2_HUMAN)
FQQNSTFSM

SEQ ID NO: 188810 - protein, 9 aa, Artificial Sequence
  Description of Artificial Sequence: Synthetic peptide
  Seed: LPVSVEETP (TYRP2_HUMAN)
LPVSVEETI

SEQ ID NO: 188811 - protein, 10 aa, Artificial Sequence
  Description of Artificial Sequence: Synthetic peptide
  Seed: RNQMGRNSMK (TYRP2_HUMAN)
RMQMGRNSMR

SEQ ID NO: 188812 - protein, 9 aa, Artificial Sequence
  Description of Artificial Sequence: Synthetic peptide
  Seed: ISRNSRFSS (TYRP2_HUMAN)
IYRNSRFSA

SEQ ID NO: 188813 - protein, 9 aa, Artificial Sequence
  Description of Artificial Sequence: Synthetic peptide
  Seed: VVMGTLVAL (TYRP2_HUMAN)
VKMGTLVAL

SEQ ID NO: 188814 - protein, 8 aa, Artificial Sequence
  Description of Artificial Sequence: Synthetic peptide
  Seed: QFANCSVY (TYRP2_HUMAN)
QQANCSVY

SEQ ID NO: 188815 - protein, 10 aa, Artificial Sequence
  Description of Artificial Sequence: Synthetic peptide
  Seed: ELWPRKFFHR (TYRP2_HUMAN)
ESWPRKFFHK

SEQ ID NO: 188816 - protein, 10 aa, Artificial Sequence
  Description of Artificial Sequence: Synthetic peptide
  Seed: MSLHNLVHSF (TYRP2_HUMAN)
MMLHNLVHSF

SEQ ID NO: 188817 - protein, 9 aa, Artificial Sequence
  Description of Artificial Sequence: Synthetic peptide
  Seed: KRFNPPADA (TYRP2_HUMAN)
KRFNPPADF

SEQ ID NO: 188818 - protein, 10 aa, Artificial Sequence
  Description of Artificial Sequence: Synthetic peptide
  Seed: KILPGAQGQF (TYRP2_HUMAN)
KVLPGAQGQW

SEQ ID NO: 188819 - protein, 9 aa, Artificial Sequence
  Description of Artificial Sequence: Synthetic peptide
  Seed: HSAANDPIF (TYRP2_HUMAN)
HQAANDPIW

SEQ ID NO: 188820 - protein, 11 aa, Artificial Sequence
  Description of Artificial Sequence: Synthetic peptide
  Seed: RNSRFSSWETV (TYRP2_HUMAN)
RNSRFSSWETL

SEQ ID NO: 188821 - protein, 9 aa, Artificial Sequence
  Description of Artificial Sequence: Synthetic peptide
  Seed: SAANDPIFV (TYRP2_HUMAN)
SVANDPIFL

SEQ ID NO: 188822 - protein, 10 aa, Artificial Sequence
  Description of Artificial Sequence: Synthetic peptide
  Seed: FFVWLHYYSV (TYRP2_HUMAN)
FWVWLHYYSV

SEQ ID NO: 188823 - protein, 8 aa, Artificial Sequence
  Description of Artificial Sequence: Synthetic peptide
  Seed: FLNGTNAL (TYRP2_HUMAN)
FYNGTNAL

SEQ ID NO: 188824 - protein, 9 aa, Artificial Sequence
  Description of Artificial Sequence: Synthetic peptide
  Seed: LVTLCNGTY (TYRP2_HUMAN)
LQTLCNGTY

SEQ ID NO: 188825 - protein, 9 aa, Artificial Sequence
  Description of Artificial Sequence: Synthetic peptide
  Seed: SFLNGTNAL (TYRP2_HUMAN)
SMLNGTNAM

SEQ ID NO: 188826 - protein, 9 aa, Artificial Sequence
  Description of Artificial Sequence: Synthetic peptide
  Seed: YSYAIDLPV (TYRP2_HUMAN)
YHYAIDLPY

SEQ ID NO: 188827 - protein, 9 aa, Artificial Sequence
  Description of Artificial Sequence: Synthetic peptide
  Seed: RLRKGYTPL (TYRP2_HUMAN)
RPRKGYTPY

SEQ ID NO: 188828 - protein, 8 aa, Artificial Sequence
  Description of Artificial Sequence: Synthetic peptide
  Seed: AIDLPVSV (TYRP2_HUMAN)
ANDLPVSL

SEQ ID NO: 188829 - protein, 8 aa, Artificial Sequence
  Description of Artificial Sequence: Synthetic peptide
  Seed: SLDDYNHL (TYRP2_HUMAN)
SQDDYNHL

SEQ ID NO: 188830 - protein, 9 aa, Artificial Sequence
  Description of Artificial Sequence: Synthetic peptide
  Seed: RLRKGYTPL (TYRP2_HUMAN)
RLRKGYTPF

SEQ ID NO: 188831 - protein, 9 aa, Artificial Sequence
  Description of Artificial Sequence: Synthetic peptide
  Seed: RLRKGYTPL (TYRP2_HUMAN)
RLRKGYTPR

SEQ ID NO: 188832 - protein, 9 aa, Artificial Sequence
  Description of Artificial Sequence: Synthetic peptide
  Seed: STFSFRNAL (TYRP2_HUMAN)
SAFSFRNAI

SEQ ID NO: 188833 - protein, 10 aa, Artificial Sequence
  Description of Artificial Sequence: Synthetic peptide
  Seed: FVVLHSFTDA (TYRP2_HUMAN)
FQVLHSFTDL

SEQ ID NO: 188834 - protein, 9 aa, Artificial Sequence
  Description of Artificial Sequence: Synthetic peptide
  Seed: ECDVCTDQL (TYRP2_HUMAN)
EFDVCTDQM

SEQ ID NO: 188835 - protein, 10 aa, Artificial Sequence
  Description of Artificial Sequence: Synthetic peptide
  Seed: FFVWLHYYSV (TYRP2_HUMAN)
FVVWLHYYSV

SEQ ID NO: 188836 - protein, 9 aa, Artificial Sequence
  Description of Artificial Sequence: Synthetic peptide
  Seed: RAIDFSHQG (TYRP2_HUMAN)
RGIDFSHQF

SEQ ID NO: 188837 - protein, 9 aa, Artificial Sequence
  Description of Artificial Sequence: Synthetic peptide
  Seed: FFQNSTFSF (TYRP2_HUMAN)
FKQNSTFSL

SEQ ID NO: 188838 - protein, 9 aa, Artificial Sequence
  Description of Artificial Sequence: Synthetic peptide
  Seed: FPPVTNEEL (TYRP2_HUMAN)
FAPVTNEEF

SEQ ID NO: 188839 - protein, 9 aa, Artificial Sequence
  Description of Artificial Sequence: Synthetic peptide
  Seed: RVCMTVDSL (TYRP2_HUMAN)
RTCMTVDSY

SEQ ID NO: 188840 - protein, 10 aa, Artificial Sequence
  Description of Artificial Sequence: Synthetic peptide
  Seed: LHYYSVRDTL (TYRP2_HUMAN)
LVYYSVRDTW

SEQ ID NO: 188841 - protein, 10 aa, Artificial Sequence
  Description of Artificial Sequence: Synthetic peptide
  Seed: MSPLWWGFLL (TYRP2_HUMAN)
MHPLWWGFLV

SEQ ID NO: 188842 - protein, 11 aa, Artificial Sequence
  Description of Artificial Sequence: Synthetic peptide
  Seed: YNMVPFFPPVT (TYRP2_HUMAN)
YTMVPFFPPVS

SEQ ID NO: 188843 - protein, 9 aa, Artificial Sequence
  Description of Artificial Sequence: Synthetic peptide
  Seed: VMSLHNLVH (TYRP2_HUMAN)
VQSLHNLVV

SEQ ID NO: 188844 - protein, 9 aa, Artificial Sequence
  Description of Artificial Sequence: Synthetic peptide
  Seed: FPPVTNEEL (TYRP2_HUMAN)
FYPVTNEEY

SEQ ID NO: 188845 - protein, 9 aa, Artificial Sequence
  Description of Artificial Sequence: Synthetic peptide
  Seed: AARPDDPTL (TYRP2_HUMAN)
AQRPDDPTV

SEQ ID NO: 188846 - protein, 9 aa, Artificial Sequence
  Description of Artificial Sequence: Synthetic peptide
  Seed: STFSFRNAL (TYRP2_HUMAN)
SKFSFRNAF

SEQ ID NO: 188847 - protein, 9 aa, Artificial Sequence
  Description of Artificial Sequence: Synthetic peptide
  Seed: AKKRVHPDY (TYRP2_HUMAN)
AMKRVHPDF

SEQ ID NO: 188848 - protein, 10 aa, Artificial Sequence
  Description of Artificial Sequence: Synthetic peptide
  Seed: RMYNMVPFFP (TYRP2_HUMAN)
RVYNMVPFFK

SEQ ID NO: 188849 - protein, 10 aa, Artificial Sequence
  Description of Artificial Sequence: Synthetic peptide
  Seed: MSLHNLVHSF (TYRP2_HUMAN)
MELHNLVHSF

SEQ ID NO: 188850 - protein, 11 aa, Artificial Sequence
  Description of Artificial Sequence: Synthetic peptide
  Seed: RNSRFSSWETV (TYRP2_HUMAN)
RISRFSSWETV

SEQ ID NO: 188851 - protein, 10 aa, Artificial Sequence
  Description of Artificial Sequence: Synthetic peptide
  Seed: ADTRPWSGPY (TYRP2_HUMAN)
AVTRPWSGPW

SEQ ID NO: 188852 - protein, 9 aa, Artificial Sequence
  Description of Artificial Sequence: Synthetic peptide
  Seed: HQGPAFVTW (TYRP2_HUMAN)
HSGPAFVTH

SEQ ID NO: 188853 - protein, 10 aa, Artificial Sequence
  Description of Artificial Sequence: Synthetic peptide
  Seed: LTSDQLGYSY (TYRP2_HUMAN)
LKSDQLGYSY

SEQ ID NO: 188854 - protein, 10 aa, Artificial Sequence
  Description of Artificial Sequence: Synthetic peptide
  Seed: RLIGNESFAL (TYRP2_HUMAN)
RMIGNESFAA

SEQ ID NO: 188855 - protein, 9 aa, Artificial Sequence
  Description of Artificial Sequence: Synthetic peptide
  Seed: LVTLCNGTY (TYRP2_HUMAN)
LATLCNGTW

SEQ ID NO: 188856 - protein, 8 aa, Artificial Sequence
  Description of Artificial Sequence: Synthetic peptide
  Seed: TFSFRNAL (TYRP2_HUMAN)
TFSFRNAM

SEQ ID NO: 188857 - protein, 11 aa, Artificial Sequence
  Description of Artificial Sequence: Synthetic peptide
  Seed: MYNMVPFFPPV (TYRP2_HUMAN)
MMNMVPFFPPM

SEQ ID NO: 188858 - protein, 10 aa, Artificial Sequence
  Description of Artificial Sequence: Synthetic peptide
  Seed: ETPGWPTTLL (TYRP2_HUMAN)
ETPGWPTTLW

SEQ ID NO: 188859 - protein, 10 aa, Artificial Sequence
  Description of Artificial Sequence: Synthetic peptide
  Seed: HLVTLCNGTY (TYRP2_HUMAN)
HMVTLCNGTF

SEQ ID NO: 188860 - protein, 11 aa, Artificial Sequence
  Description of Artificial Sequence: Synthetic peptide
  Seed: RNSRFSSWETV (TYRP2_HUMAN)
RNSRFSSWETF

SEQ ID NO: 188861 - protein, 10 aa, Artificial Sequence
  Description of Artificial Sequence: Synthetic peptide
  Seed: TTLLVVMGTL (TYRP2_HUMAN)
TTLLVVMGTV

SEQ ID NO: 188862 - protein, 10 aa, Artificial Sequence
  Description of Artificial Sequence: Synthetic peptide
  Seed: VVMGTLVALV (TYRP2_HUMAN)
VLMGTLVALG

SEQ ID NO: 188863 - protein, 10 aa, Artificial Sequence
  Description of Artificial Sequence: Synthetic peptide
  Seed: AANDPIFVVL (TYRP2_HUMAN)
ARNDPIFVVF

SEQ ID NO: 188864 - protein, 9 aa, Artificial Sequence
  Description of Artificial Sequence: Synthetic peptide
  Seed: TSDQLGYSY (TYRP2_HUMAN)
TIDQLGYSY

SEQ ID NO: 188865 - protein, 9 aa, Artificial Sequence
  Description of Artificial Sequence: Synthetic peptide
  Seed: VGLFVLLAF (TYRP2_HUMAN)
VLLFVLLAF

SEQ ID NO: 188866 - protein, 11 aa, Artificial Sequence
  Description of Artificial Sequence: Synthetic peptide
  Seed: WLHYYSVRDTL (TYRP2_HUMAN)
WWHYYSVRDTW

SEQ ID NO: 188867 - protein, 9 aa, Artificial Sequence
  Description of Artificial Sequence: Synthetic peptide
  Seed: YSYAIDLPV (TYRP2_HUMAN)
YSYAIDLPW

SEQ ID NO: 188868 - protein, 9 aa, Artificial Sequence
  Description of Artificial Sequence: Synthetic peptide
  Seed: FFPPVTNEE (TYRP2_HUMAN)
FWPPVTNEV

SEQ ID NO: 188869 - protein, 9 aa, Artificial Sequence
  Description of Artificial Sequence: Synthetic peptide
  Seed: VVMGTLVAL (TYRP2_HUMAN)
VPMGTLVAV

SEQ ID NO: 188870 - protein, 10 aa, Artificial Sequence
  Description of Artificial Sequence: Synthetic peptide
  Seed: HLVTLCNGTY (TYRP2_HUMAN)
HSVTLCNGTY

SEQ ID NO: 188871 - protein, 9 aa, Artificial Sequence
  Description of Artificial Sequence: Synthetic peptide
  Seed: VIRQNIHSL (TYRP2_HUMAN)
VFRQNIHSK

SEQ ID NO: 188872 - protein, 9 aa, Artificial Sequence
  Description of Artificial Sequence: Synthetic peptide
  Seed: DTRPWSGPY (TYRP2_HUMAN)
DARPWSGPR

SEQ ID NO: 188873 - protein, 10 aa, Artificial Sequence
  Description of Artificial Sequence: Synthetic peptide
  Seed: MGRNSMKLPT (TYRP2_HUMAN)
MTRNSMKLPG

SEQ ID NO: 188874 - protein, 10 aa, Artificial Sequence
  Description of Artificial Sequence: Synthetic peptide
  Seed: ETPGWPTTLL (TYRP2_HUMAN)
EIPGWPTTLW

SEQ ID NO: 188875 - protein, 10 aa, Artificial Sequence
  Description of Artificial Sequence: Synthetic peptide
  Seed: RNSMKLPTLK (TYRP2_HUMAN)
RDSMKLPTLK

SEQ ID NO: 188876 - protein, 8 aa, Artificial Sequence
  Description of Artificial Sequence: Synthetic peptide
  Seed: HNLVHSFL (TYRP2_HUMAN)
HQLVHSFL

SEQ ID NO: 188877 - protein, 11 aa, Artificial Sequence
  Description of Artificial Sequence: Synthetic peptide
  Seed: SLDDYNHLVTL (TYRP2_HUMAN)
SADDYNHLVTM

SEQ ID NO: 188878 - protein, 10 aa, Artificial Sequence
  Description of Artificial Sequence: Synthetic peptide
  Seed: RLRKGYTPLM (TYRP2_HUMAN)
RSRKGYTPLE

SEQ ID NO: 188879 - protein, 9 aa, Artificial Sequence
  Description of Artificial Sequence: Synthetic peptide
  Seed: SAANDPIFV (TYRP2_HUMAN)
SQANDPIFV

SEQ ID NO: 188880 - protein, 9 aa, Artificial Sequence
  Description of Artificial Sequence: Synthetic peptide
  Seed: VIRQNIHSL (TYRP2_HUMAN)
VLRQNIHSI

SEQ ID NO: 188881 - protein, 10 aa, Artificial Sequence
  Description of Artificial Sequence: Synthetic peptide
  Seed: YNMVPFFPPV (TYRP2_HUMAN)
YWMVPFFPPA

SEQ ID NO: 188882 - protein, 10 aa, Artificial Sequence
  Description of Artificial Sequence: Synthetic peptide
  Seed: GNESFALPYW (TYRP2_HUMAN)
GIESFALPYW

SEQ ID NO: 188883 - protein, 9 aa, Artificial Sequence
  Description of Artificial Sequence: Synthetic peptide
  Seed: TLVALVGLF (TYRP2_HUMAN)
TQVALVGLL

SEQ ID NO: 188884 - protein, 9 aa, Artificial Sequence
  Description of Artificial Sequence: Synthetic peptide
  Seed: VLHSFTDAI (TYRP2_HUMAN)
VIHSFTDAI

SEQ ID NO: 188885 - protein, 9 aa, Artificial Sequence
  Description of Artificial Sequence: Synthetic peptide
  Seed: RNSMKLPTL (TYRP2_HUMAN)
RTSMKLPTI

SEQ ID NO: 188886 - protein, 9 aa, Artificial Sequence
  Description of Artificial Sequence: Synthetic peptide
  Seed: RLRKGYTPL (TYRP2_HUMAN)
RSRKGYTPV

SEQ ID NO: 188887 - protein, 9 aa, Artificial Sequence
  Description of Artificial Sequence: Synthetic peptide
  Seed: DAIFDEWMK (TYRP2_HUMAN)
DVIFDEWMK

SEQ ID NO: 188888 - protein, 10 aa, Artificial Sequence
  Description of Artificial Sequence: Synthetic peptide
  Seed: FQNSTFSFRN (TYRP2_HUMAN)
FMNSTFSFRH

SEQ ID NO: 188889 - protein, 9 aa, Artificial Sequence
  Description of Artificial Sequence: Synthetic peptide
  Seed: GLFVLLAFL (TYRP2_HUMAN)
GAFVLLAFV

SEQ ID NO: 188890 - protein, 10 aa, Artificial Sequence
  Description of Artificial Sequence: Synthetic peptide
  Seed: FSFRNALEGF (TYRP2_HUMAN)
FAFRNALEGL

SEQ ID NO: 188891 - protein, 11 aa, Artificial Sequence
  Description of Artificial Sequence: Synthetic peptide
  Seed: MYNMVPFFPPV (TYRP2_HUMAN)
MMNMVPFFPPA

SEQ ID NO: 188892 - protein, 10 aa, Artificial Sequence
  Description of Artificial Sequence: Synthetic peptide
  Seed: QGPAFVTWHR (TYRP2_HUMAN)
QTPAFVTWHK

SEQ ID NO: 188893 - protein, 9 aa, Artificial Sequence
  Description of Artificial Sequence: Synthetic peptide
  Seed: ISRNSRFSS (TYRP2_HUMAN)
ITRNSRFSI

SEQ ID NO: 188894 - protein, 10 aa, Artificial Sequence
  Description of Artificial Sequence: Synthetic peptide
  Seed: RRLRKGYTPL (TYRP2_HUMAN)
RTLRKGYTPV

SEQ ID NO: 188895 - protein, 11 aa, Artificial Sequence
  Description of Artificial Sequence: Synthetic peptide
  Seed: TDAIFDEWMKR (TYRP2_HUMAN)
TVAIFDEWMKR

SEQ ID NO: 188896 - protein, 10 aa, Artificial Sequence
  Description of Artificial Sequence: Synthetic peptide
  Seed: GNESFALPYW (TYRP2_HUMAN)
GMESFALPYW

SEQ ID NO: 188897 - protein, 8 aa, Artificial Sequence
  Description of Artificial Sequence: Synthetic peptide
  Seed: FSHQGPAF (TYRP2_HUMAN)
FAHQGPAV

SEQ ID NO: 188898 - protein, 9 aa, Artificial Sequence
  Description of Artificial Sequence: Synthetic peptide
  Seed: SQVMSLHNL (TYRP2_HUMAN)
SIVMSLHNL

SEQ ID NO: 188899 - protein, 10 aa, Artificial Sequence
  Description of Artificial Sequence: Synthetic peptide
  Seed: SDQLGYSYAI (TYRP2_HUMAN)
SMQLGYSYAM

SEQ ID NO: 188900 - protein, 9 aa, Artificial Sequence
  Description of Artificial Sequence: Synthetic peptide
  Seed: ECDVCTDQL (TYRP2_HUMAN)
ETDVCTDQL

SEQ ID NO: 188901 - protein, 10 aa, Artificial Sequence
  Description of Artificial Sequence: Synthetic peptide
  Seed: FFVWLHYYSV (TYRP2_HUMAN)
FPVWLHYYSV

SEQ ID NO: 188902 - protein, 10 aa, Artificial Sequence
  Description of Artificial Sequence: Synthetic peptide
  Seed: SVYDFFVWLH (TYRP2_HUMAN)
SVYDFFVWLY

SEQ ID NO: 188903 - protein, 9 aa, Artificial Sequence
  Description of Artificial Sequence: Synthetic peptide
  Seed: VLHSFTDAI (TYRP2_HUMAN)
VEHSFTDAY

SEQ ID NO: 188904 - protein, 8 aa, Artificial Sequence
  Description of Artificial Sequence: Synthetic peptide
  Seed: AIDLPVSV (TYRP2_HUMAN)
AYDLPVSV

SEQ ID NO: 188905 - protein, 10 aa, Artificial Sequence
  Description of Artificial Sequence: Synthetic peptide
  Seed: LHYYSVRDTL (TYRP2_HUMAN)
LLYYSVRDTW

SEQ ID NO: 188906 - protein, 9 aa, Artificial Sequence
  Description of Artificial Sequence: Synthetic peptide
  Seed: LAFLQYRRL (TYRP2_HUMAN)
LTFLQYRRM

SEQ ID NO: 188907 - protein, 10 aa, Artificial Sequence
  Description of Artificial Sequence: Synthetic peptide
  Seed: RLIGNESFAL (TYRP2_HUMAN)
RKIGNESFAF

SEQ ID NO: 188908 - protein, 10 aa, Artificial Sequence
  Description of Artificial Sequence: Synthetic peptide
  Seed: SAANDPIFVV (TYRP2_HUMAN)
SMANDPIFVI

SEQ ID NO: 188909 - protein, 9 aa, Artificial Sequence
  Description of Artificial Sequence: Synthetic peptide
  Seed: VIRQNIHSL (TYRP2_HUMAN)
VIRQNIHSY

SEQ ID NO: 188910 - protein, 9 aa, Artificial Sequence
  Description of Artificial Sequence: Synthetic peptide
  Seed: ANDPIFVVL (TYRP2_HUMAN)
AGDPIFVVM

SEQ ID NO: 188911 - protein, 9 aa, Artificial Sequence
  Description of Artificial Sequence: Synthetic peptide
  Seed: RLRKGYTPL (TYRP2_HUMAN)
RVRKGYTPG

SEQ ID NO: 188912 - protein, 9 aa, Artificial Sequence
  Description of Artificial Sequence: Synthetic peptide
  Seed: IFDEWMKRF (TYRP2_HUMAN)
IIDEWMKRI

SEQ ID NO: 188913 - protein, 10 aa, Artificial Sequence
  Description of Artificial Sequence: Synthetic peptide
  Seed: FSFRNALEGF (TYRP2_HUMAN)
FAFRNALEGM

SEQ ID NO: 188914 - protein, 11 aa, Artificial Sequence
  Description of Artificial Sequence: Synthetic peptide
  Seed: FQNSTFSFRNA (TYRP2_HUMAN)
FMNSTFSFRNI

SEQ ID NO: 188915 - protein, 9 aa, Artificial Sequence
  Description of Artificial Sequence: Synthetic peptide
  Seed: FTDAIFDEW (TYRP2_HUMAN)
FSDAIFDEV

SEQ ID NO: 188916 - protein, 9 aa, Artificial Sequence
  Description of Artificial Sequence: Synthetic peptide
  Seed: VTWHRYHLL (TYRP2_HUMAN)
VLWHRYHLW

SEQ ID NO: 188917 - protein, 10 aa, Artificial Sequence
  Description of Artificial Sequence: Synthetic peptide
  Seed: CTDQLFGAAR (TYRP2_HUMAN)
CIDQLFGAAY

SEQ ID NO: 188918 - protein, 9 aa, Artificial Sequence
  Description of Artificial Sequence: Synthetic peptide
  Seed: DSLDDYNHL (TYRP2_HUMAN)
DTLDDYNHL

SEQ ID NO: 188919 - protein, 11 aa, Artificial Sequence
  Description of Artificial Sequence: Synthetic peptide
  Seed: YNMVPFFPPVT (TYRP2_HUMAN)
YMMVPFFPPVH

SEQ ID NO: 188920 - protein, 10 aa, Artificial Sequence
  Description of Artificial Sequence: Synthetic peptide
  Seed: FFVWLHYYSV (TYRP2_HUMAN)
FYVWLHYYSV

SEQ ID NO: 188921 - protein, 9 aa, Artificial Sequence
  Description of Artificial Sequence: Synthetic peptide
  Seed: SRNSRFSSW (TYRP2_HUMAN)
SQNSRFSSA

SEQ ID NO: 188922 - protein, 10 aa, Artificial Sequence
  Description of Artificial Sequence: Synthetic peptide
  Seed: SVYDFFVWLH (TYRP2_HUMAN)
SRYDFFVWLY

SEQ ID NO: 188923 - protein, 9 aa, Artificial Sequence
  Description of Artificial Sequence: Synthetic peptide
  Seed: DDYNHLVTL (TYRP2_HUMAN)
DDYNHLVTY

SEQ ID NO: 188924 - protein, 9 aa, Artificial Sequence
  Description of Artificial Sequence: Synthetic peptide
  Seed: FFQNSTFSF (TYRP2_HUMAN)
FTQNSTFSW

SEQ ID NO: 188925 - protein, 10 aa, Artificial Sequence
  Description of Artificial Sequence: Synthetic peptide
  Seed: FVWLHYYSVR (TYRP2_HUMAN)
FIWLHYYSVV

SEQ ID NO: 188926 - protein, 9 aa, Artificial Sequence
  Description of Artificial Sequence: Synthetic peptide
  Seed: LVALVGLFV (TYRP2_HUMAN)
LLALVGLFI

SEQ ID NO: 188927 - protein, 9 aa, Artificial Sequence
  Description of Artificial Sequence: Synthetic peptide
  Seed: TLDSQVMSL (TYRP2_HUMAN)
TIDSQVMSC

SEQ ID NO: 188928 - protein, 9 aa, Artificial Sequence
  Description of Artificial Sequence: Synthetic peptide
  Seed: HRYHLLCLE (TYRP2_HUMAN)
HRYHLLCLL

SEQ ID NO: 188929 - protein, 9 aa, Artificial Sequence
  Description of Artificial Sequence: Synthetic peptide
  Seed: VHPDYVITT (TYRP2_HUMAN)
VRPDYVITF

SEQ ID NO: 188930 - protein, 9 aa, Artificial Sequence
  Description of Artificial Sequence: Synthetic peptide
  Seed: LLSCLGCKI (TYRP2_HUMAN)
LMSCLGCKL

SEQ ID NO: 188931 - protein, 10 aa, Artificial Sequence
  Description of Artificial Sequence: Synthetic peptide
  Seed: REQFLGALDL (TYRP2_HUMAN)
RWQFLGALDM

SEQ ID NO: 188932 - protein, 9 aa, Artificial Sequence
  Description of Artificial Sequence: Synthetic peptide
  Seed: TLDSQVMSL (TYRP2_HUMAN)
TEDSQVMSV

SEQ ID NO: 188933 - protein, 10 aa, Artificial Sequence
  Description of Artificial Sequence: Synthetic peptide
  Seed: CMTVDSLVNK (TYRP2_HUMAN)
CPTVDSLVNK

SEQ ID NO: 188934 - protein, 10 aa, Artificial Sequence
  Description of Artificial Sequence: Synthetic peptide
  Seed: FTDAIFDEWM (TYRP2_HUMAN)
FTDAIFDEWY

SEQ ID NO: 188935 - protein, 10 aa, Artificial Sequence
  Description of Artificial Sequence: Synthetic peptide
  Seed: FVLLAFLQYR (TYRP2_HUMAN)
FDLLAFLQYR

SEQ ID NO: 188936 - protein, 9 aa, Artificial Sequence
  Description of Artificial Sequence: Synthetic peptide
  Seed: DTRPWSGPY (TYRP2_HUMAN)
DVRPWSGPF

SEQ ID NO: 188937 - protein, 10 aa, Artificial Sequence
  Description of Artificial Sequence: Synthetic peptide
  Seed: FFQNSTFSFR (TYRP2_HUMAN)
FYQNSTFSFQ

SEQ ID NO: 188938 - protein, 10 aa, Artificial Sequence
  Description of Artificial Sequence: Synthetic peptide
  Seed: HSFLNGTNAL (TYRP2_HUMAN)
HMFLNGTNAL

SEQ ID NO: 188939 - protein, 11 aa, Artificial Sequence
  Description of Artificial Sequence: Synthetic peptide
  Seed: SQVMSLHNLVH (TYRP2_HUMAN)
SKVMSLHNLVF

SEQ ID NO: 188940 - protein, 10 aa, Artificial Sequence
  Description of Artificial Sequence: Synthetic peptide
  Seed: RLRKGYTPLM (TYRP2_HUMAN)
RGRKGYTPLA

SEQ ID NO: 188941 - protein, 9 aa, Artificial Sequence
  Description of Artificial Sequence: Synthetic peptide
  Seed: ARPDDPTLI (TYRP2_HUMAN)
AQPDDPTLL

SEQ ID NO: 188942 - protein, 9 aa, Artificial Sequence
  Description of Artificial Sequence: Synthetic peptide
  Seed: RLRKGYTPL (TYRP2_HUMAN)
RRRKGYTPM

SEQ ID NO: 188943 - protein, 9 aa, Artificial Sequence
  Description of Artificial Sequence: Synthetic peptide
  Seed: RQNIHSLSP (TYRP2_HUMAN)
RRNIHSLSY

SEQ ID NO: 188944 - protein, 9 aa, Artificial Sequence
  Description of Artificial Sequence: Synthetic peptide
  Seed: NMVPFFPPV (TYRP2_HUMAN)
NLVPFFPPT

SEQ ID NO: 188945 - protein, 9 aa, Artificial Sequence
  Description of Artificial Sequence: Synthetic peptide
  Seed: SQVMSLHNL (TYRP2_HUMAN)
SQVMSLHNI

SEQ ID NO: 188946 - protein, 10 aa, Artificial Sequence
  Description of Artificial Sequence: Synthetic peptide
  Seed: FANCSVYDFF (TYRP2_HUMAN)
FANCSVYDFW

SEQ ID NO: 188947 - protein, 9 aa, Artificial Sequence
  Description of Artificial Sequence: Synthetic peptide
  Seed: VTNEELFLT (TYRP2_HUMAN)
VLNEELFLM

SEQ ID NO: 188948 - protein, 10 aa, Artificial Sequence
  Description of Artificial Sequence: Synthetic peptide
  Seed: SPLWWGFLLS (TYRP2_HUMAN)
SNLWWGFLLA

SEQ ID NO: 188949 - protein, 10 aa, Artificial Sequence
  Description of Artificial Sequence: Synthetic peptide
  Seed: GTLDSQVMSL (TYRP2_HUMAN)
GTLDSQVMSR

SEQ ID NO: 188950 - protein, 10 aa, Artificial Sequence
  Description of Artificial Sequence: Synthetic peptide
  Seed: SDQLGYSYAI (TYRP2_HUMAN)
SCQLGYSYAV

SEQ ID NO: 188951 - protein, 10 aa, Artificial Sequence
  Description of Artificial Sequence: Synthetic peptide
  Seed: FQNSTFSFRN (TYRP2_HUMAN)
FINSTFSFRR

SEQ ID NO: 188952 - protein, 10 aa, Artificial Sequence
  Description of Artificial Sequence: Synthetic peptide
  Seed: VVMGTLVALV (TYRP2_HUMAN)
VRMGTLVALV

SEQ ID NO: 188953 - protein, 9 aa, Artificial Sequence
  Description of Artificial Sequence: Synthetic peptide
  Seed: FTDAIFDEW (TYRP2_HUMAN)
FQDAIFDEF

SEQ ID NO: 188954 - protein, 9 aa, Artificial Sequence
  Description of Artificial Sequence: Synthetic peptide
  Seed: IDFSHQGPA (TYRP2_HUMAN)
IEFSHQGPV

SEQ ID NO: 188955 - protein, 10 aa, Artificial Sequence
  Description of Artificial Sequence: Synthetic peptide
  Seed: FGWTGPNCER (TYRP2_HUMAN)
FMWTGPNCER

SEQ ID NO: 188956 - protein, 9 aa, Artificial Sequence
  Description of Artificial Sequence: Synthetic peptide
  Seed: RLIGNESFA (TYRP2_HUMAN)
RLIGNESFV

SEQ ID NO: 188957 - protein, 9 aa, Artificial Sequence
  Description of Artificial Sequence: Synthetic peptide
  Seed: ALVGLFVLL (TYRP2_HUMAN)
AMVGLFVLF

SEQ ID NO: 188958 - protein, 9 aa, Artificial Sequence
  Description of Artificial Sequence: Synthetic peptide
  Seed: TLDSQVMSL (TYRP2_HUMAN)
TMDSQVMSY

SEQ ID NO: 188959 - protein, 10 aa, Artificial Sequence
  Description of Artificial Sequence: Synthetic peptide
  Seed: YAIDLPVSVE (TYRP2_HUMAN)
YMIDLPVSVN

SEQ ID NO: 188960 - protein, 10 aa, Artificial Sequence
  Description of Artificial Sequence: Synthetic peptide
  Seed: ELAPIGHNRM (TYRP2_HUMAN)
EAAPIGHNRR

SEQ ID NO: 188961 - protein, 9 aa, Artificial Sequence
  Description of Artificial Sequence: Synthetic peptide
  Seed: AANDPIFVV (TYRP2_HUMAN)
ATNDPIFVF

SEQ ID NO: 188962 - protein, 9 aa, Artificial Sequence
  Description of Artificial Sequence: Synthetic peptide
  Seed: TLDSQVMSL (TYRP2_HUMAN)
TLDSQVMSC

SEQ ID NO: 188963 - protein, 10 aa, Artificial Sequence
  Description of Artificial Sequence: Synthetic peptide
  Seed: RMYNMVPFFP (TYRP2_HUMAN)
RAYNMVPFFF

SEQ ID NO: 188964 - protein, 10 aa, Artificial Sequence
  Description of Artificial Sequence: Synthetic peptide
  Seed: SHQGPAFVTW (TYRP2_HUMAN)
SQQGPAFVTI

SEQ ID NO: 188965 - protein, 11 aa, Artificial Sequence
  Description of Artificial Sequence: Synthetic peptide
  Seed: FVVLHSFTDAI (TYRP2_HUMAN)
FKVLHSFTDAL

SEQ ID NO: 188966 - protein, 9 aa, Artificial Sequence
  Description of Artificial Sequence: Synthetic peptide
  Seed: FFQNSTFSF (TYRP2_HUMAN)
FWQNSTFSF

SEQ ID NO: 188967 - protein, 9 aa, Artificial Sequence
  Description of Artificial Sequence: Synthetic peptide
  Seed: VWLHYYSVR (TYRP2_HUMAN)
VFLHYYSVR

SEQ ID NO: 188968 - protein, 9 aa, Artificial Sequence
  Description of Artificial Sequence: Synthetic peptide
  Seed: SVYDFFVWL (TYRP2_HUMAN)
SAYDFFVWK

SEQ ID NO: 188969 - protein, 9 aa, Artificial Sequence
  Description of Artificial Sequence: Synthetic peptide
  Seed: GTLVALVGL (TYRP2_HUMAN)
GQLVALVGL

SEQ ID NO: 188970 - protein, 10 aa, Artificial Sequence
  Description of Artificial Sequence: Synthetic peptide
  Seed: RNSRFSSWET (TYRP2_HUMAN)
RLSRFSSWEM

SEQ ID NO: 188971 - protein, 9 aa, Artificial Sequence
  Description of Artificial Sequence: Synthetic peptide
  Seed: RQNIHSLSP (TYRP2_HUMAN)
RQNIHSLSH

SEQ ID NO: 188972 - protein, 9 aa, Artificial Sequence
  Description of Artificial Sequence: Synthetic peptide
  Seed: NSMKLPTLK (TYRP2_HUMAN)
NGMKLPTLR

SEQ ID NO: 188973 - protein, 9 aa, Artificial Sequence
  Description of Artificial Sequence: Synthetic peptide
  Seed: VTWHRYHLL (TYRP2_HUMAN)
VLWHRYHLK

SEQ ID NO: 188974 - protein, 10 aa, Artificial Sequence
  Description of Artificial Sequence: Synthetic peptide
  Seed: YDFFVWLHYY (TYRP2_HUMAN)
YAFFVWLHYF

SEQ ID NO: 188975 - protein, 9 aa, Artificial Sequence
  Description of Artificial Sequence: Synthetic peptide
  Seed: DSLDDYNHL (TYRP2_HUMAN)
DMLDDYNHR

SEQ ID NO: 188976 - protein, 9 aa, Artificial Sequence
  Description of Artificial Sequence: Synthetic peptide
  Seed: SWETVCDSL (TYRP2_HUMAN)
SAETVCDSL

SEQ ID NO: 188977 - protein, 9 aa, Artificial Sequence
  Description of Artificial Sequence: Synthetic peptide
  Seed: LRKGYTPLM (TYRP2_HUMAN)
LRKGYTPLL

SEQ ID NO: 188978 - protein, 8 aa, Artificial Sequence
  Description of Artificial Sequence: Synthetic peptide
  Seed: YYSVRDTL (TYRP2_HUMAN)
YFSVRDTL

SEQ ID NO: 188979 - protein, 10 aa, Artificial Sequence
  Description of Artificial Sequence: Synthetic peptide
  Seed: YNMVPFFPPV (TYRP2_HUMAN)
YSMVPFFPPM

SEQ ID NO: 188980 - protein, 9 aa, Artificial Sequence
  Description of Artificial Sequence: Synthetic peptide
  Seed: HQGPAFVTW (TYRP2_HUMAN)
HHGPAFVTW

SEQ ID NO: 188981 - protein, 10 aa, Artificial Sequence
  Description of Artificial Sequence: Synthetic peptide
  Seed: AIFDEWMKRF (TYRP2_HUMAN)
ASFDEWMKRY

SEQ ID NO: 188982 - protein, 9 aa, Artificial Sequence
  Description of Artificial Sequence: Synthetic peptide
  Seed: ETPGWPTTL (TYRP2_HUMAN)
EMPGWPTTM

SEQ ID NO: 188983 - protein, 9 aa, Artificial Sequence
  Description of Artificial Sequence: Synthetic peptide
  Seed: FTDAIFDEW (TYRP2_HUMAN)
FIDAIFDEV

SEQ ID NO: 188984 - protein, 9 aa, Artificial Sequence
  Description of Artificial Sequence: Synthetic peptide
  Seed: VALVGLFVL (TYRP2_HUMAN)
VQLVGLFVV

SEQ ID NO: 188985 - protein, 9 aa, Artificial Sequence
  Description of Artificial Sequence: Synthetic peptide
  Seed: RNQDDRELW (TYRP2_HUMAN)
RAQDDRELF

SEQ ID NO: 188986 - protein, 11 aa, Artificial Sequence
  Description of Artificial Sequence: Synthetic peptide
  Seed: VMSLHNLVHSF (TYRP2_HUMAN)
VSSLHNLVHSW

SEQ ID NO: 188987 - protein, 9 aa, Artificial Sequence
  Description of Artificial Sequence: Synthetic peptide
  Seed: QPQFANCSV (TYRP2_HUMAN)
QPQFANCSI

SEQ ID NO: 188988 - protein, 9 aa, Artificial Sequence
  Description of Artificial Sequence: Synthetic peptide
  Seed: AARPDDPTL (TYRP2_HUMAN)
AQRPDDPTI

SEQ ID NO: 188989 - protein, 10 aa, Artificial Sequence
  Description of Artificial Sequence: Synthetic peptide
  Seed: AARPDDPTLI (TYRP2_HUMAN)
AVRPDDPTLF

SEQ ID NO: 188990 - protein, 11 aa, Artificial Sequence
  Description of Artificial Sequence: Synthetic peptide
  Seed: LLVVMGTLVAL (TYRP2_HUMAN)
LTVVMGTLVAV

SEQ ID NO: 188991 - protein, 9 aa, Artificial Sequence
  Description of Artificial Sequence: Synthetic peptide
  Seed: SLDDYNHLV (TYRP2_HUMAN)
SGDDYNHLI

SEQ ID NO: 188992 - protein, 10 aa, Artificial Sequence
  Description of Artificial Sequence: Synthetic peptide
  Seed: FFVWLHYYSV (TYRP2_HUMAN)
FSVWLHYYSV

SEQ ID NO: 188993 - protein, 10 aa, Artificial Sequence
  Description of Artificial Sequence: Synthetic peptide
  Seed: RMYNMVPFFP (TYRP2_HUMAN)
RVYNMVPFFY

SEQ ID NO: 188994 - protein, 9 aa, Artificial Sequence
  Description of Artificial Sequence: Synthetic peptide
  Seed: TLDSQVMSL (TYRP2_HUMAN)
THDSQVMSI

SEQ ID NO: 188995 - protein, 9 aa, Artificial Sequence
  Description of Artificial Sequence: Synthetic peptide
  Seed: RQNIHSLSP (TYRP2_HUMAN)
RNNIHSLSM

SEQ ID NO: 188996 - protein, 9 aa, Artificial Sequence
  Description of Artificial Sequence: Synthetic peptide
  Seed: FFQNSTFSF (TYRP2_HUMAN)
FPQNSTFSI

SEQ ID NO: 188997 - protein, 10 aa, Artificial Sequence
  Description of Artificial Sequence: Synthetic peptide
  Seed: FLTSDQLGYS (TYRP2_HUMAN)
FITSDQLGYA

SEQ ID NO: 188998 - protein, 11 aa, Artificial Sequence
  Description of Artificial Sequence: Synthetic peptide
  Seed: RNSRFSSWETV (TYRP2_HUMAN)
RKSRFSSWETM

SEQ ID NO: 188999 - protein, 9 aa, Artificial Sequence
  Description of Artificial Sequence: Synthetic peptide
  Seed: YAIDLPVSV (TYRP2_HUMAN)
YAIDLPVSC

SEQ ID NO: 189000 - protein, 9 aa, Artificial Sequence
  Description of Artificial Sequence: Synthetic peptide
  Seed: SLHNLVHSF (TYRP2_HUMAN)
SWHNLVHSM

SEQ ID NO: 189001 - protein, 9 aa, Artificial Sequence
  Description of Artificial Sequence: Synthetic peptide
  Seed: AARPDDPTL (TYRP2_HUMAN)
ASRPDDPTW

SEQ ID NO: 189002 - protein, 10 aa, Artificial Sequence
  Description of Artificial Sequence: Synthetic peptide
  Seed: TVDSLVNKEC (TYRP2_HUMAN)
TSDSLVNKEL

SEQ ID NO: 189003 - protein, 10 aa, Artificial Sequence
  Description of Artificial Sequence: Synthetic peptide
  Seed: TRPWSGPYIL (TYRP2_HUMAN)
TRPWSGPYIV

SEQ ID NO: 189004 - protein, 9 aa, Artificial Sequence
  Description of Artificial Sequence: Synthetic peptide
  Seed: VIRQNIHSL (TYRP2_HUMAN)
VYRQNIHSM

SEQ ID NO: 189005 - protein, 10 aa, Artificial Sequence
  Description of Artificial Sequence: Synthetic peptide
  Seed: REQFLGALDL (TYRP2_HUMAN)
RGQFLGALDY

SEQ ID NO: 189006 - protein, 10 aa, Artificial Sequence
  Description of Artificial Sequence: Synthetic peptide
  Seed: NSTFSFRNAL (TYRP2_HUMAN)
NDTFSFRNAL

SEQ ID NO: 189007 - protein, 11 aa, Artificial Sequence
  Description of Artificial Sequence: Synthetic peptide
  Seed: YVITTQHWLGL (TYRP2_HUMAN)
YMITTQHWLGV

SEQ ID NO: 189008 - protein, 9 aa, Artificial Sequence
  Description of Artificial Sequence: Synthetic peptide
  Seed: FFPPVTNEE (TYRP2_HUMAN)
FYPPVTNEW

SEQ ID NO: 189009 - protein, 10 aa, Artificial Sequence
  Description of Artificial Sequence: Synthetic peptide
  Seed: LGPNGTQPQF (TYRP2_HUMAN)
LTPNGTQPQF

SEQ ID NO: 189010 - protein, 10 aa, Artificial Sequence
  Description of Artificial Sequence: Synthetic peptide
  Seed: MSLHNLVHSF (TYRP2_HUMAN)
MRLHNLVHSY

SEQ ID NO: 189011 - protein, 11 aa, Artificial Sequence
  Description of Artificial Sequence: Synthetic peptide
  Seed: HQGPAFVTWHR (TYRP2_HUMAN)
HIGPAFVTWHR

SEQ ID NO: 189012 - protein, 9 aa, Artificial Sequence
  Description of Artificial Sequence: Synthetic peptide
  Seed: TPGWPTTLL (TYRP2_HUMAN)
TAGWPTTLY

SEQ ID NO: 189013 - protein, 10 aa, Artificial Sequence
  Description of Artificial Sequence: Synthetic peptide
  Seed: VLLAFLQYRR (TYRP2_HUMAN)
VNLAFLQYRR

SEQ ID NO: 189014 - protein, 11 aa, Artificial Sequence
  Description of Artificial Sequence: Synthetic peptide
  Seed: QFLGALDLAKK (TYRP2_HUMAN)
QALGALDLAKK

SEQ ID NO: 189015 - protein, 9 aa, Artificial Sequence
  Description of Artificial Sequence: Synthetic peptide
  Seed: TLDSQVMSL (TYRP2_HUMAN)
TADSQVMSW

SEQ ID NO: 189016 - protein, 11 aa, Artificial Sequence
  Description of Artificial Sequence: Synthetic peptide
  Seed: VCDSLDDYNHL (TYRP2_HUMAN)
VTDSLDDYNHL

SEQ ID NO: 189017 - protein, 8 aa, Artificial Sequence
  Description of Artificial Sequence: Synthetic peptide
  Seed: KFDNPPFF (TYRP2_HUMAN)
KADNPPFM

SEQ ID NO: 189018 - protein, 10 aa, Artificial Sequence
  Description of Artificial Sequence: Synthetic peptide
  Seed: NMVPFFPPVT (TYRP2_HUMAN)
NLVPFFPPVA

SEQ ID NO: 189019 - protein, 9 aa, Artificial Sequence
  Description of Artificial Sequence: Synthetic peptide
  Seed: SVYDFFVWL (TYRP2_HUMAN)
SSYDFFVWY

SEQ ID NO: 189020 - protein, 9 aa, Artificial Sequence
  Description of Artificial Sequence: Synthetic peptide
  Seed: WHRYHLLCL (TYRP2_HUMAN)
WQRYHLLCI

SEQ ID NO: 189021 - protein, 9 aa, Artificial Sequence
  Description of Artificial Sequence: Synthetic peptide
  Seed: VVMGTLVAL (TYRP2_HUMAN)
VYMGTLVAI

SEQ ID NO: 189022 - protein, 10 aa, Artificial Sequence
  Description of Artificial Sequence: Synthetic peptide
  Seed: DTLLGPGRPY (TYRP2_HUMAN)
DVLLGPGRPR

SEQ ID NO: 189023 - protein, 9 aa, Artificial Sequence
  Description of Artificial Sequence: Synthetic peptide
  Seed: IFDEWMKRF (TYRP2_HUMAN)
ILDEWMKRY

SEQ ID NO: 189024 - protein, 9 aa, Artificial Sequence
  Description of Artificial Sequence: Synthetic peptide
  Seed: HYYSVRDTL (TYRP2_HUMAN)
HFYSVRDTF

SEQ ID NO: 189025 - protein, 9 aa, Artificial Sequence
  Description of Artificial Sequence: Synthetic peptide
  Seed: PADAWPQEL (TYRP2_HUMAN)
PSDAWPQEL

SEQ ID NO: 189026 - protein, 10 aa, Artificial Sequence
  Description of Artificial Sequence: Synthetic peptide
  Seed: FLTSDQLGYS (TYRP2_HUMAN)
FRTSDQLGYV

SEQ ID NO: 189027 - protein, 8 aa, Artificial Sequence
  Description of Artificial Sequence: Synthetic peptide
  Seed: ADAWPQEL (TYRP2_HUMAN)
AEAWPQEA

SEQ ID NO: 189028 - protein, 9 aa, Artificial Sequence
  Description of Artificial Sequence: Synthetic peptide
  Seed: RAIDFSHQG (TYRP2_HUMAN)
RVIDFSHQY

SEQ ID NO: 189029 - protein, 9 aa, Artificial Sequence
  Description of Artificial Sequence: Synthetic peptide
  Seed: TLDSQVMSL (TYRP2_HUMAN)
TNDSQVMSY

SEQ ID NO: 189030 - protein, 10 aa, Artificial Sequence
  Description of Artificial Sequence: Synthetic peptide
  Seed: LVVMGTLVAL (TYRP2_HUMAN)
LCVMGTLVAF

SEQ ID NO: 189031 - protein, 10 aa, Artificial Sequence
  Description of Artificial Sequence: Synthetic peptide
  Seed: NSTFSFRNAL (TYRP2_HUMAN)
NMTFSFRNAL

SEQ ID NO: 189032 - protein, 9 aa, Artificial Sequence
  Description of Artificial Sequence: Synthetic peptide
  Seed: WMKRFNPPA (TYRP2_HUMAN)
WSKRFNPPA

SEQ ID NO: 189033 - protein, 9 aa, Artificial Sequence
  Description of Artificial Sequence: Synthetic peptide
  Seed: AIFDEWMKR (TYRP2_HUMAN)
AMFDEWMKR

SEQ ID NO: 189034 - protein, 10 aa, Artificial Sequence
  Description of Artificial Sequence: Synthetic peptide
  Seed: MSLHNLVHSF (TYRP2_HUMAN)
MQLHNLVHSF

SEQ ID NO: 189035 - protein, 9 aa, Artificial Sequence
  Description of Artificial Sequence: Synthetic peptide
  Seed: RNSMKLPTL (TYRP2_HUMAN)
RLSMKLPTL

SEQ ID NO: 189036 - protein, 9 aa, Artificial Sequence
  Description of Artificial Sequence: Synthetic peptide
  Seed: SVRDTLLGP (TYRP2_HUMAN)
SFRDTLLGK

SEQ ID NO: 189037 - protein, 9 aa, Artificial Sequence
  Description of Artificial Sequence: Synthetic peptide
  Seed: IFDEWMKRF (TYRP2_HUMAN)
IWDEWMKRI

SEQ ID NO: 189038 - protein, 8 aa, Artificial Sequence
  Description of Artificial Sequence: Synthetic peptide
  Seed: AIDLPVSV (TYRP2_HUMAN)
AWDLPVSI

SEQ ID NO: 189039 - protein, 9 aa, Artificial Sequence
  Description of Artificial Sequence: Synthetic peptide
  Seed: FQNSTFSFR (TYRP2_HUMAN)
FANSTFSFY

SEQ ID NO: 189040 - protein, 10 aa, Artificial Sequence
  Description of Artificial Sequence: Synthetic peptide
  Seed: REQFLGALDL (TYRP2_HUMAN)
RKQFLGALDM

SEQ ID NO: 189041 - protein, 9 aa, Artificial Sequence
  Description of Artificial Sequence: Synthetic peptide
  Seed: RLRKGYTPL (TYRP2_HUMAN)
RYRKGYTPA

SEQ ID NO: 189042 - protein, 9 aa, Artificial Sequence
  Description of Artificial Sequence: Synthetic peptide
  Seed: SFLNGTNAL (TYRP2_HUMAN)
SMLNGTNAL

SEQ ID NO: 189043 - protein, 11 aa, Artificial Sequence
  Description of Artificial Sequence: Synthetic peptide
  Seed: ARPDDPTLISR (TYRP2_HUMAN)
ARPDDPTLISL

SEQ ID NO: 189044 - protein, 9 aa, Artificial Sequence
  Description of Artificial Sequence: Synthetic peptide
  Seed: LVALVGLFV (TYRP2_HUMAN)
LLALVGLFM

SEQ ID NO: 189045 - protein, 9 aa, Artificial Sequence
  Description of Artificial Sequence: Synthetic peptide
  Seed: FFQNSTFSF (TYRP2_HUMAN)
FPQNSTFSH

SEQ ID NO: 189046 - protein, 9 aa, Artificial Sequence
  Description of Artificial Sequence: Synthetic peptide
  Seed: LVHSFLNGT (TYRP2_HUMAN)
LIHSFLNGL

SEQ ID NO: 189047 - protein, 9 aa, Artificial Sequence
  Description of Artificial Sequence: Synthetic peptide
  Seed: MVPFFPPVT (TYRP2_HUMAN)
MVPFFPPVI

SEQ ID NO: 189048 - protein, 10 aa, Artificial Sequence
  Description of Artificial Sequence: Synthetic peptide
  Seed: TLVALVGLFV (TYRP2_HUMAN)
TIVALVGLFV

SEQ ID NO: 189049 - protein, 10 aa, Artificial Sequence
  Description of Artificial Sequence: Synthetic peptide
  Seed: FSFRNALEGF (TYRP2_HUMAN)
FYFRNALEGI

SEQ ID NO: 189050 - protein, 9 aa, Artificial Sequence
  Description of Artificial Sequence: Synthetic peptide
  Seed: RNQMGRNSM (TYRP2_HUMAN)
RRQMGRNSF

SEQ ID NO: 189051 - protein, 9 aa, Artificial Sequence
  Description of Artificial Sequence: Synthetic peptide
  Seed: RTCKCTGNF (TYRP2_HUMAN)
RICKCTGNY

SEQ ID NO: 189052 - protein, 10 aa, Artificial Sequence
  Description of Artificial Sequence: Synthetic peptide
  Seed: RLRKGYTPLM (TYRP2_HUMAN)
RARKGYTPLL

SEQ ID NO: 189053 - protein, 10 aa, Artificial Sequence
  Description of Artificial Sequence: Synthetic peptide
  Seed: RLRKGYTPLM (TYRP2_HUMAN)
RVRKGYTPLE

SEQ ID NO: 189054 - protein, 9 aa, Artificial Sequence
  Description of Artificial Sequence: Synthetic peptide
  Seed: AARPDDPTL (TYRP2_HUMAN)
APRPDDPTV

SEQ ID NO: 189055 - protein, 9 aa, Artificial Sequence
  Description of Artificial Sequence: Synthetic peptide
  Seed: NSMKLPTLK (TYRP2_HUMAN)
NLMKLPTLK

SEQ ID NO: 189056 - protein, 10 aa, Artificial Sequence
  Description of Artificial Sequence: Synthetic peptide
  Seed: DIRDCLSLQK (TYRP2_HUMAN)
DIRDCLSLQR

SEQ ID NO: 189057 - protein, 9 aa, Artificial Sequence
  Description of Artificial Sequence: Synthetic peptide
  Seed: RLRKGYTPL (TYRP2_HUMAN)
RYRKGYTPQ

SEQ ID NO: 189058 - protein, 9 aa, Artificial Sequence
  Description of Artificial Sequence: Synthetic peptide
  Seed: TSDQLGYSY (TYRP2_HUMAN)
TFDQLGYSI

SEQ ID NO: 189059 - protein, 11 aa, Artificial Sequence
  Description of Artificial Sequence: Synthetic peptide
  Seed: RADTRPWSGPY (TYRP2_HUMAN)
RVDTRPWSGPY

SEQ ID NO: 189060 - protein, 9 aa, Artificial Sequence
  Description of Artificial Sequence: Synthetic peptide
  Seed: SRNSRFSSW (TYRP2_HUMAN)
SVNSRFSSF

SEQ ID NO: 189061 - protein, 9 aa, Artificial Sequence
  Description of Artificial Sequence: Synthetic peptide
  Seed: GTYEGLLRR (TYRP2_HUMAN)
GAYEGLLRY

SEQ ID NO: 189062 - protein, 9 aa, Artificial Sequence
  Description of Artificial Sequence: Synthetic peptide
  Seed: VHPDYVITT (TYRP2_HUMAN)
VRPDYVITI

SEQ ID NO: 189063 - protein, 10 aa, Artificial Sequence
  Description of Artificial Sequence: Synthetic peptide
  Seed: RTCKCTGNFA (TYRP2_HUMAN)
RSCKCTGNFA

SEQ ID NO: 189064 - protein, 10 aa, Artificial Sequence
  Description of Artificial Sequence: Synthetic peptide
  Seed: CCPRLGAESA (TYRP2_HUMAN)
CCPRLGAESM

SEQ ID NO: 189065 - protein, 10 aa, Artificial Sequence
  Description of Artificial Sequence: Synthetic peptide
  Seed: MSPLWWGFLL (TYRP2_HUMAN)
MKPLWWGFLW

SEQ ID NO: 189066 - protein, 9 aa, Artificial Sequence
  Description of Artificial Sequence: Synthetic peptide
  Seed: STFSFRNAL (TYRP2_HUMAN)
SMFSFRNAL

SEQ ID NO: 189067 - protein, 10 aa, Artificial Sequence
  Description of Artificial Sequence: Synthetic peptide
  Seed: ITTQHWLGLL (TYRP2_HUMAN)
IATQHWLGLY

SEQ ID NO: 189068 - protein, 9 aa, Artificial Sequence
  Description of Artificial Sequence: Synthetic peptide
  Seed: HQGPAFVTW (TYRP2_HUMAN)
HFGPAFVTM

SEQ ID NO: 189069 - protein, 9 aa, Artificial Sequence
  Description of Artificial Sequence: Synthetic peptide
  Seed: TTQHWLGLL (TYRP2_HUMAN)
TQQHWLGLV

SEQ ID NO: 189070 - protein, 10 aa, Artificial Sequence
  Description of Artificial Sequence: Synthetic peptide
  Seed: LQKFDNPPFF (TYRP2_HUMAN)
LRKFDNPPFF

SEQ ID NO: 189071 - protein, 9 aa, Artificial Sequence
  Description of Artificial Sequence: Synthetic peptide
  Seed: QKFDNPPFF (TYRP2_HUMAN)
QHFDNPPFV

SEQ ID NO: 189072 - protein, 10 aa, Artificial Sequence
  Description of Artificial Sequence: Synthetic peptide
  Seed: YNMVPFFPPV (TYRP2_HUMAN)
YKMVPFFPPA

SEQ ID NO: 189073 - protein, 9 aa, Artificial Sequence
  Description of Artificial Sequence: Synthetic peptide
  Seed: RLRKGYTPL (TYRP2_HUMAN)
RVRKGYTPV

SEQ ID NO: 189074 - protein, 11 aa, Artificial Sequence
  Description of Artificial Sequence: Synthetic peptide
  Seed: RRLRKGYTPLM (TYRP2_HUMAN)
RRLRKGYTPLK

SEQ ID NO: 189075 - protein, 10 aa, Artificial Sequence
  Description of Artificial Sequence: Synthetic peptide
  Seed: RTCKCTGNFA (TYRP2_HUMAN)
RYCKCTGNFK

SEQ ID NO: 189076 - protein, 10 aa, Artificial Sequence
  Description of Artificial Sequence: Synthetic peptide
  Seed: YNMVPFFPPV (TYRP2_HUMAN)
YDMVPFFPPT

SEQ ID NO: 189077 - protein, 10 aa, Artificial Sequence
  Description of Artificial Sequence: Synthetic peptide
  Seed: RRLRKGYTPL (TYRP2_HUMAN)
RTLRKGYTPF

SEQ ID NO: 189078 - protein, 10 aa, Artificial Sequence
  Description of Artificial Sequence: Synthetic peptide
  Seed: DSLDDYNHLV (TYRP2_HUMAN)
DTLDDYNHLL

SEQ ID NO: 189079 - protein, 10 aa, Artificial Sequence
  Description of Artificial Sequence: Synthetic peptide
  Seed: KRFNPPADAW (TYRP2_HUMAN)
KQFNPPADAI

SEQ ID NO: 189080 - protein, 9 aa, Artificial Sequence
  Description of Artificial Sequence: Synthetic peptide
  Seed: RVCMTVDSL (TYRP2_HUMAN)
RVCMTVDSV

SEQ ID NO: 189081 - protein, 9 aa, Artificial Sequence
  Description of Artificial Sequence: Synthetic peptide
  Seed: SRFSSWETV (TYRP2_HUMAN)
SHFSSWETL

SEQ ID NO: 189082 - protein, 9 aa, Artificial Sequence
  Description of Artificial Sequence: Synthetic peptide
  Seed: YDFFVWLHY (TYRP2_HUMAN)
YEFFVWLHF

SEQ ID NO: 189083 - protein, 10 aa, Artificial Sequence
  Description of Artificial Sequence: Synthetic peptide
  Seed: VVMGTLVALV (TYRP2_HUMAN)
VSMGTLVALV

SEQ ID NO: 189084 - protein, 11 aa, Artificial Sequence
  Description of Artificial Sequence: Synthetic peptide
  Seed: RELWPRKFFHR (TYRP2_HUMAN)
RWLWPRKFFHR

SEQ ID NO: 189085 - protein, 9 aa, Artificial Sequence
  Description of Artificial Sequence: Synthetic peptide
  Seed: FTDAIFDEW (TYRP2_HUMAN)
FSDAIFDEY

SEQ ID NO: 189086 - protein, 9 aa, Artificial Sequence
  Description of Artificial Sequence: Synthetic peptide
  Seed: YVITTQHWL (TYRP2_HUMAN)
YQITTQHWI

SEQ ID NO: 189087 - protein, 11 aa, Artificial Sequence
  Description of Artificial Sequence: Synthetic peptide
  Seed: VVMGTLVALVG (TYRP2_HUMAN)
VVMGTLVALVV

SEQ ID NO: 189088 - protein, 10 aa, Artificial Sequence
  Description of Artificial Sequence: Synthetic peptide
  Seed: NSRFSSWETV (TYRP2_HUMAN)
NDRFSSWETL

SEQ ID NO: 189089 - protein, 9 aa, Artificial Sequence
  Description of Artificial Sequence: Synthetic peptide
  Seed: ANDPIFVVL (TYRP2_HUMAN)
ARDPIFVVM

SEQ ID NO: 189090 - protein, 10 aa, Artificial Sequence
  Description of Artificial Sequence: Synthetic peptide
  Seed: ADTRPWSGPY (TYRP2_HUMAN)
AGTRPWSGPK

SEQ ID NO: 189091 - protein, 10 aa, Artificial Sequence
  Description of Artificial Sequence: Synthetic peptide
  Seed: SVYDFFVWLH (TYRP2_HUMAN)
SNYDFFVWLR

SEQ ID NO: 189092 - protein, 9 aa, Artificial Sequence
  Description of Artificial Sequence: Synthetic peptide
  Seed: TLKDIRDCL (TYRP2_HUMAN)
TAKDIRDCF

SEQ ID NO: 189093 - protein, 10 aa, Artificial Sequence
  Description of Artificial Sequence: Synthetic peptide
  Seed: YNMVPFFPPV (TYRP2_HUMAN)
YNMVPFFPPM

SEQ ID NO: 189094 - protein, 9 aa, Artificial Sequence
  Description of Artificial Sequence: Synthetic peptide
  Seed: AANDPIFVV (TYRP2_HUMAN)
ASNDPIFVL

SEQ ID NO: 189095 - protein, 9 aa, Artificial Sequence
  Description of Artificial Sequence: Synthetic peptide
  Seed: MSPLWWGFL (TYRP2_HUMAN)
MWPLWWGFW

SEQ ID NO: 189096 - protein, 9 aa, Artificial Sequence
  Description of Artificial Sequence: Synthetic peptide
  Seed: MVPFFPPVT (TYRP2_HUMAN)
MIPFFPPVV

SEQ ID NO: 189097 - protein, 9 aa, Artificial Sequence
  Description of Artificial Sequence: Synthetic peptide
  Seed: ELWPRKFFH (TYRP2_HUMAN)
ELWPRKFFR

SEQ ID NO: 189098 - protein, 10 aa, Artificial Sequence
  Description of Artificial Sequence: Synthetic peptide
  Seed: MSPLWWGFLL (TYRP2_HUMAN)
MTPLWWGFLM

SEQ ID NO: 189099 - protein, 10 aa, Artificial Sequence
  Description of Artificial Sequence: Synthetic peptide
  Seed: NSTFSFRNAL (TYRP2_HUMAN)
NFTFSFRNAV

SEQ ID NO: 189100 - protein, 10 aa, Artificial Sequence
  Description of Artificial Sequence: Synthetic peptide
  Seed: LISRNSRFSS (TYRP2_HUMAN)
LPSRNSRFSK

SEQ ID NO: 189101 - protein, 10 aa, Artificial Sequence
  Description of Artificial Sequence: Synthetic peptide
  Seed: RNSRFSSWET (TYRP2_HUMAN)
RYSRFSSWEK

SEQ ID NO: 189102 - protein, 11 aa, Artificial Sequence
  Description of Artificial Sequence: Synthetic peptide
  Seed: RNSRFSSWETV (TYRP2_HUMAN)
RESRFSSWETV

SEQ ID NO: 189103 - protein, 10 aa, Artificial Sequence
  Description of Artificial Sequence: Synthetic peptide
  Seed: SDQLGYSYAI (TYRP2_HUMAN)
SCQLGYSYAI

SEQ ID NO: 189104 - protein, 11 aa, Artificial Sequence
  Description of Artificial Sequence: Synthetic peptide
  Seed: ESFALPYWNFA (TYRP2_HUMAN)
ETFALPYWNFA

SEQ ID NO: 189105 - protein, 8 aa, Artificial Sequence
  Description of Artificial Sequence: Synthetic peptide
  Seed: AIDLPVSV (TYRP2_HUMAN)
AGDLPVSV

SEQ ID NO: 189106 - protein, 10 aa, Artificial Sequence
  Description of Artificial Sequence: Synthetic peptide
  Seed: FVWLHYYSVR (TYRP2_HUMAN)
FLWLHYYSVN

SEQ ID NO: 189107 - protein, 10 aa, Artificial Sequence
  Description of Artificial Sequence: Synthetic peptide
  Seed: SDQLGYSYAI (TYRP2_HUMAN)
SSQLGYSYAL

SEQ ID NO: 189108 - protein, 9 aa, Artificial Sequence
  Description of Artificial Sequence: Synthetic peptide
  Seed: FPPVTNEEL (TYRP2_HUMAN)
FWPVTNEEF

SEQ ID NO: 189109 - protein, 11 aa, Artificial Sequence
  Description of Artificial Sequence: Synthetic peptide
  Seed: SLDDYNHLVTL (TYRP2_HUMAN)
SMDDYNHLVTL

SEQ ID NO: 189110 - protein, 9 aa, Artificial Sequence
  Description of Artificial Sequence: Synthetic peptide
  Seed: WMKRFNPPA (TYRP2_HUMAN)
WLKRFNPPY

SEQ ID NO: 189111 - protein, 10 aa, Artificial Sequence
  Description of Artificial Sequence: Synthetic peptide
  Seed: METHLSSKRY (TYRP2_HUMAN)
MQTHLSSKRF

SEQ ID NO: 189112 - protein, 9 aa, Artificial Sequence
  Description of Artificial Sequence: Synthetic peptide
  Seed: AIFDEWMKR (TYRP2_HUMAN)
AAFDEWMKL

SEQ ID NO: 189113 - protein, 9 aa, Artificial Sequence
  Description of Artificial Sequence: Synthetic peptide
  Seed: YAIDLPVSV (TYRP2_HUMAN)
YPIDLPVST

SEQ ID NO: 189114 - protein, 9 aa, Artificial Sequence
  Description of Artificial Sequence: Synthetic peptide
  Seed: ETHLSSKRY (TYRP2_HUMAN)
EIHLSSKRR

SEQ ID NO: 189115 - protein, 9 aa, Artificial Sequence
  Description of Artificial Sequence: Synthetic peptide
  Seed: AANDPIFVV (TYRP2_HUMAN)
AVNDPIFVM

SEQ ID NO: 189116 - protein, 10 aa, Artificial Sequence
  Description of Artificial Sequence: Synthetic peptide
  Seed: ADTRPWSGPY (TYRP2_HUMAN)
AVTRPWSGPY

SEQ ID NO: 189117 - protein, 11 aa, Artificial Sequence
  Description of Artificial Sequence: Synthetic peptide
  Seed: FFPPVTNEELF (TYRP2_HUMAN)
FFPPVTNEELY

SEQ ID NO: 189118 - protein, 9 aa, Artificial Sequence
  Description of Artificial Sequence: Synthetic peptide
  Seed: HQGPAFVTW (TYRP2_HUMAN)
HWGPAFVTM

SEQ ID NO: 189119 - protein, 11 aa, Artificial Sequence
  Description of Artificial Sequence: Synthetic peptide
  Seed: SLDDYNHLVTL (TYRP2_HUMAN)
SFDDYNHLVTI

SEQ ID NO: 189120 - protein, 9 aa, Artificial Sequence
  Description of Artificial Sequence: Synthetic peptide
  Seed: SLDDYNHLV (TYRP2_HUMAN)
STDDYNHLI

SEQ ID NO: 189121 - protein, 9 aa, Artificial Sequence
  Description of Artificial Sequence: Synthetic peptide
  Seed: SVRDTLLGP (TYRP2_HUMAN)
STRDTLLGI

SEQ ID NO: 189122 - protein, 9 aa, Artificial Sequence
  Description of Artificial Sequence: Synthetic peptide
  Seed: VIRQNIHSL (TYRP2_HUMAN)
VMRQNIHSA

SEQ ID NO: 189123 - protein, 9 aa, Artificial Sequence
  Description of Artificial Sequence: Synthetic peptide
  Seed: VHPDYVITT (TYRP2_HUMAN)
VVPDYVITM

SEQ ID NO: 189124 - protein, 10 aa, Artificial Sequence
  Description of Artificial Sequence: Synthetic peptide
  Seed: YDFFVWLHYY (TYRP2_HUMAN)
YMFFVWLHYR

SEQ ID NO: 189125 - protein, 10 aa, Artificial Sequence
  Description of Artificial Sequence: Synthetic peptide
  Seed: LGPNGTQPQF (TYRP2_HUMAN)
LPPNGTQPQW

SEQ ID NO: 189126 - protein, 10 aa, Artificial Sequence
  Description of Artificial Sequence: Synthetic peptide
  Seed: VVLHSFTDAI (TYRP2_HUMAN)
VCLHSFTDAL

SEQ ID NO: 189127 - protein, 10 aa, Artificial Sequence
  Description of Artificial Sequence: Synthetic peptide
  Seed: YAIDLPVSVE (TYRP2_HUMAN)
YMIDLPVSVW

SEQ ID NO: 189128 - protein, 10 aa, Artificial Sequence
  Description of Artificial Sequence: Synthetic peptide
  Seed: FPPVTNEELF (TYRP2_HUMAN)
FPPVTNEELW

SEQ ID NO: 189129 - protein, 10 aa, Artificial Sequence
  Description of Artificial Sequence: Synthetic peptide
  Seed: SQVMSLHNLV (TYRP2_HUMAN)
SNVMSLHNLV

SEQ ID NO: 189130 - protein, 9 aa, Artificial Sequence
  Description of Artificial Sequence: Synthetic peptide
  Seed: SLHNLVHSF (TYRP2_HUMAN)
SKHNLVHSM

SEQ ID NO: 189131 - protein, 9 aa, Artificial Sequence
  Description of Artificial Sequence: Synthetic peptide
  Seed: SLHNLVHSF (TYRP2_HUMAN)
SLHNLVHSM

SEQ ID NO: 189132 - protein, 9 aa, Artificial Sequence
  Description of Artificial Sequence: Synthetic peptide
  Seed: RMYNMVPFF (TYRP2_HUMAN)
RLYNMVPFA

SEQ ID NO: 189133 - protein, 9 aa, Artificial Sequence
  Description of Artificial Sequence: Synthetic peptide
  Seed: FSHQGPAFV (TYRP2_HUMAN)
FQHQGPAFF

SEQ ID NO: 189134 - protein, 9 aa, Artificial Sequence
  Description of Artificial Sequence: Synthetic peptide
  Seed: RLRKGYTPL (TYRP2_HUMAN)
RIRKGYTPK

SEQ ID NO: 189135 - protein, 9 aa, Artificial Sequence
  Description of Artificial Sequence: Synthetic peptide
  Seed: AARPDDPTL (TYRP2_HUMAN)
AMRPDDPTM

SEQ ID NO: 189136 - protein, 11 aa, Artificial Sequence
  Description of Artificial Sequence: Synthetic peptide
  Seed: ILRNQDDRELW (TYRP2_HUMAN)
ISRNQDDRELW

SEQ ID NO: 189137 - protein, 10 aa, Artificial Sequence
  Description of Artificial Sequence: Synthetic peptide
  Seed: RRLRKGYTPL (TYRP2_HUMAN)
RSLRKGYTPK

SEQ ID NO: 189138 - protein, 10 aa, Artificial Sequence
  Description of Artificial Sequence: Synthetic peptide
  Seed: YNMVPFFPPV (TYRP2_HUMAN)
YKMVPFFPPV

SEQ ID NO: 189139 - protein, 10 aa, Artificial Sequence
  Description of Artificial Sequence: Synthetic peptide
  Seed: HLVTLCNGTY (TYRP2_HUMAN)
HTVTLCNGTY

SEQ ID NO: 189140 - protein, 9 aa, Artificial Sequence
  Description of Artificial Sequence: Synthetic peptide
  Seed: RNQDDRELW (TYRP2_HUMAN)
RQQDDRELW

SEQ ID NO: 189141 - protein, 9 aa, Artificial Sequence
  Description of Artificial Sequence: Synthetic peptide
  Seed: TLLGPGRPY (TYRP2_HUMAN)
TYLGPGRPL

SEQ ID NO: 189142 - protein, 9 aa, Artificial Sequence
  Description of Artificial Sequence: Synthetic peptide
  Seed: VWLHYYSVR (TYRP2_HUMAN)
VSLHYYSVR

SEQ ID NO: 189143 - protein, 9 aa, Artificial Sequence
  Description of Artificial Sequence: Synthetic peptide
  Seed: YAIDLPVSV (TYRP2_HUMAN)
YMIDLPVSM

SEQ ID NO: 189144 - protein, 10 aa, Artificial Sequence
  Description of Artificial Sequence: Synthetic peptide
  Seed: RMYNMVPFFP (TYRP2_HUMAN)
RIYNMVPFFK

SEQ ID NO: 189145 - protein, 10 aa, Artificial Sequence
  Description of Artificial Sequence: Synthetic peptide
  Seed: TLVALVGLFV (TYRP2_HUMAN)
TVVALVGLFV

SEQ ID NO: 189146 - protein, 9 aa, Artificial Sequence
  Description of Artificial Sequence: Synthetic peptide
  Seed: YAIDLPVSV (TYRP2_HUMAN)
YPIDLPVSM

SEQ ID NO: 189147 - protein, 10 aa, Artificial Sequence
  Description of Artificial Sequence: Synthetic peptide
  Seed: GNESFALPYW (TYRP2_HUMAN)
GFESFALPYW

SEQ ID NO: 189148 - protein, 9 aa, Artificial Sequence
  Description of Artificial Sequence: Synthetic peptide
  Seed: LRKGYTPLM (TYRP2_HUMAN)
LQKGYTPLY

SEQ ID NO: 189149 - protein, 10 aa, Artificial Sequence
  Description of Artificial Sequence: Synthetic peptide
  Seed: AGYNCGDCKF (TYRP2_HUMAN)
ATYNCGDCKW

SEQ ID NO: 189150 - protein, 9 aa, Artificial Sequence
  Description of Artificial Sequence: Synthetic peptide
  Seed: FFPPVTNEE (TYRP2_HUMAN)
FYPPVTNEV

SEQ ID NO: 189151 - protein, 10 aa, Artificial Sequence
  Description of Artificial Sequence: Synthetic peptide
  Seed: RLRKGYTPLM (TYRP2_HUMAN)
RARKGYTPLI

SEQ ID NO: 189152 - protein, 9 aa, Artificial Sequence
  Description of Artificial Sequence: Synthetic peptide
  Seed: AANDPIFVV (TYRP2_HUMAN)
AVNDPIFVY

SEQ ID NO: 189153 - protein, 10 aa, Artificial Sequence
  Description of Artificial Sequence: Synthetic peptide
  Seed: MSPLWWGFLL (TYRP2_HUMAN)
MYPLWWGFLY

SEQ ID NO: 189154 - protein, 9 aa, Artificial Sequence
  Description of Artificial Sequence: Synthetic peptide
  Seed: ETPGWPTTL (TYRP2_HUMAN)
EMPGWPTTV

SEQ ID NO: 189155 - protein, 10 aa, Artificial Sequence
  Description of Artificial Sequence: Synthetic peptide
  Seed: FSFRNALEGF (TYRP2_HUMAN)
FMFRNALEGF

SEQ ID NO: 189156 - protein, 9 aa, Artificial Sequence
  Description of Artificial Sequence: Synthetic peptide
  Seed: RKFFHRTCK (TYRP2_HUMAN)
RSFFHRTCS

SEQ ID NO: 189157 - protein, 9 aa, Artificial Sequence
  Description of Artificial Sequence: Synthetic peptide
  Seed: VMSLHNLVH (TYRP2_HUMAN)
VSSLHNLVY

SEQ ID NO: 189158 - protein, 9 aa, Artificial Sequence
  Description of Artificial Sequence: Synthetic peptide
  Seed: WHRYHLLCL (TYRP2_HUMAN)
WFRYHLLCM

SEQ ID NO: 189159 - protein, 9 aa, Artificial Sequence
  Description of Artificial Sequence: Synthetic peptide
  Seed: TLISRNSRF (TYRP2_HUMAN)
TAISRNSRF

SEQ ID NO: 189160 - protein, 9 aa, Artificial Sequence
  Description of Artificial Sequence: Synthetic peptide
  Seed: RNQMGRNSM (TYRP2_HUMAN)
RLQMGRNSM

SEQ ID NO: 189161 - protein, 10 aa, Artificial Sequence
  Description of Artificial Sequence: Synthetic peptide
  Seed: RPWSGPYILR (TYRP2_HUMAN)
RSWSGPYILK

SEQ ID NO: 189162 - protein, 10 aa, Artificial Sequence
  Description of Artificial Sequence: Synthetic peptide
  Seed: LISRNSRFSS (TYRP2_HUMAN)
LYSRNSRFSK

SEQ ID NO: 189163 - protein, 9 aa, Artificial Sequence
  Description of Artificial Sequence: Synthetic peptide
  Seed: SLHNLVHSF (TYRP2_HUMAN)
STHNLVHSV

SEQ ID NO: 189164 - protein, 10 aa, Artificial Sequence
  Description of Artificial Sequence: Synthetic peptide
  Seed: YNMVPFFPPV (TYRP2_HUMAN)
YRMVPFFPPA

SEQ ID NO: 189165 - protein, 9 aa, Artificial Sequence
  Description of Artificial Sequence: Synthetic peptide
  Seed: ALDLAKKRV (TYRP2_HUMAN)
ASDLAKKRI

SEQ ID NO: 189166 - protein, 11 aa, Artificial Sequence
  Description of Artificial Sequence: Synthetic peptide
  Seed: MSLHNLVHSFL (TYRP2_HUMAN)
MTLHNLVHSFY

SEQ ID NO: 189167 - protein, 9 aa, Artificial Sequence
  Description of Artificial Sequence: Synthetic peptide
  Seed: VTWHRYHLL (TYRP2_HUMAN)
VRWHRYHLY

SEQ ID NO: 189168 - protein, 9 aa, Artificial Sequence
  Description of Artificial Sequence: Synthetic peptide
  Seed: ETPGWPTTL (TYRP2_HUMAN)
ESPGWPTTL

SEQ ID NO: 189169 - protein, 10 aa, Artificial Sequence
  Description of Artificial Sequence: Synthetic peptide
  Seed: REQFLGALDL (TYRP2_HUMAN)
RYQFLGALDY

SEQ ID NO: 189170 - protein, 9 aa, Artificial Sequence
  Description of Artificial Sequence: Synthetic peptide
  Seed: VIRQNIHSL (TYRP2_HUMAN)
VFRQNIHSL

SEQ ID NO: 189171 - protein, 10 aa, Artificial Sequence
  Description of Artificial Sequence: Synthetic peptide
  Seed: ESANVCGSQQ (TYRP2_HUMAN)
EIANVCGSQR

SEQ ID NO: 189172 - protein, 11 aa, Artificial Sequence
  Description of Artificial Sequence: Synthetic peptide
  Seed: TQPQFANCSVY (TYRP2_HUMAN)
TNPQFANCSVM

SEQ ID NO: 189173 - protein, 10 aa, Artificial Sequence
  Description of Artificial Sequence: Synthetic peptide
  Seed: LHYYSVRDTL (TYRP2_HUMAN)
LRYYSVRDTY

SEQ ID NO: 189174 - protein, 9 aa, Artificial Sequence
  Description of Artificial Sequence: Synthetic peptide
  Seed: TLDSQVMSL (TYRP2_HUMAN)
TTDSQVMSI

SEQ ID NO: 189175 - protein, 10 aa, Artificial Sequence
  Description of Artificial Sequence: Synthetic peptide
  Seed: FSFRNALEGF (TYRP2_HUMAN)
FKFRNALEGF

SEQ ID NO: 189176 - protein, 10 aa, Artificial Sequence
  Description of Artificial Sequence: Synthetic peptide
  Seed: FLLSCLGCKI (TYRP2_HUMAN)
FSLSCLGCKI

SEQ ID NO: 189177 - protein, 10 aa, Artificial Sequence
  Description of Artificial Sequence: Synthetic peptide
  Seed: FPPVTNEELF (TYRP2_HUMAN)
FKPVTNEELF

SEQ ID NO: 189178 - protein, 9 aa, Artificial Sequence
  Description of Artificial Sequence: Synthetic peptide
  Seed: EGLLRRNQM (TYRP2_HUMAN)
EPLLRRNQL

SEQ ID NO: 189179 - protein, 10 aa, Artificial Sequence
  Description of Artificial Sequence: Synthetic peptide
  Seed: MSLHNLVHSF (TYRP2_HUMAN)
MVLHNLVHSY

SEQ ID NO: 189180 - protein, 10 aa, Artificial Sequence
  Description of Artificial Sequence: Synthetic peptide
  Seed: LVVMGTLVAL (TYRP2_HUMAN)
LCVMGTLVAY

SEQ ID NO: 189181 - protein, 10 aa, Artificial Sequence
  Description of Artificial Sequence: Synthetic peptide
  Seed: RLRKGYTPLM (TYRP2_HUMAN)
RTRKGYTPLS

SEQ ID NO: 189182 - protein, 9 aa, Artificial Sequence
  Description of Artificial Sequence: Synthetic peptide
  Seed: YVITTQHWL (TYRP2_HUMAN)
YLITTQHWI

SEQ ID NO: 189183 - protein, 9 aa, Artificial Sequence
  Description of Artificial Sequence: Synthetic peptide
  Seed: FTDAIFDEW (TYRP2_HUMAN)
FGDAIFDEF

SEQ ID NO: 189184 - protein, 9 aa, Artificial Sequence
  Description of Artificial Sequence: Synthetic peptide
  Seed: SLHNLVHSF (TYRP2_HUMAN)
SLHNLVHST

SEQ ID NO: 189185 - protein, 11 aa, Artificial Sequence
  Description of Artificial Sequence: Synthetic peptide
  Seed: QPQFANCSVYD (TYRP2_HUMAN)
QRQFANCSVYF

SEQ ID NO: 189186 - protein, 9 aa, Artificial Sequence
  Description of Artificial Sequence: Synthetic peptide
  Seed: TLLVVMGTL (TYRP2_HUMAN)
TQLVVMGTF

SEQ ID NO: 189187 - protein, 10 aa, Artificial Sequence
  Description of Artificial Sequence: Synthetic peptide
  Seed: RNSRFSSWET (TYRP2_HUMAN)
RYSRFSSWEM

SEQ ID NO: 189188 - protein, 9 aa, Artificial Sequence
  Description of Artificial Sequence: Synthetic peptide
  Seed: MVPFFPPVT (TYRP2_HUMAN)
MTPFFPPVI

SEQ ID NO: 189189 - protein, 11 aa, Artificial Sequence
  Description of Artificial Sequence: Synthetic peptide
  Seed: RNSRFSSWETV (TYRP2_HUMAN)
RKSRFSSWETV

SEQ ID NO: 189190 - protein, 9 aa, Artificial Sequence
  Description of Artificial Sequence: Synthetic peptide
  Seed: YAIDLPVSV (TYRP2_HUMAN)
YTIDLPVSY

SEQ ID NO: 189191 - protein, 9 aa, Artificial Sequence
  Description of Artificial Sequence: Synthetic peptide
  Seed: RKFFHRTCK (TYRP2_HUMAN)
RFFFHRTCI

SEQ ID NO: 189192 - protein, 9 aa, Artificial Sequence
  Description of Artificial Sequence: Synthetic peptide
  Seed: RLRKGYTPL (TYRP2_HUMAN)
RFRKGYTPV

SEQ ID NO: 189193 - protein, 10 aa, Artificial Sequence
  Description of Artificial Sequence: Synthetic peptide
  Seed: HSFLNGTNAL (TYRP2_HUMAN)
HSFLNGTNAM

SEQ ID NO: 189194 - protein, 9 aa, Artificial Sequence
  Description of Artificial Sequence: Synthetic peptide
  Seed: TQHWLGLLG (TYRP2_HUMAN)
TQHWLGLLL

SEQ ID NO: 189195 - protein, 9 aa, Artificial Sequence
  Description of Artificial Sequence: Synthetic peptide
  Seed: YSYAIDLPV (TYRP2_HUMAN)
YEYAIDLPM

SEQ ID NO: 189196 - protein, 9 aa, Artificial Sequence
  Description of Artificial Sequence: Synthetic peptide
  Seed: FVLLAFLQY (TYRP2_HUMAN)
FYLLAFLQY

SEQ ID NO: 189197 - protein, 10 aa, Artificial Sequence
  Description of Artificial Sequence: Synthetic peptide
  Seed: YDFFVWLHYY (TYRP2_HUMAN)
YMFFVWLHYN

SEQ ID NO: 189198 - protein, 10 aa, Artificial Sequence
  Description of Artificial Sequence: Synthetic peptide
  Seed: LVVMGTLVAL (TYRP2_HUMAN)
LTVMGTLVAM

SEQ ID NO: 189199 - protein, 10 aa, Artificial Sequence
  Description of Artificial Sequence: Synthetic peptide
  Seed: RNSRFSSWET (TYRP2_HUMAN)
RDSRFSSWEK

SEQ ID NO: 189200 - protein, 9 aa, Artificial Sequence
  Description of Artificial Sequence: Synthetic peptide
  Seed: HYYSVRDTL (TYRP2_HUMAN)
HYYSVRDTI

SEQ ID NO: 189201 - protein, 9 aa, Artificial Sequence
  Description of Artificial Sequence: Synthetic peptide
  Seed: SVYDFFVWL (TYRP2_HUMAN)
SVYDFFVWT

SEQ ID NO: 189202 - protein, 10 aa, Artificial Sequence
  Description of Artificial Sequence: Synthetic peptide
  Seed: ISRNSRFSSW (TYRP2_HUMAN)
ISRNSRFSSY

SEQ ID NO: 189203 - protein, 11 aa, Artificial Sequence
  Description of Artificial Sequence: Synthetic peptide
  Seed: RADTRPWSGPY (TYRP2_HUMAN)
RCDTRPWSGPA

SEQ ID NO: 189204 - protein, 11 aa, Artificial Sequence
  Description of Artificial Sequence: Synthetic peptide
  Seed: RMYNMVPFFPP (TYRP2_HUMAN)
RMYNMVPFFPL

SEQ ID NO: 189205 - protein, 11 aa, Artificial Sequence
  Description of Artificial Sequence: Synthetic peptide
  Seed: YNMVPFFPPVT (TYRP2_HUMAN)
YLMVPFFPPVY

SEQ ID NO: 189206 - protein, 9 aa, Artificial Sequence
  Description of Artificial Sequence: Synthetic peptide
  Seed: FSHQGPAFV (TYRP2_HUMAN)
FTHQGPAFY

SEQ ID NO: 189207 - protein, 9 aa, Artificial Sequence
  Description of Artificial Sequence: Synthetic peptide
  Seed: YSYAIDLPV (TYRP2_HUMAN)
YWYAIDLPY

SEQ ID NO: 189208 - protein, 10 aa, Artificial Sequence
  Description of Artificial Sequence: Synthetic peptide
  Seed: LHYYSVRDTL (TYRP2_HUMAN)
LVYYSVRDTI

SEQ ID NO: 189209 - protein, 9 aa, Artificial Sequence
  Description of Artificial Sequence: Synthetic peptide
  Seed: RMYNMVPFF (TYRP2_HUMAN)
RCYNMVPFR

SEQ ID NO: 189210 - protein, 10 aa, Artificial Sequence
  Description of Artificial Sequence: Synthetic peptide
  Seed: QGPAFVTWHR (TYRP2_HUMAN)
QTPAFVTWHR

SEQ ID NO: 189211 - protein, 9 aa, Artificial Sequence
  Description of Artificial Sequence: Synthetic peptide
  Seed: GTYEGLLRR (TYRP2_HUMAN)
GMYEGLLRH

SEQ ID NO: 189212 - protein, 10 aa, Artificial Sequence
  Description of Artificial Sequence: Synthetic peptide
  Seed: FVWLHYYSVR (TYRP2_HUMAN)
FLWLHYYSVS

SEQ ID NO: 189213 - protein, 10 aa, Artificial Sequence
  Description of Artificial Sequence: Synthetic peptide
  Seed: LKDIRDCLSL (TYRP2_HUMAN)
LQDIRDCLSM

SEQ ID NO: 189214 - protein, 10 aa, Artificial Sequence
  Description of Artificial Sequence: Synthetic peptide
  Seed: REQFLGALDL (TYRP2_HUMAN)
RTQFLGALDF

SEQ ID NO: 189215 - protein, 10 aa, Artificial Sequence
  Description of Artificial Sequence: Synthetic peptide
  Seed: RMYNMVPFFP (TYRP2_HUMAN)
RMYNMVPFFC

SEQ ID NO: 189216 - protein, 9 aa, Artificial Sequence
  Description of Artificial Sequence: Synthetic peptide
  Seed: TSDQLGYSY (TYRP2_HUMAN)
TPDQLGYSM

SEQ ID NO: 189217 - protein, 10 aa, Artificial Sequence
  Description of Artificial Sequence: Synthetic peptide
  Seed: FVVLHSFTDA (TYRP2_HUMAN)
FIVLHSFTDV

SEQ ID NO: 189218 - protein, 10 aa, Artificial Sequence
  Description of Artificial Sequence: Synthetic peptide
  Seed: LVGLFVLLAF (TYRP2_HUMAN)
LQGLFVLLAF

SEQ ID NO: 189219 - protein, 10 aa, Artificial Sequence
  Description of Artificial Sequence: Synthetic peptide
  Seed: SVRDTLLGPG (TYRP2_HUMAN)
STRDTLLGPA

SEQ ID NO: 189220 - protein, 9 aa, Artificial Sequence
  Description of Artificial Sequence: Synthetic peptide
  Seed: VIRQNIHSL (TYRP2_HUMAN)
VMRQNIHSW

SEQ ID NO: 189221 - protein, 10 aa, Artificial Sequence
  Description of Artificial Sequence: Synthetic peptide
  Seed: LAPIGHNRMY (TYRP2_HUMAN)
LTPIGHNRMF

SEQ ID NO: 189222 - protein, 10 aa, Artificial Sequence
  Description of Artificial Sequence: Synthetic peptide
  Seed: FTDAIFDEWM (TYRP2_HUMAN)
FMDAIFDEWM

SEQ ID NO: 189223 - protein, 9 aa, Artificial Sequence
  Description of Artificial Sequence: Synthetic peptide
  Seed: YSYAIDLPV (TYRP2_HUMAN)
YEYAIDLPL

SEQ ID NO: 189224 - protein, 9 aa, Artificial Sequence
  Description of Artificial Sequence: Synthetic peptide
  Seed: YAIDLPVSV (TYRP2_HUMAN)
YGIDLPVSV

SEQ ID NO: 189225 - protein, 9 aa, Artificial Sequence
  Description of Artificial Sequence: Synthetic peptide
  Seed: RLRKGYTPL (TYRP2_HUMAN)
RQRKGYTPK

SEQ ID NO: 189226 - protein, 10 aa, Artificial Sequence
  Description of Artificial Sequence: Synthetic peptide
  Seed: ETPGWPTTLL (TYRP2_HUMAN)
EAPGWPTTLK

SEQ ID NO: 189227 - protein, 9 aa, Artificial Sequence
  Description of Artificial Sequence: Synthetic peptide
  Seed: TLLVVMGTL (TYRP2_HUMAN)
TMLVVMGTL

SEQ ID NO: 189228 - protein, 10 aa, Artificial Sequence
  Description of Artificial Sequence: Synthetic peptide
  Seed: SPLWWGFLLS (TYRP2_HUMAN)
SMLWWGFLLS

SEQ ID NO: 189229 - protein, 10 aa, Artificial Sequence
  Description of Artificial Sequence: Synthetic peptide
  Seed: TRPWSGPYIL (TYRP2_HUMAN)
TGPWSGPYIY

SEQ ID NO: 189230 - protein, 10 aa, Artificial Sequence
  Description of Artificial Sequence: Synthetic peptide
  Seed: GRNSMKLPTL (TYRP2_HUMAN)
GRNSMKLPTI

SEQ ID NO: 189231 - protein, 9 aa, Artificial Sequence
  Description of Artificial Sequence: Synthetic peptide
  Seed: RKFFHRTCK (TYRP2_HUMAN)
RRFFHRTCM

SEQ ID NO: 189232 - protein, 10 aa, Artificial Sequence
  Description of Artificial Sequence: Synthetic peptide
  Seed: RNSRFSSWET (TYRP2_HUMAN)
RVSRFSSWEL

SEQ ID NO: 189233 - protein, 9 aa, Artificial Sequence
  Description of Artificial Sequence: Synthetic peptide
  Seed: HQGPAFVTW (TYRP2_HUMAN)
HRGPAFVTF

SEQ ID NO: 189234 - protein, 9 aa, Artificial Sequence
  Description of Artificial Sequence: Synthetic peptide
  Seed: LVTLCNGTY (TYRP2_HUMAN)
LMTLCNGTF

SEQ ID NO: 189235 - protein, 9 aa, Artificial Sequence
  Description of Artificial Sequence: Synthetic peptide
  Seed: TLDSQVMSL (TYRP2_HUMAN)
TTDSQVMSM

SEQ ID NO: 189236 - protein, 9 aa, Artificial Sequence
  Description of Artificial Sequence: Synthetic peptide
  Seed: SFRNALEGF (TYRP2_HUMAN)
SFRNALEGM

SEQ ID NO: 189237 - protein, 11 aa, Artificial Sequence
  Description of Artificial Sequence: Synthetic peptide
  Seed: YNMVPFFPPVT (TYRP2_HUMAN)
YIMVPFFPPVP

SEQ ID NO: 189238 - protein, 9 aa, Artificial Sequence
  Description of Artificial Sequence: Synthetic peptide
  Seed: ALPYWNFAT (TYRP2_HUMAN)
AQPYWNFAV

SEQ ID NO: 189239 - protein, 9 aa, Artificial Sequence
  Description of Artificial Sequence: Synthetic peptide
  Seed: LMETHLSSK (TYRP2_HUMAN)
LTETHLSSY

SEQ ID NO: 189240 - protein, 10 aa, Artificial Sequence
  Description of Artificial Sequence: Synthetic peptide
  Seed: RELWPRKFFH (TYRP2_HUMAN)
RVLWPRKFFK

SEQ ID NO: 189241 - protein, 10 aa, Artificial Sequence
  Description of Artificial Sequence: Synthetic peptide
  Seed: FFQNSTFSFR (TYRP2_HUMAN)
FYQNSTFSFI

SEQ ID NO: 189242 - protein, 11 aa, Artificial Sequence
  Description of Artificial Sequence: Synthetic peptide
  Seed: VMSLHNLVHSF (TYRP2_HUMAN)
VQSLHNLVHSY

SEQ ID NO: 189243 - protein, 9 aa, Artificial Sequence
  Description of Artificial Sequence: Synthetic peptide
  Seed: DDYNHLVTL (TYRP2_HUMAN)
DMYNHLVTV

SEQ ID NO: 189244 - protein, 9 aa, Artificial Sequence
  Description of Artificial Sequence: Synthetic peptide
  Seed: ELWPRKFFH (TYRP2_HUMAN)
EAWPRKFFR

SEQ ID NO: 189245 - protein, 10 aa, Artificial Sequence
  Description of Artificial Sequence: Synthetic peptide
  Seed: VVMGTLVALV (TYRP2_HUMAN)
VMMGTLVALE

SEQ ID NO: 189246 - protein, 10 aa, Artificial Sequence
  Description of Artificial Sequence: Synthetic peptide
  Seed: HNRMYNMVPF (TYRP2_HUMAN)
HYRMYNMVPM

SEQ ID NO: 189247 - protein, 9 aa, Artificial Sequence
  Description of Artificial Sequence: Synthetic peptide
  Seed: NMVPFFPPV (TYRP2_HUMAN)
NSVPFFPPI

SEQ ID NO: 189248 - protein, 9 aa, Artificial Sequence
  Description of Artificial Sequence: Synthetic peptide
  Seed: SLDDYNHLV (TYRP2_HUMAN)
SMDDYNHLM

SEQ ID NO: 189249 - protein, 8 aa, Artificial Sequence
  Description of Artificial Sequence: Synthetic peptide
  Seed: LDDYNHLV (TYRP2_HUMAN)
LWDYNHLV

SEQ ID NO: 189250 - protein, 9 aa, Artificial Sequence
  Description of Artificial Sequence: Synthetic peptide
  Seed: AIFDEWMKR (TYRP2_HUMAN)
AAFDEWMKY

SEQ ID NO: 189251 - protein, 10 aa, Artificial Sequence
  Description of Artificial Sequence: Synthetic peptide
  Seed: VGLFVLLAFL (TYRP2_HUMAN)
VELFVLLAFV

SEQ ID NO: 189252 - protein, 9 aa, Artificial Sequence
  Description of Artificial Sequence: Synthetic peptide
  Seed: SLDDYNHLV (TYRP2_HUMAN)
SSDDYNHLY

SEQ ID NO: 189253 - protein, 10 aa, Artificial Sequence
  Description of Artificial Sequence: Synthetic peptide
  Seed: SPLWWGFLLS (TYRP2_HUMAN)
SGLWWGFLLA

SEQ ID NO: 189254 - protein, 8 aa, Artificial Sequence
  Description of Artificial Sequence: Synthetic peptide
  Seed: AIDLPVSV (TYRP2_HUMAN)
AADLPVSL

SEQ ID NO: 189255 - protein, 9 aa, Artificial Sequence
  Description of Artificial Sequence: Synthetic peptide
  Seed: SVYDFFVWL (TYRP2_HUMAN)
SSYDFFVWF

SEQ ID NO: 189256 - protein, 10 aa, Artificial Sequence
  Description of Artificial Sequence: Synthetic peptide
  Seed: MSPLWWGFLL (TYRP2_HUMAN)
MNPLWWGFLW

SEQ ID NO: 189257 - protein, 10 aa, Artificial Sequence
  Description of Artificial Sequence: Synthetic peptide
  Seed: TQPQFANCSV (TYRP2_HUMAN)
TTPQFANCSL

SEQ ID NO: 189258 - protein, 9 aa, Artificial Sequence
  Description of Artificial Sequence: Synthetic peptide
  Seed: WMKRFNPPA (TYRP2_HUMAN)
WQKRFNPPF

SEQ ID NO: 189259 - protein, 11 aa, Artificial Sequence
  Description of Artificial Sequence: Synthetic peptide
  Seed: VTLCNGTYEGL (TYRP2_HUMAN)
VTLCNGTYEGW

SEQ ID NO: 189260 - protein, 11 aa, Artificial Sequence
  Description of Artificial Sequence: Synthetic peptide
  Seed: YRRLRKGYTPL (TYRP2_HUMAN)
YLRLRKGYTPL

SEQ ID NO: 189261 - protein, 9 aa, Artificial Sequence
  Description of Artificial Sequence: Synthetic peptide
  Seed: STFSFRNAL (TYRP2_HUMAN)
SYFSFRNAA

SEQ ID NO: 189262 - protein, 9 aa, Artificial Sequence
  Description of Artificial Sequence: Synthetic peptide
  Seed: RLRKGYTPL (TYRP2_HUMAN)
RERKGYTPM

SEQ ID NO: 189263 - protein, 9 aa, Artificial Sequence
  Description of Artificial Sequence: Synthetic peptide
  Seed: LAFLQYRRL (TYRP2_HUMAN)
LSFLQYRRF

SEQ ID NO: 189264 - protein, 11 aa, Artificial Sequence
  Description of Artificial Sequence: Synthetic peptide
  Seed: YTPLMETHLSS (TYRP2_HUMAN)
YCPLMETHLSA

SEQ ID NO: 189265 - protein, 9 aa, Artificial Sequence
  Description of Artificial Sequence: Synthetic peptide
  Seed: RNQMGRNSM (TYRP2_HUMAN)
REQMGRNSY

SEQ ID NO: 189266 - protein, 10 aa, Artificial Sequence
  Description of Artificial Sequence: Synthetic peptide
  Seed: VVMGTLVALV (TYRP2_HUMAN)
VMMGTLVALA

SEQ ID NO: 189267 - protein, 9 aa, Artificial Sequence
  Description of Artificial Sequence: Synthetic peptide
  Seed: ETPGWPTTL (TYRP2_HUMAN)
EVPGWPTTL

SEQ ID NO: 189268 - protein, 9 aa, Artificial Sequence
  Description of Artificial Sequence: Synthetic peptide
  Seed: MTVDSLVNK (TYRP2_HUMAN)
MVVDSLVNF

SEQ ID NO: 189269 - protein, 9 aa, Artificial Sequence
  Description of Artificial Sequence: Synthetic peptide
  Seed: TLDSQVMSL (TYRP2_HUMAN)
TEDSQVMSM

SEQ ID NO: 189270 - protein, 10 aa, Artificial Sequence
  Description of Artificial Sequence: Synthetic peptide
  Seed: LISRNSRFSS (TYRP2_HUMAN)
LQSRNSRFSK

SEQ ID NO: 189271 - protein, 10 aa, Artificial Sequence
  Description of Artificial Sequence: Synthetic peptide
  Seed: SHQGPAFVTW (TYRP2_HUMAN)
SFQGPAFVTL

SEQ ID NO: 189272 - protein, 9 aa, Artificial Sequence
  Description of Artificial Sequence: Synthetic peptide
  Seed: SFLNGTNAL (TYRP2_HUMAN)
SPLNGTNAY

SEQ ID NO: 189273 - protein, 10 aa, Artificial Sequence
  Description of Artificial Sequence: Synthetic peptide
  Seed: SVRDTLLGPG (TYRP2_HUMAN)
SVRDTLLGPA

SEQ ID NO: 189274 - protein, 9 aa, Artificial Sequence
  Description of Artificial Sequence: Synthetic peptide
  Seed: FSHQGPAFV (TYRP2_HUMAN)
FLHQGPAFL

SEQ ID NO: 189275 - protein, 9 aa, Artificial Sequence
  Description of Artificial Sequence: Synthetic peptide
  Seed: RTCKCTGNF (TYRP2_HUMAN)
RQCKCTGNY

SEQ ID NO: 189276 - protein, 9 aa, Artificial Sequence
  Description of Artificial Sequence: Synthetic peptide
  Seed: GTYEGLLRR (TYRP2_HUMAN)
GSYEGLLRM

SEQ ID NO: 189277 - protein, 10 aa, Artificial Sequence
  Description of Artificial Sequence: Synthetic peptide
  Seed: HNRMYNMVPF (TYRP2_HUMAN)
HQRMYNMVPM

SEQ ID NO: 189278 - protein, 9 aa, Artificial Sequence
  Description of Artificial Sequence: Synthetic peptide
  Seed: LVTLCNGTY (TYRP2_HUMAN)
LPTLCNGTY

SEQ ID NO: 189279 - protein, 10 aa, Artificial Sequence
  Description of Artificial Sequence: Synthetic peptide
  Seed: FVLLAFLQYR (TYRP2_HUMAN)
FGLLAFLQYR

SEQ ID NO: 189280 - protein, 9 aa, Artificial Sequence
  Description of Artificial Sequence: Synthetic peptide
  Seed: FFPPVTNEE (TYRP2_HUMAN)
FYPPVTNEH

SEQ ID NO: 189281 - protein, 8 aa, Artificial Sequence
  Description of Artificial Sequence: Synthetic peptide
  Seed: SLDDYNHL (TYRP2_HUMAN)
SIDDYNHL

SEQ ID NO: 189282 - protein, 9 aa, Artificial Sequence
  Description of Artificial Sequence: Synthetic peptide
  Seed: FFPPVTNEE (TYRP2_HUMAN)
FSPPVTNEM

SEQ ID NO: 189283 - protein, 10 aa, Artificial Sequence
  Description of Artificial Sequence: Synthetic peptide
  Seed: FVWLHYYSVR (TYRP2_HUMAN)
FMWLHYYSVF

SEQ ID NO: 189284 - protein, 9 aa, Artificial Sequence
  Description of Artificial Sequence: Synthetic peptide
  Seed: HQGPAFVTW (TYRP2_HUMAN)
HMGPAFVTY

SEQ ID NO: 189285 - protein, 9 aa, Artificial Sequence
  Description of Artificial Sequence: Synthetic peptide
  Seed: IFDEWMKRF (TYRP2_HUMAN)
ISDEWMKRW

SEQ ID NO: 189286 - protein, 9 aa, Artificial Sequence
  Description of Artificial Sequence: Synthetic peptide
  Seed: TSDQLGYSY (TYRP2_HUMAN)
TLDQLGYSL

SEQ ID NO: 189287 - protein, 9 aa, Artificial Sequence
  Description of Artificial Sequence: Synthetic peptide
  Seed: RLRKGYTPL (TYRP2_HUMAN)
RMRKGYTPM

SEQ ID NO: 189288 - protein, 10 aa, Artificial Sequence
  Description of Artificial Sequence: Synthetic peptide
  Seed: RLRKGYTPLM (TYRP2_HUMAN)
RPRKGYTPLW

SEQ ID NO: 189289 - protein, 9 aa, Artificial Sequence
  Description of Artificial Sequence: Synthetic peptide
  Seed: HSFLNGTNA (TYRP2_HUMAN)
HSFLNGTNK

SEQ ID NO: 189290 - protein, 9 aa, Artificial Sequence
  Description of Artificial Sequence: Synthetic peptide
  Seed: TSDQLGYSY (TYRP2_HUMAN)
TLDQLGYSM

SEQ ID NO: 189291 - protein, 9 aa, Artificial Sequence
  Description of Artificial Sequence: Synthetic peptide
  Seed: MTVDSLVNK (TYRP2_HUMAN)
MLVDSLVNK

SEQ ID NO: 189292 - protein, 9 aa, Artificial Sequence
  Description of Artificial Sequence: Synthetic peptide
  Seed: FPPVTNEEL (TYRP2_HUMAN)
FPPVTNEEM

SEQ ID NO: 189293 - protein, 10 aa, Artificial Sequence
  Description of Artificial Sequence: Synthetic peptide
  Seed: FSFRNALEGF (TYRP2_HUMAN)
FMFRNALEGY

SEQ ID NO: 189294 - protein, 10 aa, Artificial Sequence
  Description of Artificial Sequence: Synthetic peptide
  Seed: RNSRFSSWET (TYRP2_HUMAN)
RESRFSSWEK

SEQ ID NO: 189295 - protein, 8 aa, Artificial Sequence
  Description of Artificial Sequence: Synthetic peptide
  Seed: KFDNPPFF (TYRP2_HUMAN)
KIDNPPFI

SEQ ID NO: 189296 - protein, 9 aa, Artificial Sequence
  Description of Artificial Sequence: Synthetic peptide
  Seed: SSKRYTEEA (TYRP2_HUMAN)
SMKRYTEEK

SEQ ID NO: 189297 - protein, 9 aa, Artificial Sequence
  Description of Artificial Sequence: Synthetic peptide
  Seed: QPQFANCSV (TYRP2_HUMAN)
QPQFANCSL

SEQ ID NO: 189298 - protein, 9 aa, Artificial Sequence
  Description of Artificial Sequence: Synthetic peptide
  Seed: VTWHRYHLL (TYRP2_HUMAN)
VGWHRYHLW

SEQ ID NO: 189299 - protein, 10 aa, Artificial Sequence
  Description of Artificial Sequence: Synthetic peptide
  Seed: RRLRKGYTPL (TYRP2_HUMAN)
RMLRKGYTPV

SEQ ID NO: 189300 - protein, 9 aa, Artificial Sequence
  Description of Artificial Sequence: Synthetic peptide
  Seed: SVYDFFVWL (TYRP2_HUMAN)
SQYDFFVWY

SEQ ID NO: 189301 - protein, 9 aa, Artificial Sequence
  Description of Artificial Sequence: Synthetic peptide
  Seed: RQNIHSLSP (TYRP2_HUMAN)
RHNIHSLSM

SEQ ID NO: 189302 - protein, 9 aa, Artificial Sequence
  Description of Artificial Sequence: Synthetic peptide
  Seed: QKFDNPPFF (TYRP2_HUMAN)
QQFDNPPFF

SEQ ID NO: 189303 - protein, 10 aa, Artificial Sequence
  Description of Artificial Sequence: Synthetic peptide
  Seed: FANCSVYDFF (TYRP2_HUMAN)
FPNCSVYDFW

SEQ ID NO: 189304 - protein, 9 aa, Artificial Sequence
  Description of Artificial Sequence: Synthetic peptide
  Seed: HYYSVRDTL (TYRP2_HUMAN)
HQYSVRDTM

SEQ ID NO: 189305 - protein, 11 aa, Artificial Sequence
  Description of Artificial Sequence: Synthetic peptide
  Seed: YNMVPFFPPVT (TYRP2_HUMAN)
YVMVPFFPPVF

SEQ ID NO: 189306 - protein, 9 aa, Artificial Sequence
  Description of Artificial Sequence: Synthetic peptide
  Seed: TLLGPGRPY (TYRP2_HUMAN)
TQLGPGRPF

SEQ ID NO: 189307 - protein, 8 aa, Artificial Sequence
  Description of Artificial Sequence: Synthetic peptide
  Seed: SLDDYNHL (TYRP2_HUMAN)
SLDDYNHM

SEQ ID NO: 189308 - protein, 11 aa, Artificial Sequence
  Description of Artificial Sequence: Synthetic peptide
  Seed: RADTRPWSGPY (TYRP2_HUMAN)
RNDTRPWSGPK

SEQ ID NO: 189309 - protein, 9 aa, Artificial Sequence
  Description of Artificial Sequence: Synthetic peptide
  Seed: LQKFDNPPF (TYRP2_HUMAN)
LVKFDNPPY

SEQ ID NO: 189310 - protein, 9 aa, Artificial Sequence
  Description of Artificial Sequence: Synthetic peptide
  Seed: SAANDPIFV (TYRP2_HUMAN)
SSANDPIFL

SEQ ID NO: 189311 - protein, 9 aa, Artificial Sequence
  Description of Artificial Sequence: Synthetic peptide
  Seed: LGALDLAKK (TYRP2_HUMAN)
LVALDLAKK

SEQ ID NO: 189312 - protein, 10 aa, Artificial Sequence
  Description of Artificial Sequence: Synthetic peptide
  Seed: AARPDDPTLI (TYRP2_HUMAN)
ASRPDDPTLW

SEQ ID NO: 189313 - protein, 10 aa, Artificial Sequence
  Description of Artificial Sequence: Synthetic peptide
  Seed: RRLRKGYTPL (TYRP2_HUMAN)
RWLRKGYTPY

SEQ ID NO: 189314 - protein, 11 aa, Artificial Sequence
  Description of Artificial Sequence: Synthetic peptide
  Seed: TDAIFDEWMKR (TYRP2_HUMAN)
TTAIFDEWMKR

SEQ ID NO: 189315 - protein, 10 aa, Artificial Sequence
  Description of Artificial Sequence: Synthetic peptide
  Seed: VVLHSFTDAI (TYRP2_HUMAN)
VALHSFTDAL

SEQ ID NO: 189316 - protein, 9 aa, Artificial Sequence
  Description of Artificial Sequence: Synthetic peptide
  Seed: VTWHRYHLL (TYRP2_HUMAN)
VVWHRYHLI

SEQ ID NO: 189317 - protein, 9 aa, Artificial Sequence
  Description of Artificial Sequence: Synthetic peptide
  Seed: RMYNMVPFF (TYRP2_HUMAN)
RIYNMVPFK

SEQ ID NO: 189318 - protein, 10 aa, Artificial Sequence
  Description of Artificial Sequence: Synthetic peptide
  Seed: METHLSSKRY (TYRP2_HUMAN)
MATHLSSKRW

SEQ ID NO: 189319 - protein, 10 aa, Artificial Sequence
  Description of Artificial Sequence: Synthetic peptide
  Seed: ISRNSRFSSW (TYRP2_HUMAN)
IARNSRFSSW

SEQ ID NO: 189320 - protein, 9 aa, Artificial Sequence
  Description of Artificial Sequence: Synthetic peptide
  Seed: AARPDDPTL (TYRP2_HUMAN)
ASRPDDPTM

SEQ ID NO: 189321 - protein, 10 aa, Artificial Sequence
  Description of Artificial Sequence: Synthetic peptide
  Seed: RNSMKLPTLK (TYRP2_HUMAN)
RVSMKLPTLR

SEQ ID NO: 189322 - protein, 10 aa, Artificial Sequence
  Description of Artificial Sequence: Synthetic peptide
  Seed: FFQNSTFSFR (TYRP2_HUMAN)
FWQNSTFSFK

SEQ ID NO: 189323 - protein, 10 aa, Artificial Sequence
  Description of Artificial Sequence: Synthetic peptide
  Seed: TRPWSGPYIL (TYRP2_HUMAN)
TDPWSGPYIY

SEQ ID NO: 189324 - protein, 10 aa, Artificial Sequence
  Description of Artificial Sequence: Synthetic peptide
  Seed: ADTRPWSGPY (TYRP2_HUMAN)
AITRPWSGPK

SEQ ID NO: 189325 - protein, 8 aa, Artificial Sequence
  Description of Artificial Sequence: Synthetic peptide
  Seed: SDQLGYSY (TYRP2_HUMAN)
SEQLGYSF

SEQ ID NO: 189326 - protein, 9 aa, Artificial Sequence
  Description of Artificial Sequence: Synthetic peptide
  Seed: RMYNMVPFF (TYRP2_HUMAN)
RSYNMVPFS

SEQ ID NO: 189327 - protein, 9 aa, Artificial Sequence
  Description of Artificial Sequence: Synthetic peptide
  Seed: RMYNMVPFF (TYRP2_HUMAN)
RFYNMVPFA

SEQ ID NO: 189328 - protein, 9 aa, Artificial Sequence
  Description of Artificial Sequence: Synthetic peptide
  Seed: VTWHRYHLL (TYRP2_HUMAN)
VSWHRYHLF

SEQ ID NO: 189329 - protein, 10 aa, Artificial Sequence
  Description of Artificial Sequence: Synthetic peptide
  Seed: ETPGWPTTLL (TYRP2_HUMAN)
EIPGWPTTLK

SEQ ID NO: 189330 - protein, 9 aa, Artificial Sequence
  Description of Artificial Sequence: Synthetic peptide
  Seed: SFALPYWNF (TYRP2_HUMAN)
SFALPYWNY

SEQ ID NO: 189331 - protein, 11 aa, Artificial Sequence
  Description of Artificial Sequence: Synthetic peptide
  Seed: SVYDFFVWLHY (TYRP2_HUMAN)
SFYDFFVWLHY

SEQ ID NO: 189332 - protein, 9 aa, Artificial Sequence
  Description of Artificial Sequence: Synthetic peptide
  Seed: FANCSVYDF (TYRP2_HUMAN)
FVNCSVYDY

SEQ ID NO: 189333 - protein, 11 aa, Artificial Sequence
  Description of Artificial Sequence: Synthetic peptide
  Seed: QRLIGNESFAL (TYRP2_HUMAN)
QSLIGNESFAV

SEQ ID NO: 189334 - protein, 10 aa, Artificial Sequence
  Description of Artificial Sequence: Synthetic peptide
  Seed: MSPLWWGFLL (TYRP2_HUMAN)
MGPLWWGFLY

SEQ ID NO: 189335 - protein, 9 aa, Artificial Sequence
  Description of Artificial Sequence: Synthetic peptide
  Seed: MTVDSLVNK (TYRP2_HUMAN)
MVVDSLVNL

SEQ ID NO: 189336 - protein, 11 aa, Artificial Sequence
  Description of Artificial Sequence: Synthetic peptide
  Seed: RADTRPWSGPY (TYRP2_HUMAN)
RIDTRPWSGPF

SEQ ID NO: 189337 - protein, 11 aa, Artificial Sequence
  Description of Artificial Sequence: Synthetic peptide
  Seed: SLDDYNHLVTL (TYRP2_HUMAN)
SQDDYNHLVTW

SEQ ID NO: 189338 - protein, 9 aa, Artificial Sequence
  Description of Artificial Sequence: Synthetic peptide
  Seed: APIGHNRMY (TYRP2_HUMAN)
ARIGHNRMY

SEQ ID NO: 189339 - protein, 9 aa, Artificial Sequence
  Description of Artificial Sequence: Synthetic peptide
  Seed: QRLIGNESF (TYRP2_HUMAN)
QKLIGNESY

SEQ ID NO: 189340 - protein, 10 aa, Artificial Sequence
  Description of Artificial Sequence: Synthetic peptide
  Seed: LVVMGTLVAL (TYRP2_HUMAN)
LNVMGTLVAI

SEQ ID NO: 189341 - protein, 10 aa, Artificial Sequence
  Description of Artificial Sequence: Synthetic peptide
  Seed: SPLWWGFLLS (TYRP2_HUMAN)
SKLWWGFLLA

SEQ ID NO: 189342 - protein, 9 aa, Artificial Sequence
  Description of Artificial Sequence: Synthetic peptide
  Seed: SQVMSLHNL (TYRP2_HUMAN)
SMVMSLHNL

SEQ ID NO: 189343 - protein, 10 aa, Artificial Sequence
  Description of Artificial Sequence: Synthetic peptide
  Seed: FLTSDQLGYS (TYRP2_HUMAN)
FITSDQLGYL

SEQ ID NO: 189344 - protein, 9 aa, Artificial Sequence
  Description of Artificial Sequence: Synthetic peptide
  Seed: YAIDLPVSV (TYRP2_HUMAN)
YPIDLPVSF

SEQ ID NO: 189345 - protein, 9 aa, Artificial Sequence
  Description of Artificial Sequence: Synthetic peptide
  Seed: DTRPWSGPY (TYRP2_HUMAN)
DIRPWSGPR

SEQ ID NO: 189346 - protein, 9 aa, Artificial Sequence
  Description of Artificial Sequence: Synthetic peptide
  Seed: ISRNSRFSS (TYRP2_HUMAN)
IMRNSRFSI

SEQ ID NO: 189347 - protein, 10 aa, Artificial Sequence
  Description of Artificial Sequence: Synthetic peptide
  Seed: LHYYSVRDTL (TYRP2_HUMAN)
LNYYSVRDTF

SEQ ID NO: 189348 - protein, 9 aa, Artificial Sequence
  Description of Artificial Sequence: Synthetic peptide
  Seed: VYDFFVWLH (TYRP2_HUMAN)
VLDFFVWLY

SEQ ID NO: 189349 - protein, 10 aa, Artificial Sequence
  Description of Artificial Sequence: Synthetic peptide
  Seed: RTCKCTGNFA (TYRP2_HUMAN)
RTCKCTGNFI

SEQ ID NO: 189350 - protein, 10 aa, Artificial Sequence
  Description of Artificial Sequence: Synthetic peptide
  Seed: ALVGLFVLLA (TYRP2_HUMAN)
AMVGLFVLLV

SEQ ID NO: 189351 - protein, 9 aa, Artificial Sequence
  Description of Artificial Sequence: Synthetic peptide
  Seed: VTNEELFLT (TYRP2_HUMAN)
VVNEELFLL

SEQ ID NO: 189352 - protein, 10 aa, Artificial Sequence
  Description of Artificial Sequence: Synthetic peptide
  Seed: NGTYEGLLRR (TYRP2_HUMAN)
NVTYEGLLRR

SEQ ID NO: 189353 - protein, 9 aa, Artificial Sequence
  Description of Artificial Sequence: Synthetic peptide
  Seed: ALVGLFVLL (TYRP2_HUMAN)
AMVGLFVLK

SEQ ID NO: 189354 - protein, 9 aa, Artificial Sequence
  Description of Artificial Sequence: Synthetic peptide
  Seed: VVMGTLVAL (TYRP2_HUMAN)
VTMGTLVAR

SEQ ID NO: 189355 - protein, 9 aa, Artificial Sequence
  Description of Artificial Sequence: Synthetic peptide
  Seed: DTRPWSGPY (TYRP2_HUMAN)
DVRPWSGPW

SEQ ID NO: 189356 - protein, 9 aa, Artificial Sequence
  Description of Artificial Sequence: Synthetic peptide
  Seed: HYYSVRDTL (TYRP2_HUMAN)
HQYSVRDTI

SEQ ID NO: 189357 - protein, 10 aa, Artificial Sequence
  Description of Artificial Sequence: Synthetic peptide
  Seed: RNSMKLPTLK (TYRP2_HUMAN)
RASMKLPTLR

SEQ ID NO: 189358 - protein, 9 aa, Artificial Sequence
  Description of Artificial Sequence: Synthetic peptide
  Seed: SFALPYWNF (TYRP2_HUMAN)
SYALPYWNL

SEQ ID NO: 189359 - protein, 9 aa, Artificial Sequence
  Description of Artificial Sequence: Synthetic peptide
  Seed: FPPVTNEEL (TYRP2_HUMAN)
FHPVTNEEV

SEQ ID NO: 189360 - protein, 8 aa, Artificial Sequence
  Description of Artificial Sequence: Synthetic peptide
  Seed: FSHQGPAF (TYRP2_HUMAN)
FYHQGPAM

SEQ ID NO: 189361 - protein, 9 aa, Artificial Sequence
  Description of Artificial Sequence: Synthetic peptide
  Seed: VVMGTLVAL (TYRP2_HUMAN)
VNMGTLVAY

SEQ ID NO: 189362 - protein, 8 aa, Artificial Sequence
  Description of Artificial Sequence: Synthetic peptide
  Seed: FLNGTNAL (TYRP2_HUMAN)
FYNGTNAY

SEQ ID NO: 189363 - protein, 10 aa, Artificial Sequence
  Description of Artificial Sequence: Synthetic peptide
  Seed: RNSRFSSWET (TYRP2_HUMAN)
RLSRFSSWEV

SEQ ID NO: 189364 - protein, 9 aa, Artificial Sequence
  Description of Artificial Sequence: Synthetic peptide
  Seed: FVLLAFLQY (TYRP2_HUMAN)
FTLLAFLQF

SEQ ID NO: 189365 - protein, 11 aa, Artificial Sequence
  Description of Artificial Sequence: Synthetic peptide
  Seed: SVRDTLLGPGR (TYRP2_HUMAN)
STRDTLLGPGK

SEQ ID NO: 189366 - protein, 10 aa, Artificial Sequence
  Description of Artificial Sequence: Synthetic peptide
  Seed: NGTYEGLLRR (TYRP2_HUMAN)
NETYEGLLRR

SEQ ID NO: 189367 - protein, 10 aa, Artificial Sequence
  Description of Artificial Sequence: Synthetic peptide
  Seed: VALVGLFVLL (TYRP2_HUMAN)
VLLVGLFVLI

SEQ ID NO: 189368 - protein, 10 aa, Artificial Sequence
  Description of Artificial Sequence: Synthetic peptide
  Seed: SAANDPIFVV (TYRP2_HUMAN)
SIANDPIFVA

SEQ ID NO: 189369 - protein, 9 aa, Artificial Sequence
  Description of Artificial Sequence: Synthetic peptide
  Seed: RVCMTVDSL (TYRP2_HUMAN)
RQCMTVDSM

SEQ ID NO: 189370 - protein, 10 aa, Artificial Sequence
  Description of Artificial Sequence: Synthetic peptide
  Seed: AANDPIFVVL (TYRP2_HUMAN)
ALNDPIFVVF

SEQ ID NO: 189371 - protein, 9 aa, Artificial Sequence
  Description of Artificial Sequence: Synthetic peptide
  Seed: ANDPIFVVL (TYRP2_HUMAN)
AMDPIFVVI

SEQ ID NO: 189372 - protein, 9 aa, Artificial Sequence
  Description of Artificial Sequence: Synthetic peptide
  Seed: DSLDDYNHL (TYRP2_HUMAN)
DTLDDYNHI

SEQ ID NO: 189373 - protein, 9 aa, Artificial Sequence
  Description of Artificial Sequence: Synthetic peptide
  Seed: GFDKADGTL (TYRP2_HUMAN)
GLDKADGTL

SEQ ID NO: 189374 - protein, 9 aa, Artificial Sequence
  Description of Artificial Sequence: Synthetic peptide
  Seed: HQGPAFVTW (TYRP2_HUMAN)
HEGPAFVTM

SEQ ID NO: 189375 - protein, 9 aa, Artificial Sequence
  Description of Artificial Sequence: Synthetic peptide
  Seed: SRNSRFSSW (TYRP2_HUMAN)
SRNSRFSSM

SEQ ID NO: 189376 - protein, 9 aa, Artificial Sequence
  Description of Artificial Sequence: Synthetic peptide
  Seed: SRNSRFSSW (TYRP2_HUMAN)
SGNSRFSSY

SEQ ID NO: 189377 - protein, 11 aa, Artificial Sequence
  Description of Artificial Sequence: Synthetic peptide
  Seed: FLTSDQLGYSY (TYRP2_HUMAN)
FKTSDQLGYSY

SEQ ID NO: 189378 - protein, 10 aa, Artificial Sequence
  Description of Artificial Sequence: Synthetic peptide
  Seed: GNESFALPYW (TYRP2_HUMAN)
GQESFALPYW

SEQ ID NO: 189379 - protein, 11 aa, Artificial Sequence
  Description of Artificial Sequence: Synthetic peptide
  Seed: FVVLHSFTDAI (TYRP2_HUMAN)
FLVLHSFTDAI

SEQ ID NO: 189380 - protein, 9 aa, Artificial Sequence
  Description of Artificial Sequence: Synthetic peptide
  Seed: VVMGTLVAL (TYRP2_HUMAN)
VPMGTLVAG

SEQ ID NO: 189381 - protein, 11 aa, Artificial Sequence
  Description of Artificial Sequence: Synthetic peptide
  Seed: HQGPAFVTWHR (TYRP2_HUMAN)
HMGPAFVTWHR

SEQ ID NO: 189382 - protein, 11 aa, Artificial Sequence
  Description of Artificial Sequence: Synthetic peptide
  Seed: FFPPVTNEELF (TYRP2_HUMAN)
FCPPVTNEELW

SEQ ID NO: 189383 - protein, 9 aa, Artificial Sequence
  Description of Artificial Sequence: Synthetic peptide
  Seed: TLLVVMGTL (TYRP2_HUMAN)
TVLVVMGTV

SEQ ID NO: 189384 - protein, 9 aa, Artificial Sequence
  Description of Artificial Sequence: Synthetic peptide
  Seed: RKFFHRTCK (TYRP2_HUMAN)
RSFFHRTCG

SEQ ID NO: 189385 - protein, 9 aa, Artificial Sequence
  Description of Artificial Sequence: Synthetic peptide
  Seed: RVCMTVDSL (TYRP2_HUMAN)
RVCMTVDSY

SEQ ID NO: 189386 - protein, 9 aa, Artificial Sequence
  Description of Artificial Sequence: Synthetic peptide
  Seed: DTRPWSGPY (TYRP2_HUMAN)
DMRPWSGPR

SEQ ID NO: 189387 - protein, 9 aa, Artificial Sequence
  Description of Artificial Sequence: Synthetic peptide
  Seed: LQKFDNPPF (TYRP2_HUMAN)
LAKFDNPPY

SEQ ID NO: 189388 - protein, 10 aa, Artificial Sequence
  Description of Artificial Sequence: Synthetic peptide
  Seed: GTLDSQVMSL (TYRP2_HUMAN)
GSLDSQVMSF

SEQ ID NO: 189389 - protein, 9 aa, Artificial Sequence
  Description of Artificial Sequence: Synthetic peptide
  Seed: YSVRDTLLG (TYRP2_HUMAN)
YTVRDTLLW

SEQ ID NO: 189390 - protein, 10 aa, Artificial Sequence
  Description of Artificial Sequence: Synthetic peptide
  Seed: HNRMYNMVPF (TYRP2_HUMAN)
HHRMYNMVPL

SEQ ID NO: 189391 - protein, 9 aa, Artificial Sequence
  Description of Artificial Sequence: Synthetic peptide
  Seed: YVITTQHWL (TYRP2_HUMAN)
YVITTQHWW

SEQ ID NO: 189392 - protein, 9 aa, Artificial Sequence
  Description of Artificial Sequence: Synthetic peptide
  Seed: ALPYWNFAT (TYRP2_HUMAN)
ATPYWNFAV

SEQ ID NO: 189393 - protein, 9 aa, Artificial Sequence
  Description of Artificial Sequence: Synthetic peptide
  Seed: AARPDDPTL (TYRP2_HUMAN)
AQRPDDPTW

SEQ ID NO: 189394 - protein, 9 aa, Artificial Sequence
  Description of Artificial Sequence: Synthetic peptide
  Seed: STFSFRNAL (TYRP2_HUMAN)
SEFSFRNAY

SEQ ID NO: 189395 - protein, 8 aa, Artificial Sequence
  Description of Artificial Sequence: Synthetic peptide
  Seed: FSHQGPAF (TYRP2_HUMAN)
FVHQGPAI

SEQ ID NO: 189396 - protein, 9 aa, Artificial Sequence
  Description of Artificial Sequence: Synthetic peptide
  Seed: SFLNGTNAL (TYRP2_HUMAN)
SALNGTNAF

SEQ ID NO: 189397 - protein, 10 aa, Artificial Sequence
  Description of Artificial Sequence: Synthetic peptide
  Seed: RRLRKGYTPL (TYRP2_HUMAN)
RYLRKGYTPI

SEQ ID NO: 189398 - protein, 9 aa, Artificial Sequence
  Description of Artificial Sequence: Synthetic peptide
  Seed: IFDEWMKRF (TYRP2_HUMAN)
ITDEWMKRM

SEQ ID NO: 189399 - protein, 9 aa, Artificial Sequence
  Description of Artificial Sequence: Synthetic peptide
  Seed: LGYSYAIDL (TYRP2_HUMAN)
LAYSYAIDF

SEQ ID NO: 189400 - protein, 10 aa, Artificial Sequence
  Description of Artificial Sequence: Synthetic peptide
  Seed: AANDPIFVVL (TYRP2_HUMAN)
AANDPIFVVI

SEQ ID NO: 189401 - protein, 10 aa, Artificial Sequence
  Description of Artificial Sequence: Synthetic peptide
  Seed: SAANDPIFVV (TYRP2_HUMAN)
SLANDPIFVV

SEQ ID NO: 189402 - protein, 9 aa, Artificial Sequence
  Description of Artificial Sequence: Synthetic peptide
  Seed: SFLNGTNAL (TYRP2_HUMAN)
STLNGTNAL

SEQ ID NO: 189403 - protein, 9 aa, Artificial Sequence
  Description of Artificial Sequence: Synthetic peptide
  Seed: YDFFVWLHY (TYRP2_HUMAN)
YFFFVWLHF

SEQ ID NO: 189404 - protein, 9 aa, Artificial Sequence
  Description of Artificial Sequence: Synthetic peptide
  Seed: FQNSTFSFR (TYRP2_HUMAN)
FINSTFSFK

SEQ ID NO: 189405 - protein, 10 aa, Artificial Sequence
  Description of Artificial Sequence: Synthetic peptide
  Seed: NSTFSFRNAL (TYRP2_HUMAN)
NPTFSFRNAL

SEQ ID NO: 189406 - protein, 11 aa, Artificial Sequence
  Description of Artificial Sequence: Synthetic peptide
  Seed: WLHYYSVRDTL (TYRP2_HUMAN)
WSHYYSVRDTW

SEQ ID NO: 189407 - protein, 10 aa, Artificial Sequence
  Description of Artificial Sequence: Synthetic peptide
  Seed: TLLGPGRPYR (TYRP2_HUMAN)
TALGPGRPYK

SEQ ID NO: 189408 - protein, 10 aa, Artificial Sequence
  Description of Artificial Sequence: Synthetic peptide
  Seed: SLSPQEREQF (TYRP2_HUMAN)
SMSPQEREQF

SEQ ID NO: 189409 - protein, 10 aa, Artificial Sequence
  Description of Artificial Sequence: Synthetic peptide
  Seed: MTVDSLVNKE (TYRP2_HUMAN)
MLVDSLVNKR

SEQ ID NO: 189410 - protein, 8 aa, Artificial Sequence
  Description of Artificial Sequence: Synthetic peptide
  Seed: AIDLPVSV (TYRP2_HUMAN)
AQDLPVSL

SEQ ID NO: 189411 - protein, 9 aa, Artificial Sequence
  Description of Artificial Sequence: Synthetic peptide
  Seed: SFLNGTNAL (TYRP2_HUMAN)
SRLNGTNAF

SEQ ID NO: 189412 - protein, 10 aa, Artificial Sequence
  Description of Artificial Sequence: Synthetic peptide
  Seed: ADTRPWSGPY (TYRP2_HUMAN)
ANTRPWSGPK

SEQ ID NO: 189413 - protein, 9 aa, Artificial Sequence
  Description of Artificial Sequence: Synthetic peptide
  Seed: DQLGYSYAI (TYRP2_HUMAN)
DRLGYSYAV

SEQ ID NO: 189414 - protein, 9 aa, Artificial Sequence
  Description of Artificial Sequence: Synthetic peptide
  Seed: RLRKGYTPL (TYRP2_HUMAN)
RLRKGYTPS

SEQ ID NO: 189415 - protein, 11 aa, Artificial Sequence
  Description of Artificial Sequence: Synthetic peptide
  Seed: ELAPIGHNRMY (TYRP2_HUMAN)
ELAPIGHNRMR

SEQ ID NO: 189416 - protein, 10 aa, Artificial Sequence
  Description of Artificial Sequence: Synthetic peptide
  Seed: GQFPRVCMTV (TYRP2_HUMAN)
GRFPRVCMTL

SEQ ID NO: 189417 - protein, 10 aa, Artificial Sequence
  Description of Artificial Sequence: Synthetic peptide
  Seed: METHLSSKRY (TYRP2_HUMAN)
MSTHLSSKRW

SEQ ID NO: 189418 - protein, 10 aa, Artificial Sequence
  Description of Artificial Sequence: Synthetic peptide
  Seed: RVCMTVDSLV (TYRP2_HUMAN)
RLCMTVDSLV

SEQ ID NO: 189419 - protein, 9 aa, Artificial Sequence
  Description of Artificial Sequence: Synthetic peptide
  Seed: VLHSFTDAI (TYRP2_HUMAN)
VAHSFTDAY

SEQ ID NO: 189420 - protein, 8 aa, Artificial Sequence
  Description of Artificial Sequence: Synthetic peptide
  Seed: FPRVCMTV (TYRP2_HUMAN)
FMRVCMTL

SEQ ID NO: 189421 - protein, 9 aa, Artificial Sequence
  Description of Artificial Sequence: Synthetic peptide
  Seed: AARPDDPTL (TYRP2_HUMAN)
ASRPDDPTL

SEQ ID NO: 189422 - protein, 8 aa, Artificial Sequence
  Description of Artificial Sequence: Synthetic peptide
  Seed: AIDLPVSV (TYRP2_HUMAN)
ATDLPVSM

SEQ ID NO: 189423 - protein, 9 aa, Artificial Sequence
  Description of Artificial Sequence: Synthetic peptide
  Seed: FVLLAFLQY (TYRP2_HUMAN)
FPLLAFLQF

SEQ ID NO: 189424 - protein, 11 aa, Artificial Sequence
  Description of Artificial Sequence: Synthetic peptide
  Seed: ELAPIGHNRMY (TYRP2_HUMAN)
ETAPIGHNRMR

SEQ ID NO: 189425 - protein, 9 aa, Artificial Sequence
  Description of Artificial Sequence: Synthetic peptide
  Seed: GTYEGLLRR (TYRP2_HUMAN)
GTYEGLLRY

SEQ ID NO: 189426 - protein, 9 aa, Artificial Sequence
  Description of Artificial Sequence: Synthetic peptide
  Seed: MTVDSLVNK (TYRP2_HUMAN)
MYVDSLVNY

SEQ ID NO: 189427 - protein, 10 aa, Artificial Sequence
  Description of Artificial Sequence: Synthetic peptide
  Seed: RLRKGYTPLM (TYRP2_HUMAN)
RMRKGYTPLS

SEQ ID NO: 189428 - protein, 9 aa, Artificial Sequence
  Description of Artificial Sequence: Synthetic peptide
  Seed: YSYAIDLPV (TYRP2_HUMAN)
YKYAIDLPH

SEQ ID NO: 189429 - protein, 10 aa, Artificial Sequence
  Description of Artificial Sequence: Synthetic peptide
  Seed: REQFLGALDL (TYRP2_HUMAN)
RMQFLGALDM

SEQ ID NO: 189430 - protein, 9 aa, Artificial Sequence
  Description of Artificial Sequence: Synthetic peptide
  Seed: SLDDYNHLV (TYRP2_HUMAN)
SNDDYNHLI

SEQ ID NO: 189431 - protein, 10 aa, Artificial Sequence
  Description of Artificial Sequence: Synthetic peptide
  Seed: CCPRLGAESA (TYRP2_HUMAN)
CAPRLGAESM

SEQ ID NO: 189432 - protein, 9 aa, Artificial Sequence
  Description of Artificial Sequence: Synthetic peptide
  Seed: WHRYHLLCL (TYRP2_HUMAN)
WRRYHLLCF

SEQ ID NO: 189433 - protein, 10 aa, Artificial Sequence
  Description of Artificial Sequence: Synthetic peptide
  Seed: AFLQYRRLRK (TYRP2_HUMAN)
AFLQYRRLRR

SEQ ID NO: 189434 - protein, 10 aa, Artificial Sequence
  Description of Artificial Sequence: Synthetic peptide
  Seed: TQPQFANCSV (TYRP2_HUMAN)
TSPQFANCSL

SEQ ID NO: 189435 - protein, 9 aa, Artificial Sequence
  Description of Artificial Sequence: Synthetic peptide
  Seed: RAIDFSHQG (TYRP2_HUMAN)
RMIDFSHQF

SEQ ID NO: 189436 - protein, 9 aa, Artificial Sequence
  Description of Artificial Sequence: Synthetic peptide
  Seed: NMVPFFPPV (TYRP2_HUMAN)
NRVPFFPPF

SEQ ID NO: 189437 - protein, 10 aa, Artificial Sequence
  Description of Artificial Sequence: Synthetic peptide
  Seed: RRLRKGYTPL (TYRP2_HUMAN)
RILRKGYTPF

SEQ ID NO: 189438 - protein, 9 aa, Artificial Sequence
  Description of Artificial Sequence: Synthetic peptide
  Seed: VTNEELFLT (TYRP2_HUMAN)
VQNEELFLI

SEQ ID NO: 189439 - protein, 9 aa, Artificial Sequence
  Description of Artificial Sequence: Synthetic peptide
  Seed: FFQNSTFSF (TYRP2_HUMAN)
FRQNSTFSY

SEQ ID NO: 189440 - protein, 8 aa, Artificial Sequence
  Description of Artificial Sequence: Synthetic peptide
  Seed: SLDDYNHL (TYRP2_HUMAN)
SCDDYNHL

SEQ ID NO: 189441 - protein, 9 aa, Artificial Sequence
  Description of Artificial Sequence: Synthetic peptide
  Seed: YDFFVWLHY (TYRP2_HUMAN)
YCFFVWLHY

SEQ ID NO: 189442 - protein, 9 aa, Artificial Sequence
  Description of Artificial Sequence: Synthetic peptide
  Seed: IGHNRMYNM (TYRP2_HUMAN)
IAHNRMYNM

SEQ ID NO: 189443 - protein, 9 aa, Artificial Sequence
  Description of Artificial Sequence: Synthetic peptide
  Seed: VVMGTLVAL (TYRP2_HUMAN)
VVMGTLVAY

SEQ ID NO: 189444 - protein, 9 aa, Artificial Sequence
  Description of Artificial Sequence: Synthetic peptide
  Seed: NQMGRNSMK (TYRP2_HUMAN)
NMMGRNSMR

SEQ ID NO: 189445 - protein, 10 aa, Artificial Sequence
  Description of Artificial Sequence: Synthetic peptide
  Seed: AFVTWHRYHL (TYRP2_HUMAN)
AYVTWHRYHI

SEQ ID NO: 189446 - protein, 9 aa, Artificial Sequence
  Description of Artificial Sequence: Synthetic peptide
  Seed: VTWHRYHLL (TYRP2_HUMAN)
VLWHRYHLY

SEQ ID NO: 189447 - protein, 10 aa, Artificial Sequence
  Description of Artificial Sequence: Synthetic peptide
  Seed: CCPRLGAESA (TYRP2_HUMAN)
CHPRLGAESM

SEQ ID NO: 189448 - protein, 9 aa, Artificial Sequence
  Description of Artificial Sequence: Synthetic peptide
  Seed: RMYNMVPFF (TYRP2_HUMAN)
RTYNMVPFT

SEQ ID NO: 189449 - protein, 10 aa, Artificial Sequence
  Description of Artificial Sequence: Synthetic peptide
  Seed: RLIGNESFAL (TYRP2_HUMAN)
REIGNESFAF

SEQ ID NO: 189450 - protein, 9 aa, Artificial Sequence
  Description of Artificial Sequence: Synthetic peptide
  Seed: TEVRADTRP (TYRP2_HUMAN)
TEVRADTRA

SEQ ID NO: 189451 - protein, 9 aa, Artificial Sequence
  Description of Artificial Sequence: Synthetic peptide
  Seed: HSFLNGTNA (TYRP2_HUMAN)
HSFLNGTNF

SEQ ID NO: 189452 - protein, 9 aa, Artificial Sequence
  Description of Artificial Sequence: Synthetic peptide
  Seed: YSVRDTLLG (TYRP2_HUMAN)
YVVRDTLLW

SEQ ID NO: 189453 - protein, 9 aa, Artificial Sequence
  Description of Artificial Sequence: Synthetic peptide
  Seed: YDFFVWLHY (TYRP2_HUMAN)
YAFFVWLHF

SEQ ID NO: 189454 - protein, 8 aa, Artificial Sequence
  Description of Artificial Sequence: Synthetic peptide
  Seed: KFDNPPFF (TYRP2_HUMAN)
KADNPPFL

SEQ ID NO: 189455 - protein, 9 aa, Artificial Sequence
  Description of Artificial Sequence: Synthetic peptide
  Seed: DDYNHLVTL (TYRP2_HUMAN)
DVYNHLVTV

SEQ ID NO: 189456 - protein, 9 aa, Artificial Sequence
  Description of Artificial Sequence: Synthetic peptide
  Seed: RPWSGPYIL (TYRP2_HUMAN)
RHWSGPYIL

SEQ ID NO: 189457 - protein, 9 aa, Artificial Sequence
  Description of Artificial Sequence: Synthetic peptide
  Seed: TLDSQVMSL (TYRP2_HUMAN)
TMDSQVMSM

SEQ ID NO: 189458 - protein, 9 aa, Artificial Sequence
  Description of Artificial Sequence: Synthetic peptide
  Seed: FTDAIFDEW (TYRP2_HUMAN)
FGDAIFDEI

SEQ ID NO: 189459 - protein, 9 aa, Artificial Sequence
  Description of Artificial Sequence: Synthetic peptide
  Seed: VVMGTLVAL (TYRP2_HUMAN)
VFMGTLVAV

SEQ ID NO: 189460 - protein, 9 aa, Artificial Sequence
  Description of Artificial Sequence: Synthetic peptide
  Seed: RMYNMVPFF (TYRP2_HUMAN)
RVYNMVPFG

SEQ ID NO: 189461 - protein, 10 aa, Artificial Sequence
  Description of Artificial Sequence: Synthetic peptide
  Seed: SDQLGYSYAI (TYRP2_HUMAN)
SFQLGYSYAF

SEQ ID NO: 189462 - protein, 10 aa, Artificial Sequence
  Description of Artificial Sequence: Synthetic peptide
  Seed: VLHSFTDAIF (TYRP2_HUMAN)
VQHSFTDAIY

SEQ ID NO: 189463 - protein, 9 aa, Artificial Sequence
  Description of Artificial Sequence: Synthetic peptide
  Seed: VVMGTLVAL (TYRP2_HUMAN)
VLMGTLVAF

SEQ ID NO: 189464 - protein, 9 aa, Artificial Sequence
  Description of Artificial Sequence: Synthetic peptide
  Seed: AARPDDPTL (TYRP2_HUMAN)
APRPDDPTW

SEQ ID NO: 189465 - protein, 9 aa, Artificial Sequence
  Description of Artificial Sequence: Synthetic peptide
  Seed: SVRDTLLGP (TYRP2_HUMAN)
SIRDTLLGK

SEQ ID NO: 189466 - protein, 11 aa, Artificial Sequence
  Description of Artificial Sequence: Synthetic peptide
  Seed: TQPQFANCSVY (TYRP2_HUMAN)
TIPQFANCSVM

SEQ ID NO: 189467 - protein, 10 aa, Artificial Sequence
  Description of Artificial Sequence: Synthetic peptide
  Seed: ESANVCGSQQ (TYRP2_HUMAN)
ELANVCGSQK

SEQ ID NO: 189468 - protein, 9 aa, Artificial Sequence
  Description of Artificial Sequence: Synthetic peptide
  Seed: RDCLSLQKF (TYRP2_HUMAN)
RVCLSLQKL

SEQ ID NO: 189469 - protein, 9 aa, Artificial Sequence
  Description of Artificial Sequence: Synthetic peptide
  Seed: SFLNGTNAL (TYRP2_HUMAN)
SALNGTNAY

SEQ ID NO: 189470 - protein, 11 aa, Artificial Sequence
  Description of Artificial Sequence: Synthetic peptide
  Seed: FQNSTFSFRNA (TYRP2_HUMAN)
FMNSTFSFRNV

SEQ ID NO: 189471 - protein, 9 aa, Artificial Sequence
  Description of Artificial Sequence: Synthetic peptide
  Seed: EQFLGALDL (TYRP2_HUMAN)
EHFLGALDA

SEQ ID NO: 189472 - protein, 10 aa, Artificial Sequence
  Description of Artificial Sequence: Synthetic peptide
  Seed: RNSRFSSWET (TYRP2_HUMAN)
RASRFSSWEL

SEQ ID NO: 189473 - protein, 9 aa, Artificial Sequence
  Description of Artificial Sequence: Synthetic peptide
  Seed: RKFFHRTCK (TYRP2_HUMAN)
RNFFHRTCR

SEQ ID NO: 189474 - protein, 10 aa, Artificial Sequence
  Description of Artificial Sequence: Synthetic peptide
  Seed: AANDPIFVVL (TYRP2_HUMAN)
ASNDPIFVVY

SEQ ID NO: 189475 - protein, 9 aa, Artificial Sequence
  Description of Artificial Sequence: Synthetic peptide
  Seed: RFNPPADAW (TYRP2_HUMAN)
RFNPPADAF

SEQ ID NO: 189476 - protein, 9 aa, Artificial Sequence
  Description of Artificial Sequence: Synthetic peptide
  Seed: DIRDCLSLQ (TYRP2_HUMAN)
DMRDCLSLK

SEQ ID NO: 189477 - protein, 9 aa, Artificial Sequence
  Description of Artificial Sequence: Synthetic peptide
  Seed: RVCMTVDSL (TYRP2_HUMAN)
RICMTVDSY

SEQ ID NO: 189478 - protein, 10 aa, Artificial Sequence
  Description of Artificial Sequence: Synthetic peptide
  Seed: LVVMGTLVAL (TYRP2_HUMAN)
LSVMGTLVAY

SEQ ID NO: 189479 - protein, 10 aa, Artificial Sequence
  Description of Artificial Sequence: Synthetic peptide
  Seed: GTLVALVGLF (TYRP2_HUMAN)
GTLVALVGLW

SEQ ID NO: 189480 - protein, 10 aa, Artificial Sequence
  Description of Artificial Sequence: Synthetic peptide
  Seed: HYYSVRDTLL (TYRP2_HUMAN)
HFYSVRDTLF

SEQ ID NO: 189481 - protein, 9 aa, Artificial Sequence
  Description of Artificial Sequence: Synthetic peptide
  Seed: RNQDDRELW (TYRP2_HUMAN)
RVQDDRELV

SEQ ID NO: 189482 - protein, 10 aa, Artificial Sequence
  Description of Artificial Sequence: Synthetic peptide
  Seed: TLLGPGRPYR (TYRP2_HUMAN)
TALGPGRPYR

SEQ ID NO: 189483 - protein, 9 aa, Artificial Sequence
  Description of Artificial Sequence: Synthetic peptide
  Seed: TLDSQVMSL (TYRP2_HUMAN)
TNDSQVMSF

SEQ ID NO: 189484 - protein, 9 aa, Artificial Sequence
  Description of Artificial Sequence: Synthetic peptide
  Seed: STFSFRNAL (TYRP2_HUMAN)
SPFSFRNAA

SEQ ID NO: 189485 - protein, 11 aa, Artificial Sequence
  Description of Artificial Sequence: Synthetic peptide
  Seed: LPVSVEETPGW (TYRP2_HUMAN)
LLVSVEETPGW

SEQ ID NO: 189486 - protein, 8 aa, Artificial Sequence
  Description of Artificial Sequence: Synthetic peptide
  Seed: YYSVRDTL (TYRP2_HUMAN)
YSSVRDTM

SEQ ID NO: 189487 - protein, 8 aa, Artificial Sequence
  Description of Artificial Sequence: Synthetic peptide
  Seed: FSHQGPAF (TYRP2_HUMAN)
FAHQGPAM

SEQ ID NO: 189488 - protein, 10 aa, Artificial Sequence
  Description of Artificial Sequence: Synthetic peptide
  Seed: FPPVTNEELF (TYRP2_HUMAN)
FVPVTNEELW

SEQ ID NO: 189489 - protein, 9 aa, Artificial Sequence
  Description of Artificial Sequence: Synthetic peptide
  Seed: VVMGTLVAL (TYRP2_HUMAN)
VHMGTLVAF

SEQ ID NO: 189490 - protein, 9 aa, Artificial Sequence
  Description of Artificial Sequence: Synthetic peptide
  Seed: ALPYWNFAT (TYRP2_HUMAN)
ALPYWNFAM

SEQ ID NO: 189491 - protein, 9 aa, Artificial Sequence
  Description of Artificial Sequence: Synthetic peptide
  Seed: FLTSDQLGY (TYRP2_HUMAN)
FMTSDQLGY

SEQ ID NO: 189492 - protein, 9 aa, Artificial Sequence
  Description of Artificial Sequence: Synthetic peptide
  Seed: VIRQNIHSL (TYRP2_HUMAN)
VSRQNIHSK

SEQ ID NO: 189493 - protein, 9 aa, Artificial Sequence
  Description of Artificial Sequence: Synthetic peptide
  Seed: RFNPPADAW (TYRP2_HUMAN)
RFNPPADAL

SEQ ID NO: 189494 - protein, 10 aa, Artificial Sequence
  Description of Artificial Sequence: Synthetic peptide
  Seed: SDQLGYSYAI (TYRP2_HUMAN)
SYQLGYSYAY

SEQ ID NO: 189495 - protein, 8 aa, Artificial Sequence
  Description of Artificial Sequence: Synthetic peptide
  Seed: AIDLPVSV (TYRP2_HUMAN)
ATDLPVSI

SEQ ID NO: 189496 - protein, 10 aa, Artificial Sequence
  Description of Artificial Sequence: Synthetic peptide
  Seed: ESANVCGSQQ (TYRP2_HUMAN)
ETANVCGSQM

SEQ ID NO: 189497 - protein, 10 aa, Artificial Sequence
  Description of Artificial Sequence: Synthetic peptide
  Seed: AANDPIFVVL (TYRP2_HUMAN)
AYNDPIFVVF

SEQ ID NO: 189498 - protein, 9 aa, Artificial Sequence
  Description of Artificial Sequence: Synthetic peptide
  Seed: LSPQEREQF (TYRP2_HUMAN)
LAPQEREQI

SEQ ID NO: 189499 - protein, 9 aa, Artificial Sequence
  Description of Artificial Sequence: Synthetic peptide
  Seed: RQNIHSLSP (TYRP2_HUMAN)
RQNIHSLSA

SEQ ID NO: 189500 - protein, 8 aa, Artificial Sequence
  Description of Artificial Sequence: Synthetic peptide
  Seed: RPWSGPYI (TYRP2_HUMAN)
RPWSGPYM

SEQ ID NO: 189501 - protein, 9 aa, Artificial Sequence
  Description of Artificial Sequence: Synthetic peptide
  Seed: AARPDDPTL (TYRP2_HUMAN)
AVRPDDPTM

SEQ ID NO: 189502 - protein, 9 aa, Artificial Sequence
  Description of Artificial Sequence: Synthetic peptide
  Seed: HPDYVITTQ (TYRP2_HUMAN)
HPDYVITTM

SEQ ID NO: 189503 - protein, 10 aa, Artificial Sequence
  Description of Artificial Sequence: Synthetic peptide
  Seed: IGNESFALPY (TYRP2_HUMAN)
IVNESFALPF

SEQ ID NO: 189504 - protein, 8 aa, Artificial Sequence
  Description of Artificial Sequence: Synthetic peptide
  Seed: LDDYNHLV (TYRP2_HUMAN)
LSDYNHLI

SEQ ID NO: 189505 - protein, 10 aa, Artificial Sequence
  Description of Artificial Sequence: Synthetic peptide
  Seed: LVVMGTLVAL (TYRP2_HUMAN)
LHVMGTLVAI

SEQ ID NO: 189506 - protein, 9 aa, Artificial Sequence
  Description of Artificial Sequence: Synthetic peptide
  Seed: IFDEWMKRF (TYRP2_HUMAN)
IFDEWMKRV

SEQ ID NO: 189507 - protein, 8 aa, Artificial Sequence
  Description of Artificial Sequence: Synthetic peptide
  Seed: RPDDPTLI (TYRP2_HUMAN)
RVDDPTLM

SEQ ID NO: 189508 - protein, 10 aa, Artificial Sequence
  Description of Artificial Sequence: Synthetic peptide
  Seed: KILPGAQGQF (TYRP2_HUMAN)
KVLPGAQGQK

SEQ ID NO: 189509 - protein, 10 aa, Artificial Sequence
  Description of Artificial Sequence: Synthetic peptide
  Seed: GTLDSQVMSL (TYRP2_HUMAN)
GMLDSQVMSM

SEQ ID NO: 189510 - protein, 11 aa, Artificial Sequence
  Description of Artificial Sequence: Synthetic peptide
  Seed: MSLHNLVHSFL (TYRP2_HUMAN)
MILHNLVHSFV

SEQ ID NO: 189511 - protein, 9 aa, Artificial Sequence
  Description of Artificial Sequence: Synthetic peptide
  Seed: STFSFRNAL (TYRP2_HUMAN)
SHFSFRNAF

SEQ ID NO: 189512 - protein, 11 aa, Artificial Sequence
  Description of Artificial Sequence: Synthetic peptide
  Seed: VLLAFLQYRRL (TYRP2_HUMAN)
VMLAFLQYRRL

SEQ ID NO: 189513 - protein, 8 aa, Artificial Sequence
  Description of Artificial Sequence: Synthetic peptide
  Seed: FQNSTFSF (TYRP2_HUMAN)
FANSTFSY

SEQ ID NO: 189514 - protein, 8 aa, Artificial Sequence
  Description of Artificial Sequence: Synthetic peptide
  Seed: LHNLVHSF (TYRP2_HUMAN)
LHNLVHSL

SEQ ID NO: 189515 - protein, 10 aa, Artificial Sequence
  Description of Artificial Sequence: Synthetic peptide
  Seed: VVMGTLVALV (TYRP2_HUMAN)
VCMGTLVALV

SEQ ID NO: 189516 - protein, 11 aa, Artificial Sequence
  Description of Artificial Sequence: Synthetic peptide
  Seed: RADTRPWSGPY (TYRP2_HUMAN)
RRDTRPWSGPA

SEQ ID NO: 189517 - protein, 9 aa, Artificial Sequence
  Description of Artificial Sequence: Synthetic peptide
  Seed: LLGPGRPYR (TYRP2_HUMAN)
LIGPGRPYK

SEQ ID NO: 189518 - protein, 10 aa, Artificial Sequence
  Description of Artificial Sequence: Synthetic peptide
  Seed: SHQGPAFVTW (TYRP2_HUMAN)
SYQGPAFVTL

SEQ ID NO: 189519 - protein, 10 aa, Artificial Sequence
  Description of Artificial Sequence: Synthetic peptide
  Seed: CCPRLGAESA (TYRP2_HUMAN)
CTPRLGAESL

SEQ ID NO: 189520 - protein, 10 aa, Artificial Sequence
  Description of Artificial Sequence: Synthetic peptide
  Seed: FLTSDQLGYS (TYRP2_HUMAN)
FVTSDQLGYV

SEQ ID NO: 189521 - protein, 10 aa, Artificial Sequence
  Description of Artificial Sequence: Synthetic peptide
  Seed: NSRFSSWETV (TYRP2_HUMAN)
NMRFSSWETL

SEQ ID NO: 189522 - protein, 9 aa, Artificial Sequence
  Description of Artificial Sequence: Synthetic peptide
  Seed: RQNIHSLSP (TYRP2_HUMAN)
RANIHSLSF

SEQ ID NO: 189523 - protein, 10 aa, Artificial Sequence
  Description of Artificial Sequence: Synthetic peptide
  Seed: AANDPIFVVL (TYRP2_HUMAN)
AANDPIFVVV

SEQ ID NO: 189524 - protein, 10 aa, Artificial Sequence
  Description of Artificial Sequence: Synthetic peptide
  Seed: RMYNMVPFFP (TYRP2_HUMAN)
RVYNMVPFFV

SEQ ID NO: 189525 - protein, 9 aa, Artificial Sequence
  Description of Artificial Sequence: Synthetic peptide
  Seed: TSDQLGYSY (TYRP2_HUMAN)
TVDQLGYSV

SEQ ID NO: 189526 - protein, 9 aa, Artificial Sequence
  Description of Artificial Sequence: Synthetic peptide
  Seed: GPNGTQPQF (TYRP2_HUMAN)
GVNGTQPQF

SEQ ID NO: 189527 - protein, 9 aa, Artificial Sequence
  Description of Artificial Sequence: Synthetic peptide
  Seed: YAIDLPVSV (TYRP2_HUMAN)
YTIDLPVST

SEQ ID NO: 189528 - protein, 10 aa, Artificial Sequence
  Description of Artificial Sequence: Synthetic peptide
  Seed: CMTVDSLVNK (TYRP2_HUMAN)
CDTVDSLVNR

SEQ ID NO: 189529 - protein, 9 aa, Artificial Sequence
  Description of Artificial Sequence: Synthetic peptide
  Seed: VTWHRYHLL (TYRP2_HUMAN)
VFWHRYHLW

SEQ ID NO: 189530 - protein, 10 aa, Artificial Sequence
  Description of Artificial Sequence: Synthetic peptide
  Seed: AANDPIFVVL (TYRP2_HUMAN)
APNDPIFVVL

SEQ ID NO: 189531 - protein, 9 aa, Artificial Sequence
  Description of Artificial Sequence: Synthetic peptide
  Seed: SLHNLVHSF (TYRP2_HUMAN)
SAHNLVHSI

SEQ ID NO: 189532 - protein, 9 aa, Artificial Sequence
  Description of Artificial Sequence: Synthetic peptide
  Seed: FVWLHYYSV (TYRP2_HUMAN)
FTWLHYYSA

SEQ ID NO: 189533 - protein, 10 aa, Artificial Sequence
  Description of Artificial Sequence: Synthetic peptide
  Seed: SHQGPAFVTW (TYRP2_HUMAN)
SWQGPAFVTF

SEQ ID NO: 189534 - protein, 10 aa, Artificial Sequence
  Description of Artificial Sequence: Synthetic peptide
  Seed: HNRMYNMVPF (TYRP2_HUMAN)
HFRMYNMVPF

SEQ ID NO: 189535 - protein, 10 aa, Artificial Sequence
  Description of Artificial Sequence: Synthetic peptide
  Seed: VVMGTLVALV (TYRP2_HUMAN)
VLMGTLVALC

SEQ ID NO: 189536 - protein, 10 aa, Artificial Sequence
  Description of Artificial Sequence: Synthetic peptide
  Seed: VALVGLFVLL (TYRP2_HUMAN)
VTLVGLFVLV

SEQ ID NO: 189537 - protein, 9 aa, Artificial Sequence
  Description of Artificial Sequence: Synthetic peptide
  Seed: FPPVTNEEL (TYRP2_HUMAN)
FIPVTNEEL

SEQ ID NO: 189538 - protein, 9 aa, Artificial Sequence
  Description of Artificial Sequence: Synthetic peptide
  Seed: FPPVTNEEL (TYRP2_HUMAN)
FQPVTNEEL

SEQ ID NO: 189539 - protein, 10 aa, Artificial Sequence
  Description of Artificial Sequence: Synthetic peptide
  Seed: VALVGLFVLL (TYRP2_HUMAN)
VALVGLFVLV

SEQ ID NO: 189540 - protein, 9 aa, Artificial Sequence
  Description of Artificial Sequence: Synthetic peptide
  Seed: YVITTQHWL (TYRP2_HUMAN)
YSITTQHWW

SEQ ID NO: 189541 - protein, 9 aa, Artificial Sequence
  Description of Artificial Sequence: Synthetic peptide
  Seed: VTNEELFLT (TYRP2_HUMAN)
VINEELFLI

SEQ ID NO: 189542 - protein, 10 aa, Artificial Sequence
  Description of Artificial Sequence: Synthetic peptide
  Seed: GWPTTLLVVM (TYRP2_HUMAN)
GFPTTLLVVY

SEQ ID NO: 189543 - protein, 9 aa, Artificial Sequence
  Description of Artificial Sequence: Synthetic peptide
  Seed: FFPPVTNEE (TYRP2_HUMAN)
FIPPVTNEM

SEQ ID NO: 189544 - protein, 10 aa, Artificial Sequence
  Description of Artificial Sequence: Synthetic peptide
  Seed: RLRKGYTPLM (TYRP2_HUMAN)
RVRKGYTPLS

SEQ ID NO: 189545 - protein, 10 aa, Artificial Sequence
  Description of Artificial Sequence: Synthetic peptide
  Seed: RPWSGPYILR (TYRP2_HUMAN)
RFWSGPYILK

SEQ ID NO: 189546 - protein, 10 aa, Artificial Sequence
  Description of Artificial Sequence: Synthetic peptide
  Seed: GTLDSQVMSL (TYRP2_HUMAN)
GLLDSQVMSV

SEQ ID NO: 189547 - protein, 9 aa, Artificial Sequence
  Description of Artificial Sequence: Synthetic peptide
  Seed: YAIDLPVSV (TYRP2_HUMAN)
YYIDLPVSM

SEQ ID NO: 189548 - protein, 10 aa, Artificial Sequence
  Description of Artificial Sequence: Synthetic peptide
  Seed: SPLWWGFLLS (TYRP2_HUMAN)
SALWWGFLLV

SEQ ID NO: 189549 - protein, 9 aa, Artificial Sequence
  Description of Artificial Sequence: Synthetic peptide
  Seed: SLDDYNHLV (TYRP2_HUMAN)
SSDDYNHLL

SEQ ID NO: 189550 - protein, 8 aa, Artificial Sequence
  Description of Artificial Sequence: Synthetic peptide
  Seed: SLDDYNHL (TYRP2_HUMAN)
SFDDYNHM

SEQ ID NO: 189551 - protein, 11 aa, Artificial Sequence
  Description of Artificial Sequence: Synthetic peptide
  Seed: MYNMVPFFPPV (TYRP2_HUMAN)
MANMVPFFPPL

SEQ ID NO: 189552 - protein, 8 aa, Artificial Sequence
  Description of Artificial Sequence: Synthetic peptide
  Seed: FSHQGPAF (TYRP2_HUMAN)
FMHQGPAF

SEQ ID NO: 189553 - protein, 10 aa, Artificial Sequence
  Description of Artificial Sequence: Synthetic peptide
  Seed: ETPGWPTTLL (TYRP2_HUMAN)
ETPGWPTTLV

SEQ ID NO: 189554 - protein, 10 aa, Artificial Sequence
  Description of Artificial Sequence: Synthetic peptide
  Seed: QGPAFVTWHR (TYRP2_HUMAN)
QVPAFVTWHR

SEQ ID NO: 189555 - protein, 10 aa, Artificial Sequence
  Description of Artificial Sequence: Synthetic peptide
  Seed: SLDDYNHLVT (TYRP2_HUMAN)
STDDYNHLVL

SEQ ID NO: 189556 - protein, 10 aa, Artificial Sequence
  Description of Artificial Sequence: Synthetic peptide
  Seed: GQFPRVCMTV (TYRP2_HUMAN)
GLFPRVCMTY

SEQ ID NO: 189557 - protein, 8 aa, Artificial Sequence
  Description of Artificial Sequence: Synthetic peptide
  Seed: LHNLVHSF (TYRP2_HUMAN)
LQNLVHSF

SEQ ID NO: 189558 - protein, 11 aa, Artificial Sequence
  Description of Artificial Sequence: Synthetic peptide
  Seed: FVVLHSFTDAI (TYRP2_HUMAN)
FWVLHSFTDAI

SEQ ID NO: 189559 - protein, 9 aa, Artificial Sequence
  Description of Artificial Sequence: Synthetic peptide
  Seed: ETPGWPTTL (TYRP2_HUMAN)
EVPGWPTTF

SEQ ID NO: 189560 - protein, 11 aa, Artificial Sequence
  Description of Artificial Sequence: Synthetic peptide
  Seed: YRRLRKGYTPL (TYRP2_HUMAN)
YMRLRKGYTPL

SEQ ID NO: 189561 - protein, 10 aa, Artificial Sequence
  Description of Artificial Sequence: Synthetic peptide
  Seed: ESANVCGSQQ (TYRP2_HUMAN)
ESANVCGSQR

SEQ ID NO: 189562 - protein, 9 aa, Artificial Sequence
  Description of Artificial Sequence: Synthetic peptide
  Seed: LVALVGLFV (TYRP2_HUMAN)
LQALVGLFI

SEQ ID NO: 189563 - protein, 11 aa, Artificial Sequence
  Description of Artificial Sequence: Synthetic peptide
  Seed: TQPQFANCSVY (TYRP2_HUMAN)
TNPQFANCSVY

SEQ ID NO: 189564 - protein, 10 aa, Artificial Sequence
  Description of Artificial Sequence: Synthetic peptide
  Seed: TRPWSGPYIL (TYRP2_HUMAN)
TRPWSGPYIM

SEQ ID NO: 189565 - protein, 10 aa, Artificial Sequence
  Description of Artificial Sequence: Synthetic peptide
  Seed: NSRFSSWETV (TYRP2_HUMAN)
NLRFSSWETL

SEQ ID NO: 189566 - protein, 9 aa, Artificial Sequence
  Description of Artificial Sequence: Synthetic peptide
  Seed: VGLFVLLAF (TYRP2_HUMAN)
VKLFVLLAF

SEQ ID NO: 189567 - protein, 10 aa, Artificial Sequence
  Description of Artificial Sequence: Synthetic peptide
  Seed: FFQNSTFSFR (TYRP2_HUMAN)
FAQNSTFSFR

SEQ ID NO: 189568 - protein, 9 aa, Artificial Sequence
  Description of Artificial Sequence: Synthetic peptide
  Seed: SQVMSLHNL (TYRP2_HUMAN)
SRVMSLHNI

SEQ ID NO: 189569 - protein, 11 aa, Artificial Sequence
  Description of Artificial Sequence: Synthetic peptide
  Seed: RNSRFSSWETV (TYRP2_HUMAN)
RYSRFSSWETM

SEQ ID NO: 189570 - protein, 11 aa, Artificial Sequence
  Description of Artificial Sequence: Synthetic peptide
  Seed: YSYAIDLPVSV (TYRP2_HUMAN)
YLYAIDLPVSM

SEQ ID NO: 189571 - protein, 9 aa, Artificial Sequence
  Description of Artificial Sequence: Synthetic peptide
  Seed: SVRDTLLGP (TYRP2_HUMAN)
SVRDTLLGA

SEQ ID NO: 189572 - protein, 9 aa, Artificial Sequence
  Description of Artificial Sequence: Synthetic peptide
  Seed: RELWPRKFF (TYRP2_HUMAN)
RQLWPRKFF

SEQ ID NO: 189573 - protein, 9 aa, Artificial Sequence
  Description of Artificial Sequence: Synthetic peptide
  Seed: SFRNALEGF (TYRP2_HUMAN)
SQRNALEGF

SEQ ID NO: 189574 - protein, 10 aa, Artificial Sequence
  Description of Artificial Sequence: Synthetic peptide
  Seed: QELAPIGHNR (TYRP2_HUMAN)
QMLAPIGHNK

SEQ ID NO: 189575 - protein, 9 aa, Artificial Sequence
  Description of Artificial Sequence: Synthetic peptide
  Seed: RYHLLCLER (TYRP2_HUMAN)
RSHLLCLEK

SEQ ID NO: 189576 - protein, 9 aa, Artificial Sequence
  Description of Artificial Sequence: Synthetic peptide
  Seed: DQLGYSYAI (TYRP2_HUMAN)
DELGYSYAI

SEQ ID NO: 189577 - protein, 10 aa, Artificial Sequence
  Description of Artificial Sequence: Synthetic peptide
  Seed: KILPGAQGQF (TYRP2_HUMAN)
KQLPGAQGQV

SEQ ID NO: 189578 - protein, 9 aa, Artificial Sequence
  Description of Artificial Sequence: Synthetic peptide
  Seed: NQMGRNSMK (TYRP2_HUMAN)
NMMGRNSMK

SEQ ID NO: 189579 - protein, 11 aa, Artificial Sequence
  Description of Artificial Sequence: Synthetic peptide
  Seed: YTPLMETHLSS (TYRP2_HUMAN)
YWPLMETHLSA

SEQ ID NO: 189580 - protein, 9 aa, Artificial Sequence
  Description of Artificial Sequence: Synthetic peptide
  Seed: HPDYVITTQ (TYRP2_HUMAN)
HADYVITTY

SEQ ID NO: 189581 - protein, 9 aa, Artificial Sequence
  Description of Artificial Sequence: Synthetic peptide
  Seed: EETPGWPTT (TYRP2_HUMAN)
EETPGWPTV

SEQ ID NO: 189582 - protein, 9 aa, Artificial Sequence
  Description of Artificial Sequence: Synthetic peptide
  Seed: FANCSVYDF (TYRP2_HUMAN)
FANCSVYDW

SEQ ID NO: 189583 - protein, 10 aa, Artificial Sequence
  Description of Artificial Sequence: Synthetic peptide
  Seed: KRFNPPADAW (TYRP2_HUMAN)
KVFNPPADAW

SEQ ID NO: 189584 - protein, 10 aa, Artificial Sequence
  Description of Artificial Sequence: Synthetic peptide
  Seed: TRPWSGPYIL (TYRP2_HUMAN)
TPPWSGPYIY

SEQ ID NO: 189585 - protein, 9 aa, Artificial Sequence
  Description of Artificial Sequence: Synthetic peptide
  Seed: VMSLHNLVH (TYRP2_HUMAN)
VQSLHNLVL

SEQ ID NO: 189586 - protein, 11 aa, Artificial Sequence
  Description of Artificial Sequence: Synthetic peptide
  Seed: SLDDYNHLVTL (TYRP2_HUMAN)
SYDDYNHLVTM

SEQ ID NO: 189587 - protein, 9 aa, Artificial Sequence
  Description of Artificial Sequence: Synthetic peptide
  Seed: LLAFLQYRR (TYRP2_HUMAN)
LYAFLQYRR

SEQ ID NO: 189588 - protein, 10 aa, Artificial Sequence
  Description of Artificial Sequence: Synthetic peptide
  Seed: VLLAFLQYRR (TYRP2_HUMAN)
VQLAFLQYRR

SEQ ID NO: 189589 - protein, 9 aa, Artificial Sequence
  Description of Artificial Sequence: Synthetic peptide
  Seed: RLRKGYTPL (TYRP2_HUMAN)
RHRKGYTPK

SEQ ID NO: 189590 - protein, 10 aa, Artificial Sequence
  Description of Artificial Sequence: Synthetic peptide
  Seed: ELAPIGHNRM (TYRP2_HUMAN)
ETAPIGHNRC

SEQ ID NO: 189591 - protein, 10 aa, Artificial Sequence
  Description of Artificial Sequence: Synthetic peptide
  Seed: VVLHSFTDAI (TYRP2_HUMAN)
VLLHSFTDAI

SEQ ID NO: 189592 - protein, 9 aa, Artificial Sequence
  Description of Artificial Sequence: Synthetic peptide
  Seed: RLIGNESFA (TYRP2_HUMAN)
RTIGNESFV

SEQ ID NO: 189593 - protein, 9 aa, Artificial Sequence
  Description of Artificial Sequence: Synthetic peptide
  Seed: FPPVTNEEL (TYRP2_HUMAN)
FAPVTNEEL

SEQ ID NO: 189594 - protein, 9 aa, Artificial Sequence
  Description of Artificial Sequence: Synthetic peptide
  Seed: RMYNMVPFF (TYRP2_HUMAN)
RWYNMVPFA

SEQ ID NO: 189595 - protein, 11 aa, Artificial Sequence
  Description of Artificial Sequence: Synthetic peptide
  Seed: FVVLHSFTDAI (TYRP2_HUMAN)
FRVLHSFTDAV

SEQ ID NO: 189596 - protein, 10 aa, Artificial Sequence
  Description of Artificial Sequence: Synthetic peptide
  Seed: SHQGPAFVTW (TYRP2_HUMAN)
SEQGPAFVTF

SEQ ID NO: 189597 - protein, 9 aa, Artificial Sequence
  Description of Artificial Sequence: Synthetic peptide
  Seed: TLDSQVMSL (TYRP2_HUMAN)
TADSQVMST

SEQ ID NO: 189598 - protein, 10 aa, Artificial Sequence
  Description of Artificial Sequence: Synthetic peptide
  Seed: ELWPRKFFHR (TYRP2_HUMAN)
EYWPRKFFHK

SEQ ID NO: 189599 - protein, 10 aa, Artificial Sequence
  Description of Artificial Sequence: Synthetic peptide
  Seed: ADTRPWSGPY (TYRP2_HUMAN)
AITRPWSGPY

SEQ ID NO: 189600 - protein, 10 aa, Artificial Sequence
  Description of Artificial Sequence: Synthetic peptide
  Seed: DAIFDEWMKR (TYRP2_HUMAN)
DQIFDEWMKR

SEQ ID NO: 189601 - protein, 10 aa, Artificial Sequence
  Description of Artificial Sequence: Synthetic peptide
  Seed: RELWPRKFFH (TYRP2_HUMAN)
RCLWPRKFFR

SEQ ID NO: 189602 - protein, 10 aa, Artificial Sequence
  Description of Artificial Sequence: Synthetic peptide
  Seed: FANCSVYDFF (TYRP2_HUMAN)
FQNCSVYDFF

SEQ ID NO: 189603 - protein, 11 aa, Artificial Sequence
  Description of Artificial Sequence: Synthetic peptide
  Seed: RRNQMGRNSMK (TYRP2_HUMAN)
RMNQMGRNSMK

SEQ ID NO: 189604 - protein, 9 aa, Artificial Sequence
  Description of Artificial Sequence: Synthetic peptide
  Seed: FPPVTNEEL (TYRP2_HUMAN)
FIPVTNEEM

SEQ ID NO: 189605 - protein, 9 aa, Artificial Sequence
  Description of Artificial Sequence: Synthetic peptide
  Seed: SVYDFFVWL (TYRP2_HUMAN)
SSYDFFVWW

SEQ ID NO: 189606 - protein, 9 aa, Artificial Sequence
  Description of Artificial Sequence: Synthetic peptide
  Seed: GQFPRVCMT (TYRP2_HUMAN)
GVFPRVCMV

SEQ ID NO: 189607 - protein, 9 aa, Artificial Sequence
  Description of Artificial Sequence: Synthetic peptide
  Seed: TSDQLGYSY (TYRP2_HUMAN)
TFDQLGYSF

SEQ ID NO: 189608 - protein, 9 aa, Artificial Sequence
  Description of Artificial Sequence: Synthetic peptide
  Seed: SVRDTLLGP (TYRP2_HUMAN)
STRDTLLGM

SEQ ID NO: 189609 - protein, 11 aa, Artificial Sequence
  Description of Artificial Sequence: Synthetic peptide
  Seed: WLHYYSVRDTL (TYRP2_HUMAN)
WEHYYSVRDTW

SEQ ID NO: 189610 - protein, 9 aa, Artificial Sequence
  Description of Artificial Sequence: Synthetic peptide
  Seed: VTWHRYHLL (TYRP2_HUMAN)
VNWHRYHLY

SEQ ID NO: 189611 - protein, 9 aa, Artificial Sequence
  Description of Artificial Sequence: Synthetic peptide
  Seed: RKFFHRTCK (TYRP2_HUMAN)
RTFFHRTCR

SEQ ID NO: 189612 - protein, 10 aa, Artificial Sequence
  Description of Artificial Sequence: Synthetic peptide
  Seed: SDQLGYSYAI (TYRP2_HUMAN)
SVQLGYSYAI

SEQ ID NO: 189613 - protein, 11 aa, Artificial Sequence
  Description of Artificial Sequence: Synthetic peptide
  Seed: SQVMSLHNLVH (TYRP2_HUMAN)
SQVMSLHNLVF

SEQ ID NO: 189614 - protein, 9 aa, Artificial Sequence
  Description of Artificial Sequence: Synthetic peptide
  Seed: APIGHNRMY (TYRP2_HUMAN)
AAIGHNRML

SEQ ID NO: 189615 - protein, 9 aa, Artificial Sequence
  Description of Artificial Sequence: Synthetic peptide
  Seed: RNSMKLPTL (TYRP2_HUMAN)
RASMKLPTI

SEQ ID NO: 189616 - protein, 10 aa, Artificial Sequence
  Description of Artificial Sequence: Synthetic peptide
  Seed: FFVWLHYYSV (TYRP2_HUMAN)
FEVWLHYYSV

SEQ ID NO: 189617 - protein, 9 aa, Artificial Sequence
  Description of Artificial Sequence: Synthetic peptide
  Seed: STFSFRNAL (TYRP2_HUMAN)
SRFSFRNAL

SEQ ID NO: 189618 - protein, 9 aa, Artificial Sequence
  Description of Artificial Sequence: Synthetic peptide
  Seed: RMYNMVPFF (TYRP2_HUMAN)
RVYNMVPFH

SEQ ID NO: 189619 - protein, 9 aa, Artificial Sequence
  Description of Artificial Sequence: Synthetic peptide
  Seed: FTDAIFDEW (TYRP2_HUMAN)
FYDAIFDEM

SEQ ID NO: 189620 - protein, 10 aa, Artificial Sequence
  Description of Artificial Sequence: Synthetic peptide
  Seed: TWHRYHLLCL (TYRP2_HUMAN)
TFHRYHLLCF

SEQ ID NO: 189621 - protein, 9 aa, Artificial Sequence
  Description of Artificial Sequence: Synthetic peptide
  Seed: QKFDNPPFF (TYRP2_HUMAN)
QAFDNPPFY

SEQ ID NO: 189622 - protein, 9 aa, Artificial Sequence
  Description of Artificial Sequence: Synthetic peptide
  Seed: YSYAIDLPV (TYRP2_HUMAN)
YFYAIDLPV

SEQ ID NO: 189623 - protein, 9 aa, Artificial Sequence
  Description of Artificial Sequence: Synthetic peptide
  Seed: ILPGAQGQF (TYRP2_HUMAN)
ILPGAQGQM

SEQ ID NO: 189624 - protein, 9 aa, Artificial Sequence
  Description of Artificial Sequence: Synthetic peptide
  Seed: NMVPFFPPV (TYRP2_HUMAN)
NHVPFFPPF

SEQ ID NO: 189625 - protein, 10 aa, Artificial Sequence
  Description of Artificial Sequence: Synthetic peptide
  Seed: SHQGPAFVTW (TYRP2_HUMAN)
SQQGPAFVTF

SEQ ID NO: 189626 - protein, 10 aa, Artificial Sequence
  Description of Artificial Sequence: Synthetic peptide
  Seed: SVYDFFVWLH (TYRP2_HUMAN)
SYYDFFVWLK

SEQ ID NO: 189627 - protein, 9 aa, Artificial Sequence
  Description of Artificial Sequence: Synthetic peptide
  Seed: RFNPPADAW (TYRP2_HUMAN)
RTNPPADAF

SEQ ID NO: 189628 - protein, 9 aa, Artificial Sequence
  Description of Artificial Sequence: Synthetic peptide
  Seed: RMYNMVPFF (TYRP2_HUMAN)
RTYNMVPFA

SEQ ID NO: 189629 - protein, 10 aa, Artificial Sequence
  Description of Artificial Sequence: Synthetic peptide
  Seed: RELWPRKFFH (TYRP2_HUMAN)
RWLWPRKFFY

SEQ ID NO: 189630 - protein, 9 aa, Artificial Sequence
  Description of Artificial Sequence: Synthetic peptide
  Seed: TLDSQVMSL (TYRP2_HUMAN)
TMDSQVMSL

SEQ ID NO: 189631 - protein, 10 aa, Artificial Sequence
  Description of Artificial Sequence: Synthetic peptide
  Seed: SDQLGYSYAI (TYRP2_HUMAN)
SLQLGYSYAF

SEQ ID NO: 189632 - protein, 10 aa, Artificial Sequence
  Description of Artificial Sequence: Synthetic peptide
  Seed: VVMGTLVALV (TYRP2_HUMAN)
VTMGTLVALA

SEQ ID NO: 189633 - protein, 9 aa, Artificial Sequence
  Description of Artificial Sequence: Synthetic peptide
  Seed: AANDPIFVV (TYRP2_HUMAN)
ATNDPIFVW

SEQ ID NO: 189634 - protein, 9 aa, Artificial Sequence
  Description of Artificial Sequence: Synthetic peptide
  Seed: GFDKADGTL (TYRP2_HUMAN)
GWDKADGTM

SEQ ID NO: 189635 - protein, 8 aa, Artificial Sequence
  Description of Artificial Sequence: Synthetic peptide
  Seed: IFDEWMKR (TYRP2_HUMAN)
IADEWMKL

SEQ ID NO: 189636 - protein, 9 aa, Artificial Sequence
  Description of Artificial Sequence: Synthetic peptide
  Seed: VIRQNIHSL (TYRP2_HUMAN)
VIRQNIHSF

SEQ ID NO: 189637 - protein, 9 aa, Artificial Sequence
  Description of Artificial Sequence: Synthetic peptide
  Seed: FPPVTNEEL (TYRP2_HUMAN)
FMPVTNEEL

SEQ ID NO: 189638 - protein, 11 aa, Artificial Sequence
  Description of Artificial Sequence: Synthetic peptide
  Seed: YTPLMETHLSS (TYRP2_HUMAN)
YAPLMETHLSM

SEQ ID NO: 189639 - protein, 11 aa, Artificial Sequence
  Description of Artificial Sequence: Synthetic peptide
  Seed: MSLHNLVHSFL (TYRP2_HUMAN)
MLLHNLVHSFI

SEQ ID NO: 189640 - protein, 10 aa, Artificial Sequence
  Description of Artificial Sequence: Synthetic peptide
  Seed: MSPLWWGFLL (TYRP2_HUMAN)
MSPLWWGFLA

SEQ ID NO: 189641 - protein, 10 aa, Artificial Sequence
  Description of Artificial Sequence: Synthetic peptide
  Seed: AANDPIFVVL (TYRP2_HUMAN)
AQNDPIFVVV

SEQ ID NO: 189642 - protein, 10 aa, Artificial Sequence
  Description of Artificial Sequence: Synthetic peptide
  Seed: RLRKGYTPLM (TYRP2_HUMAN)
RFRKGYTPLG

SEQ ID NO: 189643 - protein, 11 aa, Artificial Sequence
  Description of Artificial Sequence: Synthetic peptide
  Seed: RNSRFSSWETV (TYRP2_HUMAN)
RCSRFSSWETM

SEQ ID NO: 189644 - protein, 9 aa, Artificial Sequence
  Description of Artificial Sequence: Synthetic peptide
  Seed: FVWLHYYSV (TYRP2_HUMAN)
FTWLHYYSL

SEQ ID NO: 189645 - protein, 9 aa, Artificial Sequence
  Description of Artificial Sequence: Synthetic peptide
  Seed: RQNIHSLSP (TYRP2_HUMAN)
RYNIHSLSY

SEQ ID NO: 189646 - protein, 9 aa, Artificial Sequence
  Description of Artificial Sequence: Synthetic peptide
  Seed: RMYNMVPFF (TYRP2_HUMAN)
RSYNMVPFA

SEQ ID NO: 189647 - protein, 10 aa, Artificial Sequence
  Description of Artificial Sequence: Synthetic peptide
  Seed: SDQLGYSYAI (TYRP2_HUMAN)
SQQLGYSYAF

SEQ ID NO: 189648 - protein, 10 aa, Artificial Sequence
  Description of Artificial Sequence: Synthetic peptide
  Seed: VLHSFTDAIF (TYRP2_HUMAN)
VVHSFTDAIY

SEQ ID NO: 189649 - protein, 9 aa, Artificial Sequence
  Description of Artificial Sequence: Synthetic peptide
  Seed: YAIDLPVSV (TYRP2_HUMAN)
YTIDLPVSI

SEQ ID NO: 189650 - protein, 9 aa, Artificial Sequence
  Description of Artificial Sequence: Synthetic peptide
  Seed: NRMYNMVPF (TYRP2_HUMAN)
NSMYNMVPY

SEQ ID NO: 189651 - protein, 10 aa, Artificial Sequence
  Description of Artificial Sequence: Synthetic peptide
  Seed: TRPWSGPYIL (TYRP2_HUMAN)
TRPWSGPYIF

SEQ ID NO: 189652 - protein, 11 aa, Artificial Sequence
  Description of Artificial Sequence: Synthetic peptide
  Seed: CDSLDDYNHLV (TYRP2_HUMAN)
CFSLDDYNHLL

SEQ ID NO: 189653 - protein, 10 aa, Artificial Sequence
  Description of Artificial Sequence: Synthetic peptide
  Seed: FSFRNALEGF (TYRP2_HUMAN)
FQFRNALEGF

SEQ ID NO: 189654 - protein, 10 aa, Artificial Sequence
  Description of Artificial Sequence: Synthetic peptide
  Seed: FPPVTNEELF (TYRP2_HUMAN)
FLPVTNEELF

SEQ ID NO: 189655 - protein, 9 aa, Artificial Sequence
  Description of Artificial Sequence: Synthetic peptide
  Seed: WPTTLLVVM (TYRP2_HUMAN)
WRTTLLVVL

SEQ ID NO: 189656 - protein, 9 aa, Artificial Sequence
  Description of Artificial Sequence: Synthetic peptide
  Seed: VWLHYYSVR (TYRP2_HUMAN)
VLLHYYSVR

SEQ ID NO: 189657 - protein, 10 aa, Artificial Sequence
  Description of Artificial Sequence: Synthetic peptide
  Seed: CMTVDSLVNK (TYRP2_HUMAN)
CLTVDSLVNR

SEQ ID NO: 189658 - protein, 9 aa, Artificial Sequence
  Description of Artificial Sequence: Synthetic peptide
  Seed: ERKKPPVIR (TYRP2_HUMAN)
ESKKPPVIR

SEQ ID NO: 189659 - protein, 10 aa, Artificial Sequence
  Description of Artificial Sequence: Synthetic peptide
  Seed: RNSRFSSWET (TYRP2_HUMAN)
RESRFSSWEA

SEQ ID NO: 189660 - protein, 11 aa, Artificial Sequence
  Description of Artificial Sequence: Synthetic peptide
  Seed: PFFQNSTFSFR (TYRP2_HUMAN)
PVFQNSTFSFR

SEQ ID NO: 189661 - protein, 9 aa, Artificial Sequence
  Description of Artificial Sequence: Synthetic peptide
  Seed: HQGPAFVTW (TYRP2_HUMAN)
HAGPAFVTM

SEQ ID NO: 189662 - protein, 10 aa, Artificial Sequence
  Description of Artificial Sequence: Synthetic peptide
  Seed: SLSPQEREQF (TYRP2_HUMAN)
SASPQEREQW

SEQ ID NO: 189663 - protein, 9 aa, Artificial Sequence
  Description of Artificial Sequence: Synthetic peptide
  Seed: VSVEETPGW (TYRP2_HUMAN)
VMVEETPGL

SEQ ID NO: 189664 - protein, 10 aa, Artificial Sequence
  Description of Artificial Sequence: Synthetic peptide
  Seed: FSFRNALEGF (TYRP2_HUMAN)
FAFRNALEGW

SEQ ID NO: 189665 - protein, 9 aa, Artificial Sequence
  Description of Artificial Sequence: Synthetic peptide
  Seed: HYYSVRDTL (TYRP2_HUMAN)
HFYSVRDTI

SEQ ID NO: 189666 - protein, 10 aa, Artificial Sequence
  Description of Artificial Sequence: Synthetic peptide
  Seed: SPLWWGFLLS (TYRP2_HUMAN)
SHLWWGFLLV

SEQ ID NO: 189667 - protein, 9 aa, Artificial Sequence
  Description of Artificial Sequence: Synthetic peptide
  Seed: ARPDDPTLI (TYRP2_HUMAN)
AVPDDPTLL

SEQ ID NO: 189668 - protein, 10 aa, Artificial Sequence
  Description of Artificial Sequence: Synthetic peptide
  Seed: YDFFVWLHYY (TYRP2_HUMAN)
YHFFVWLHYF

SEQ ID NO: 189669 - protein, 11 aa, Artificial Sequence
  Description of Artificial Sequence: Synthetic peptide
  Seed: RADTRPWSGPY (TYRP2_HUMAN)
RPDTRPWSGPW

SEQ ID NO: 189670 - protein, 10 aa, Artificial Sequence
  Description of Artificial Sequence: Synthetic peptide
  Seed: LPHSAANDPI (TYRP2_HUMAN)
LPHSAANDPF

SEQ ID NO: 189671 - protein, 10 aa, Artificial Sequence
  Description of Artificial Sequence: Synthetic peptide
  Seed: LHYYSVRDTL (TYRP2_HUMAN)
LSYYSVRDTF

SEQ ID NO: 189672 - protein, 9 aa, Artificial Sequence
  Description of Artificial Sequence: Synthetic peptide
  Seed: SRNSRFSSW (TYRP2_HUMAN)
SQNSRFSSM

SEQ ID NO: 189673 - protein, 9 aa, Artificial Sequence
  Description of Artificial Sequence: Synthetic peptide
  Seed: VIRQNIHSL (TYRP2_HUMAN)
VLRQNIHSW

SEQ ID NO: 189674 - protein, 10 aa, Artificial Sequence
  Description of Artificial Sequence: Synthetic peptide
  Seed: RNQMGRNSMK (TYRP2_HUMAN)
RLQMGRNSMK

SEQ ID NO: 189675 - protein, 10 aa, Artificial Sequence
  Description of Artificial Sequence: Synthetic peptide
  Seed: VVLHSFTDAI (TYRP2_HUMAN)
VQLHSFTDAL

SEQ ID NO: 189676 - protein, 10 aa, Artificial Sequence
  Description of Artificial Sequence: Synthetic peptide
  Seed: FFVWLHYYSV (TYRP2_HUMAN)
FTVWLHYYSL

SEQ ID NO: 189677 - protein, 9 aa, Artificial Sequence
  Description of Artificial Sequence: Synthetic peptide
  Seed: RLRKGYTPL (TYRP2_HUMAN)
RVRKGYTPT

SEQ ID NO: 189678 - protein, 9 aa, Artificial Sequence
  Description of Artificial Sequence: Synthetic peptide
  Seed: ALVGLFVLL (TYRP2_HUMAN)
AMVGLFVLA

SEQ ID NO: 189679 - protein, 10 aa, Artificial Sequence
  Description of Artificial Sequence: Synthetic peptide
  Seed: ADTRPWSGPY (TYRP2_HUMAN)
AVTRPWSGPK

SEQ ID NO: 189680 - protein, 9 aa, Artificial Sequence
  Description of Artificial Sequence: Synthetic peptide
  Seed: RFNPPADAW (TYRP2_HUMAN)
RTNPPADAY

SEQ ID NO: 189681 - protein, 10 aa, Artificial Sequence
  Description of Artificial Sequence: Synthetic peptide
  Seed: ETPGWPTTLL (TYRP2_HUMAN)
EAPGWPTTLR

SEQ ID NO: 189682 - protein, 9 aa, Artificial Sequence
  Description of Artificial Sequence: Synthetic peptide
  Seed: VTWHRYHLL (TYRP2_HUMAN)
VIWHRYHLL

SEQ ID NO: 189683 - protein, 10 aa, Artificial Sequence
  Description of Artificial Sequence: Synthetic peptide
  Seed: LVVMGTLVAL (TYRP2_HUMAN)
LRVMGTLVAY

SEQ ID NO: 189684 - protein, 11 aa, Artificial Sequence
  Description of Artificial Sequence: Synthetic peptide
  Seed: FFPPVTNEELF (TYRP2_HUMAN)
FHPPVTNEELY

SEQ ID NO: 189685 - protein, 9 aa, Artificial Sequence
  Description of Artificial Sequence: Synthetic peptide
  Seed: HYYSVRDTL (TYRP2_HUMAN)
HWYSVRDTY

SEQ ID NO: 189686 - protein, 9 aa, Artificial Sequence
  Description of Artificial Sequence: Synthetic peptide
  Seed: STFSFRNAL (TYRP2_HUMAN)
SPFSFRNAT

SEQ ID NO: 189687 - protein, 9 aa, Artificial Sequence
  Description of Artificial Sequence: Synthetic peptide
  Seed: YAIDLPVSV (TYRP2_HUMAN)
YVIDLPVSI

SEQ ID NO: 189688 - protein, 10 aa, Artificial Sequence
  Description of Artificial Sequence: Synthetic peptide
  Seed: HNRMYNMVPF (TYRP2_HUMAN)
HKRMYNMVPM

SEQ ID NO: 189689 - protein, 10 aa, Artificial Sequence
  Description of Artificial Sequence: Synthetic peptide
  Seed: FFQNSTFSFR (TYRP2_HUMAN)
FYQNSTFSFN

SEQ ID NO: 189690 - protein, 10 aa, Artificial Sequence
  Description of Artificial Sequence: Synthetic peptide
  Seed: HSFLNGTNAL (TYRP2_HUMAN)
HWFLNGTNAL

SEQ ID NO: 189691 - protein, 10 aa, Artificial Sequence
  Description of Artificial Sequence: Synthetic peptide
  Seed: RRLRKGYTPL (TYRP2_HUMAN)
RVLRKGYTPK

SEQ ID NO: 189692 - protein, 10 aa, Artificial Sequence
  Description of Artificial Sequence: Synthetic peptide
  Seed: FLLSCLGCKI (TYRP2_HUMAN)
FGLSCLGCKL

SEQ ID NO: 189693 - protein, 10 aa, Artificial Sequence
  Description of Artificial Sequence: Synthetic peptide
  Seed: LHYYSVRDTL (TYRP2_HUMAN)
LWYYSVRDTM

SEQ ID NO: 189694 - protein, 9 aa, Artificial Sequence
  Description of Artificial Sequence: Synthetic peptide
  Seed: YSYAIDLPV (TYRP2_HUMAN)
YWYAIDLPV

SEQ ID NO: 189695 - protein, 9 aa, Artificial Sequence
  Description of Artificial Sequence: Synthetic peptide
  Seed: APIGHNRMY (TYRP2_HUMAN)
AAIGHNRMY

SEQ ID NO: 189696 - protein, 11 aa, Artificial Sequence
  Description of Artificial Sequence: Synthetic peptide
  Seed: RADTRPWSGPY (TYRP2_HUMAN)
RMDTRPWSGPF

SEQ ID NO: 189697 - protein, 9 aa, Artificial Sequence
  Description of Artificial Sequence: Synthetic peptide
  Seed: FFPPVTNEE (TYRP2_HUMAN)
FQPPVTNEF

SEQ ID NO: 189698 - protein, 10 aa, Artificial Sequence
  Description of Artificial Sequence: Synthetic peptide
  Seed: MGTLVALVGL (TYRP2_HUMAN)
MVTLVALVGI

SEQ ID NO: 189699 - protein, 10 aa, Artificial Sequence
  Description of Artificial Sequence: Synthetic peptide
  Seed: SDQLGYSYAI (TYRP2_HUMAN)
SWQLGYSYAI

SEQ ID NO: 189700 - protein, 10 aa, Artificial Sequence
  Description of Artificial Sequence: Synthetic peptide
  Seed: YNMVPFFPPV (TYRP2_HUMAN)
YNMVPFFPPI

SEQ ID NO: 189701 - protein, 10 aa, Artificial Sequence
  Description of Artificial Sequence: Synthetic peptide
  Seed: FPPVTNEELF (TYRP2_HUMAN)
FAPVTNEELF

SEQ ID NO: 189702 - protein, 10 aa, Artificial Sequence
  Description of Artificial Sequence: Synthetic peptide
  Seed: QPQFANCSVY (TYRP2_HUMAN)
QLQFANCSVY

SEQ ID NO: 189703 - protein, 9 aa, Artificial Sequence
  Description of Artificial Sequence: Synthetic peptide
  Seed: RFNPPADAW (TYRP2_HUMAN)
RQNPPADAY

SEQ ID NO: 189704 - protein, 9 aa, Artificial Sequence
  Description of Artificial Sequence: Synthetic peptide
  Seed: RVHPDYVIT (TYRP2_HUMAN)
RTHPDYVIA

SEQ ID NO: 189705 - protein, 9 aa, Artificial Sequence
  Description of Artificial Sequence: Synthetic peptide
  Seed: YAIDLPVSV (TYRP2_HUMAN)
YMIDLPVST

SEQ ID NO: 189706 - protein, 9 aa, Artificial Sequence
  Description of Artificial Sequence: Synthetic peptide
  Seed: TLLGPGRPY (TYRP2_HUMAN)
TTLGPGRPL

SEQ ID NO: 189707 - protein, 9 aa, Artificial Sequence
  Description of Artificial Sequence: Synthetic peptide
  Seed: VTWHRYHLL (TYRP2_HUMAN)
VVWHRYHLW

SEQ ID NO: 189708 - protein, 9 aa, Artificial Sequence
  Description of Artificial Sequence: Synthetic peptide
  Seed: QFPRVCMTV (TYRP2_HUMAN)
QYPRVCMTW

SEQ ID NO: 189709 - protein, 9 aa, Artificial Sequence
  Description of Artificial Sequence: Synthetic peptide
  Seed: VVMGTLVAL (TYRP2_HUMAN)
VVMGTLVAM

SEQ ID NO: 189710 - protein, 9 aa, Artificial Sequence
  Description of Artificial Sequence: Synthetic peptide
  Seed: FFPPVTNEE (TYRP2_HUMAN)
FVPPVTNEM

SEQ ID NO: 189711 - protein, 10 aa, Artificial Sequence
  Description of Artificial Sequence: Synthetic peptide
  Seed: NGTYEGLLRR (TYRP2_HUMAN)
NITYEGLLRR

SEQ ID NO: 189712 - protein, 9 aa, Artificial Sequence
  Description of Artificial Sequence: Synthetic peptide
  Seed: RKFFHRTCK (TYRP2_HUMAN)
RFFFHRTCR

SEQ ID NO: 189713 - protein, 9 aa, Artificial Sequence
  Description of Artificial Sequence: Synthetic peptide
  Seed: RRLRKGYTP (TYRP2_HUMAN)
RRLRKGYTI

SEQ ID NO: 189714 - protein, 8 aa, Artificial Sequence
  Description of Artificial Sequence: Synthetic peptide
  Seed: FQNSTFSF (TYRP2_HUMAN)
FTNSTFSY

SEQ ID NO: 189715 - protein, 9 aa, Artificial Sequence
  Description of Artificial Sequence: Synthetic peptide
  Seed: FLTSDQLGY (TYRP2_HUMAN)
FQTSDQLGM

SEQ ID NO: 189716 - protein, 10 aa, Artificial Sequence
  Description of Artificial Sequence: Synthetic peptide
  Seed: KILPGAQGQF (TYRP2_HUMAN)
KKLPGAQGQY

SEQ ID NO: 189717 - protein, 10 aa, Artificial Sequence
  Description of Artificial Sequence: Synthetic peptide
  Seed: LHYYSVRDTL (TYRP2_HUMAN)
LQYYSVRDTM

SEQ ID NO: 189718 - protein, 10 aa, Artificial Sequence
  Description of Artificial Sequence: Synthetic peptide
  Seed: RELWPRKFFH (TYRP2_HUMAN)
RCLWPRKFFK

SEQ ID NO: 189719 - protein, 10 aa, Artificial Sequence
  Description of Artificial Sequence: Synthetic peptide
  Seed: FANCSVYDFF (TYRP2_HUMAN)
FPNCSVYDFL

SEQ ID NO: 189720 - protein, 10 aa, Artificial Sequence
  Description of Artificial Sequence: Synthetic peptide
  Seed: SLQKFDNPPF (TYRP2_HUMAN)
SNQKFDNPPY

SEQ ID NO: 189721 - protein, 9 aa, Artificial Sequence
  Description of Artificial Sequence: Synthetic peptide
  Seed: DQLGYSYAI (TYRP2_HUMAN)
DRLGYSYAA

SEQ ID NO: 189722 - protein, 8 aa, Artificial Sequence
  Description of Artificial Sequence: Synthetic peptide
  Seed: RMYNMVPF (TYRP2_HUMAN)
RYYNMVPF

SEQ ID NO: 189723 - protein, 9 aa, Artificial Sequence
  Description of Artificial Sequence: Synthetic peptide
  Seed: YSYAIDLPV (TYRP2_HUMAN)
YKYAIDLPL

SEQ ID NO: 189724 - protein, 9 aa, Artificial Sequence
  Description of Artificial Sequence: Synthetic peptide
  Seed: IFDEWMKRF (TYRP2_HUMAN)
IVDEWMKRF

SEQ ID NO: 189725 - protein, 10 aa, Artificial Sequence
  Description of Artificial Sequence: Synthetic peptide
  Seed: HSAANDPIFV (TYRP2_HUMAN)
HLAANDPIFL

SEQ ID NO: 189726 - protein, 9 aa, Artificial Sequence
  Description of Artificial Sequence: Synthetic peptide
  Seed: FTDAIFDEW (TYRP2_HUMAN)
FPDAIFDEW

SEQ ID NO: 189727 - protein, 10 aa, Artificial Sequence
  Description of Artificial Sequence: Synthetic peptide
  Seed: NGTYEGLLRR (TYRP2_HUMAN)
NATYEGLLRR

SEQ ID NO: 189728 - protein, 9 aa, Artificial Sequence
  Description of Artificial Sequence: Synthetic peptide
  Seed: DTRPWSGPY (TYRP2_HUMAN)
DLRPWSGPY

SEQ ID NO: 189729 - protein, 11 aa, Artificial Sequence
  Description of Artificial Sequence: Synthetic peptide
  Seed: FANCSVYDFFV (TYRP2_HUMAN)
FLNCSVYDFFM

SEQ ID NO: 189730 - protein, 10 aa, Artificial Sequence
  Description of Artificial Sequence: Synthetic peptide
  Seed: GTLDSQVMSL (TYRP2_HUMAN)
GQLDSQVMSM

SEQ ID NO: 189731 - protein, 9 aa, Artificial Sequence
  Description of Artificial Sequence: Synthetic peptide
  Seed: RNQMGRNSM (TYRP2_HUMAN)
RKQMGRNSL

SEQ ID NO: 189732 - protein, 10 aa, Artificial Sequence
  Description of Artificial Sequence: Synthetic peptide
  Seed: MSLHNLVHSF (TYRP2_HUMAN)
MMLHNLVHSY

SEQ ID NO: 189733 - protein, 11 aa, Artificial Sequence
  Description of Artificial Sequence: Synthetic peptide
  Seed: PFFQNSTFSFR (TYRP2_HUMAN)
PSFQNSTFSFR

SEQ ID NO: 189734 - protein, 9 aa, Artificial Sequence
  Description of Artificial Sequence: Synthetic peptide
  Seed: ARPDDPTLI (TYRP2_HUMAN)
ATPDDPTLL

SEQ ID NO: 189735 - protein, 10 aa, Artificial Sequence
  Description of Artificial Sequence: Synthetic peptide
  Seed: FFPPVTNEEL (TYRP2_HUMAN)
FGPPVTNEEL

SEQ ID NO: 189736 - protein, 10 aa, Artificial Sequence
  Description of Artificial Sequence: Synthetic peptide
  Seed: LISRNSRFSS (TYRP2_HUMAN)
LTSRNSRFSK

SEQ ID NO: 189737 - protein, 9 aa, Artificial Sequence
  Description of Artificial Sequence: Synthetic peptide
  Seed: LQKFDNPPF (TYRP2_HUMAN)
LQKFDNPPL

SEQ ID NO: 189738 - protein, 9 aa, Artificial Sequence
  Description of Artificial Sequence: Synthetic peptide
  Seed: FPPVTNEEL (TYRP2_HUMAN)
FYPVTNEEL

SEQ ID NO: 189739 - protein, 9 aa, Artificial Sequence
  Description of Artificial Sequence: Synthetic peptide
  Seed: AARPDDPTL (TYRP2_HUMAN)
ASRPDDPTK

SEQ ID NO: 189740 - protein, 10 aa, Artificial Sequence
  Description of Artificial Sequence: Synthetic peptide
  Seed: SHQGPAFVTW (TYRP2_HUMAN)
SYQGPAFVTF

SEQ ID NO: 189741 - protein, 10 aa, Artificial Sequence
  Description of Artificial Sequence: Synthetic peptide
  Seed: SLDDYNHLVT (TYRP2_HUMAN)
SGDDYNHLVI

SEQ ID NO: 189742 - protein, 9 aa, Artificial Sequence
  Description of Artificial Sequence: Synthetic peptide
  Seed: STFSFRNAL (TYRP2_HUMAN)
SGFSFRNAF

SEQ ID NO: 189743 - protein, 9 aa, Artificial Sequence
  Description of Artificial Sequence: Synthetic peptide
  Seed: YSYAIDLPV (TYRP2_HUMAN)
YAYAIDLPM

SEQ ID NO: 189744 - protein, 9 aa, Artificial Sequence
  Description of Artificial Sequence: Synthetic peptide
  Seed: WMKRFNPPA (TYRP2_HUMAN)
WSKRFNPPF

SEQ ID NO: 189745 - protein, 9 aa, Artificial Sequence
  Description of Artificial Sequence: Synthetic peptide
  Seed: YVITTQHWL (TYRP2_HUMAN)
YTITTQHWV

SEQ ID NO: 189746 - protein, 10 aa, Artificial Sequence
  Description of Artificial Sequence: Synthetic peptide
  Seed: LTSDQLGYSY (TYRP2_HUMAN)
LISDQLGYSW

SEQ ID NO: 189747 - protein, 9 aa, Artificial Sequence
  Description of Artificial Sequence: Synthetic peptide
  Seed: VVMGTLVAL (TYRP2_HUMAN)
VGMGTLVAL

SEQ ID NO: 189748 - protein, 9 aa, Artificial Sequence
  Description of Artificial Sequence: Synthetic peptide
  Seed: YAIDLPVSV (TYRP2_HUMAN)
YFIDLPVSY

SEQ ID NO: 189749 - protein, 10 aa, Artificial Sequence
  Description of Artificial Sequence: Synthetic peptide
  Seed: FFPPVTNEEL (TYRP2_HUMAN)
FEPPVTNEEY

SEQ ID NO: 189750 - protein, 10 aa, Artificial Sequence
  Description of Artificial Sequence: Synthetic peptide
  Seed: DSLDDYNHLV (TYRP2_HUMAN)
DYLDDYNHLI

SEQ ID NO: 189751 - protein, 10 aa, Artificial Sequence
  Description of Artificial Sequence: Synthetic peptide
  Seed: RMYNMVPFFP (TYRP2_HUMAN)
RMYNMVPFFT

SEQ ID NO: 189752 - protein, 10 aa, Artificial Sequence
  Description of Artificial Sequence: Synthetic peptide
  Seed: SLQKFDNPPF (TYRP2_HUMAN)
SQQKFDNPPM

SEQ ID NO: 189753 - protein, 9 aa, Artificial Sequence
  Description of Artificial Sequence: Synthetic peptide
  Seed: SRFSSWETV (TYRP2_HUMAN)
SYFSSWETY

SEQ ID NO: 189754 - protein, 9 aa, Artificial Sequence
  Description of Artificial Sequence: Synthetic peptide
  Seed: FANCSVYDF (TYRP2_HUMAN)
FINCSVYDY

SEQ ID NO: 189755 - protein, 9 aa, Artificial Sequence
  Description of Artificial Sequence: Synthetic peptide
  Seed: RLRKGYTPL (TYRP2_HUMAN)
RMRKGYTPR

SEQ ID NO: 189756 - protein, 10 aa, Artificial Sequence
  Description of Artificial Sequence: Synthetic peptide
  Seed: FANCSVYDFF (TYRP2_HUMAN)
FTNCSVYDFW

SEQ ID NO: 189757 - protein, 9 aa, Artificial Sequence
  Description of Artificial Sequence: Synthetic peptide
  Seed: VVMGTLVAL (TYRP2_HUMAN)
VGMGTLVAW

SEQ ID NO: 189758 - protein, 9 aa, Artificial Sequence
  Description of Artificial Sequence: Synthetic peptide
  Seed: SFLNGTNAL (TYRP2_HUMAN)
SFLNGTNAW

SEQ ID NO: 189759 - protein, 9 aa, Artificial Sequence
  Description of Artificial Sequence: Synthetic peptide
  Seed: QRLIGNESF (TYRP2_HUMAN)
QMLIGNESY

SEQ ID NO: 189760 - protein, 9 aa, Artificial Sequence
  Description of Artificial Sequence: Synthetic peptide
  Seed: VVMGTLVAL (TYRP2_HUMAN)
VSMGTLVAI

SEQ ID NO: 189761 - protein, 10 aa, Artificial Sequence
  Description of Artificial Sequence: Synthetic peptide
  Seed: MSPLWWGFLL (TYRP2_HUMAN)
MWPLWWGFLW

SEQ ID NO: 189762 - protein, 9 aa, Artificial Sequence
  Description of Artificial Sequence: Synthetic peptide
  Seed: AKKRVHPDY (TYRP2_HUMAN)
ALKRVHPDY

SEQ ID NO: 189763 - protein, 10 aa, Artificial Sequence
  Description of Artificial Sequence: Synthetic peptide
  Seed: SVRDTLLGPG (TYRP2_HUMAN)
SSRDTLLGPK

SEQ ID NO: 189764 - protein, 9 aa, Artificial Sequence
  Description of Artificial Sequence: Synthetic peptide
  Seed: YSYAIDLPV (TYRP2_HUMAN)
YIYAIDLPY

SEQ ID NO: 189765 - protein, 9 aa, Artificial Sequence
  Description of Artificial Sequence: Synthetic peptide
  Seed: LSPQEREQF (TYRP2_HUMAN)
LTPQEREQW

SEQ ID NO: 189766 - protein, 8 aa, Artificial Sequence
  Description of Artificial Sequence: Synthetic peptide
  Seed: FSHQGPAF (TYRP2_HUMAN)
FWHQGPAY

SEQ ID NO: 189767 - protein, 10 aa, Artificial Sequence
  Description of Artificial Sequence: Synthetic peptide
  Seed: SLDDYNHLVT (TYRP2_HUMAN)
SADDYNHLVV

SEQ ID NO: 189768 - protein, 10 aa, Artificial Sequence
  Description of Artificial Sequence: Synthetic peptide
  Seed: RPWSGPYILR (TYRP2_HUMAN)
RVWSGPYILK

SEQ ID NO: 189769 - protein, 10 aa, Artificial Sequence
  Description of Artificial Sequence: Synthetic peptide
  Seed: YSYAIDLPVS (TYRP2_HUMAN)
YQYAIDLPVI

SEQ ID NO: 189770 - protein, 10 aa, Artificial Sequence
  Description of Artificial Sequence: Synthetic peptide
  Seed: FFVWLHYYSV (TYRP2_HUMAN)
FQVWLHYYSV

SEQ ID NO: 189771 - protein, 10 aa, Artificial Sequence
  Description of Artificial Sequence: Synthetic peptide
  Seed: GYTPLMETHL (TYRP2_HUMAN)
GYTPLMETHF

SEQ ID NO: 189772 - protein, 9 aa, Artificial Sequence
  Description of Artificial Sequence: Synthetic peptide
  Seed: SFRNALEGF (TYRP2_HUMAN)
SLRNALEGF

SEQ ID NO: 189773 - protein, 10 aa, Artificial Sequence
  Description of Artificial Sequence: Synthetic peptide
  Seed: RLIGNESFAL (TYRP2_HUMAN)
RLIGNESFAA

SEQ ID NO: 189774 - protein, 8 aa, Artificial Sequence
  Description of Artificial Sequence: Synthetic peptide
  Seed: TFSFRNAL (TYRP2_HUMAN)
TFSFRNAF

SEQ ID NO: 189775 - protein, 8 aa, Artificial Sequence
  Description of Artificial Sequence: Synthetic peptide
  Seed: HSFTDAIF (TYRP2_HUMAN)
HQFTDAIF

SEQ ID NO: 189776 - protein, 10 aa, Artificial Sequence
  Description of Artificial Sequence: Synthetic peptide
  Seed: MSPLWWGFLL (TYRP2_HUMAN)
MGPLWWGFLM

SEQ ID NO: 189777 - protein, 11 aa, Artificial Sequence
  Description of Artificial Sequence: Synthetic peptide
  Seed: LLVVMGTLVAL (TYRP2_HUMAN)
LMVVMGTLVAL

SEQ ID NO: 189778 - protein, 9 aa, Artificial Sequence
  Description of Artificial Sequence: Synthetic peptide
  Seed: SVYDFFVWL (TYRP2_HUMAN)
SMYDFFVWM

SEQ ID NO: 189779 - protein, 10 aa, Artificial Sequence
  Description of Artificial Sequence: Synthetic peptide
  Seed: GNESFALPYW (TYRP2_HUMAN)
GYESFALPYW

SEQ ID NO: 189780 - protein, 9 aa, Artificial Sequence
  Description of Artificial Sequence: Synthetic peptide
  Seed: AARPDDPTL (TYRP2_HUMAN)
AMRPDDPTL

SEQ ID NO: 189781 - protein, 11 aa, Artificial Sequence
  Description of Artificial Sequence: Synthetic peptide
  Seed: SQVMSLHNLVH (TYRP2_HUMAN)
SQVMSLHNLVM

SEQ ID NO: 189782 - protein, 9 aa, Artificial Sequence
  Description of Artificial Sequence: Synthetic peptide
  Seed: FFQNSTFSF (TYRP2_HUMAN)
FLQNSTFSY

SEQ ID NO: 189783 - protein, 10 aa, Artificial Sequence
  Description of Artificial Sequence: Synthetic peptide
  Seed: RLRKGYTPLM (TYRP2_HUMAN)
RIRKGYTPLG

SEQ ID NO: 189784 - protein, 9 aa, Artificial Sequence
  Description of Artificial Sequence: Synthetic peptide
  Seed: YAIDLPVSV (TYRP2_HUMAN)
YAIDLPVSW

SEQ ID NO: 189785 - protein, 9 aa, Artificial Sequence
  Description of Artificial Sequence: Synthetic peptide
  Seed: ERKKPPVIR (TYRP2_HUMAN)
EAKKPPVIR

SEQ ID NO: 189786 - protein, 9 aa, Artificial Sequence
  Description of Artificial Sequence: Synthetic peptide
  Seed: VVMGTLVAL (TYRP2_HUMAN)
VSMGTLVAL

SEQ ID NO: 189787 - protein, 9 aa, Artificial Sequence
  Description of Artificial Sequence: Synthetic peptide
  Seed: VVMGTLVAL (TYRP2_HUMAN)
VAMGTLVAV

SEQ ID NO: 189788 - protein, 10 aa, Artificial Sequence
  Description of Artificial Sequence: Synthetic peptide
  Seed: SFTDAIFDEW (TYRP2_HUMAN)
SWTDAIFDEF

SEQ ID NO: 189789 - protein, 10 aa, Artificial Sequence
  Description of Artificial Sequence: Synthetic peptide
  Seed: YDFFVWLHYY (TYRP2_HUMAN)
YMFFVWLHYF

SEQ ID NO: 189790 - protein, 10 aa, Artificial Sequence
  Description of Artificial Sequence: Synthetic peptide
  Seed: AANDPIFVVL (TYRP2_HUMAN)
AVNDPIFVVL

SEQ ID NO: 189791 - protein, 9 aa, Artificial Sequence
  Description of Artificial Sequence: Synthetic peptide
  Seed: RLRKGYTPL (TYRP2_HUMAN)
RQRKGYTPF

SEQ ID NO: 189792 - protein, 9 aa, Artificial Sequence
  Description of Artificial Sequence: Synthetic peptide
  Seed: ILPGAQGQF (TYRP2_HUMAN)
IIPGAQGQM

SEQ ID NO: 189793 - protein, 9 aa, Artificial Sequence
  Description of Artificial Sequence: Synthetic peptide
  Seed: MTVDSLVNK (TYRP2_HUMAN)
MVVDSLVNM

SEQ ID NO: 189794 - protein, 9 aa, Artificial Sequence
  Description of Artificial Sequence: Synthetic peptide
  Seed: TTLLVVMGT (TYRP2_HUMAN)
TTLLVVMGA

SEQ ID NO: 189795 - protein, 11 aa, Artificial Sequence
  Description of Artificial Sequence: Synthetic peptide
  Seed: YSYAIDLPVSV (TYRP2_HUMAN)
YVYAIDLPVSI

SEQ ID NO: 189796 - protein, 10 aa, Artificial Sequence
  Description of Artificial Sequence: Synthetic peptide
  Seed: RPDDPTLISR (TYRP2_HUMAN)
RTDDPTLISM

SEQ ID NO: 189797 - protein, 10 aa, Artificial Sequence
  Description of Artificial Sequence: Synthetic peptide
  Seed: QVMSLHNLVH (TYRP2_HUMAN)
QTMSLHNLVR

SEQ ID NO: 189798 - protein, 11 aa, Artificial Sequence
  Description of Artificial Sequence: Synthetic peptide
  Seed: RADTRPWSGPY (TYRP2_HUMAN)
RWDTRPWSGPY

SEQ ID NO: 189799 - protein, 9 aa, Artificial Sequence
  Description of Artificial Sequence: Synthetic peptide
  Seed: TSDQLGYSY (TYRP2_HUMAN)
TMDQLGYSY

SEQ ID NO: 189800 - protein, 8 aa, Artificial Sequence
  Description of Artificial Sequence: Synthetic peptide
  Seed: NQMGRNSM (TYRP2_HUMAN)
NMMGRNSL

SEQ ID NO: 189801 - protein, 9 aa, Artificial Sequence
  Description of Artificial Sequence: Synthetic peptide
  Seed: RLRKGYTPL (TYRP2_HUMAN)
RIRKGYTPQ

SEQ ID NO: 189802 - protein, 10 aa, Artificial Sequence
  Description of Artificial Sequence: Synthetic peptide
  Seed: VVLHSFTDAI (TYRP2_HUMAN)
VWLHSFTDAV

SEQ ID NO: 189803 - protein, 10 aa, Artificial Sequence
  Description of Artificial Sequence: Synthetic peptide
  Seed: LVVMGTLVAL (TYRP2_HUMAN)
LHVMGTLVAY

SEQ ID NO: 189804 - protein, 9 aa, Artificial Sequence
  Description of Artificial Sequence: Synthetic peptide
  Seed: DFFVWLHYY (TYRP2_HUMAN)
DMFVWLHYR

SEQ ID NO: 189805 - protein, 10 aa, Artificial Sequence
  Description of Artificial Sequence: Synthetic peptide
  Seed: MGTLVALVGL (TYRP2_HUMAN)
MNTLVALVGV

SEQ ID NO: 189806 - protein, 9 aa, Artificial Sequence
  Description of Artificial Sequence: Synthetic peptide
  Seed: STFSFRNAL (TYRP2_HUMAN)
SIFSFRNAL

SEQ ID NO: 189807 - protein, 9 aa, Artificial Sequence
  Description of Artificial Sequence: Synthetic peptide
  Seed: VIRQNIHSL (TYRP2_HUMAN)
VFRQNIHSV

SEQ ID NO: 189808 - protein, 9 aa, Artificial Sequence
  Description of Artificial Sequence: Synthetic peptide
  Seed: SRNSRFSSW (TYRP2_HUMAN)
SSNSRFSSF

SEQ ID NO: 189809 - protein, 9 aa, Artificial Sequence
  Description of Artificial Sequence: Synthetic peptide
  Seed: VLHSFTDAI (TYRP2_HUMAN)
VIHSFTDAY

SEQ ID NO: 189810 - protein, 10 aa, Artificial Sequence
  Description of Artificial Sequence: Synthetic peptide
  Seed: TWHRYHLLCL (TYRP2_HUMAN)
TYHRYHLLCF

SEQ ID NO: 189811 - protein, 10 aa, Artificial Sequence
  Description of Artificial Sequence: Synthetic peptide
  Seed: FLTSDQLGYS (TYRP2_HUMAN)
FLTSDQLGYV

SEQ ID NO: 189812 - protein, 9 aa, Artificial Sequence
  Description of Artificial Sequence: Synthetic peptide
  Seed: AANDPIFVV (TYRP2_HUMAN)
AYNDPIFVL

SEQ ID NO: 189813 - protein, 9 aa, Artificial Sequence
  Description of Artificial Sequence: Synthetic peptide
  Seed: DDYNHLVTL (TYRP2_HUMAN)
DPYNHLVTI

SEQ ID NO: 189814 - protein, 10 aa, Artificial Sequence
  Description of Artificial Sequence: Synthetic peptide
  Seed: LVVMGTLVAL (TYRP2_HUMAN)
LWVMGTLVAL

SEQ ID NO: 189815 - protein, 10 aa, Artificial Sequence
  Description of Artificial Sequence: Synthetic peptide
  Seed: YSYAIDLPVS (TYRP2_HUMAN)
YQYAIDLPVV

SEQ ID NO: 189816 - protein, 9 aa, Artificial Sequence
  Description of Artificial Sequence: Synthetic peptide
  Seed: WHRYHLLCL (TYRP2_HUMAN)
WLRYHLLCF

SEQ ID NO: 189817 - protein, 9 aa, Artificial Sequence
  Description of Artificial Sequence: Synthetic peptide
  Seed: RLRKGYTPL (TYRP2_HUMAN)
RIRKGYTPL

SEQ ID NO: 189818 - protein, 10 aa, Artificial Sequence
  Description of Artificial Sequence: Synthetic peptide
  Seed: TRPWSGPYIL (TYRP2_HUMAN)
THPWSGPYIY

SEQ ID NO: 189819 - protein, 8 aa, Artificial Sequence
  Description of Artificial Sequence: Synthetic peptide
  Seed: RPDDPTLI (TYRP2_HUMAN)
RIDDPTLL

SEQ ID NO: 189820 - protein, 9 aa, Artificial Sequence
  Description of Artificial Sequence: Synthetic peptide
  Seed: FSHQGPAFV (TYRP2_HUMAN)
FVHQGPAFV

SEQ ID NO: 189821 - protein, 9 aa, Artificial Sequence
  Description of Artificial Sequence: Synthetic peptide
  Seed: VVMGTLVAL (TYRP2_HUMAN)
VSMGTLVAW

SEQ ID NO: 189822 - protein, 10 aa, Artificial Sequence
  Description of Artificial Sequence: Synthetic peptide
  Seed: YSYAIDLPVS (TYRP2_HUMAN)
YVYAIDLPVI

SEQ ID NO: 189823 - protein, 9 aa, Artificial Sequence
  Description of Artificial Sequence: Synthetic peptide
  Seed: FFPPVTNEE (TYRP2_HUMAN)
FTPPVTNEM

SEQ ID NO: 189824 - protein, 9 aa, Artificial Sequence
  Description of Artificial Sequence: Synthetic peptide
  Seed: ALVGLFVLL (TYRP2_HUMAN)
AVVGLFVLA

SEQ ID NO: 189825 - protein, 10 aa, Artificial Sequence
  Description of Artificial Sequence: Synthetic peptide
  Seed: GTLDSQVMSL (TYRP2_HUMAN)
GCLDSQVMSV

SEQ ID NO: 189826 - protein, 10 aa, Artificial Sequence
  Description of Artificial Sequence: Synthetic peptide
  Seed: MSPLWWGFLL (TYRP2_HUMAN)
MNPLWWGFLF

SEQ ID NO: 189827 - protein, 9 aa, Artificial Sequence
  Description of Artificial Sequence: Synthetic peptide
  Seed: RLRKGYTPL (TYRP2_HUMAN)
RQRKGYTPV

SEQ ID NO: 189828 - protein, 10 aa, Artificial Sequence
  Description of Artificial Sequence: Synthetic peptide
  Seed: SYAIDLPVSV (TYRP2_HUMAN)
SWAIDLPVSF

SEQ ID NO: 189829 - protein, 10 aa, Artificial Sequence
  Description of Artificial Sequence: Synthetic peptide
  Seed: DAWPQELAPI (TYRP2_HUMAN)
DTWPQELAPV

SEQ ID NO: 189830 - protein, 9 aa, Artificial Sequence
  Description of Artificial Sequence: Synthetic peptide
  Seed: RFNPPADAW (TYRP2_HUMAN)
RQNPPADAL

SEQ ID NO: 189831 - protein, 9 aa, Artificial Sequence
  Description of Artificial Sequence: Synthetic peptide
  Seed: ISRNSRFSS (TYRP2_HUMAN)
IFRNSRFSV

SEQ ID NO: 189832 - protein, 10 aa, Artificial Sequence
  Description of Artificial Sequence: Synthetic peptide
  Seed: SDQLGYSYAI (TYRP2_HUMAN)
SNQLGYSYAM

SEQ ID NO: 189833 - protein, 9 aa, Artificial Sequence
  Description of Artificial Sequence: Synthetic peptide
  Seed: RTCKCTGNF (TYRP2_HUMAN)
RVCKCTGNW

SEQ ID NO: 189834 - protein, 10 aa, Artificial Sequence
  Description of Artificial Sequence: Synthetic peptide
  Seed: FANCSVYDFF (TYRP2_HUMAN)
FQNCSVYDFY

SEQ ID NO: 189835 - protein, 11 aa, Artificial Sequence
  Description of Artificial Sequence: Synthetic peptide
  Seed: YNMVPFFPPVT (TYRP2_HUMAN)
YTMVPFFPPVR

SEQ ID NO: 189836 - protein, 10 aa, Artificial Sequence
  Description of Artificial Sequence: Synthetic peptide
  Seed: LGPNGTQPQF (TYRP2_HUMAN)
LVPNGTQPQW

SEQ ID NO: 189837 - protein, 9 aa, Artificial Sequence
  Description of Artificial Sequence: Synthetic peptide
  Seed: SQVMSLHNL (TYRP2_HUMAN)
SLVMSLHNY

SEQ ID NO: 189838 - protein, 9 aa, Artificial Sequence
  Description of Artificial Sequence: Synthetic peptide
  Seed: TLDSQVMSL (TYRP2_HUMAN)
TWDSQVMSV

SEQ ID NO: 189839 - protein, 11 aa, Artificial Sequence
  Description of Artificial Sequence: Synthetic peptide
  Seed: VCDSLDDYNHL (TYRP2_HUMAN)
VADSLDDYNHM

SEQ ID NO: 189840 - protein, 9 aa, Artificial Sequence
  Description of Artificial Sequence: Synthetic peptide
  Seed: YAIDLPVSV (TYRP2_HUMAN)
YYIDLPVSI

SEQ ID NO: 189841 - protein, 8 aa, Artificial Sequence
  Description of Artificial Sequence: Synthetic peptide
  Seed: LDDYNHLV (TYRP2_HUMAN)
LADYNHLL

SEQ ID NO: 189842 - protein, 9 aa, Artificial Sequence
  Description of Artificial Sequence: Synthetic peptide
  Seed: AARPDDPTL (TYRP2_HUMAN)
ARRPDDPTL

SEQ ID NO: 189843 - protein, 9 aa, Artificial Sequence
  Description of Artificial Sequence: Synthetic peptide
  Seed: VIRQNIHSL (TYRP2_HUMAN)
VTRQNIHSW

SEQ ID NO: 189844 - protein, 10 aa, Artificial Sequence
  Description of Artificial Sequence: Synthetic peptide
  Seed: FSFRNALEGF (TYRP2_HUMAN)
FPFRNALEGM

SEQ ID NO: 189845 - protein, 10 aa, Artificial Sequence
  Description of Artificial Sequence: Synthetic peptide
  Seed: FLLSCLGCKI (TYRP2_HUMAN)
FLLSCLGCKV

SEQ ID NO: 189846 - protein, 9 aa, Artificial Sequence
  Description of Artificial Sequence: Synthetic peptide
  Seed: YAIDLPVSV (TYRP2_HUMAN)
YRIDLPVSA

SEQ ID NO: 189847 - protein, 9 aa, Artificial Sequence
  Description of Artificial Sequence: Synthetic peptide
  Seed: RMYNMVPFF (TYRP2_HUMAN)
RVYNMVPFA

SEQ ID NO: 189848 - protein, 9 aa, Artificial Sequence
  Description of Artificial Sequence: Synthetic peptide
  Seed: FLNGTNALP (TYRP2_HUMAN)
FLNGTNALL

SEQ ID NO: 189849 - protein, 10 aa, Artificial Sequence
  Description of Artificial Sequence: Synthetic peptide
  Seed: RPWSGPYILR (TYRP2_HUMAN)
RFWSGPYILR

SEQ ID NO: 189850 - protein, 9 aa, Artificial Sequence
  Description of Artificial Sequence: Synthetic peptide
  Seed: SLHNLVHSF (TYRP2_HUMAN)
SSHNLVHSH

SEQ ID NO: 189851 - protein, 9 aa, Artificial Sequence
  Description of Artificial Sequence: Synthetic peptide
  Seed: GTYEGLLRR (TYRP2_HUMAN)
GIYEGLLRR

SEQ ID NO: 189852 - protein, 10 aa, Artificial Sequence
  Description of Artificial Sequence: Synthetic peptide
  Seed: RPDDPTLISR (TYRP2_HUMAN)
RADDPTLISL

SEQ ID NO: 189853 - protein, 10 aa, Artificial Sequence
  Description of Artificial Sequence: Synthetic peptide
  Seed: SLDDYNHLVT (TYRP2_HUMAN)
SIDDYNHLVV

SEQ ID NO: 189854 - protein, 10 aa, Artificial Sequence
  Description of Artificial Sequence: Synthetic peptide
  Seed: YNMVPFFPPV (TYRP2_HUMAN)
YRMVPFFPPI

SEQ ID NO: 189855 - protein, 9 aa, Artificial Sequence
  Description of Artificial Sequence: Synthetic peptide
  Seed: SLHNLVHSF (TYRP2_HUMAN)
SMHNLVHSM

SEQ ID NO: 189856 - protein, 10 aa, Artificial Sequence
  Description of Artificial Sequence: Synthetic peptide
  Seed: RELWPRKFFH (TYRP2_HUMAN)
RGLWPRKFFR

SEQ ID NO: 189857 - protein, 9 aa, Artificial Sequence
  Description of Artificial Sequence: Synthetic peptide
  Seed: SQVMSLHNL (TYRP2_HUMAN)
SHVMSLHNI

SEQ ID NO: 189858 - protein, 8 aa, Artificial Sequence
  Description of Artificial Sequence: Synthetic peptide
  Seed: KFDNPPFF (TYRP2_HUMAN)
KVDNPPFM

SEQ ID NO: 189859 - protein, 9 aa, Artificial Sequence
  Description of Artificial Sequence: Synthetic peptide
  Seed: RYHLLCLER (TYRP2_HUMAN)
RLHLLCLER

SEQ ID NO: 189860 - protein, 9 aa, Artificial Sequence
  Description of Artificial Sequence: Synthetic peptide
  Seed: DSLDDYNHL (TYRP2_HUMAN)
DTLDDYNHR

SEQ ID NO: 189861 - protein, 10 aa, Artificial Sequence
  Description of Artificial Sequence: Synthetic peptide
  Seed: YHLLCLERDL (TYRP2_HUMAN)
YLLLCLERDL

SEQ ID NO: 189862 - protein, 10 aa, Artificial Sequence
  Description of Artificial Sequence: Synthetic peptide
  Seed: LVVMGTLVAL (TYRP2_HUMAN)
LFVMGTLVAI

SEQ ID NO: 189863 - protein, 10 aa, Artificial Sequence
  Description of Artificial Sequence: Synthetic peptide
  Seed: SPLWWGFLLS (TYRP2_HUMAN)
SLLWWGFLLM

SEQ ID NO: 189864 - protein, 9 aa, Artificial Sequence
  Description of Artificial Sequence: Synthetic peptide
  Seed: LLRRNQMGR (TYRP2_HUMAN)
LYRRNQMGR

SEQ ID NO: 189865 - protein, 9 aa, Artificial Sequence
  Description of Artificial Sequence: Synthetic peptide
  Seed: NRMYNMVPF (TYRP2_HUMAN)
NKMYNMVPF

SEQ ID NO: 189866 - protein, 10 aa, Artificial Sequence
  Description of Artificial Sequence: Synthetic peptide
  Seed: LVVMGTLVAL (TYRP2_HUMAN)
LYVMGTLVAV

SEQ ID NO: 189867 - protein, 9 aa, Artificial Sequence
  Description of Artificial Sequence: Synthetic peptide
  Seed: LVNKECCPR (TYRP2_HUMAN)
LTNKECCPR

SEQ ID NO: 189868 - protein, 10 aa, Artificial Sequence
  Description of Artificial Sequence: Synthetic peptide
  Seed: DAIFDEWMKR (TYRP2_HUMAN)
DFIFDEWMKR

SEQ ID NO: 189869 - protein, 10 aa, Artificial Sequence
  Description of Artificial Sequence: Synthetic peptide
  Seed: KRFNPPADAW (TYRP2_HUMAN)
KQFNPPADAW

SEQ ID NO: 189870 - protein, 10 aa, Artificial Sequence
  Description of Artificial Sequence: Synthetic peptide
  Seed: FLLSCLGCKI (TYRP2_HUMAN)
FVLSCLGCKL

SEQ ID NO: 189871 - protein, 9 aa, Artificial Sequence
  Description of Artificial Sequence: Synthetic peptide
  Seed: FLNGTNALP (TYRP2_HUMAN)
FLNGTNALT

SEQ ID NO: 189872 - protein, 10 aa, Artificial Sequence
  Description of Artificial Sequence: Synthetic peptide
  Seed: REQFLGALDL (TYRP2_HUMAN)
RPQFLGALDF

SEQ ID NO: 189873 - protein, 9 aa, Artificial Sequence
  Description of Artificial Sequence: Synthetic peptide
  Seed: RLRKGYTPL (TYRP2_HUMAN)
RRRKGYTPF

SEQ ID NO: 189874 - protein, 9 aa, Artificial Sequence
  Description of Artificial Sequence: Synthetic peptide
  Seed: FSHQGPAFV (TYRP2_HUMAN)
FRHQGPAFL

SEQ ID NO: 189875 - protein, 8 aa, Artificial Sequence
  Description of Artificial Sequence: Synthetic peptide
  Seed: LDDYNHLV (TYRP2_HUMAN)
LSDYNHLM

SEQ ID NO: 189876 - protein, 9 aa, Artificial Sequence
  Description of Artificial Sequence: Synthetic peptide
  Seed: LVALVGLFV (TYRP2_HUMAN)
LVALVGLFI

SEQ ID NO: 189877 - protein, 9 aa, Artificial Sequence
  Description of Artificial Sequence: Synthetic peptide
  Seed: TLDSQVMSL (TYRP2_HUMAN)
TWDSQVMSI

SEQ ID NO: 189878 - protein, 10 aa, Artificial Sequence
  Description of Artificial Sequence: Synthetic peptide
  Seed: LVVMGTLVAL (TYRP2_HUMAN)
LLVMGTLVAV

SEQ ID NO: 189879 - protein, 9 aa, Artificial Sequence
  Description of Artificial Sequence: Synthetic peptide
  Seed: GLFVLLAFL (TYRP2_HUMAN)
GMFVLLAFV

SEQ ID NO: 189880 - protein, 9 aa, Artificial Sequence
  Description of Artificial Sequence: Synthetic peptide
  Seed: ALPYWNFAT (TYRP2_HUMAN)
ALPYWNFAL

SEQ ID NO: 189881 - protein, 10 aa, Artificial Sequence
  Description of Artificial Sequence: Synthetic peptide
  Seed: MSPLWWGFLL (TYRP2_HUMAN)
MEPLWWGFLW

SEQ ID NO: 189882 - protein, 10 aa, Artificial Sequence
  Description of Artificial Sequence: Synthetic peptide
  Seed: KRFNPPADAW (TYRP2_HUMAN)
KRFNPPADAL

SEQ ID NO: 189883 - protein, 10 aa, Artificial Sequence
  Description of Artificial Sequence: Synthetic peptide
  Seed: HSFLNGTNAL (TYRP2_HUMAN)
HYFLNGTNAI

SEQ ID NO: 189884 - protein, 9 aa, Artificial Sequence
  Description of Artificial Sequence: Synthetic peptide
  Seed: RTCKCTGNF (TYRP2_HUMAN)
RMCKCTGNY

SEQ ID NO: 189885 - protein, 9 aa, Artificial Sequence
  Description of Artificial Sequence: Synthetic peptide
  Seed: FFQNSTFSF (TYRP2_HUMAN)
FWQNSTFSM

SEQ ID NO: 189886 - protein, 9 aa, Artificial Sequence
  Description of Artificial Sequence: Synthetic peptide
  Seed: DQLGYSYAI (TYRP2_HUMAN)
DHLGYSYAV

SEQ ID NO: 189887 - protein, 9 aa, Artificial Sequence
  Description of Artificial Sequence: Synthetic peptide
  Seed: RKFFHRTCK (TYRP2_HUMAN)
RSFFHRTCA

SEQ ID NO: 189888 - protein, 9 aa, Artificial Sequence
  Description of Artificial Sequence: Synthetic peptide
  Seed: YVITTQHWL (TYRP2_HUMAN)
YAITTQHWI

SEQ ID NO: 189889 - protein, 9 aa, Artificial Sequence
  Description of Artificial Sequence: Synthetic peptide
  Seed: SQVMSLHNL (TYRP2_HUMAN)
SQVMSLHNY

SEQ ID NO: 189890 - protein, 9 aa, Artificial Sequence
  Description of Artificial Sequence: Synthetic peptide
  Seed: STFSFRNAL (TYRP2_HUMAN)
SWFSFRNAI

SEQ ID NO: 189891 - protein, 10 aa, Artificial Sequence
  Description of Artificial Sequence: Synthetic peptide
  Seed: SVRDTLLGPG (TYRP2_HUMAN)
SQRDTLLGPK

SEQ ID NO: 189892 - protein, 11 aa, Artificial Sequence
  Description of Artificial Sequence: Synthetic peptide
  Seed: RNSRFSSWETV (TYRP2_HUMAN)
RFSRFSSWETL

SEQ ID NO: 189893 - protein, 10 aa, Artificial Sequence
  Description of Artificial Sequence: Synthetic peptide
  Seed: FLLSCLGCKI (TYRP2_HUMAN)
FILSCLGCKL

SEQ ID NO: 189894 - protein, 11 aa, Artificial Sequence
  Description of Artificial Sequence: Synthetic peptide
  Seed: LFVLLAFLQYR (TYRP2_HUMAN)
LMVLLAFLQYR

SEQ ID NO: 189895 - protein, 9 aa, Artificial Sequence
  Description of Artificial Sequence: Synthetic peptide
  Seed: VIRQNIHSL (TYRP2_HUMAN)
VTRQNIHSV

SEQ ID NO: 189896 - protein, 9 aa, Artificial Sequence
  Description of Artificial Sequence: Synthetic peptide
  Seed: NRMYNMVPF (TYRP2_HUMAN)
NKMYNMVPA

SEQ ID NO: 189897 - protein, 11 aa, Artificial Sequence
  Description of Artificial Sequence: Synthetic peptide
  Seed: FFVWLHYYSVR (TYRP2_HUMAN)
FYVWLHYYSVR

SEQ ID NO: 189898 - protein, 10 aa, Artificial Sequence
  Description of Artificial Sequence: Synthetic peptide
  Seed: YDFFVWLHYY (TYRP2_HUMAN)
YKFFVWLHYY

SEQ ID NO: 189899 - protein, 9 aa, Artificial Sequence
  Description of Artificial Sequence: Synthetic peptide
  Seed: DDYNHLVTL (TYRP2_HUMAN)
DEYNHLVTA

SEQ ID NO: 189900 - protein, 9 aa, Artificial Sequence
  Description of Artificial Sequence: Synthetic peptide
  Seed: FVWLHYYSV (TYRP2_HUMAN)
FIWLHYYST

SEQ ID NO: 189901 - protein, 8 aa, Artificial Sequence
  Description of Artificial Sequence: Synthetic peptide
  Seed: KFDNPPFF (TYRP2_HUMAN)
KADNPPFI

SEQ ID NO: 189902 - protein, 10 aa, Artificial Sequence
  Description of Artificial Sequence: Synthetic peptide
  Seed: RLRKGYTPLM (TYRP2_HUMAN)
RYRKGYTPLT

SEQ ID NO: 189903 - protein, 10 aa, Artificial Sequence
  Description of Artificial Sequence: Synthetic peptide
  Seed: MSPLWWGFLL (TYRP2_HUMAN)
MHPLWWGFLA

SEQ ID NO: 189904 - protein, 11 aa, Artificial Sequence
  Description of Artificial Sequence: Synthetic peptide
  Seed: YNMVPFFPPVT (TYRP2_HUMAN)
YFMVPFFPPVV

SEQ ID NO: 189905 - protein, 9 aa, Artificial Sequence
  Description of Artificial Sequence: Synthetic peptide
  Seed: GTYEGLLRR (TYRP2_HUMAN)
GLYEGLLRR

SEQ ID NO: 189906 - protein, 9 aa, Artificial Sequence
  Description of Artificial Sequence: Synthetic peptide
  Seed: ETHLSSKRY (TYRP2_HUMAN)
EAHLSSKRR

SEQ ID NO: 189907 - protein, 10 aa, Artificial Sequence
  Description of Artificial Sequence: Synthetic peptide
  Seed: LAPIGHNRMY (TYRP2_HUMAN)
LTPIGHNRMW

SEQ ID NO: 189908 - protein, 10 aa, Artificial Sequence
  Description of Artificial Sequence: Synthetic peptide
  Seed: FVLLAFLQYR (TYRP2_HUMAN)
FRLLAFLQYR

SEQ ID NO: 189909 - protein, 9 aa, Artificial Sequence
  Description of Artificial Sequence: Synthetic peptide
  Seed: TLLGPGRPY (TYRP2_HUMAN)
TQLGPGRPM

SEQ ID NO: 189910 - protein, 9 aa, Artificial Sequence
  Description of Artificial Sequence: Synthetic peptide
  Seed: FFPPVTNEE (TYRP2_HUMAN)
FYPPVTNEM

SEQ ID NO: 189911 - protein, 10 aa, Artificial Sequence
  Description of Artificial Sequence: Synthetic peptide
  Seed: HNRMYNMVPF (TYRP2_HUMAN)
HTRMYNMVPY

SEQ ID NO: 189912 - protein, 8 aa, Artificial Sequence
  Description of Artificial Sequence: Synthetic peptide
  Seed: SLDDYNHL (TYRP2_HUMAN)
SIDDYNHV

SEQ ID NO: 189913 - protein, 10 aa, Artificial Sequence
  Description of Artificial Sequence: Synthetic peptide
  Seed: FLLSCLGCKI (TYRP2_HUMAN)
FILSCLGCKV

SEQ ID NO: 189914 - protein, 10 aa, Artificial Sequence
  Description of Artificial Sequence: Synthetic peptide
  Seed: RLIGNESFAL (TYRP2_HUMAN)
RHIGNESFAF

SEQ ID NO: 189915 - protein, 9 aa, Artificial Sequence
  Description of Artificial Sequence: Synthetic peptide
  Seed: RLRKGYTPL (TYRP2_HUMAN)
RFRKGYTPT

SEQ ID NO: 189916 - protein, 10 aa, Artificial Sequence
  Description of Artificial Sequence: Synthetic peptide
  Seed: RMYNMVPFFP (TYRP2_HUMAN)
RMYNMVPFFY

SEQ ID NO: 189917 - protein, 9 aa, Artificial Sequence
  Description of Artificial Sequence: Synthetic peptide
  Seed: RLRKGYTPL (TYRP2_HUMAN)
RTRKGYTPW

SEQ ID NO: 189918 - protein, 11 aa, Artificial Sequence
  Description of Artificial Sequence: Synthetic peptide
  Seed: YSYAIDLPVSV (TYRP2_HUMAN)
YLYAIDLPVST

SEQ ID NO: 189919 - protein, 10 aa, Artificial Sequence
  Description of Artificial Sequence: Synthetic peptide
  Seed: CLGCKILPGA (TYRP2_HUMAN)
CMGCKILPGV

SEQ ID NO: 189920 - protein, 9 aa, Artificial Sequence
  Description of Artificial Sequence: Synthetic peptide
  Seed: YSYAIDLPV (TYRP2_HUMAN)
YSYAIDLPA

SEQ ID NO: 189921 - protein, 10 aa, Artificial Sequence
  Description of Artificial Sequence: Synthetic peptide
  Seed: HLVTLCNGTY (TYRP2_HUMAN)
HVVTLCNGTY

SEQ ID NO: 189922 - protein, 9 aa, Artificial Sequence
  Description of Artificial Sequence: Synthetic peptide
  Seed: RFNPPADAW (TYRP2_HUMAN)
RWNPPADAW

SEQ ID NO: 189923 - protein, 11 aa, Artificial Sequence
  Description of Artificial Sequence: Synthetic peptide
  Seed: RNSRFSSWETV (TYRP2_HUMAN)
RFSRFSSWETM

SEQ ID NO: 189924 - protein, 10 aa, Artificial Sequence
  Description of Artificial Sequence: Synthetic peptide
  Seed: RRLRKGYTPL (TYRP2_HUMAN)
RTLRKGYTPS

SEQ ID NO: 189925 - protein, 9 aa, Artificial Sequence
  Description of Artificial Sequence: Synthetic peptide
  Seed: FTDAIFDEW (TYRP2_HUMAN)
FTDAIFDEV

SEQ ID NO: 189926 - protein, 9 aa, Artificial Sequence
  Description of Artificial Sequence: Synthetic peptide
  Seed: RMYNMVPFF (TYRP2_HUMAN)
RAYNMVPFK

SEQ ID NO: 189927 - protein, 10 aa, Artificial Sequence
  Description of Artificial Sequence: Synthetic peptide
  Seed: FLLSCLGCKI (TYRP2_HUMAN)
FSLSCLGCKV

SEQ ID NO: 189928 - protein, 10 aa, Artificial Sequence
  Description of Artificial Sequence: Synthetic peptide
  Seed: VALVGLFVLL (TYRP2_HUMAN)
VMLVGLFVLI

SEQ ID NO: 189929 - protein, 11 aa, Artificial Sequence
  Description of Artificial Sequence: Synthetic peptide
  Seed: YNMVPFFPPVT (TYRP2_HUMAN)
YTMVPFFPPVL

SEQ ID NO: 189930 - protein, 10 aa, Artificial Sequence
  Description of Artificial Sequence: Synthetic peptide
  Seed: LVVMGTLVAL (TYRP2_HUMAN)
LWVMGTLVAY

SEQ ID NO: 189931 - protein, 9 aa, Artificial Sequence
  Description of Artificial Sequence: Synthetic peptide
  Seed: ISRNSRFSS (TYRP2_HUMAN)
IVRNSRFSS

SEQ ID NO: 189932 - protein, 9 aa, Artificial Sequence
  Description of Artificial Sequence: Synthetic peptide
  Seed: FSHQGPAFV (TYRP2_HUMAN)
FAHQGPAFL

SEQ ID NO: 189933 - protein, 10 aa, Artificial Sequence
  Description of Artificial Sequence: Synthetic peptide
  Seed: RELWPRKFFH (TYRP2_HUMAN)
RNLWPRKFFH

SEQ ID NO: 189934 - protein, 9 aa, Artificial Sequence
  Description of Artificial Sequence: Synthetic peptide
  Seed: FANCSVYDF (TYRP2_HUMAN)
FVNCSVYDF

SEQ ID NO: 189935 - protein, 10 aa, Artificial Sequence
  Description of Artificial Sequence: Synthetic peptide
  Seed: REQFLGALDL (TYRP2_HUMAN)
RTQFLGALDM

SEQ ID NO: 189936 - protein, 10 aa, Artificial Sequence
  Description of Artificial Sequence: Synthetic peptide
  Seed: VGLFVLLAFL (TYRP2_HUMAN)
VRLFVLLAFV

SEQ ID NO: 189937 - protein, 9 aa, Artificial Sequence
  Description of Artificial Sequence: Synthetic peptide
  Seed: SLHNLVHSF (TYRP2_HUMAN)
SPHNLVHSM

SEQ ID NO: 189938 - protein, 9 aa, Artificial Sequence
  Description of Artificial Sequence: Synthetic peptide
  Seed: LHNLVHSFL (TYRP2_HUMAN)
LQNLVHSFF

SEQ ID NO: 189939 - protein, 10 aa, Artificial Sequence
  Description of Artificial Sequence: Synthetic peptide
  Seed: RNQMGRNSMK (TYRP2_HUMAN)
RLQMGRNSMR

SEQ ID NO: 189940 - protein, 11 aa, Artificial Sequence
  Description of Artificial Sequence: Synthetic peptide
  Seed: YNMVPFFPPVT (TYRP2_HUMAN)
YQMVPFFPPVH

SEQ ID NO: 189941 - protein, 10 aa, Artificial Sequence
  Description of Artificial Sequence: Synthetic peptide
  Seed: YDFFVWLHYY (TYRP2_HUMAN)
YIFFVWLHYY

SEQ ID NO: 189942 - protein, 9 aa, Artificial Sequence
  Description of Artificial Sequence: Synthetic peptide
  Seed: LMETHLSSK (TYRP2_HUMAN)
LSETHLSSY

SEQ ID NO: 189943 - protein, 10 aa, Artificial Sequence
  Description of Artificial Sequence: Synthetic peptide
  Seed: YNMVPFFPPV (TYRP2_HUMAN)
YEMVPFFPPL

SEQ ID NO: 189944 - protein, 10 aa, Artificial Sequence
  Description of Artificial Sequence: Synthetic peptide
  Seed: REQFLGALDL (TYRP2_HUMAN)
RDQFLGALDF

SEQ ID NO: 189945 - protein, 9 aa, Artificial Sequence
  Description of Artificial Sequence: Synthetic peptide
  Seed: SVRDTLLGP (TYRP2_HUMAN)
SARDTLLGK

SEQ ID NO: 189946 - protein, 10 aa, Artificial Sequence
  Description of Artificial Sequence: Synthetic peptide
  Seed: RNQMGRNSMK (TYRP2_HUMAN)
RDQMGRNSMR

SEQ ID NO: 189947 - protein, 10 aa, Artificial Sequence
  Description of Artificial Sequence: Synthetic peptide
  Seed: SDQLGYSYAI (TYRP2_HUMAN)
SFQLGYSYAI

SEQ ID NO: 189948 - protein, 9 aa, Artificial Sequence
  Description of Artificial Sequence: Synthetic peptide
  Seed: STFSFRNAL (TYRP2_HUMAN)
SQFSFRNAW

SEQ ID NO: 189949 - protein, 10 aa, Artificial Sequence
  Description of Artificial Sequence: Synthetic peptide
  Seed: YEGLLRRNQM (TYRP2_HUMAN)
YPGLLRRNQL

SEQ ID NO: 189950 - protein, 9 aa, Artificial Sequence
  Description of Artificial Sequence: Synthetic peptide
  Seed: RQNIHSLSP (TYRP2_HUMAN)
RQNIHSLSF

SEQ ID NO: 189951 - protein, 10 aa, Artificial Sequence
  Description of Artificial Sequence: Synthetic peptide
  Seed: KILPGAQGQF (TYRP2_HUMAN)
KILPGAQGQW

SEQ ID NO: 189952 - protein, 9 aa, Artificial Sequence
  Description of Artificial Sequence: Synthetic peptide
  Seed: RMYNMVPFF (TYRP2_HUMAN)
RTYNMVPFG

SEQ ID NO: 189953 - protein, 9 aa, Artificial Sequence
  Description of Artificial Sequence: Synthetic peptide
  Seed: SPQEREQFL (TYRP2_HUMAN)
SIQEREQFL

SEQ ID NO: 189954 - protein, 10 aa, Artificial Sequence
  Description of Artificial Sequence: Synthetic peptide
  Seed: SHQGPAFVTW (TYRP2_HUMAN)
SHQGPAFVTI

SEQ ID NO: 189955 - protein, 8 aa, Artificial Sequence
  Description of Artificial Sequence: Synthetic peptide
  Seed: MVPFFPPV (TYRP2_HUMAN)
MMPFFPPI

SEQ ID NO: 189956 - protein, 9 aa, Artificial Sequence
  Description of Artificial Sequence: Synthetic peptide
  Seed: RKFFHRTCK (TYRP2_HUMAN)
RTFFHRTCA

SEQ ID NO: 189957 - protein, 10 aa, Artificial Sequence
  Description of Artificial Sequence: Synthetic peptide
  Seed: LVVMGTLVAL (TYRP2_HUMAN)
LEVMGTLVAI

SEQ ID NO: 189958 - protein, 8 aa, Artificial Sequence
  Description of Artificial Sequence: Synthetic peptide
  Seed: FQNSTFSF (TYRP2_HUMAN)
FMNSTFSM

SEQ ID NO: 189959 - protein, 10 aa, Artificial Sequence
  Description of Artificial Sequence: Synthetic peptide
  Seed: RMYNMVPFFP (TYRP2_HUMAN)
RWYNMVPFFK

SEQ ID NO: 189960 - protein, 9 aa, Artificial Sequence
  Description of Artificial Sequence: Synthetic peptide
  Seed: RLRKGYTPL (TYRP2_HUMAN)
RIRKGYTPP

SEQ ID NO: 189961 - protein, 9 aa, Artificial Sequence
  Description of Artificial Sequence: Synthetic peptide
  Seed: VTNEELFLT (TYRP2_HUMAN)
VTNEELFLI

SEQ ID NO: 189962 - protein, 9 aa, Artificial Sequence
  Description of Artificial Sequence: Synthetic peptide
  Seed: TQHWLGLLG (TYRP2_HUMAN)
TAHWLGLLY

SEQ ID NO: 189963 - protein, 8 aa, Artificial Sequence
  Description of Artificial Sequence: Synthetic peptide
  Seed: FSHQGPAF (TYRP2_HUMAN)
FVHQGPAM

SEQ ID NO: 189964 - protein, 9 aa, Artificial Sequence
  Description of Artificial Sequence: Synthetic peptide
  Seed: FQNSTFSFR (TYRP2_HUMAN)
FFNSTFSFR

SEQ ID NO: 189965 - protein, 9 aa, Artificial Sequence
  Description of Artificial Sequence: Synthetic peptide
  Seed: TLDSQVMSL (TYRP2_HUMAN)
TSDSQVMSF

SEQ ID NO: 189966 - protein, 9 aa, Artificial Sequence
  Description of Artificial Sequence: Synthetic peptide
  Seed: SVYDFFVWL (TYRP2_HUMAN)
SFYDFFVWR

SEQ ID NO: 189967 - protein, 9 aa, Artificial Sequence
  Description of Artificial Sequence: Synthetic peptide
  Seed: FPPVTNEEL (TYRP2_HUMAN)
FRPVTNEEY

SEQ ID NO: 189968 - protein, 9 aa, Artificial Sequence
  Description of Artificial Sequence: Synthetic peptide
  Seed: RRLRKGYTP (TYRP2_HUMAN)
RRLRKGYTR

SEQ ID NO: 189969 - protein, 9 aa, Artificial Sequence
  Description of Artificial Sequence: Synthetic peptide
  Seed: SLDDYNHLV (TYRP2_HUMAN)
SQDDYNHLL

SEQ ID NO: 189970 - protein, 11 aa, Artificial Sequence
  Description of Artificial Sequence: Synthetic peptide
  Seed: RELWPRKFFHR (TYRP2_HUMAN)
RLLWPRKFFHK

SEQ ID NO: 189971 - protein, 10 aa, Artificial Sequence
  Description of Artificial Sequence: Synthetic peptide
  Seed: SDQLGYSYAI (TYRP2_HUMAN)
SMQLGYSYAI

SEQ ID NO: 189972 - protein, 10 aa, Artificial Sequence
  Description of Artificial Sequence: Synthetic peptide
  Seed: QELAPIGHNR (TYRP2_HUMAN)
QGLAPIGHNR

SEQ ID NO: 189973 - protein, 9 aa, Artificial Sequence
  Description of Artificial Sequence: Synthetic peptide
  Seed: NSMKLPTLK (TYRP2_HUMAN)
NAMKLPTLM

SEQ ID NO: 189974 - protein, 9 aa, Artificial Sequence
  Description of Artificial Sequence: Synthetic peptide
  Seed: GPAFVTWHR (TYRP2_HUMAN)
GQAFVTWHR

SEQ ID NO: 189975 - protein, 10 aa, Artificial Sequence
  Description of Artificial Sequence: Synthetic peptide
  Seed: HSFLNGTNAL (TYRP2_HUMAN)
HAFLNGTNAL

SEQ ID NO: 189976 - protein, 10 aa, Artificial Sequence
  Description of Artificial Sequence: Synthetic peptide
  Seed: TRPWSGPYIL (TYRP2_HUMAN)
THPWSGPYIM

SEQ ID NO: 189977 - protein, 10 aa, Artificial Sequence
  Description of Artificial Sequence: Synthetic peptide
  Seed: FSFRNALEGF (TYRP2_HUMAN)
FYFRNALEGY

SEQ ID NO: 189978 - protein, 10 aa, Artificial Sequence
  Description of Artificial Sequence: Synthetic peptide
  Seed: RLIGNESFAL (TYRP2_HUMAN)
RRIGNESFAF

SEQ ID NO: 189979 - protein, 9 aa, Artificial Sequence
  Description of Artificial Sequence: Synthetic peptide
  Seed: FTDAIFDEW (TYRP2_HUMAN)
FWDAIFDEF

SEQ ID NO: 189980 - protein, 11 aa, Artificial Sequence
  Description of Artificial Sequence: Synthetic peptide
  Seed: LLGPNGTQPQF (TYRP2_HUMAN)
LAGPNGTQPQW

SEQ ID NO: 189981 - protein, 11 aa, Artificial Sequence
  Description of Artificial Sequence: Synthetic peptide
  Seed: DEWMKRFNPPA (TYRP2_HUMAN)
DEWMKRFNPPF

SEQ ID NO: 189982 - protein, 9 aa, Artificial Sequence
  Description of Artificial Sequence: Synthetic peptide
  Seed: SLHNLVHSF (TYRP2_HUMAN)
SRHNLVHSM

SEQ ID NO: 189983 - protein, 9 aa, Artificial Sequence
  Description of Artificial Sequence: Synthetic peptide
  Seed: QEREQFLGA (TYRP2_HUMAN)
QEREQFLGI

SEQ ID NO: 189984 - protein, 9 aa, Artificial Sequence
  Description of Artificial Sequence: Synthetic peptide
  Seed: FFQNSTFSF (TYRP2_HUMAN)
FTQNSTFSY

SEQ ID NO: 189985 - protein, 10 aa, Artificial Sequence
  Description of Artificial Sequence: Synthetic peptide
  Seed: LVVMGTLVAL (TYRP2_HUMAN)
LTVMGTLVAI

SEQ ID NO: 189986 - protein, 9 aa, Artificial Sequence
  Description of Artificial Sequence: Synthetic peptide
  Seed: HQGPAFVTW (TYRP2_HUMAN)
HIGPAFVTY

SEQ ID NO: 189987 - protein, 9 aa, Artificial Sequence
  Description of Artificial Sequence: Synthetic peptide
  Seed: RTCKCTGNF (TYRP2_HUMAN)
RVCKCTGNK

SEQ ID NO: 189988 - protein, 10 aa, Artificial Sequence
  Description of Artificial Sequence: Synthetic peptide
  Seed: SLSPQEREQF (TYRP2_HUMAN)
SSSPQEREQF

SEQ ID NO: 189989 - protein, 10 aa, Artificial Sequence
  Description of Artificial Sequence: Synthetic peptide
  Seed: FTDAIFDEWM (TYRP2_HUMAN)
FLDAIFDEWL

SEQ ID NO: 189990 - protein, 8 aa, Artificial Sequence
  Description of Artificial Sequence: Synthetic peptide
  Seed: FLNGTNAL (TYRP2_HUMAN)
FMNGTNAV

SEQ ID NO: 189991 - protein, 10 aa, Artificial Sequence
  Description of Artificial Sequence: Synthetic peptide
  Seed: REQFLGALDL (TYRP2_HUMAN)
REQFLGALDY

SEQ ID NO: 189992 - protein, 9 aa, Artificial Sequence
  Description of Artificial Sequence: Synthetic peptide
  Seed: LHNLVHSFL (TYRP2_HUMAN)
LKNLVHSFF

SEQ ID NO: 189993 - protein, 9 aa, Artificial Sequence
  Description of Artificial Sequence: Synthetic peptide
  Seed: SQVMSLHNL (TYRP2_HUMAN)
SQVMSLHNM

SEQ ID NO: 189994 - protein, 9 aa, Artificial Sequence
  Description of Artificial Sequence: Synthetic peptide
  Seed: VIRQNIHSL (TYRP2_HUMAN)
VPRQNIHSA

SEQ ID NO: 189995 - protein, 9 aa, Artificial Sequence
  Description of Artificial Sequence: Synthetic peptide
  Seed: RNQMGRNSM (TYRP2_HUMAN)
RAQMGRNSM

SEQ ID NO: 189996 - protein, 9 aa, Artificial Sequence
  Description of Artificial Sequence: Synthetic peptide
  Seed: TDQLFGAAR (TYRP2_HUMAN)
TTQLFGAAK

SEQ ID NO: 189997 - protein, 11 aa, Artificial Sequence
  Description of Artificial Sequence: Synthetic peptide
  Seed: RADTRPWSGPY (TYRP2_HUMAN)
RADTRPWSGPA

SEQ ID NO: 189998 - protein, 9 aa, Artificial Sequence
  Description of Artificial Sequence: Synthetic peptide
  Seed: CSVYDFFVW (TYRP2_HUMAN)
CPVYDFFVF

SEQ ID NO: 189999 - protein, 11 aa, Artificial Sequence
  Description of Artificial Sequence: Synthetic peptide
  Seed: FFPPVTNEELF (TYRP2_HUMAN)
FKPPVTNEELW

SEQ ID NO: 190000 - protein, 9 aa, Artificial Sequence
  Description of Artificial Sequence: Synthetic peptide
  Seed: RVHPDYVIT (TYRP2_HUMAN)
RQHPDYVIK

SEQ ID NO: 190001 - protein, 9 aa, Artificial Sequence
  Description of Artificial Sequence: Synthetic peptide
  Seed: CERKKPPVI (TYRP2_HUMAN)
CERKKPPVL

SEQ ID NO: 190002 - protein, 10 aa, Artificial Sequence
  Description of Artificial Sequence: Synthetic peptide
  Seed: IDFSHQGPAF (TYRP2_HUMAN)
IQFSHQGPAM

SEQ ID NO: 190003 - protein, 9 aa, Artificial Sequence
  Description of Artificial Sequence: Synthetic peptide
  Seed: VPFFPPVTN (TYRP2_HUMAN)
VPFFPPVTA

SEQ ID NO: 190004 - protein, 9 aa, Artificial Sequence
  Description of Artificial Sequence: Synthetic peptide
  Seed: DFFVWLHYY (TYRP2_HUMAN)
DMFVWLHYY

SEQ ID NO: 190005 - protein, 9 aa, Artificial Sequence
  Description of Artificial Sequence: Synthetic peptide
  Seed: SAANDPIFV (TYRP2_HUMAN)
SQANDPIFI

SEQ ID NO: 190006 - protein, 9 aa, Artificial Sequence
  Description of Artificial Sequence: Synthetic peptide
  Seed: YAIDLPVSV (TYRP2_HUMAN)
YIIDLPVSY

SEQ ID NO: 190007 - protein, 9 aa, Artificial Sequence
  Description of Artificial Sequence: Synthetic peptide
  Seed: GTYEGLLRR (TYRP2_HUMAN)
GMYEGLLRV

SEQ ID NO: 190008 - protein, 9 aa, Artificial Sequence
  Description of Artificial Sequence: Synthetic peptide
  Seed: YTPLMETHL (TYRP2_HUMAN)
YVPLMETHL

SEQ ID NO: 190009 - protein, 10 aa, Artificial Sequence
  Description of Artificial Sequence: Synthetic peptide
  Seed: RMYNMVPFFP (TYRP2_HUMAN)
RVYNMVPFFW

SEQ ID NO: 190010 - protein, 10 aa, Artificial Sequence
  Description of Artificial Sequence: Synthetic peptide
  Seed: TRPWSGPYIL (TYRP2_HUMAN)
TFPWSGPYIM

SEQ ID NO: 190011 - protein, 9 aa, Artificial Sequence
  Description of Artificial Sequence: Synthetic peptide
  Seed: IFDEWMKRF (TYRP2_HUMAN)
IYDEWMKRM

SEQ ID NO: 190012 - protein, 10 aa, Artificial Sequence
  Description of Artificial Sequence: Synthetic peptide
  Seed: RLRKGYTPLM (TYRP2_HUMAN)
RARKGYTPLT

SEQ ID NO: 190013 - protein, 9 aa, Artificial Sequence
  Description of Artificial Sequence: Synthetic peptide
  Seed: SLHNLVHSF (TYRP2_HUMAN)
SMHNLVHSC

SEQ ID NO: 190014 - protein, 10 aa, Artificial Sequence
  Description of Artificial Sequence: Synthetic peptide
  Seed: YDFFVWLHYY (TYRP2_HUMAN)
YFFFVWLHYY

SEQ ID NO: 190015 - protein, 9 aa, Artificial Sequence
  Description of Artificial Sequence: Synthetic peptide
  Seed: SRFSSWETV (TYRP2_HUMAN)
SSFSSWETY

SEQ ID NO: 190016 - protein, 9 aa, Artificial Sequence
  Description of Artificial Sequence: Synthetic peptide
  Seed: SAANDPIFV (TYRP2_HUMAN)
SLANDPIFM

SEQ ID NO: 190017 - protein, 10 aa, Artificial Sequence
  Description of Artificial Sequence: Synthetic peptide
  Seed: YAIDLPVSVE (TYRP2_HUMAN)
YVIDLPVSVI

SEQ ID NO: 190018 - protein, 10 aa, Artificial Sequence
  Description of Artificial Sequence: Synthetic peptide
  Seed: GRNSMKLPTL (TYRP2_HUMAN)
GRNSMKLPTF

SEQ ID NO: 190019 - protein, 9 aa, Artificial Sequence
  Description of Artificial Sequence: Synthetic peptide
  Seed: GLFVLLAFL (TYRP2_HUMAN)
GMFVLLAFL

SEQ ID NO: 190020 - protein, 9 aa, Artificial Sequence
  Description of Artificial Sequence: Synthetic peptide
  Seed: VIRQNIHSL (TYRP2_HUMAN)
VQRQNIHSK

SEQ ID NO: 190021 - protein, 11 aa, Artificial Sequence
  Description of Artificial Sequence: Synthetic peptide
  Seed: IGNESFALPYW (TYRP2_HUMAN)
ISNESFALPYW

SEQ ID NO: 190022 - protein, 10 aa, Artificial Sequence
  Description of Artificial Sequence: Synthetic peptide
  Seed: NMVPFFPPVT (TYRP2_HUMAN)
NMVPFFPPVA

SEQ ID NO: 190023 - protein, 9 aa, Artificial Sequence
  Description of Artificial Sequence: Synthetic peptide
  Seed: ALVGLFVLL (TYRP2_HUMAN)
AQVGLFVLF

SEQ ID NO: 190024 - protein, 10 aa, Artificial Sequence
  Description of Artificial Sequence: Synthetic peptide
  Seed: YDFFVWLHYY (TYRP2_HUMAN)
YYFFVWLHYI

SEQ ID NO: 190025 - protein, 10 aa, Artificial Sequence
  Description of Artificial Sequence: Synthetic peptide
  Seed: RMYNMVPFFP (TYRP2_HUMAN)
RMYNMVPFFI

SEQ ID NO: 190026 - protein, 9 aa, Artificial Sequence
  Description of Artificial Sequence: Synthetic peptide
  Seed: FVWLHYYSV (TYRP2_HUMAN)
FSWLHYYSV

SEQ ID NO: 190027 - protein, 11 aa, Artificial Sequence
  Description of Artificial Sequence: Synthetic peptide
  Seed: GTLDSQVMSLH (TYRP2_HUMAN)
GVLDSQVMSLK

SEQ ID NO: 190028 - protein, 9 aa, Artificial Sequence
  Description of Artificial Sequence: Synthetic peptide
  Seed: IFDEWMKRF (TYRP2_HUMAN)
IIDEWMKRM

SEQ ID NO: 190029 - protein, 9 aa, Artificial Sequence
  Description of Artificial Sequence: Synthetic peptide
  Seed: HQGPAFVTW (TYRP2_HUMAN)
HQGPAFVTF

SEQ ID NO: 190030 - protein, 10 aa, Artificial Sequence
  Description of Artificial Sequence: Synthetic peptide
  Seed: AIFDEWMKRF (TYRP2_HUMAN)
AWFDEWMKRF

SEQ ID NO: 190031 - protein, 9 aa, Artificial Sequence
  Description of Artificial Sequence: Synthetic peptide
  Seed: RMYNMVPFF (TYRP2_HUMAN)
RNYNMVPFR

SEQ ID NO: 190032 - protein, 10 aa, Artificial Sequence
  Description of Artificial Sequence: Synthetic peptide
  Seed: ELAPIGHNRM (TYRP2_HUMAN)
EVAPIGHNRP

SEQ ID NO: 190033 - protein, 10 aa, Artificial Sequence
  Description of Artificial Sequence: Synthetic peptide
  Seed: TQPQFANCSV (TYRP2_HUMAN)
TMPQFANCSL

SEQ ID NO: 190034 - protein, 11 aa, Artificial Sequence
  Description of Artificial Sequence: Synthetic peptide
  Seed: YNMVPFFPPVT (TYRP2_HUMAN)
YIMVPFFPPVI

SEQ ID NO: 190035 - protein, 9 aa, Artificial Sequence
  Description of Artificial Sequence: Synthetic peptide
  Seed: LVGLFVLLA (TYRP2_HUMAN)
LVGLFVLLV

SEQ ID NO: 190036 - protein, 9 aa, Artificial Sequence
  Description of Artificial Sequence: Synthetic peptide
  Seed: RFNPPADAW (TYRP2_HUMAN)
RLNPPADAF

SEQ ID NO: 190037 - protein, 9 aa, Artificial Sequence
  Description of Artificial Sequence: Synthetic peptide
  Seed: GTYEGLLRR (TYRP2_HUMAN)
GYYEGLLRR

SEQ ID NO: 190038 - protein, 9 aa, Artificial Sequence
  Description of Artificial Sequence: Synthetic peptide
  Seed: SFLNGTNAL (TYRP2_HUMAN)
SWLNGTNAF

SEQ ID NO: 190039 - protein, 11 aa, Artificial Sequence
  Description of Artificial Sequence: Synthetic peptide
  Seed: FSHQGPAFVTW (TYRP2_HUMAN)
FAHQGPAFVTH

SEQ ID NO: 190040 - protein, 11 aa, Artificial Sequence
  Description of Artificial Sequence: Synthetic peptide
  Seed: RELWPRKFFHR (TYRP2_HUMAN)
RNLWPRKFFHR

SEQ ID NO: 190041 - protein, 9 aa, Artificial Sequence
  Description of Artificial Sequence: Synthetic peptide
  Seed: SWETVCDSL (TYRP2_HUMAN)
SFETVCDSM

SEQ ID NO: 190042 - protein, 9 aa, Artificial Sequence
  Description of Artificial Sequence: Synthetic peptide
  Seed: RLRKGYTPL (TYRP2_HUMAN)
RTRKGYTPN

SEQ ID NO: 190043 - protein, 10 aa, Artificial Sequence
  Description of Artificial Sequence: Synthetic peptide
  Seed: SFTDAIFDEW (TYRP2_HUMAN)
SMTDAIFDEW

SEQ ID NO: 190044 - protein, 11 aa, Artificial Sequence
  Description of Artificial Sequence: Synthetic peptide
  Seed: WLHYYSVRDTL (TYRP2_HUMAN)
WHHYYSVRDTW

SEQ ID NO: 190045 - protein, 9 aa, Artificial Sequence
  Description of Artificial Sequence: Synthetic peptide
  Seed: DDYNHLVTL (TYRP2_HUMAN)
DMYNHLVTM

SEQ ID NO: 190046 - protein, 9 aa, Artificial Sequence
  Description of Artificial Sequence: Synthetic peptide
  Seed: YDFFVWLHY (TYRP2_HUMAN)
YQFFVWLHM

SEQ ID NO: 190047 - protein, 10 aa, Artificial Sequence
  Description of Artificial Sequence: Synthetic peptide
  Seed: FLTSDQLGYS (TYRP2_HUMAN)
FMTSDQLGYV

SEQ ID NO: 190048 - protein, 9 aa, Artificial Sequence
  Description of Artificial Sequence: Synthetic peptide
  Seed: ITTQHWLGL (TYRP2_HUMAN)
IVTQHWLGW

SEQ ID NO: 190049 - protein, 9 aa, Artificial Sequence
  Description of Artificial Sequence: Synthetic peptide
  Seed: RQNIHSLSP (TYRP2_HUMAN)
RFNIHSLSF

SEQ ID NO: 190050 - protein, 9 aa, Artificial Sequence
  Description of Artificial Sequence: Synthetic peptide
  Seed: LAPIGHNRM (TYRP2_HUMAN)
LVPIGHNRL

SEQ ID NO: 190051 - protein, 9 aa, Artificial Sequence
  Description of Artificial Sequence: Synthetic peptide
  Seed: RDCLSLQKF (TYRP2_HUMAN)
RACLSLQKF

SEQ ID NO: 190052 - protein, 10 aa, Artificial Sequence
  Description of Artificial Sequence: Synthetic peptide
  Seed: RLRKGYTPLM (TYRP2_HUMAN)
RPRKGYTPLV

SEQ ID NO: 190053 - protein, 9 aa, Artificial Sequence
  Description of Artificial Sequence: Synthetic peptide
  Seed: SFRNALEGF (TYRP2_HUMAN)
SIRNALEGF

SEQ ID NO: 190054 - protein, 9 aa, Artificial Sequence
  Description of Artificial Sequence: Synthetic peptide
  Seed: NMVPFFPPV (TYRP2_HUMAN)
NGVPFFPPY

SEQ ID NO: 190055 - protein, 9 aa, Artificial Sequence
  Description of Artificial Sequence: Synthetic peptide
  Seed: SLHNLVHSF (TYRP2_HUMAN)
SAHNLVHSV

SEQ ID NO: 190056 - protein, 10 aa, Artificial Sequence
  Description of Artificial Sequence: Synthetic peptide
  Seed: VALVGLFVLL (TYRP2_HUMAN)
VNLVGLFVLV

SEQ ID NO: 190057 - protein, 10 aa, Artificial Sequence
  Description of Artificial Sequence: Synthetic peptide
  Seed: LTSDQLGYSY (TYRP2_HUMAN)
LESDQLGYSY

SEQ ID NO: 190058 - protein, 11 aa, Artificial Sequence
  Description of Artificial Sequence: Synthetic peptide
  Seed: WLHYYSVRDTL (TYRP2_HUMAN)
WMHYYSVRDTF

SEQ ID NO: 190059 - protein, 10 aa, Artificial Sequence
  Description of Artificial Sequence: Synthetic peptide
  Seed: RNSRFSSWET (TYRP2_HUMAN)
RASRFSSWEM

SEQ ID NO: 190060 - protein, 9 aa, Artificial Sequence
  Description of Artificial Sequence: Synthetic peptide
  Seed: YDFFVWLHY (TYRP2_HUMAN)
YTFFVWLHF

SEQ ID NO: 190061 - protein, 10 aa, Artificial Sequence
  Description of Artificial Sequence: Synthetic peptide
  Seed: SYAIDLPVSV (TYRP2_HUMAN)
SYAIDLPVSW

SEQ ID NO: 190062 - protein, 9 aa, Artificial Sequence
  Description of Artificial Sequence: Synthetic peptide
  Seed: VMSLHNLVH (TYRP2_HUMAN)
VRSLHNLVM

SEQ ID NO: 190063 - protein, 10 aa, Artificial Sequence
  Description of Artificial Sequence: Synthetic peptide
  Seed: LLAFLQYRRL (TYRP2_HUMAN)
LMAFLQYRRI

SEQ ID NO: 190064 - protein, 10 aa, Artificial Sequence
  Description of Artificial Sequence: Synthetic peptide
  Seed: SDQLGYSYAI (TYRP2_HUMAN)
SIQLGYSYAL

SEQ ID NO: 190065 - protein, 9 aa, Artificial Sequence
  Description of Artificial Sequence: Synthetic peptide
  Seed: SHQGPAFVT (TYRP2_HUMAN)
SQQGPAFVL

SEQ ID NO: 190066 - protein, 10 aa, Artificial Sequence
  Description of Artificial Sequence: Synthetic peptide
  Seed: DAIFDEWMKR (TYRP2_HUMAN)
DSIFDEWMKR

SEQ ID NO: 190067 - protein, 9 aa, Artificial Sequence
  Description of Artificial Sequence: Synthetic peptide
  Seed: HYYSVRDTL (TYRP2_HUMAN)
HHYSVRDTL

SEQ ID NO: 190068 - protein, 10 aa, Artificial Sequence
  Description of Artificial Sequence: Synthetic peptide
  Seed: SLSPQEREQF (TYRP2_HUMAN)
SQSPQEREQY

SEQ ID NO: 190069 - protein, 9 aa, Artificial Sequence
  Description of Artificial Sequence: Synthetic peptide
  Seed: RNQMGRNSM (TYRP2_HUMAN)
RTQMGRNSF

SEQ ID NO: 190070 - protein, 9 aa, Artificial Sequence
  Description of Artificial Sequence: Synthetic peptide
  Seed: EQFLGALDL (TYRP2_HUMAN)
EEFLGALDM

SEQ ID NO: 190071 - protein, 9 aa, Artificial Sequence
  Description of Artificial Sequence: Synthetic peptide
  Seed: VIRQNIHSL (TYRP2_HUMAN)
VLRQNIHSV

SEQ ID NO: 190072 - protein, 10 aa, Artificial Sequence
  Description of Artificial Sequence: Synthetic peptide
  Seed: AARPDDPTLI (TYRP2_HUMAN)
ATRPDDPTLF

SEQ ID NO: 190073 - protein, 10 aa, Artificial Sequence
  Description of Artificial Sequence: Synthetic peptide
  Seed: RPWSGPYILR (TYRP2_HUMAN)
RDWSGPYILR

SEQ ID NO: 190074 - protein, 10 aa, Artificial Sequence
  Description of Artificial Sequence: Synthetic peptide
  Seed: TRPWSGPYIL (TYRP2_HUMAN)
THPWSGPYIF

SEQ ID NO: 190075 - protein, 10 aa, Artificial Sequence
  Description of Artificial Sequence: Synthetic peptide
  Seed: MSPLWWGFLL (TYRP2_HUMAN)
MHPLWWGFLM

SEQ ID NO: 190076 - protein, 9 aa, Artificial Sequence
  Description of Artificial Sequence: Synthetic peptide
  Seed: FFQNSTFSF (TYRP2_HUMAN)
FFQNSTFSM

SEQ ID NO: 190077 - protein, 10 aa, Artificial Sequence
  Description of Artificial Sequence: Synthetic peptide
  Seed: RRLRKGYTPL (TYRP2_HUMAN)
RFLRKGYTPA

SEQ ID NO: 190078 - protein, 9 aa, Artificial Sequence
  Description of Artificial Sequence: Synthetic peptide
  Seed: FQNSTFSFR (TYRP2_HUMAN)
FPNSTFSFR

SEQ ID NO: 190079 - protein, 10 aa, Artificial Sequence
  Description of Artificial Sequence: Synthetic peptide
  Seed: SLQKFDNPPF (TYRP2_HUMAN)
SDQKFDNPPF

SEQ ID NO: 190080 - protein, 9 aa, Artificial Sequence
  Description of Artificial Sequence: Synthetic peptide
  Seed: DDYNHLVTL (TYRP2_HUMAN)
DHYNHLVTS

SEQ ID NO: 190081 - protein, 10 aa, Artificial Sequence
  Description of Artificial Sequence: Synthetic peptide
  Seed: MSPLWWGFLL (TYRP2_HUMAN)
MTPLWWGFLW

SEQ ID NO: 190082 - protein, 10 aa, Artificial Sequence
  Description of Artificial Sequence: Synthetic peptide
  Seed: RNSRFSSWET (TYRP2_HUMAN)
RQSRFSSWEK

SEQ ID NO: 190083 - protein, 10 aa, Artificial Sequence
  Description of Artificial Sequence: Synthetic peptide
  Seed: SDQLGYSYAI (TYRP2_HUMAN)
SGQLGYSYAV

SEQ ID NO: 190084 - protein, 9 aa, Artificial Sequence
  Description of Artificial Sequence: Synthetic peptide
  Seed: FFQNSTFSF (TYRP2_HUMAN)
FYQNSTFSW

SEQ ID NO: 190085 - protein, 9 aa, Artificial Sequence
  Description of Artificial Sequence: Synthetic peptide
  Seed: SFLNGTNAL (TYRP2_HUMAN)
SLLNGTNAF

SEQ ID NO: 190086 - protein, 9 aa, Artificial Sequence
  Description of Artificial Sequence: Synthetic peptide
  Seed: YAIDLPVSV (TYRP2_HUMAN)
YIIDLPVSH

SEQ ID NO: 190087 - protein, 9 aa, Artificial Sequence
  Description of Artificial Sequence: Synthetic peptide
  Seed: DDYNHLVTL (TYRP2_HUMAN)
DEYNHLVTV

SEQ ID NO: 190088 - protein, 9 aa, Artificial Sequence
  Description of Artificial Sequence: Synthetic peptide
  Seed: SVRDTLLGP (TYRP2_HUMAN)
STRDTLLGK

SEQ ID NO: 190089 - protein, 9 aa, Artificial Sequence
  Description of Artificial Sequence: Synthetic peptide
  Seed: LWPRKFFHR (TYRP2_HUMAN)
LMPRKFFHK

SEQ ID NO: 190090 - protein, 9 aa, Artificial Sequence
  Description of Artificial Sequence: Synthetic peptide
  Seed: YSYAIDLPV (TYRP2_HUMAN)
YMYAIDLPY

SEQ ID NO: 190091 - protein, 9 aa, Artificial Sequence
  Description of Artificial Sequence: Synthetic peptide
  Seed: FVLLAFLQY (TYRP2_HUMAN)
FNLLAFLQY

SEQ ID NO: 190092 - protein, 9 aa, Artificial Sequence
  Description of Artificial Sequence: Synthetic peptide
  Seed: FTDAIFDEW (TYRP2_HUMAN)
FVDAIFDEL

SEQ ID NO: 190093 - protein, 9 aa, Artificial Sequence
  Description of Artificial Sequence: Synthetic peptide
  Seed: DIRDCLSLQ (TYRP2_HUMAN)
DLRDCLSLR

SEQ ID NO: 190094 - protein, 9 aa, Artificial Sequence
  Description of Artificial Sequence: Synthetic peptide
  Seed: YSYAIDLPV (TYRP2_HUMAN)
YQYAIDLPC

SEQ ID NO: 190095 - protein, 10 aa, Artificial Sequence
  Description of Artificial Sequence: Synthetic peptide
  Seed: RMYNMVPFFP (TYRP2_HUMAN)
RMYNMVPFFW

SEQ ID NO: 190096 - protein, 9 aa, Artificial Sequence
  Description of Artificial Sequence: Synthetic peptide
  Seed: FLLSCLGCK (TYRP2_HUMAN)
FILSCLGCK

SEQ ID NO: 190097 - protein, 9 aa, Artificial Sequence
  Description of Artificial Sequence: Synthetic peptide
  Seed: RLRKGYTPL (TYRP2_HUMAN)
RTRKGYTPY

SEQ ID NO: 190098 - protein, 9 aa, Artificial Sequence
  Description of Artificial Sequence: Synthetic peptide
  Seed: SPLWWGFLL (TYRP2_HUMAN)
STLWWGFLI

SEQ ID NO: 190099 - protein, 10 aa, Artificial Sequence
  Description of Artificial Sequence: Synthetic peptide
  Seed: TQPQFANCSV (TYRP2_HUMAN)
TRPQFANCSL

SEQ ID NO: 190100 - protein, 9 aa, Artificial Sequence
  Description of Artificial Sequence: Synthetic peptide
  Seed: VVMGTLVAL (TYRP2_HUMAN)
VMMGTLVAY

SEQ ID NO: 190101 - protein, 9 aa, Artificial Sequence
  Description of Artificial Sequence: Synthetic peptide
  Seed: VVMGTLVAL (TYRP2_HUMAN)
VQMGTLVAA

SEQ ID NO: 190102 - protein, 9 aa, Artificial Sequence
  Description of Artificial Sequence: Synthetic peptide
  Seed: FPPVTNEEL (TYRP2_HUMAN)
FPPVTNEEA

SEQ ID NO: 190103 - protein, 10 aa, Artificial Sequence
  Description of Artificial Sequence: Synthetic peptide
  Seed: GQFPRVCMTV (TYRP2_HUMAN)
GQFPRVCMTF

SEQ ID NO: 190104 - protein, 9 aa, Artificial Sequence
  Description of Artificial Sequence: Synthetic peptide
  Seed: AIFDEWMKR (TYRP2_HUMAN)
AMFDEWMKY

SEQ ID NO: 190105 - protein, 8 aa, Artificial Sequence
  Description of Artificial Sequence: Synthetic peptide
  Seed: HSFTDAIF (TYRP2_HUMAN)
HTFTDAIW

SEQ ID NO: 190106 - protein, 8 aa, Artificial Sequence
  Description of Artificial Sequence: Synthetic peptide
  Seed: SLDDYNHL (TYRP2_HUMAN)
SWDDYNHL

SEQ ID NO: 190107 - protein, 9 aa, Artificial Sequence
  Description of Artificial Sequence: Synthetic peptide
  Seed: RQNIHSLSP (TYRP2_HUMAN)
RQNIHSLSI

SEQ ID NO: 190108 - protein, 9 aa, Artificial Sequence
  Description of Artificial Sequence: Synthetic peptide
  Seed: YSYAIDLPV (TYRP2_HUMAN)
YKYAIDLPI

SEQ ID NO: 190109 - protein, 9 aa, Artificial Sequence
  Description of Artificial Sequence: Synthetic peptide
  Seed: RNQDDRELW (TYRP2_HUMAN)
RLQDDRELF

SEQ ID NO: 190110 - protein, 9 aa, Artificial Sequence
  Description of Artificial Sequence: Synthetic peptide
  Seed: VVMGTLVAL (TYRP2_HUMAN)
VLMGTLVAK

SEQ ID NO: 190111 - protein, 10 aa, Artificial Sequence
  Description of Artificial Sequence: Synthetic peptide
  Seed: MSLHNLVHSF (TYRP2_HUMAN)
MFLHNLVHSY

SEQ ID NO: 190112 - protein, 9 aa, Artificial Sequence
  Description of Artificial Sequence: Synthetic peptide
  Seed: RQNIHSLSP (TYRP2_HUMAN)
RNNIHSLSF

SEQ ID NO: 190113 - protein, 9 aa, Artificial Sequence
  Description of Artificial Sequence: Synthetic peptide
  Seed: YAIDLPVSV (TYRP2_HUMAN)
YMIDLPVSA

SEQ ID NO: 190114 - protein, 10 aa, Artificial Sequence
  Description of Artificial Sequence: Synthetic peptide
  Seed: FSFRNALEGF (TYRP2_HUMAN)
FSFRNALEGY

SEQ ID NO: 190115 - protein, 9 aa, Artificial Sequence
  Description of Artificial Sequence: Synthetic peptide
  Seed: ANDPIFVVL (TYRP2_HUMAN)
AWDPIFVVV

SEQ ID NO: 190116 - protein, 10 aa, Artificial Sequence
  Description of Artificial Sequence: Synthetic peptide
  Seed: LHYYSVRDTL (TYRP2_HUMAN)
LSYYSVRDTM

SEQ ID NO: 190117 - protein, 10 aa, Artificial Sequence
  Description of Artificial Sequence: Synthetic peptide
  Seed: KILPGAQGQF (TYRP2_HUMAN)
KWLPGAQGQF

SEQ ID NO: 190118 - protein, 10 aa, Artificial Sequence
  Description of Artificial Sequence: Synthetic peptide
  Seed: REQFLGALDL (TYRP2_HUMAN)
RLQFLGALDY

SEQ ID NO: 190119 - protein, 9 aa, Artificial Sequence
  Description of Artificial Sequence: Synthetic peptide
  Seed: SLHNLVHSF (TYRP2_HUMAN)
SIHNLVHSR

SEQ ID NO: 190120 - protein, 10 aa, Artificial Sequence
  Description of Artificial Sequence: Synthetic peptide
  Seed: FFVWLHYYSV (TYRP2_HUMAN)
FLVWLHYYSM

SEQ ID NO: 190121 - protein, 9 aa, Artificial Sequence
  Description of Artificial Sequence: Synthetic peptide
  Seed: FVWLHYYSV (TYRP2_HUMAN)
FQWLHYYSR

SEQ ID NO: 190122 - protein, 9 aa, Artificial Sequence
  Description of Artificial Sequence: Synthetic peptide
  Seed: VTWHRYHLL (TYRP2_HUMAN)
VVWHRYHLR

SEQ ID NO: 190123 - protein, 9 aa, Artificial Sequence
  Description of Artificial Sequence: Synthetic peptide
  Seed: VIRQNIHSL (TYRP2_HUMAN)
VPRQNIHSC

SEQ ID NO: 190124 - protein, 9 aa, Artificial Sequence
  Description of Artificial Sequence: Synthetic peptide
  Seed: VMGTLVALV (TYRP2_HUMAN)
VIGTLVALV

SEQ ID NO: 190125 - protein, 9 aa, Artificial Sequence
  Description of Artificial Sequence: Synthetic peptide
  Seed: YVITTQHWL (TYRP2_HUMAN)
YMITTQHWC

SEQ ID NO: 190126 - protein, 11 aa, Artificial Sequence
  Description of Artificial Sequence: Synthetic peptide
  Seed: LFVLLAFLQYR (TYRP2_HUMAN)
LYVLLAFLQYR

SEQ ID NO: 190127 - protein, 10 aa, Artificial Sequence
  Description of Artificial Sequence: Synthetic peptide
  Seed: RNSRFSSWET (TYRP2_HUMAN)
RLSRFSSWEK

SEQ ID NO: 190128 - protein, 10 aa, Artificial Sequence
  Description of Artificial Sequence: Synthetic peptide
  Seed: IDFSHQGPAF (TYRP2_HUMAN)
ILFSHQGPAY

SEQ ID NO: 190129 - protein, 9 aa, Artificial Sequence
  Description of Artificial Sequence: Synthetic peptide
  Seed: RDCLSLQKF (TYRP2_HUMAN)
RMCLSLQKW

SEQ ID NO: 190130 - protein, 10 aa, Artificial Sequence
  Description of Artificial Sequence: Synthetic peptide
  Seed: SLDDYNHLVT (TYRP2_HUMAN)
SMDDYNHLVE

SEQ ID NO: 190131 - protein, 10 aa, Artificial Sequence
  Description of Artificial Sequence: Synthetic peptide
  Seed: MGRNSMKLPT (TYRP2_HUMAN)
MIRNSMKLPK

SEQ ID NO: 190132 - protein, 10 aa, Artificial Sequence
  Description of Artificial Sequence: Synthetic peptide
  Seed: LVVMGTLVAL (TYRP2_HUMAN)
LVVMGTLVAF

SEQ ID NO: 190133 - protein, 10 aa, Artificial Sequence
  Description of Artificial Sequence: Synthetic peptide
  Seed: NSRFSSWETV (TYRP2_HUMAN)
NTRFSSWETL

SEQ ID NO: 190134 - protein, 9 aa, Artificial Sequence
  Description of Artificial Sequence: Synthetic peptide
  Seed: WPTTLLVVM (TYRP2_HUMAN)
WHTTLLVVI

SEQ ID NO: 190135 - protein, 9 aa, Artificial Sequence
  Description of Artificial Sequence: Synthetic peptide
  Seed: DSLDDYNHL (TYRP2_HUMAN)
DVLDDYNHI

SEQ ID NO: 190136 - protein, 10 aa, Artificial Sequence
  Description of Artificial Sequence: Synthetic peptide
  Seed: CCPRLGAESA (TYRP2_HUMAN)
CVPRLGAESM

SEQ ID NO: 190137 - protein, 10 aa, Artificial Sequence
  Description of Artificial Sequence: Synthetic peptide
  Seed: SQVMSLHNLV (TYRP2_HUMAN)
SPVMSLHNLV

SEQ ID NO: 190138 - protein, 9 aa, Artificial Sequence
  Description of Artificial Sequence: Synthetic peptide
  Seed: FVWLHYYSV (TYRP2_HUMAN)
FPWLHYYSI

SEQ ID NO: 190139 - protein, 11 aa, Artificial Sequence
  Description of Artificial Sequence: Synthetic peptide
  Seed: TQPQFANCSVY (TYRP2_HUMAN)
TGPQFANCSVY

SEQ ID NO: 190140 - protein, 9 aa, Artificial Sequence
  Description of Artificial Sequence: Synthetic peptide
  Seed: RNQDDRELW (TYRP2_HUMAN)
RAQDDRELL

SEQ ID NO: 190141 - protein, 9 aa, Artificial Sequence
  Description of Artificial Sequence: Synthetic peptide
  Seed: SFLNGTNAL (TYRP2_HUMAN)
SLLNGTNAM

SEQ ID NO: 190142 - protein, 11 aa, Artificial Sequence
  Description of Artificial Sequence: Synthetic peptide
  Seed: TQPQFANCSVY (TYRP2_HUMAN)
TSPQFANCSVM

SEQ ID NO: 190143 - protein, 11 aa, Artificial Sequence
  Description of Artificial Sequence: Synthetic peptide
  Seed: FFPPVTNEELF (TYRP2_HUMAN)
FSPPVTNEELW

SEQ ID NO: 190144 - protein, 9 aa, Artificial Sequence
  Description of Artificial Sequence: Synthetic peptide
  Seed: YSYAIDLPV (TYRP2_HUMAN)
YSYAIDLPH

SEQ ID NO: 190145 - protein, 9 aa, Artificial Sequence
  Description of Artificial Sequence: Synthetic peptide
  Seed: YSYAIDLPV (TYRP2_HUMAN)
YRYAIDLPF

SEQ ID NO: 190146 - protein, 10 aa, Artificial Sequence
  Description of Artificial Sequence: Synthetic peptide
  Seed: SVYDFFVWLH (TYRP2_HUMAN)
SVYDFFVWLK

SEQ ID NO: 190147 - protein, 10 aa, Artificial Sequence
  Description of Artificial Sequence: Synthetic peptide
  Seed: KILPGAQGQF (TYRP2_HUMAN)
KLLPGAQGQW

SEQ ID NO: 190148 - protein, 9 aa, Artificial Sequence
  Description of Artificial Sequence: Synthetic peptide
  Seed: LSPQEREQF (TYRP2_HUMAN)
LFPQEREQM

SEQ ID NO: 190149 - protein, 10 aa, Artificial Sequence
  Description of Artificial Sequence: Synthetic peptide
  Seed: FVLLAFLQYR (TYRP2_HUMAN)
FWLLAFLQYR

SEQ ID NO: 190150 - protein, 10 aa, Artificial Sequence
  Description of Artificial Sequence: Synthetic peptide
  Seed: ELWPRKFFHR (TYRP2_HUMAN)
EIWPRKFFHK

SEQ ID NO: 190151 - protein, 10 aa, Artificial Sequence
  Description of Artificial Sequence: Synthetic peptide
  Seed: QGPAFVTWHR (TYRP2_HUMAN)
QIPAFVTWHK

SEQ ID NO: 190152 - protein, 10 aa, Artificial Sequence
  Description of Artificial Sequence: Synthetic peptide
  Seed: GTLDSQVMSL (TYRP2_HUMAN)
GLLDSQVMSL

SEQ ID NO: 190153 - protein, 9 aa, Artificial Sequence
  Description of Artificial Sequence: Synthetic peptide
  Seed: GWPTTLLVV (TYRP2_HUMAN)
GYPTTLLVF

SEQ ID NO: 190154 - protein, 9 aa, Artificial Sequence
  Description of Artificial Sequence: Synthetic peptide
  Seed: WHRYHLLCL (TYRP2_HUMAN)
WERYHLLCF

SEQ ID NO: 190155 - protein, 9 aa, Artificial Sequence
  Description of Artificial Sequence: Synthetic peptide
  Seed: CSVYDFFVW (TYRP2_HUMAN)
CTVYDFFVY

SEQ ID NO: 190156 - protein, 10 aa, Artificial Sequence
  Description of Artificial Sequence: Synthetic peptide
  Seed: MGRNSMKLPT (TYRP2_HUMAN)
MSRNSMKLPV

SEQ ID NO: 190157 - protein, 9 aa, Artificial Sequence
  Description of Artificial Sequence: Synthetic peptide
  Seed: GTYEGLLRR (TYRP2_HUMAN)
GTYEGLLRL

SEQ ID NO: 190158 - protein, 10 aa, Artificial Sequence
  Description of Artificial Sequence: Synthetic peptide
  Seed: FVWLHYYSVR (TYRP2_HUMAN)
FAWLHYYSVR

SEQ ID NO: 190159 - protein, 10 aa, Artificial Sequence
  Description of Artificial Sequence: Synthetic peptide
  Seed: HYYSVRDTLL (TYRP2_HUMAN)
HYYSVRDTLM

SEQ ID NO: 190160 - protein, 11 aa, Artificial Sequence
  Description of Artificial Sequence: Synthetic peptide
  Seed: YTPLMETHLSS (TYRP2_HUMAN)
YYPLMETHLSA

SEQ ID NO: 190161 - protein, 9 aa, Artificial Sequence
  Description of Artificial Sequence: Synthetic peptide
  Seed: DDYNHLVTL (TYRP2_HUMAN)
DRYNHLVTV

SEQ ID NO: 190162 - protein, 9 aa, Artificial Sequence
  Description of Artificial Sequence: Synthetic peptide
  Seed: DIRDCLSLQ (TYRP2_HUMAN)
DSRDCLSLR

SEQ ID NO: 190163 - protein, 9 aa, Artificial Sequence
  Description of Artificial Sequence: Synthetic peptide
  Seed: GNESFALPY (TYRP2_HUMAN)
GQESFALPY

SEQ ID NO: 190164 - protein, 9 aa, Artificial Sequence
  Description of Artificial Sequence: Synthetic peptide
  Seed: LQKFDNPPF (TYRP2_HUMAN)
LMKFDNPPL

SEQ ID NO: 190165 - protein, 10 aa, Artificial Sequence
  Description of Artificial Sequence: Synthetic peptide
  Seed: LVVMGTLVAL (TYRP2_HUMAN)
LAVMGTLVAL

SEQ ID NO: 190166 - protein, 10 aa, Artificial Sequence
  Description of Artificial Sequence: Synthetic peptide
  Seed: FVVLHSFTDA (TYRP2_HUMAN)
FMVLHSFTDA

SEQ ID NO: 190167 - protein, 10 aa, Artificial Sequence
  Description of Artificial Sequence: Synthetic peptide
  Seed: RLRKGYTPLM (TYRP2_HUMAN)
RTRKGYTPLI

SEQ ID NO: 190168 - protein, 10 aa, Artificial Sequence
  Description of Artificial Sequence: Synthetic peptide
  Seed: NPPFFQNSTF (TYRP2_HUMAN)
NEPFFQNSTY

SEQ ID NO: 190169 - protein, 11 aa, Artificial Sequence
  Description of Artificial Sequence: Synthetic peptide
  Seed: RNSRFSSWETV (TYRP2_HUMAN)
RISRFSSWETM

SEQ ID NO: 190170 - protein, 11 aa, Artificial Sequence
  Description of Artificial Sequence: Synthetic peptide
  Seed: YNMVPFFPPVT (TYRP2_HUMAN)
YTMVPFFPPVM

SEQ ID NO: 190171 - protein, 9 aa, Artificial Sequence
  Description of Artificial Sequence: Synthetic peptide
  Seed: YAIDLPVSV (TYRP2_HUMAN)
YHIDLPVSV

SEQ ID NO: 190172 - protein, 9 aa, Artificial Sequence
  Description of Artificial Sequence: Synthetic peptide
  Seed: SVYDFFVWL (TYRP2_HUMAN)
SLYDFFVWR

SEQ ID NO: 190173 - protein, 9 aa, Artificial Sequence
  Description of Artificial Sequence: Synthetic peptide
  Seed: STFSFRNAL (TYRP2_HUMAN)
STFSFRNAY

SEQ ID NO: 190174 - protein, 10 aa, Artificial Sequence
  Description of Artificial Sequence: Synthetic peptide
  Seed: YSYAIDLPVS (TYRP2_HUMAN)
YMYAIDLPVL

SEQ ID NO: 190175 - protein, 9 aa, Artificial Sequence
  Description of Artificial Sequence: Synthetic peptide
  Seed: LVALVGLFV (TYRP2_HUMAN)
LMALVGLFM

SEQ ID NO: 190176 - protein, 9 aa, Artificial Sequence
  Description of Artificial Sequence: Synthetic peptide
  Seed: VVMGTLVAL (TYRP2_HUMAN)
VAMGTLVAW

SEQ ID NO: 190177 - protein, 9 aa, Artificial Sequence
  Description of Artificial Sequence: Synthetic peptide
  Seed: VEETPGWPT (TYRP2_HUMAN)
VEETPGWPM

SEQ ID NO: 190178 - protein, 9 aa, Artificial Sequence
  Description of Artificial Sequence: Synthetic peptide
  Seed: RLRKGYTPL (TYRP2_HUMAN)
RARKGYTPK

SEQ ID NO: 190179 - protein, 9 aa, Artificial Sequence
  Description of Artificial Sequence: Synthetic peptide
  Seed: RQNIHSLSP (TYRP2_HUMAN)
RKNIHSLSI

SEQ ID NO: 190180 - protein, 9 aa, Artificial Sequence
  Description of Artificial Sequence: Synthetic peptide
  Seed: SRNSRFSSW (TYRP2_HUMAN)
STNSRFSSF

SEQ ID NO: 190181 - protein, 10 aa, Artificial Sequence
  Description of Artificial Sequence: Synthetic peptide
  Seed: RLRKGYTPLM (TYRP2_HUMAN)
RARKGYTPLS

SEQ ID NO: 190182 - protein, 10 aa, Artificial Sequence
  Description of Artificial Sequence: Synthetic peptide
  Seed: CCPRLGAESA (TYRP2_HUMAN)
CSPRLGAESM

SEQ ID NO: 190183 - protein, 9 aa, Artificial Sequence
  Description of Artificial Sequence: Synthetic peptide
  Seed: FTDAIFDEW (TYRP2_HUMAN)
FFDAIFDEL

SEQ ID NO: 190184 - protein, 10 aa, Artificial Sequence
  Description of Artificial Sequence: Synthetic peptide
  Seed: NIHSLSPQER (TYRP2_HUMAN)
NVHSLSPQEK

SEQ ID NO: 190185 - protein, 9 aa, Artificial Sequence
  Description of Artificial Sequence: Synthetic peptide
  Seed: AANDPIFVV (TYRP2_HUMAN)
AGNDPIFVY

SEQ ID NO: 190186 - protein, 9 aa, Artificial Sequence
  Description of Artificial Sequence: Synthetic peptide
  Seed: SQVMSLHNL (TYRP2_HUMAN)
SIVMSLHNY

SEQ ID NO: 190187 - protein, 9 aa, Artificial Sequence
  Description of Artificial Sequence: Synthetic peptide
  Seed: TSDQLGYSY (TYRP2_HUMAN)
TIDQLGYSF

SEQ ID NO: 190188 - protein, 9 aa, Artificial Sequence
  Description of Artificial Sequence: Synthetic peptide
  Seed: RKFFHRTCK (TYRP2_HUMAN)
RVFFHRTCA

SEQ ID NO: 190189 - protein, 10 aa, Artificial Sequence
  Description of Artificial Sequence: Synthetic peptide
  Seed: AIFDEWMKRF (TYRP2_HUMAN)
ATFDEWMKRW

SEQ ID NO: 190190 - protein, 10 aa, Artificial Sequence
  Description of Artificial Sequence: Synthetic peptide
  Seed: TRPWSGPYIL (TYRP2_HUMAN)
TNPWSGPYIY

SEQ ID NO: 190191 - protein, 10 aa, Artificial Sequence
  Description of Artificial Sequence: Synthetic peptide
  Seed: SPLWWGFLLS (TYRP2_HUMAN)
SSLWWGFLLV

SEQ ID NO: 190192 - protein, 9 aa, Artificial Sequence
  Description of Artificial Sequence: Synthetic peptide
  Seed: ALVGLFVLL (TYRP2_HUMAN)
AVVGLFVLL

SEQ ID NO: 190193 - protein, 10 aa, Artificial Sequence
  Description of Artificial Sequence: Synthetic peptide
  Seed: RLIGNESFAL (TYRP2_HUMAN)
RKIGNESFAL

SEQ ID NO: 190194 - protein, 10 aa, Artificial Sequence
  Description of Artificial Sequence: Synthetic peptide
  Seed: SSWETVCDSL (TYRP2_HUMAN)
SIWETVCDSV

SEQ ID NO: 190195 - protein, 10 aa, Artificial Sequence
  Description of Artificial Sequence: Synthetic peptide
  Seed: RMYNMVPFFP (TYRP2_HUMAN)
RQYNMVPFFE

SEQ ID NO: 190196 - protein, 10 aa, Artificial Sequence
  Description of Artificial Sequence: Synthetic peptide
  Seed: NPPFFQNSTF (TYRP2_HUMAN)
NMPFFQNSTW

SEQ ID NO: 190197 - protein, 9 aa, Artificial Sequence
  Description of Artificial Sequence: Synthetic peptide
  Seed: WHRYHLLCL (TYRP2_HUMAN)
WIRYHLLCM

SEQ ID NO: 190198 - protein, 9 aa, Artificial Sequence
  Description of Artificial Sequence: Synthetic peptide
  Seed: FFPPVTNEE (TYRP2_HUMAN)
FYPPVTNEA

SEQ ID NO: 190199 - protein, 10 aa, Artificial Sequence
  Description of Artificial Sequence: Synthetic peptide
  Seed: GTLDSQVMSL (TYRP2_HUMAN)
GLLDSQVMSF

SEQ ID NO: 190200 - protein, 10 aa, Artificial Sequence
  Description of Artificial Sequence: Synthetic peptide
  Seed: HSFLNGTNAL (TYRP2_HUMAN)
HHFLNGTNAL

SEQ ID NO: 190201 - protein, 9 aa, Artificial Sequence
  Description of Artificial Sequence: Synthetic peptide
  Seed: WMKRFNPPA (TYRP2_HUMAN)
WQKRFNPPM

SEQ ID NO: 190202 - protein, 10 aa, Artificial Sequence
  Description of Artificial Sequence: Synthetic peptide
  Seed: RLRKGYTPLM (TYRP2_HUMAN)
RSRKGYTPLK

SEQ ID NO: 190203 - protein, 9 aa, Artificial Sequence
  Description of Artificial Sequence: Synthetic peptide
  Seed: LERDLQRLI (TYRP2_HUMAN)
LERDLQRLF

SEQ ID NO: 190204 - protein, 9 aa, Artificial Sequence
  Description of Artificial Sequence: Synthetic peptide
  Seed: LRKGYTPLM (TYRP2_HUMAN)
LAKGYTPLY

SEQ ID NO: 190205 - protein, 10 aa, Artificial Sequence
  Description of Artificial Sequence: Synthetic peptide
  Seed: RLIGNESFAL (TYRP2_HUMAN)
RVIGNESFAW

SEQ ID NO: 190206 - protein, 11 aa, Artificial Sequence
  Description of Artificial Sequence: Synthetic peptide
  Seed: FVVLHSFTDAI (TYRP2_HUMAN)
FCVLHSFTDAL

SEQ ID NO: 190207 - protein, 9 aa, Artificial Sequence
  Description of Artificial Sequence: Synthetic peptide
  Seed: TQHWLGLLG (TYRP2_HUMAN)
TKHWLGLLF

SEQ ID NO: 190208 - protein, 9 aa, Artificial Sequence
  Description of Artificial Sequence: Synthetic peptide
  Seed: WPQELAPIG (TYRP2_HUMAN)
WAQELAPIF

SEQ ID NO: 190209 - protein, 10 aa, Artificial Sequence
  Description of Artificial Sequence: Synthetic peptide
  Seed: RLIGNESFAL (TYRP2_HUMAN)
RTIGNESFAR

SEQ ID NO: 190210 - protein, 10 aa, Artificial Sequence
  Description of Artificial Sequence: Synthetic peptide
  Seed: KADGTLDSQV (TYRP2_HUMAN)
KADGTLDSQM

SEQ ID NO: 190211 - protein, 9 aa, Artificial Sequence
  Description of Artificial Sequence: Synthetic peptide
  Seed: SQVMSLHNL (TYRP2_HUMAN)
SLVMSLHNL

SEQ ID NO: 190212 - protein, 10 aa, Artificial Sequence
  Description of Artificial Sequence: Synthetic peptide
  Seed: LISRNSRFSS (TYRP2_HUMAN)
LKSRNSRFSV

SEQ ID NO: 190213 - protein, 10 aa, Artificial Sequence
  Description of Artificial Sequence: Synthetic peptide
  Seed: YDFFVWLHYY (TYRP2_HUMAN)
YCFFVWLHYY

SEQ ID NO: 190214 - protein, 9 aa, Artificial Sequence
  Description of Artificial Sequence: Synthetic peptide
  Seed: TLDSQVMSL (TYRP2_HUMAN)
TNDSQVMSI

SEQ ID NO: 190215 - protein, 10 aa, Artificial Sequence
  Description of Artificial Sequence: Synthetic peptide
  Seed: SLHNLVHSFL (TYRP2_HUMAN)
SMHNLVHSFL

SEQ ID NO: 190216 - protein, 10 aa, Artificial Sequence
  Description of Artificial Sequence: Synthetic peptide
  Seed: CMTVDSLVNK (TYRP2_HUMAN)
CCTVDSLVNR

SEQ ID NO: 190217 - protein, 9 aa, Artificial Sequence
  Description of Artificial Sequence: Synthetic peptide
  Seed: STFSFRNAL (TYRP2_HUMAN)
SSFSFRNAF

SEQ ID NO: 190218 - protein, 9 aa, Artificial Sequence
  Description of Artificial Sequence: Synthetic peptide
  Seed: WHRYHLLCL (TYRP2_HUMAN)
WPRYHLLCV

SEQ ID NO: 190219 - protein, 9 aa, Artificial Sequence
  Description of Artificial Sequence: Synthetic peptide
  Seed: STFSFRNAL (TYRP2_HUMAN)
SAFSFRNAA

SEQ ID NO: 190220 - protein, 10 aa, Artificial Sequence
  Description of Artificial Sequence: Synthetic peptide
  Seed: LHYYSVRDTL (TYRP2_HUMAN)
LQYYSVRDTL

SEQ ID NO: 190221 - protein, 10 aa, Artificial Sequence
  Description of Artificial Sequence: Synthetic peptide
  Seed: RLRKGYTPLM (TYRP2_HUMAN)
RPRKGYTPLN

SEQ ID NO: 190222 - protein, 9 aa, Artificial Sequence
  Description of Artificial Sequence: Synthetic peptide
  Seed: VTWHRYHLL (TYRP2_HUMAN)
VAWHRYHLR

SEQ ID NO: 190223 - protein, 9 aa, Artificial Sequence
  Description of Artificial Sequence: Synthetic peptide
  Seed: SFLNGTNAL (TYRP2_HUMAN)
SQLNGTNAY

SEQ ID NO: 190224 - protein, 9 aa, Artificial Sequence
  Description of Artificial Sequence: Synthetic peptide
  Seed: FSHQGPAFV (TYRP2_HUMAN)
FLHQGPAFC

SEQ ID NO: 190225 - protein, 10 aa, Artificial Sequence
  Description of Artificial Sequence: Synthetic peptide
  Seed: NSTFSFRNAL (TYRP2_HUMAN)
NYTFSFRNAI

SEQ ID NO: 190226 - protein, 10 aa, Artificial Sequence
  Description of Artificial Sequence: Synthetic peptide
  Seed: VLLAFLQYRR (TYRP2_HUMAN)
VCLAFLQYRR

SEQ ID NO: 190227 - protein, 9 aa, Artificial Sequence
  Description of Artificial Sequence: Synthetic peptide
  Seed: LVTLCNGTY (TYRP2_HUMAN)
LSTLCNGTW

SEQ ID NO: 190228 - protein, 10 aa, Artificial Sequence
  Description of Artificial Sequence: Synthetic peptide
  Seed: LHYYSVRDTL (TYRP2_HUMAN)
LSYYSVRDTI

SEQ ID NO: 190229 - protein, 10 aa, Artificial Sequence
  Description of Artificial Sequence: Synthetic peptide
  Seed: MGTLVALVGL (TYRP2_HUMAN)
MATLVALVGV

SEQ ID NO: 190230 - protein, 9 aa, Artificial Sequence
  Description of Artificial Sequence: Synthetic peptide
  Seed: RVCMTVDSL (TYRP2_HUMAN)
RVCMTVDSF

SEQ ID NO: 190231 - protein, 10 aa, Artificial Sequence
  Description of Artificial Sequence: Synthetic peptide
  Seed: LVVMGTLVAL (TYRP2_HUMAN)
LYVMGTLVAI

SEQ ID NO: 190232 - protein, 10 aa, Artificial Sequence
  Description of Artificial Sequence: Synthetic peptide
  Seed: YNMVPFFPPV (TYRP2_HUMAN)
YMMVPFFPPM

SEQ ID NO: 190233 - protein, 9 aa, Artificial Sequence
  Description of Artificial Sequence: Synthetic peptide
  Seed: RPWSGPYIL (TYRP2_HUMAN)
RRWSGPYIY

SEQ ID NO: 190234 - protein, 10 aa, Artificial Sequence
  Description of Artificial Sequence: Synthetic peptide
  Seed: RMYNMVPFFP (TYRP2_HUMAN)
RMYNMVPFFA

SEQ ID NO: 190235 - protein, 10 aa, Artificial Sequence
  Description of Artificial Sequence: Synthetic peptide
  Seed: YSYAIDLPVS (TYRP2_HUMAN)
YMYAIDLPVV

SEQ ID NO: 190236 - protein, 9 aa, Artificial Sequence
  Description of Artificial Sequence: Synthetic peptide
  Seed: DIRDCLSLQ (TYRP2_HUMAN)
DVRDCLSLK

SEQ ID NO: 190237 - protein, 10 aa, Artificial Sequence
  Description of Artificial Sequence: Synthetic peptide
  Seed: LGPNGTQPQF (TYRP2_HUMAN)
LWPNGTQPQW

SEQ ID NO: 190238 - protein, 9 aa, Artificial Sequence
  Description of Artificial Sequence: Synthetic peptide
  Seed: ELAPIGHNR (TYRP2_HUMAN)
EMAPIGHNY

SEQ ID NO: 190239 - protein, 9 aa, Artificial Sequence
  Description of Artificial Sequence: Synthetic peptide
  Seed: SLHNLVHSF (TYRP2_HUMAN)
STHNLVHSI

SEQ ID NO: 190240 - protein, 10 aa, Artificial Sequence
  Description of Artificial Sequence: Synthetic peptide
  Seed: YSYAIDLPVS (TYRP2_HUMAN)
YMYAIDLPVA

SEQ ID NO: 190241 - protein, 9 aa, Artificial Sequence
  Description of Artificial Sequence: Synthetic peptide
  Seed: VTWHRYHLL (TYRP2_HUMAN)
VQWHRYHLV

SEQ ID NO: 190242 - protein, 10 aa, Artificial Sequence
  Description of Artificial Sequence: Synthetic peptide
  Seed: SDQLGYSYAI (TYRP2_HUMAN)
SRQLGYSYAV

SEQ ID NO: 190243 - protein, 9 aa, Artificial Sequence
  Description of Artificial Sequence: Synthetic peptide
  Seed: VALVGLFVL (TYRP2_HUMAN)
VTLVGLFVW

SEQ ID NO: 190244 - protein, 11 aa, Artificial Sequence
  Description of Artificial Sequence: Synthetic peptide
  Seed: RELWPRKFFHR (TYRP2_HUMAN)
RFLWPRKFFHK

SEQ ID NO: 190245 - protein, 9 aa, Artificial Sequence
  Description of Artificial Sequence: Synthetic peptide
  Seed: FSHQGPAFV (TYRP2_HUMAN)
FAHQGPAFY

SEQ ID NO: 190246 - protein, 9 aa, Artificial Sequence
  Description of Artificial Sequence: Synthetic peptide
  Seed: NMVPFFPPV (TYRP2_HUMAN)
NWVPFFPPM

SEQ ID NO: 190247 - protein, 10 aa, Artificial Sequence
  Description of Artificial Sequence: Synthetic peptide
  Seed: SDQLGYSYAI (TYRP2_HUMAN)
SAQLGYSYAM

SEQ ID NO: 190248 - protein, 9 aa, Artificial Sequence
  Description of Artificial Sequence: Synthetic peptide
  Seed: WHRYHLLCL (TYRP2_HUMAN)
WSRYHLLCF

SEQ ID NO: 190249 - protein, 9 aa, Artificial Sequence
  Description of Artificial Sequence: Synthetic peptide
  Seed: KCTGNFAGY (TYRP2_HUMAN)
KMTGNFAGF

SEQ ID NO: 190250 - protein, 10 aa, Artificial Sequence
  Description of Artificial Sequence: Synthetic peptide
  Seed: SDQLGYSYAI (TYRP2_HUMAN)
SVQLGYSYAF

SEQ ID NO: 190251 - protein, 9 aa, Artificial Sequence
  Description of Artificial Sequence: Synthetic peptide
  Seed: QVMSLHNLV (TYRP2_HUMAN)
QLMSLHNLI

SEQ ID NO: 190252 - protein, 10 aa, Artificial Sequence
  Description of Artificial Sequence: Synthetic peptide
  Seed: GTLDSQVMSL (TYRP2_HUMAN)
GLLDSQVMSW

SEQ ID NO: 190253 - protein, 9 aa, Artificial Sequence
  Description of Artificial Sequence: Synthetic peptide
  Seed: HQGPAFVTW (TYRP2_HUMAN)
HFGPAFVTW

SEQ ID NO: 190254 - protein, 9 aa, Artificial Sequence
  Description of Artificial Sequence: Synthetic peptide
  Seed: VTWHRYHLL (TYRP2_HUMAN)
VFWHRYHLY

SEQ ID NO: 190255 - protein, 11 aa, Artificial Sequence
  Description of Artificial Sequence: Synthetic peptide
  Seed: TQPQFANCSVY (TYRP2_HUMAN)
TPPQFANCSVF

SEQ ID NO: 190256 - protein, 10 aa, Artificial Sequence
  Description of Artificial Sequence: Synthetic peptide
  Seed: VLHSFTDAIF (TYRP2_HUMAN)
VMHSFTDAIM

SEQ ID NO: 190257 - protein, 9 aa, Artificial Sequence
  Description of Artificial Sequence: Synthetic peptide
  Seed: QVMSLHNLV (TYRP2_HUMAN)
QTMSLHNLL

SEQ ID NO: 190258 - protein, 10 aa, Artificial Sequence
  Description of Artificial Sequence: Synthetic peptide
  Seed: SDQLGYSYAI (TYRP2_HUMAN)
SGQLGYSYAM

SEQ ID NO: 190259 - protein, 8 aa, Artificial Sequence
  Description of Artificial Sequence: Synthetic peptide
  Seed: AIDLPVSV (TYRP2_HUMAN)
AYDLPVSM

SEQ ID NO: 190260 - protein, 10 aa, Artificial Sequence
  Description of Artificial Sequence: Synthetic peptide
  Seed: CMTVDSLVNK (TYRP2_HUMAN)
CKTVDSLVNK

SEQ ID NO: 190261 - protein, 9 aa, Artificial Sequence
  Description of Artificial Sequence: Synthetic peptide
  Seed: LSPQEREQF (TYRP2_HUMAN)
LYPQEREQY

SEQ ID NO: 190262 - protein, 10 aa, Artificial Sequence
  Description of Artificial Sequence: Synthetic peptide
  Seed: RRLRKGYTPL (TYRP2_HUMAN)
RYLRKGYTPK

SEQ ID NO: 190263 - protein, 9 aa, Artificial Sequence
  Description of Artificial Sequence: Synthetic peptide
  Seed: HYYSVRDTL (TYRP2_HUMAN)
HEYSVRDTL

SEQ ID NO: 190264 - protein, 9 aa, Artificial Sequence
  Description of Artificial Sequence: Synthetic peptide
  Seed: DDYNHLVTL (TYRP2_HUMAN)
DHYNHLVTL

SEQ ID NO: 190265 - protein, 10 aa, Artificial Sequence
  Description of Artificial Sequence: Synthetic peptide
  Seed: REQFLGALDL (TYRP2_HUMAN)
RHQFLGALDY

SEQ ID NO: 190266 - protein, 10 aa, Artificial Sequence
  Description of Artificial Sequence: Synthetic peptide
  Seed: RPDDPTLISR (TYRP2_HUMAN)
RTDDPTLISF

SEQ ID NO: 190267 - protein, 11 aa, Artificial Sequence
  Description of Artificial Sequence: Synthetic peptide
  Seed: TQPQFANCSVY (TYRP2_HUMAN)
TKPQFANCSVY

SEQ ID NO: 190268 - protein, 11 aa, Artificial Sequence
  Description of Artificial Sequence: Synthetic peptide
  Seed: CPRLGAESANV (TYRP2_HUMAN)
CPRLGAESANL

SEQ ID NO: 190269 - protein, 11 aa, Artificial Sequence
  Description of Artificial Sequence: Synthetic peptide
  Seed: KRVHPDYVITT (TYRP2_HUMAN)
KRVHPDYVITY

SEQ ID NO: 190270 - protein, 10 aa, Artificial Sequence
  Description of Artificial Sequence: Synthetic peptide
  Seed: RLIGNESFAL (TYRP2_HUMAN)
RKIGNESFAM

SEQ ID NO: 190271 - protein, 10 aa, Artificial Sequence
  Description of Artificial Sequence: Synthetic peptide
  Seed: RTCKCTGNFA (TYRP2_HUMAN)
RVCKCTGNFM

SEQ ID NO: 190272 - protein, 9 aa, Artificial Sequence
  Description of Artificial Sequence: Synthetic peptide
  Seed: SFALPYWNF (TYRP2_HUMAN)
SFALPYWNW

SEQ ID NO: 190273 - protein, 9 aa, Artificial Sequence
  Description of Artificial Sequence: Synthetic peptide
  Seed: TLLVVMGTL (TYRP2_HUMAN)
TLLVVMGTY

SEQ ID NO: 190274 - protein, 9 aa, Artificial Sequence
  Description of Artificial Sequence: Synthetic peptide
  Seed: RFNPPADAW (TYRP2_HUMAN)
RRNPPADAL

SEQ ID NO: 190275 - protein, 9 aa, Artificial Sequence
  Description of Artificial Sequence: Synthetic peptide
  Seed: RMYNMVPFF (TYRP2_HUMAN)
RIYNMVPFG

SEQ ID NO: 190276 - protein, 10 aa, Artificial Sequence
  Description of Artificial Sequence: Synthetic peptide
  Seed: MSPLWWGFLL (TYRP2_HUMAN)
MHPLWWGFLF

SEQ ID NO: 190277 - protein, 9 aa, Artificial Sequence
  Description of Artificial Sequence: Synthetic peptide
  Seed: SLDDYNHLV (TYRP2_HUMAN)
SWDDYNHLL

SEQ ID NO: 190278 - protein, 11 aa, Artificial Sequence
  Description of Artificial Sequence: Synthetic peptide
  Seed: RNSRFSSWETV (TYRP2_HUMAN)
RHSRFSSWETF

SEQ ID NO: 190279 - protein, 11 aa, Artificial Sequence
  Description of Artificial Sequence: Synthetic peptide
  Seed: RNSRFSSWETV (TYRP2_HUMAN)
RTSRFSSWETV

SEQ ID NO: 190280 - protein, 9 aa, Artificial Sequence
  Description of Artificial Sequence: Synthetic peptide
  Seed: NALEGFDKA (TYRP2_HUMAN)
NILEGFDKI

SEQ ID NO: 190281 - protein, 9 aa, Artificial Sequence
  Description of Artificial Sequence: Synthetic peptide
  Seed: LRKGYTPLM (TYRP2_HUMAN)
LHKGYTPLF

SEQ ID NO: 190282 - protein, 9 aa, Artificial Sequence
  Description of Artificial Sequence: Synthetic peptide
  Seed: WHRYHLLCL (TYRP2_HUMAN)
WPRYHLLCF

SEQ ID NO: 190283 - protein, 9 aa, Artificial Sequence
  Description of Artificial Sequence: Synthetic peptide
  Seed: WHRYHLLCL (TYRP2_HUMAN)
WIRYHLLCL

SEQ ID NO: 190284 - protein, 9 aa, Artificial Sequence
  Description of Artificial Sequence: Synthetic peptide
  Seed: YSYAIDLPV (TYRP2_HUMAN)
YCYAIDLPY

SEQ ID NO: 190285 - protein, 9 aa, Artificial Sequence
  Description of Artificial Sequence: Synthetic peptide
  Seed: DDYNHLVTL (TYRP2_HUMAN)
DHYNHLVTT

SEQ ID NO: 190286 - protein, 9 aa, Artificial Sequence
  Description of Artificial Sequence: Synthetic peptide
  Seed: SVYDFFVWL (TYRP2_HUMAN)
SQYDFFVWR

SEQ ID NO: 190287 - protein, 10 aa, Artificial Sequence
  Description of Artificial Sequence: Synthetic peptide
  Seed: HRYHLLCLER (TYRP2_HUMAN)
HGYHLLCLER

SEQ ID NO: 190288 - protein, 9 aa, Artificial Sequence
  Description of Artificial Sequence: Synthetic peptide
  Seed: VTNEELFLT (TYRP2_HUMAN)
VLNEELFLA

SEQ ID NO: 190289 - protein, 10 aa, Artificial Sequence
  Description of Artificial Sequence: Synthetic peptide
  Seed: FLLSCLGCKI (TYRP2_HUMAN)
FTLSCLGCKA

SEQ ID NO: 190290 - protein, 9 aa, Artificial Sequence
  Description of Artificial Sequence: Synthetic peptide
  Seed: TQHWLGLLG (TYRP2_HUMAN)
TKHWLGLLY

SEQ ID NO: 190291 - protein, 10 aa, Artificial Sequence
  Description of Artificial Sequence: Synthetic peptide
  Seed: NCSVYDFFVW (TYRP2_HUMAN)
NNSVYDFFVW

SEQ ID NO: 190292 - protein, 9 aa, Artificial Sequence
  Description of Artificial Sequence: Synthetic peptide
  Seed: RQNIHSLSP (TYRP2_HUMAN)
RYNIHSLSF

SEQ ID NO: 190293 - protein, 9 aa, Artificial Sequence
  Description of Artificial Sequence: Synthetic peptide
  Seed: ADAWPQELA (TYRP2_HUMAN)
AEAWPQELI

SEQ ID NO: 190294 - protein, 9 aa, Artificial Sequence
  Description of Artificial Sequence: Synthetic peptide
  Seed: ETPGWPTTL (TYRP2_HUMAN)
ETPGWPTTW

SEQ ID NO: 190295 - protein, 10 aa, Artificial Sequence
  Description of Artificial Sequence: Synthetic peptide
  Seed: GTLDSQVMSL (TYRP2_HUMAN)
GILDSQVMSA

SEQ ID NO: 190296 - protein, 9 aa, Artificial Sequence
  Description of Artificial Sequence: Synthetic peptide
  Seed: DFFVWLHYY (TYRP2_HUMAN)
DSFVWLHYR

SEQ ID NO: 190297 - protein, 11 aa, Artificial Sequence
  Description of Artificial Sequence: Synthetic peptide
  Seed: VMSLHNLVHSF (TYRP2_HUMAN)
VTSLHNLVHSF

SEQ ID NO: 190298 - protein, 10 aa, Artificial Sequence
  Description of Artificial Sequence: Synthetic peptide
  Seed: RRLRKGYTPL (TYRP2_HUMAN)
RVLRKGYTPL

SEQ ID NO: 190299 - protein, 9 aa, Artificial Sequence
  Description of Artificial Sequence: Synthetic peptide
  Seed: NMVPFFPPV (TYRP2_HUMAN)
NMVPFFPPR

SEQ ID NO: 190300 - protein, 9 aa, Artificial Sequence
  Description of Artificial Sequence: Synthetic peptide
  Seed: SRFSSWETV (TYRP2_HUMAN)
SSFSSWETF

SEQ ID NO: 190301 - protein, 9 aa, Artificial Sequence
  Description of Artificial Sequence: Synthetic peptide
  Seed: HYYSVRDTL (TYRP2_HUMAN)
HWYSVRDTM

SEQ ID NO: 190302 - protein, 9 aa, Artificial Sequence
  Description of Artificial Sequence: Synthetic peptide
  Seed: SPQEREQFL (TYRP2_HUMAN)
SQQEREQFL

SEQ ID NO: 190303 - protein, 10 aa, Artificial Sequence
  Description of Artificial Sequence: Synthetic peptide
  Seed: FFPPVTNEEL (TYRP2_HUMAN)
FMPPVTNEEF

SEQ ID NO: 190304 - protein, 10 aa, Artificial Sequence
  Description of Artificial Sequence: Synthetic peptide
  Seed: DAIFDEWMKR (TYRP2_HUMAN)
DPIFDEWMKR

SEQ ID NO: 190305 - protein, 9 aa, Artificial Sequence
  Description of Artificial Sequence: Synthetic peptide
  Seed: LHNLVHSFL (TYRP2_HUMAN)
LRNLVHSFY

SEQ ID NO: 190306 - protein, 9 aa, Artificial Sequence
  Description of Artificial Sequence: Synthetic peptide
  Seed: FVLLAFLQY (TYRP2_HUMAN)
FPLLAFLQL

SEQ ID NO: 190307 - protein, 9 aa, Artificial Sequence
  Description of Artificial Sequence: Synthetic peptide
  Seed: RKFFHRTCK (TYRP2_HUMAN)
RRFFHRTCK

SEQ ID NO: 190308 - protein, 8 aa, Artificial Sequence
  Description of Artificial Sequence: Synthetic peptide
  Seed: SYAIDLPV (TYRP2_HUMAN)
SYAIDLPM

SEQ ID NO: 190309 - protein, 10 aa, Artificial Sequence
  Description of Artificial Sequence: Synthetic peptide
  Seed: YDFFVWLHYY (TYRP2_HUMAN)
YEFFVWLHYY

SEQ ID NO: 190310 - protein, 9 aa, Artificial Sequence
  Description of Artificial Sequence: Synthetic peptide
  Seed: DAWPQELAP (TYRP2_HUMAN)
DPWPQELAV

SEQ ID NO: 190311 - protein, 10 aa, Artificial Sequence
  Description of Artificial Sequence: Synthetic peptide
  Seed: IDFSHQGPAF (TYRP2_HUMAN)
IAFSHQGPAH

SEQ ID NO: 190312 - protein, 10 aa, Artificial Sequence
  Description of Artificial Sequence: Synthetic peptide
  Seed: SRFSSWETVC (TYRP2_HUMAN)
SRFSSWETVY

SEQ ID NO: 190313 - protein, 10 aa, Artificial Sequence
  Description of Artificial Sequence: Synthetic peptide
  Seed: REQFLGALDL (TYRP2_HUMAN)
RWQFLGALDF

SEQ ID NO: 190314 - protein, 11 aa, Artificial Sequence
  Description of Artificial Sequence: Synthetic peptide
  Seed: YNMVPFFPPVT (TYRP2_HUMAN)
YLMVPFFPPVN

SEQ ID NO: 190315 - protein, 10 aa, Artificial Sequence
  Description of Artificial Sequence: Synthetic peptide
  Seed: LVALVGLFVL (TYRP2_HUMAN)
LLALVGLFVV

SEQ ID NO: 190316 - protein, 9 aa, Artificial Sequence
  Description of Artificial Sequence: Synthetic peptide
  Seed: VVMGTLVAL (TYRP2_HUMAN)
VIMGTLVAW

SEQ ID NO: 190317 - protein, 11 aa, Artificial Sequence
  Description of Artificial Sequence: Synthetic peptide
  Seed: HSFTDAIFDEW (TYRP2_HUMAN)
HTFTDAIFDEW

SEQ ID NO: 190318 - protein, 10 aa, Artificial Sequence
  Description of Artificial Sequence: Synthetic peptide
  Seed: RNSRFSSWET (TYRP2_HUMAN)
RMSRFSSWES

SEQ ID NO: 190319 - protein, 9 aa, Artificial Sequence
  Description of Artificial Sequence: Synthetic peptide
  Seed: TPGWPTTLL (TYRP2_HUMAN)
TAGWPTTLL

SEQ ID NO: 190320 - protein, 10 aa, Artificial Sequence
  Description of Artificial Sequence: Synthetic peptide
  Seed: YNMVPFFPPV (TYRP2_HUMAN)
YQMVPFFPPT

SEQ ID NO: 190321 - protein, 11 aa, Artificial Sequence
  Description of Artificial Sequence: Synthetic peptide
  Seed: LLVVMGTLVAL (TYRP2_HUMAN)
LNVVMGTLVAV

SEQ ID NO: 190322 - protein, 10 aa, Artificial Sequence
  Description of Artificial Sequence: Synthetic peptide
  Seed: SSWETVCDSL (TYRP2_HUMAN)
SMWETVCDSL

SEQ ID NO: 190323 - protein, 11 aa, Artificial Sequence
  Description of Artificial Sequence: Synthetic peptide
  Seed: RRNQMGRNSMK (TYRP2_HUMAN)
RMNQMGRNSMR

SEQ ID NO: 190324 - protein, 11 aa, Artificial Sequence
  Description of Artificial Sequence: Synthetic peptide
  Seed: YNMVPFFPPVT (TYRP2_HUMAN)
YQMVPFFPPVS

SEQ ID NO: 190325 - protein, 10 aa, Artificial Sequence
  Description of Artificial Sequence: Synthetic peptide
  Seed: RRLRKGYTPL (TYRP2_HUMAN)
RPLRKGYTPI

SEQ ID NO: 190326 - protein, 10 aa, Artificial Sequence
  Description of Artificial Sequence: Synthetic peptide
  Seed: VVMGTLVALV (TYRP2_HUMAN)
VPMGTLVALV

SEQ ID NO: 190327 - protein, 8 aa, Artificial Sequence
  Description of Artificial Sequence: Synthetic peptide
  Seed: KFFHRTCK (TYRP2_HUMAN)
KTFHRTCR

SEQ ID NO: 190328 - protein, 9 aa, Artificial Sequence
  Description of Artificial Sequence: Synthetic peptide
  Seed: ERKKPPVIR (TYRP2_HUMAN)
EWKKPPVIR

SEQ ID NO: 190329 - protein, 9 aa, Artificial Sequence
  Description of Artificial Sequence: Synthetic peptide
  Seed: SQVMSLHNL (TYRP2_HUMAN)
SDVMSLHNM

SEQ ID NO: 190330 - protein, 10 aa, Artificial Sequence
  Description of Artificial Sequence: Synthetic peptide
  Seed: TRPWSGPYIL (TYRP2_HUMAN)
TMPWSGPYIF

SEQ ID NO: 190331 - protein, 9 aa, Artificial Sequence
  Description of Artificial Sequence: Synthetic peptide
  Seed: VLHSFTDAI (TYRP2_HUMAN)
VGHSFTDAY

SEQ ID NO: 190332 - protein, 9 aa, Artificial Sequence
  Description of Artificial Sequence: Synthetic peptide
  Seed: FLLSCLGCK (TYRP2_HUMAN)
FALSCLGCK

SEQ ID NO: 190333 - protein, 10 aa, Artificial Sequence
  Description of Artificial Sequence: Synthetic peptide
  Seed: HSFLNGTNAL (TYRP2_HUMAN)
HHFLNGTNAF

SEQ ID NO: 190334 - protein, 10 aa, Artificial Sequence
  Description of Artificial Sequence: Synthetic peptide
  Seed: RELWPRKFFH (TYRP2_HUMAN)
RELWPRKFFK

SEQ ID NO: 190335 - protein, 9 aa, Artificial Sequence
  Description of Artificial Sequence: Synthetic peptide
  Seed: DDYNHLVTL (TYRP2_HUMAN)
DRYNHLVTT

SEQ ID NO: 190336 - protein, 9 aa, Artificial Sequence
  Description of Artificial Sequence: Synthetic peptide
  Seed: FTDAIFDEW (TYRP2_HUMAN)
FWDAIFDEV

SEQ ID NO: 190337 - protein, 9 aa, Artificial Sequence
  Description of Artificial Sequence: Synthetic peptide
  Seed: FFQNSTFSF (TYRP2_HUMAN)
FYQNSTFSI

SEQ ID NO: 190338 - protein, 9 aa, Artificial Sequence
  Description of Artificial Sequence: Synthetic peptide
  Seed: DSLDDYNHL (TYRP2_HUMAN)
DVLDDYNHL

SEQ ID NO: 190339 - protein, 10 aa, Artificial Sequence
  Description of Artificial Sequence: Synthetic peptide
  Seed: SLQKFDNPPF (TYRP2_HUMAN)
SGQKFDNPPF

SEQ ID NO: 190340 - protein, 9 aa, Artificial Sequence
  Description of Artificial Sequence: Synthetic peptide
  Seed: VLHSFTDAI (TYRP2_HUMAN)
VMHSFTDAF

SEQ ID NO: 190341 - protein, 10 aa, Artificial Sequence
  Description of Artificial Sequence: Synthetic peptide
  Seed: HSFLNGTNAL (TYRP2_HUMAN)
HQFLNGTNAL

SEQ ID NO: 190342 - protein, 9 aa, Artificial Sequence
  Description of Artificial Sequence: Synthetic peptide
  Seed: IFDEWMKRF (TYRP2_HUMAN)
ISDEWMKRV

SEQ ID NO: 190343 - protein, 9 aa, Artificial Sequence
  Description of Artificial Sequence: Synthetic peptide
  Seed: VMSLHNLVH (TYRP2_HUMAN)
VSSLHNLVF

SEQ ID NO: 190344 - protein, 10 aa, Artificial Sequence
  Description of Artificial Sequence: Synthetic peptide
  Seed: FFPPVTNEEL (TYRP2_HUMAN)
FMPPVTNEEI

SEQ ID NO: 190345 - protein, 11 aa, Artificial Sequence
  Description of Artificial Sequence: Synthetic peptide
  Seed: RADTRPWSGPY (TYRP2_HUMAN)
RKDTRPWSGPA

SEQ ID NO: 190346 - protein, 10 aa, Artificial Sequence
  Description of Artificial Sequence: Synthetic peptide
  Seed: RLRKGYTPLM (TYRP2_HUMAN)
RFRKGYTPLI

SEQ ID NO: 190347 - protein, 9 aa, Artificial Sequence
  Description of Artificial Sequence: Synthetic peptide
  Seed: VLHSFTDAI (TYRP2_HUMAN)
VTHSFTDAV

SEQ ID NO: 190348 - protein, 10 aa, Artificial Sequence
  Description of Artificial Sequence: Synthetic peptide
  Seed: TDAIFDEWMK (TYRP2_HUMAN)
TEAIFDEWMR

SEQ ID NO: 190349 - protein, 9 aa, Artificial Sequence
  Description of Artificial Sequence: Synthetic peptide
  Seed: YSYAIDLPV (TYRP2_HUMAN)
YAYAIDLPH

SEQ ID NO: 190350 - protein, 9 aa, Artificial Sequence
  Description of Artificial Sequence: Synthetic peptide
  Seed: RKFFHRTCK (TYRP2_HUMAN)
RVFFHRTCM

SEQ ID NO: 190351 - protein, 11 aa, Artificial Sequence
  Description of Artificial Sequence: Synthetic peptide
  Seed: YNMVPFFPPVT (TYRP2_HUMAN)
YTMVPFFPPVC

SEQ ID NO: 190352 - protein, 10 aa, Artificial Sequence
  Description of Artificial Sequence: Synthetic peptide
  Seed: TDAIFDEWMK (TYRP2_HUMAN)
TKAIFDEWMR

SEQ ID NO: 190353 - protein, 9 aa, Artificial Sequence
  Description of Artificial Sequence: Synthetic peptide
  Seed: LRKGYTPLM (TYRP2_HUMAN)
LLKGYTPLF

SEQ ID NO: 190354 - protein, 9 aa, Artificial Sequence
  Description of Artificial Sequence: Synthetic peptide
  Seed: YSYAIDLPV (TYRP2_HUMAN)
YAYAIDLPA

SEQ ID NO: 190355 - protein, 9 aa, Artificial Sequence
  Description of Artificial Sequence: Synthetic peptide
  Seed: TLDSQVMSL (TYRP2_HUMAN)
TGDSQVMSL

SEQ ID NO: 190356 - protein, 10 aa, Artificial Sequence
  Description of Artificial Sequence: Synthetic peptide
  Seed: SAANDPIFVV (TYRP2_HUMAN)
STANDPIFVV

SEQ ID NO: 190357 - protein, 10 aa, Artificial Sequence
  Description of Artificial Sequence: Synthetic peptide
  Seed: LHYYSVRDTL (TYRP2_HUMAN)
LLYYSVRDTL

SEQ ID NO: 190358 - protein, 9 aa, Artificial Sequence
  Description of Artificial Sequence: Synthetic peptide
  Seed: FVLLAFLQY (TYRP2_HUMAN)
FTLLAFLQL

SEQ ID NO: 190359 - protein, 9 aa, Artificial Sequence
  Description of Artificial Sequence: Synthetic peptide
  Seed: ETPGWPTTL (TYRP2_HUMAN)
EAPGWPTTI

SEQ ID NO: 190360 - protein, 9 aa, Artificial Sequence
  Description of Artificial Sequence: Synthetic peptide
  Seed: TLDSQVMSL (TYRP2_HUMAN)
TQDSQVMSY

SEQ ID NO: 190361 - protein, 9 aa, Artificial Sequence
  Description of Artificial Sequence: Synthetic peptide
  Seed: KRVHPDYVI (TYRP2_HUMAN)
KHVHPDYVI

SEQ ID NO: 190362 - protein, 10 aa, Artificial Sequence
  Description of Artificial Sequence: Synthetic peptide
  Seed: SLDDYNHLVT (TYRP2_HUMAN)
SADDYNHLVL

SEQ ID NO: 190363 - protein, 11 aa, Artificial Sequence
  Description of Artificial Sequence: Synthetic peptide
  Seed: RRNQMGRNSMK (TYRP2_HUMAN)
RLNQMGRNSMR

SEQ ID NO: 190364 - protein, 9 aa, Artificial Sequence
  Description of Artificial Sequence: Synthetic peptide
  Seed: MTVDSLVNK (TYRP2_HUMAN)
MAVDSLVNL

SEQ ID NO: 190365 - protein, 11 aa, Artificial Sequence
  Description of Artificial Sequence: Synthetic peptide
  Seed: WLHYYSVRDTL (TYRP2_HUMAN)
WGHYYSVRDTW

SEQ ID NO: 190366 - protein, 9 aa, Artificial Sequence
  Description of Artificial Sequence: Synthetic peptide
  Seed: ILPGAQGQF (TYRP2_HUMAN)
IVPGAQGQM

SEQ ID NO: 190367 - protein, 9 aa, Artificial Sequence
  Description of Artificial Sequence: Synthetic peptide
  Seed: GTYEGLLRR (TYRP2_HUMAN)
GIYEGLLRY

SEQ ID NO: 190368 - protein, 10 aa, Artificial Sequence
  Description of Artificial Sequence: Synthetic peptide
  Seed: GTLDSQVMSL (TYRP2_HUMAN)
GILDSQVMSI

SEQ ID NO: 190369 - protein, 9 aa, Artificial Sequence
  Description of Artificial Sequence: Synthetic peptide
  Seed: YSVRDTLLG (TYRP2_HUMAN)
YNVRDTLLW

SEQ ID NO: 190370 - protein, 10 aa, Artificial Sequence
  Description of Artificial Sequence: Synthetic peptide
  Seed: AANDPIFVVL (TYRP2_HUMAN)
AINDPIFVVL

SEQ ID NO: 190371 - protein, 10 aa, Artificial Sequence
  Description of Artificial Sequence: Synthetic peptide
  Seed: SPLWWGFLLS (TYRP2_HUMAN)
SYLWWGFLLL

SEQ ID NO: 190372 - protein, 11 aa, Artificial Sequence
  Description of Artificial Sequence: Synthetic peptide
  Seed: SLDDYNHLVTL (TYRP2_HUMAN)
SLDDYNHLVTY

SEQ ID NO: 190373 - protein, 9 aa, Artificial Sequence
  Description of Artificial Sequence: Synthetic peptide
  Seed: LHNLVHSFL (TYRP2_HUMAN)
LKNLVHSFM

SEQ ID NO: 190374 - protein, 10 aa, Artificial Sequence
  Description of Artificial Sequence: Synthetic peptide
  Seed: ESANVCGSQQ (TYRP2_HUMAN)
EVANVCGSQF

SEQ ID NO: 190375 - protein, 9 aa, Artificial Sequence
  Description of Artificial Sequence: Synthetic peptide
  Seed: RKFFHRTCK (TYRP2_HUMAN)
RQFFHRTCK

SEQ ID NO: 190376 - protein, 9 aa, Artificial Sequence
  Description of Artificial Sequence: Synthetic peptide
  Seed: QFPRVCMTV (TYRP2_HUMAN)
QMPRVCMTW

SEQ ID NO: 190377 - protein, 9 aa, Artificial Sequence
  Description of Artificial Sequence: Synthetic peptide
  Seed: HYYSVRDTL (TYRP2_HUMAN)
HAYSVRDTL

SEQ ID NO: 190378 - protein, 11 aa, Artificial Sequence
  Description of Artificial Sequence: Synthetic peptide
  Seed: SVYDFFVWLHY (TYRP2_HUMAN)
STYDFFVWLHY

SEQ ID NO: 190379 - protein, 9 aa, Artificial Sequence
  Description of Artificial Sequence: Synthetic peptide
  Seed: ELWPRKFFH (TYRP2_HUMAN)
EVWPRKFFR

SEQ ID NO: 190380 - protein, 10 aa, Artificial Sequence
  Description of Artificial Sequence: Synthetic peptide
  Seed: HSFLNGTNAL (TYRP2_HUMAN)
HAFLNGTNAM

SEQ ID NO: 190381 - protein, 9 aa, Artificial Sequence
  Description of Artificial Sequence: Synthetic peptide
  Seed: AANDPIFVV (TYRP2_HUMAN)
AMNDPIFVS

SEQ ID NO: 190382 - protein, 10 aa, Artificial Sequence
  Description of Artificial Sequence: Synthetic peptide
  Seed: MSPLWWGFLL (TYRP2_HUMAN)
MMPLWWGFLV

SEQ ID NO: 190383 - protein, 9 aa, Artificial Sequence
  Description of Artificial Sequence: Synthetic peptide
  Seed: ITTQHWLGL (TYRP2_HUMAN)
ITTQHWLGW

SEQ ID NO: 190384 - protein, 10 aa, Artificial Sequence
  Description of Artificial Sequence: Synthetic peptide
  Seed: LHYYSVRDTL (TYRP2_HUMAN)
LLYYSVRDTF

SEQ ID NO: 190385 - protein, 10 aa, Artificial Sequence
  Description of Artificial Sequence: Synthetic peptide
  Seed: YDFFVWLHYY (TYRP2_HUMAN)
YSFFVWLHYY

SEQ ID NO: 190386 - protein, 9 aa, Artificial Sequence
  Description of Artificial Sequence: Synthetic peptide
  Seed: ARPDDPTLI (TYRP2_HUMAN)
AFPDDPTLL

SEQ ID NO: 190387 - protein, 10 aa, Artificial Sequence
  Description of Artificial Sequence: Synthetic peptide
  Seed: FFPPVTNEEL (TYRP2_HUMAN)
FAPPVTNEEM

SEQ ID NO: 190388 - protein, 9 aa, Artificial Sequence
  Description of Artificial Sequence: Synthetic peptide
  Seed: MTVDSLVNK (TYRP2_HUMAN)
MNVDSLVNR

SEQ ID NO: 190389 - protein, 10 aa, Artificial Sequence
  Description of Artificial Sequence: Synthetic peptide
  Seed: HNRMYNMVPF (TYRP2_HUMAN)
HERMYNMVPL

SEQ ID NO: 190390 - protein, 11 aa, Artificial Sequence
  Description of Artificial Sequence: Synthetic peptide
  Seed: RADTRPWSGPY (TYRP2_HUMAN)
RWDTRPWSGPK

SEQ ID NO: 190391 - protein, 9 aa, Artificial Sequence
  Description of Artificial Sequence: Synthetic peptide
  Seed: GFDKADGTL (TYRP2_HUMAN)
GFDKADGTF

SEQ ID NO: 190392 - protein, 10 aa, Artificial Sequence
  Description of Artificial Sequence: Synthetic peptide
  Seed: QGPAFVTWHR (TYRP2_HUMAN)
QSPAFVTWHK

SEQ ID NO: 190393 - protein, 9 aa, Artificial Sequence
  Description of Artificial Sequence: Synthetic peptide
  Seed: RVCMTVDSL (TYRP2_HUMAN)
RACMTVDSY

SEQ ID NO: 190394 - protein, 10 aa, Artificial Sequence
  Description of Artificial Sequence: Synthetic peptide
  Seed: NGTYEGLLRR (TYRP2_HUMAN)
NQTYEGLLRR

SEQ ID NO: 190395 - protein, 9 aa, Artificial Sequence
  Description of Artificial Sequence: Synthetic peptide
  Seed: RPWSGPYIL (TYRP2_HUMAN)
RAWSGPYII

SEQ ID NO: 190396 - protein, 9 aa, Artificial Sequence
  Description of Artificial Sequence: Synthetic peptide
  Seed: FFQNSTFSF (TYRP2_HUMAN)
FIQNSTFSM

SEQ ID NO: 190397 - protein, 10 aa, Artificial Sequence
  Description of Artificial Sequence: Synthetic peptide
  Seed: RLRKGYTPLM (TYRP2_HUMAN)
RSRKGYTPLQ

SEQ ID NO: 190398 - protein, 9 aa, Artificial Sequence
  Description of Artificial Sequence: Synthetic peptide
  Seed: QRLIGNESF (TYRP2_HUMAN)
QHLIGNESM

SEQ ID NO: 190399 - protein, 11 aa, Artificial Sequence
  Description of Artificial Sequence: Synthetic peptide
  Seed: RNSRFSSWETV (TYRP2_HUMAN)
RQSRFSSWETV

SEQ ID NO: 190400 - protein, 10 aa, Artificial Sequence
  Description of Artificial Sequence: Synthetic peptide
  Seed: MGRNSMKLPT (TYRP2_HUMAN)
MARNSMKLPA

SEQ ID NO: 190401 - protein, 9 aa, Artificial Sequence
  Description of Artificial Sequence: Synthetic peptide
  Seed: STFSFRNAL (TYRP2_HUMAN)
SFFSFRNAW

SEQ ID NO: 190402 - protein, 9 aa, Artificial Sequence
  Description of Artificial Sequence: Synthetic peptide
  Seed: NSMKLPTLK (TYRP2_HUMAN)
NLMKLPTLR

SEQ ID NO: 190403 - protein, 9 aa, Artificial Sequence
  Description of Artificial Sequence: Synthetic peptide
  Seed: ALVGLFVLL (TYRP2_HUMAN)
AMVGLFVLW

SEQ ID NO: 190404 - protein, 10 aa, Artificial Sequence
  Description of Artificial Sequence: Synthetic peptide
  Seed: KADGTLDSQV (TYRP2_HUMAN)
KIDGTLDSQL

SEQ ID NO: 190405 - protein, 10 aa, Artificial Sequence
  Description of Artificial Sequence: Synthetic peptide
  Seed: RTCKCTGNFA (TYRP2_HUMAN)
RFCKCTGNFK

SEQ ID NO: 190406 - protein, 10 aa, Artificial Sequence
  Description of Artificial Sequence: Synthetic peptide
  Seed: YNMVPFFPPV (TYRP2_HUMAN)
YIMVPFFPPV

SEQ ID NO: 190407 - protein, 10 aa, Artificial Sequence
  Description of Artificial Sequence: Synthetic peptide
  Seed: DAIFDEWMKR (TYRP2_HUMAN)
DIIFDEWMKK

SEQ ID NO: 190408 - protein, 9 aa, Artificial Sequence
  Description of Artificial Sequence: Synthetic peptide
  Seed: TLLGPGRPY (TYRP2_HUMAN)
TALGPGRPL

SEQ ID NO: 190409 - protein, 9 aa, Artificial Sequence
  Description of Artificial Sequence: Synthetic peptide
  Seed: APIGHNRMY (TYRP2_HUMAN)
AMIGHNRMY

SEQ ID NO: 190410 - protein, 11 aa, Artificial Sequence
  Description of Artificial Sequence: Synthetic peptide
  Seed: RNSRFSSWETV (TYRP2_HUMAN)
RSSRFSSWETF

SEQ ID NO: 190411 - protein, 10 aa, Artificial Sequence
  Description of Artificial Sequence: Synthetic peptide
  Seed: DIRDCLSLQK (TYRP2_HUMAN)
DSRDCLSLQK

SEQ ID NO: 190412 - protein, 11 aa, Artificial Sequence
  Description of Artificial Sequence: Synthetic peptide
  Seed: SLDDYNHLVTL (TYRP2_HUMAN)
STDDYNHLVTL

SEQ ID NO: 190413 - protein, 10 aa, Artificial Sequence
  Description of Artificial Sequence: Synthetic peptide
  Seed: LHYYSVRDTL (TYRP2_HUMAN)
LKYYSVRDTI

SEQ ID NO: 190414 - protein, 9 aa, Artificial Sequence
  Description of Artificial Sequence: Synthetic peptide
  Seed: ALVGLFVLL (TYRP2_HUMAN)
ATVGLFVLL

SEQ ID NO: 190415 - protein, 9 aa, Artificial Sequence
  Description of Artificial Sequence: Synthetic peptide
  Seed: EETPGWPTT (TYRP2_HUMAN)
EETPGWPTM

SEQ ID NO: 190416 - protein, 9 aa, Artificial Sequence
  Description of Artificial Sequence: Synthetic peptide
  Seed: YVITTQHWL (TYRP2_HUMAN)
YAITTQHWW

SEQ ID NO: 190417 - protein, 9 aa, Artificial Sequence
  Description of Artificial Sequence: Synthetic peptide
  Seed: SFALPYWNF (TYRP2_HUMAN)
SAALPYWNY

SEQ ID NO: 190418 - protein, 10 aa, Artificial Sequence
  Description of Artificial Sequence: Synthetic peptide
  Seed: NSTFSFRNAL (TYRP2_HUMAN)
NMTFSFRNAA

SEQ ID NO: 190419 - protein, 11 aa, Artificial Sequence
  Description of Artificial Sequence: Synthetic peptide
  Seed: HPDYVITTQHW (TYRP2_HUMAN)
HTDYVITTQHW

SEQ ID NO: 190420 - protein, 9 aa, Artificial Sequence
  Description of Artificial Sequence: Synthetic peptide
  Seed: AANDPIFVV (TYRP2_HUMAN)
ALNDPIFVV

SEQ ID NO: 190421 - protein, 10 aa, Artificial Sequence
  Description of Artificial Sequence: Synthetic peptide
  Seed: DTLLGPGRPY (TYRP2_HUMAN)
DTLLGPGRPR

SEQ ID NO: 190422 - protein, 10 aa, Artificial Sequence
  Description of Artificial Sequence: Synthetic peptide
  Seed: RNSRFSSWET (TYRP2_HUMAN)
RGSRFSSWEV

SEQ ID NO: 190423 - protein, 10 aa, Artificial Sequence
  Description of Artificial Sequence: Synthetic peptide
  Seed: RNSRFSSWET (TYRP2_HUMAN)
RGSRFSSWEL

SEQ ID NO: 190424 - protein, 9 aa, Artificial Sequence
  Description of Artificial Sequence: Synthetic peptide
  Seed: TLVALVGLF (TYRP2_HUMAN)
TKVALVGLF

SEQ ID NO: 190425 - protein, 10 aa, Artificial Sequence
  Description of Artificial Sequence: Synthetic peptide
  Seed: RNSRFSSWET (TYRP2_HUMAN)
RYSRFSSWEL

SEQ ID NO: 190426 - protein, 9 aa, Artificial Sequence
  Description of Artificial Sequence: Synthetic peptide
  Seed: SVYDFFVWL (TYRP2_HUMAN)
SSYDFFVWI

SEQ ID NO: 190427 - protein, 9 aa, Artificial Sequence
  Description of Artificial Sequence: Synthetic peptide
  Seed: SQVMSLHNL (TYRP2_HUMAN)
SVVMSLHNL

SEQ ID NO: 190428 - protein, 10 aa, Artificial Sequence
  Description of Artificial Sequence: Synthetic peptide
  Seed: RRNQMGRNSM (TYRP2_HUMAN)
RMNQMGRNSF

SEQ ID NO: 190429 - protein, 9 aa, Artificial Sequence
  Description of Artificial Sequence: Synthetic peptide
  Seed: RLRKGYTPL (TYRP2_HUMAN)
RVRKGYTPY

SEQ ID NO: 190430 - protein, 10 aa, Artificial Sequence
  Description of Artificial Sequence: Synthetic peptide
  Seed: LQRLIGNESF (TYRP2_HUMAN)
LLRLIGNESF

SEQ ID NO: 190431 - protein, 9 aa, Artificial Sequence
  Description of Artificial Sequence: Synthetic peptide
  Seed: SPLWWGFLL (TYRP2_HUMAN)
STLWWGFLL

SEQ ID NO: 190432 - protein, 10 aa, Artificial Sequence
  Description of Artificial Sequence: Synthetic peptide
  Seed: DPTLISRNSR (TYRP2_HUMAN)
DSTLISRNSR

SEQ ID NO: 190433 - protein, 10 aa, Artificial Sequence
  Description of Artificial Sequence: Synthetic peptide
  Seed: LVVMGTLVAL (TYRP2_HUMAN)
LDVMGTLVAV

SEQ ID NO: 190434 - protein, 9 aa, Artificial Sequence
  Description of Artificial Sequence: Synthetic peptide
  Seed: ELWPRKFFH (TYRP2_HUMAN)
EWWPRKFFK

SEQ ID NO: 190435 - protein, 10 aa, Artificial Sequence
  Description of Artificial Sequence: Synthetic peptide
  Seed: TLVALVGLFV (TYRP2_HUMAN)
TSVALVGLFV

SEQ ID NO: 190436 - protein, 9 aa, Artificial Sequence
  Description of Artificial Sequence: Synthetic peptide
  Seed: ETPGWPTTL (TYRP2_HUMAN)
ESPGWPTTV

SEQ ID NO: 190437 - protein, 10 aa, Artificial Sequence
  Description of Artificial Sequence: Synthetic peptide
  Seed: DPTLISRNSR (TYRP2_HUMAN)
DYTLISRNSR

SEQ ID NO: 190438 - protein, 10 aa, Artificial Sequence
  Description of Artificial Sequence: Synthetic peptide
  Seed: SLDDYNHLVT (TYRP2_HUMAN)
SVDDYNHLVF

SEQ ID NO: 190439 - protein, 9 aa, Artificial Sequence
  Description of Artificial Sequence: Synthetic peptide
  Seed: DFFVWLHYY (TYRP2_HUMAN)
DIFVWLHYK

SEQ ID NO: 190440 - protein, 8 aa, Artificial Sequence
  Description of Artificial Sequence: Synthetic peptide
  Seed: FQNSTFSF (TYRP2_HUMAN)
FMNSTFSY

SEQ ID NO: 190441 - protein, 9 aa, Artificial Sequence
  Description of Artificial Sequence: Synthetic peptide
  Seed: WPTTLLVVM (TYRP2_HUMAN)
WHTTLLVVL

SEQ ID NO: 190442 - protein, 11 aa, Artificial Sequence
  Description of Artificial Sequence: Synthetic peptide
  Seed: FLTSDQLGYSY (TYRP2_HUMAN)
FTTSDQLGYSY

SEQ ID NO: 190443 - protein, 11 aa, Artificial Sequence
  Description of Artificial Sequence: Synthetic peptide
  Seed: WLHYYSVRDTL (TYRP2_HUMAN)
WWHYYSVRDTF

SEQ ID NO: 190444 - protein, 9 aa, Artificial Sequence
  Description of Artificial Sequence: Synthetic peptide
  Seed: SFLNGTNAL (TYRP2_HUMAN)
SALNGTNAI

SEQ ID NO: 190445 - protein, 9 aa, Artificial Sequence
  Description of Artificial Sequence: Synthetic peptide
  Seed: SQVMSLHNL (TYRP2_HUMAN)
SEVMSLHNF

SEQ ID NO: 190446 - protein, 9 aa, Artificial Sequence
  Description of Artificial Sequence: Synthetic peptide
  Seed: YVITTQHWL (TYRP2_HUMAN)
YVITTQHWM

SEQ ID NO: 190447 - protein, 11 aa, Artificial Sequence
  Description of Artificial Sequence: Synthetic peptide
  Seed: LLVVMGTLVAL (TYRP2_HUMAN)
LRVVMGTLVAV

SEQ ID NO: 190448 - protein, 10 aa, Artificial Sequence
  Description of Artificial Sequence: Synthetic peptide
  Seed: FLLSCLGCKI (TYRP2_HUMAN)
FILSCLGCKA

SEQ ID NO: 190449 - protein, 9 aa, Artificial Sequence
  Description of Artificial Sequence: Synthetic peptide
  Seed: RMYNMVPFF (TYRP2_HUMAN)
RWYNMVPFR

SEQ ID NO: 190450 - protein, 10 aa, Artificial Sequence
  Description of Artificial Sequence: Synthetic peptide
  Seed: RLRKGYTPLM (TYRP2_HUMAN)
RARKGYTPLV

SEQ ID NO: 190451 - protein, 10 aa, Artificial Sequence
  Description of Artificial Sequence: Synthetic peptide
  Seed: WPTTLLVVMG (TYRP2_HUMAN)
WPTTLLVVML

SEQ ID NO: 190452 - protein, 9 aa, Artificial Sequence
  Description of Artificial Sequence: Synthetic peptide
  Seed: SLHNLVHSF (TYRP2_HUMAN)
SRHNLVHSI

SEQ ID NO: 190453 - protein, 9 aa, Artificial Sequence
  Description of Artificial Sequence: Synthetic peptide
  Seed: LLGPGRPYR (TYRP2_HUMAN)
LTGPGRPYR

SEQ ID NO: 190454 - protein, 9 aa, Artificial Sequence
  Description of Artificial Sequence: Synthetic peptide
  Seed: ESANVCGSQ (TYRP2_HUMAN)
EAANVCGSK

SEQ ID NO: 190455 - protein, 9 aa, Artificial Sequence
  Description of Artificial Sequence: Synthetic peptide
  Seed: HQGPAFVTW (TYRP2_HUMAN)
HMGPAFVTL

SEQ ID NO: 190456 - protein, 9 aa, Artificial Sequence
  Description of Artificial Sequence: Synthetic peptide
  Seed: ARPDDPTLI (TYRP2_HUMAN)
AGPDDPTLL

SEQ ID NO: 190457 - protein, 10 aa, Artificial Sequence
  Description of Artificial Sequence: Synthetic peptide
  Seed: QPQFANCSVY (TYRP2_HUMAN)
QPQFANCSVM

SEQ ID NO: 190458 - protein, 10 aa, Artificial Sequence
  Description of Artificial Sequence: Synthetic peptide
  Seed: AFVTWHRYHL (TYRP2_HUMAN)
AYVTWHRYHL

SEQ ID NO: 190459 - protein, 10 aa, Artificial Sequence
  Description of Artificial Sequence: Synthetic peptide
  Seed: RMYNMVPFFP (TYRP2_HUMAN)
RSYNMVPFFW

SEQ ID NO: 190460 - protein, 9 aa, Artificial Sequence
  Description of Artificial Sequence: Synthetic peptide
  Seed: RAIDFSHQG (TYRP2_HUMAN)
RLIDFSHQF

SEQ ID NO: 190461 - protein, 11 aa, Artificial Sequence
  Description of Artificial Sequence: Synthetic peptide
  Seed: VCDSLDDYNHL (TYRP2_HUMAN)
VADSLDDYNHL

SEQ ID NO: 190462 - protein, 10 aa, Artificial Sequence
  Description of Artificial Sequence: Synthetic peptide
  Seed: ADTRPWSGPY (TYRP2_HUMAN)
AYTRPWSGPK

SEQ ID NO: 190463 - protein, 9 aa, Artificial Sequence
  Description of Artificial Sequence: Synthetic peptide
  Seed: SLHNLVHSF (TYRP2_HUMAN)
SQHNLVHSF

SEQ ID NO: 190464 - protein, 10 aa, Artificial Sequence
  Description of Artificial Sequence: Synthetic peptide
  Seed: AARPDDPTLI (TYRP2_HUMAN)
AMRPDDPTLW

SEQ ID NO: 190465 - protein, 9 aa, Artificial Sequence
  Description of Artificial Sequence: Synthetic peptide
  Seed: ETPGWPTTL (TYRP2_HUMAN)
EVPGWPTTM

SEQ ID NO: 190466 - protein, 10 aa, Artificial Sequence
  Description of Artificial Sequence: Synthetic peptide
  Seed: ADTRPWSGPY (TYRP2_HUMAN)
ATTRPWSGPK

SEQ ID NO: 190467 - protein, 9 aa, Artificial Sequence
  Description of Artificial Sequence: Synthetic peptide
  Seed: RNSMKLPTL (TYRP2_HUMAN)
RTSMKLPTL

SEQ ID NO: 190468 - protein, 11 aa, Artificial Sequence
  Description of Artificial Sequence: Synthetic peptide
  Seed: TQPQFANCSVY (TYRP2_HUMAN)
TKPQFANCSVF

SEQ ID NO: 190469 - protein, 8 aa, Artificial Sequence
  Description of Artificial Sequence: Synthetic peptide
  Seed: SLDDYNHL (TYRP2_HUMAN)
SWDDYNHM

SEQ ID NO: 190470 - protein, 10 aa, Artificial Sequence
  Description of Artificial Sequence: Synthetic peptide
  Seed: HNRMYNMVPF (TYRP2_HUMAN)
HMRMYNMVPL

SEQ ID NO: 190471 - protein, 9 aa, Artificial Sequence
  Description of Artificial Sequence: Synthetic peptide
  Seed: RLRKGYTPL (TYRP2_HUMAN)
RTRKGYTPC

SEQ ID NO: 190472 - protein, 9 aa, Artificial Sequence
  Description of Artificial Sequence: Synthetic peptide
  Seed: SVYDFFVWL (TYRP2_HUMAN)
STYDFFVWV

SEQ ID NO: 190473 - protein, 10 aa, Artificial Sequence
  Description of Artificial Sequence: Synthetic peptide
  Seed: VVMGTLVALV (TYRP2_HUMAN)
VLMGTLVALR

SEQ ID NO: 190474 - protein, 9 aa, Artificial Sequence
  Description of Artificial Sequence: Synthetic peptide
  Seed: DFSHQGPAF (TYRP2_HUMAN)
DMSHQGPAY

SEQ ID NO: 190475 - protein, 10 aa, Artificial Sequence
  Description of Artificial Sequence: Synthetic peptide
  Seed: HRYHLLCLER (TYRP2_HUMAN)
HLYHLLCLER

SEQ ID NO: 190476 - protein, 9 aa, Artificial Sequence
  Description of Artificial Sequence: Synthetic peptide
  Seed: GTYEGLLRR (TYRP2_HUMAN)
GLYEGLLRV

SEQ ID NO: 190477 - protein, 9 aa, Artificial Sequence
  Description of Artificial Sequence: Synthetic peptide
  Seed: SRNSRFSSW (TYRP2_HUMAN)
SRNSRFSSI

SEQ ID NO: 190478 - protein, 11 aa, Artificial Sequence
  Description of Artificial Sequence: Synthetic peptide
  Seed: YNMVPFFPPVT (TYRP2_HUMAN)
YYMVPFFPPVV

SEQ ID NO: 190479 - protein, 10 aa, Artificial Sequence
  Description of Artificial Sequence: Synthetic peptide
  Seed: SLDDYNHLVT (TYRP2_HUMAN)
SVDDYNHLVI

SEQ ID NO: 190480 - protein, 11 aa, Artificial Sequence
  Description of Artificial Sequence: Synthetic peptide
  Seed: FFPPVTNEELF (TYRP2_HUMAN)
FHPPVTNEELW

SEQ ID NO: 190481 - protein, 9 aa, Artificial Sequence
  Description of Artificial Sequence: Synthetic peptide
  Seed: AANDPIFVV (TYRP2_HUMAN)
AINDPIFVA

SEQ ID NO: 190482 - protein, 10 aa, Artificial Sequence
  Description of Artificial Sequence: Synthetic peptide
  Seed: HRYHLLCLER (TYRP2_HUMAN)
HRYHLLCLEY

SEQ ID NO: 190483 - protein, 10 aa, Artificial Sequence
  Description of Artificial Sequence: Synthetic peptide
  Seed: RNSRFSSWET (TYRP2_HUMAN)
RYSRFSSWEA

SEQ ID NO: 190484 - protein, 10 aa, Artificial Sequence
  Description of Artificial Sequence: Synthetic peptide
  Seed: LDDYNHLVTL (TYRP2_HUMAN)
LTDYNHLVTL

SEQ ID NO: 190485 - protein, 9 aa, Artificial Sequence
  Description of Artificial Sequence: Synthetic peptide
  Seed: RKFFHRTCK (TYRP2_HUMAN)
RIFFHRTCI

SEQ ID NO: 190486 - protein, 9 aa, Artificial Sequence
  Description of Artificial Sequence: Synthetic peptide
  Seed: WMKRFNPPA (TYRP2_HUMAN)
WAKRFNPPF

SEQ ID NO: 190487 - protein, 10 aa, Artificial Sequence
  Description of Artificial Sequence: Synthetic peptide
  Seed: NPPFFQNSTF (TYRP2_HUMAN)
NCPFFQNSTY

SEQ ID NO: 190488 - protein, 10 aa, Artificial Sequence
  Description of Artificial Sequence: Synthetic peptide
  Seed: RLRKGYTPLM (TYRP2_HUMAN)
RSRKGYTPLP

SEQ ID NO: 190489 - protein, 11 aa, Artificial Sequence
  Description of Artificial Sequence: Synthetic peptide
  Seed: FVVLHSFTDAI (TYRP2_HUMAN)
FNVLHSFTDAI

SEQ ID NO: 190490 - protein, 11 aa, Artificial Sequence
  Description of Artificial Sequence: Synthetic peptide
  Seed: SLDDYNHLVTL (TYRP2_HUMAN)
SGDDYNHLVTM

SEQ ID NO: 190491 - protein, 9 aa, Artificial Sequence
  Description of Artificial Sequence: Synthetic peptide
  Seed: GTYEGLLRR (TYRP2_HUMAN)
GSYEGLLRF

SEQ ID NO: 190492 - protein, 9 aa, Artificial Sequence
  Description of Artificial Sequence: Synthetic peptide
  Seed: WHRYHLLCL (TYRP2_HUMAN)
WRRYHLLCY

SEQ ID NO: 190493 - protein, 9 aa, Artificial Sequence
  Description of Artificial Sequence: Synthetic peptide
  Seed: FFQNSTFSF (TYRP2_HUMAN)
FTQNSTFSI

SEQ ID NO: 190494 - protein, 10 aa, Artificial Sequence
  Description of Artificial Sequence: Synthetic peptide
  Seed: RNSRFSSWET (TYRP2_HUMAN)
RFSRFSSWEI

SEQ ID NO: 190495 - protein, 9 aa, Artificial Sequence
  Description of Artificial Sequence: Synthetic peptide
  Seed: LPVSVEETP (TYRP2_HUMAN)
LPVSVEETF

SEQ ID NO: 190496 - protein, 10 aa, Artificial Sequence
  Description of Artificial Sequence: Synthetic peptide
  Seed: VVLHSFTDAI (TYRP2_HUMAN)
VMLHSFTDAL

SEQ ID NO: 190497 - protein, 11 aa, Artificial Sequence
  Description of Artificial Sequence: Synthetic peptide
  Seed: SANVCGSQQGR (TYRP2_HUMAN)
STNVCGSQQGY

SEQ ID NO: 190498 - protein, 11 aa, Artificial Sequence
  Description of Artificial Sequence: Synthetic peptide
  Seed: RMYNMVPFFPP (TYRP2_HUMAN)
RMYNMVPFFPV

SEQ ID NO: 190499 - protein, 10 aa, Artificial Sequence
  Description of Artificial Sequence: Synthetic peptide
  Seed: QFANCSVYDF (TYRP2_HUMAN)
QYANCSVYDW

SEQ ID NO: 190500 - protein, 9 aa, Artificial Sequence
  Description of Artificial Sequence: Synthetic peptide
  Seed: RQNIHSLSP (TYRP2_HUMAN)
RGNIHSLSY

SEQ ID NO: 190501 - protein, 11 aa, Artificial Sequence
  Description of Artificial Sequence: Synthetic peptide
  Seed: RMYNMVPFFPP (TYRP2_HUMAN)
RLYNMVPFFPV

SEQ ID NO: 190502 - protein, 10 aa, Artificial Sequence
  Description of Artificial Sequence: Synthetic peptide
  Seed: YNCGDCKFGW (TYRP2_HUMAN)
YSCGDCKFGW

SEQ ID NO: 190503 - protein, 9 aa, Artificial Sequence
  Description of Artificial Sequence: Synthetic peptide
  Seed: YSVRDTLLG (TYRP2_HUMAN)
YAVRDTLLF

SEQ ID NO: 190504 - protein, 9 aa, Artificial Sequence
  Description of Artificial Sequence: Synthetic peptide
  Seed: SLDDYNHLV (TYRP2_HUMAN)
SPDDYNHLM

SEQ ID NO: 190505 - protein, 9 aa, Artificial Sequence
  Description of Artificial Sequence: Synthetic peptide
  Seed: NRMYNMVPF (TYRP2_HUMAN)
NHMYNMVPV

SEQ ID NO: 190506 - protein, 11 aa, Artificial Sequence
  Description of Artificial Sequence: Synthetic peptide
  Seed: YTPLMETHLSS (TYRP2_HUMAN)
YCPLMETHLSI

SEQ ID NO: 190507 - protein, 11 aa, Artificial Sequence
  Description of Artificial Sequence: Synthetic peptide
  Seed: YNMVPFFPPVT (TYRP2_HUMAN)
YQMVPFFPPVA

SEQ ID NO: 190508 - protein, 9 aa, Artificial Sequence
  Description of Artificial Sequence: Synthetic peptide
  Seed: YTPLMETHL (TYRP2_HUMAN)
YYPLMETHL

SEQ ID NO: 190509 - protein, 9 aa, Artificial Sequence
  Description of Artificial Sequence: Synthetic peptide
  Seed: RNSMKLPTL (TYRP2_HUMAN)
RASMKLPTM

SEQ ID NO: 190510 - protein, 10 aa, Artificial Sequence
  Description of Artificial Sequence: Synthetic peptide
  Seed: CKCTGNFAGY (TYRP2_HUMAN)
CQCTGNFAGF

SEQ ID NO: 190511 - protein, 10 aa, Artificial Sequence
  Description of Artificial Sequence: Synthetic peptide
  Seed: RLRKGYTPLM (TYRP2_HUMAN)
RTRKGYTPLQ

SEQ ID NO: 190512 - protein, 9 aa, Artificial Sequence
  Description of Artificial Sequence: Synthetic peptide
  Seed: DSLDDYNHL (TYRP2_HUMAN)
DTLDDYNHY

SEQ ID NO: 190513 - protein, 10 aa, Artificial Sequence
  Description of Artificial Sequence: Synthetic peptide
  Seed: TQPQFANCSV (TYRP2_HUMAN)
TKPQFANCSL

SEQ ID NO: 190514 - protein, 9 aa, Artificial Sequence
  Description of Artificial Sequence: Synthetic peptide
  Seed: HSFLNGTNA (TYRP2_HUMAN)
HTFLNGTNF

SEQ ID NO: 190515 - protein, 9 aa, Artificial Sequence
  Description of Artificial Sequence: Synthetic peptide
  Seed: ISRNSRFSS (TYRP2_HUMAN)
IYRNSRFSV

SEQ ID NO: 190516 - protein, 10 aa, Artificial Sequence
  Description of Artificial Sequence: Synthetic peptide
  Seed: YNMVPFFPPV (TYRP2_HUMAN)
YKMVPFFPPI

SEQ ID NO: 190517 - protein, 9 aa, Artificial Sequence
  Description of Artificial Sequence: Synthetic peptide
  Seed: AANDPIFVV (TYRP2_HUMAN)
ATNDPIFVL

SEQ ID NO: 190518 - protein, 10 aa, Artificial Sequence
  Description of Artificial Sequence: Synthetic peptide
  Seed: FFPPVTNEEL (TYRP2_HUMAN)
FTPPVTNEEL

SEQ ID NO: 190519 - protein, 11 aa, Artificial Sequence
  Description of Artificial Sequence: Synthetic peptide
  Seed: HNRMYNMVPFF (TYRP2_HUMAN)
HMRMYNMVPFF

SEQ ID NO: 190520 - protein, 11 aa, Artificial Sequence
  Description of Artificial Sequence: Synthetic peptide
  Seed: FANCSVYDFFV (TYRP2_HUMAN)
FQNCSVYDFFL

SEQ ID NO: 190521 - protein, 9 aa, Artificial Sequence
  Description of Artificial Sequence: Synthetic peptide
  Seed: VALVGLFVL (TYRP2_HUMAN)
VMLVGLFVA

SEQ ID NO: 190522 - protein, 11 aa, Artificial Sequence
  Description of Artificial Sequence: Synthetic peptide
  Seed: MYNMVPFFPPV (TYRP2_HUMAN)
MWNMVPFFPPI

SEQ ID NO: 190523 - protein, 9 aa, Artificial Sequence
  Description of Artificial Sequence: Synthetic peptide
  Seed: DDRELWPRK (TYRP2_HUMAN)
DTRELWPRR

SEQ ID NO: 190524 - protein, 9 aa, Artificial Sequence
  Description of Artificial Sequence: Synthetic peptide
  Seed: SFLNGTNAL (TYRP2_HUMAN)
SILNGTNAY

SEQ ID NO: 190525 - protein, 9 aa, Artificial Sequence
  Description of Artificial Sequence: Synthetic peptide
  Seed: LAPIGHNRM (TYRP2_HUMAN)
LIPIGHNRL

SEQ ID NO: 190526 - protein, 10 aa, Artificial Sequence
  Description of Artificial Sequence: Synthetic peptide
  Seed: FVVLHSFTDA (TYRP2_HUMAN)
FPVLHSFTDV

SEQ ID NO: 190527 - protein, 10 aa, Artificial Sequence
  Description of Artificial Sequence: Synthetic peptide
  Seed: GPAFVTWHRY (TYRP2_HUMAN)
GVAFVTWHRY

SEQ ID NO: 190528 - protein, 9 aa, Artificial Sequence
  Description of Artificial Sequence: Synthetic peptide
  Seed: HQGPAFVTW (TYRP2_HUMAN)
HYGPAFVTW

SEQ ID NO: 190529 - protein, 10 aa, Artificial Sequence
  Description of Artificial Sequence: Synthetic peptide
  Seed: EELFLTSDQL (TYRP2_HUMAN)
EELFLTSDQW

SEQ ID NO: 190530 - protein, 9 aa, Artificial Sequence
  Description of Artificial Sequence: Synthetic peptide
  Seed: MTVDSLVNK (TYRP2_HUMAN)
MQVDSLVNR

SEQ ID NO: 190531 - protein, 9 aa, Artificial Sequence
  Description of Artificial Sequence: Synthetic peptide
  Seed: TLLGPGRPY (TYRP2_HUMAN)
TRLGPGRPF

SEQ ID NO: 190532 - protein, 11 aa, Artificial Sequence
  Description of Artificial Sequence: Synthetic peptide
  Seed: VCDSLDDYNHL (TYRP2_HUMAN)
VFDSLDDYNHL

SEQ ID NO: 190533 - protein, 9 aa, Artificial Sequence
  Description of Artificial Sequence: Synthetic peptide
  Seed: SLHNLVHSF (TYRP2_HUMAN)
STHNLVHSW

SEQ ID NO: 190534 - protein, 10 aa, Artificial Sequence
  Description of Artificial Sequence: Synthetic peptide
  Seed: HLVTLCNGTY (TYRP2_HUMAN)
HQVTLCNGTM

SEQ ID NO: 190535 - protein, 10 aa, Artificial Sequence
  Description of Artificial Sequence: Synthetic peptide
  Seed: FFQNSTFSFR (TYRP2_HUMAN)
FWQNSTFSFF

SEQ ID NO: 190536 - protein, 10 aa, Artificial Sequence
  Description of Artificial Sequence: Synthetic peptide
  Seed: RRLRKGYTPL (TYRP2_HUMAN)
RTLRKGYTPY

SEQ ID NO: 190537 - protein, 10 aa, Artificial Sequence
  Description of Artificial Sequence: Synthetic peptide
  Seed: NGTYEGLLRR (TYRP2_HUMAN)
NYTYEGLLRR

SEQ ID NO: 190538 - protein, 11 aa, Artificial Sequence
  Description of Artificial Sequence: Synthetic peptide
  Seed: RNSRFSSWETV (TYRP2_HUMAN)
RDSRFSSWETM

SEQ ID NO: 190539 - protein, 9 aa, Artificial Sequence
  Description of Artificial Sequence: Synthetic peptide
  Seed: YDFFVWLHY (TYRP2_HUMAN)
YSFFVWLHF

SEQ ID NO: 190540 - protein, 10 aa, Artificial Sequence
  Description of Artificial Sequence: Synthetic peptide
  Seed: ETPGWPTTLL (TYRP2_HUMAN)
EMPGWPTTLR

SEQ ID NO: 190541 - protein, 9 aa, Artificial Sequence
  Description of Artificial Sequence: Synthetic peptide
  Seed: NMVPFFPPV (TYRP2_HUMAN)
NMVPFFPPF

SEQ ID NO: 190542 - protein, 9 aa, Artificial Sequence
  Description of Artificial Sequence: Synthetic peptide
  Seed: SFLNGTNAL (TYRP2_HUMAN)
SFLNGTNAF

SEQ ID NO: 190543 - protein, 10 aa, Artificial Sequence
  Description of Artificial Sequence: Synthetic peptide
  Seed: FFVWLHYYSV (TYRP2_HUMAN)
FIVWLHYYSI

SEQ ID NO: 190544 - protein, 9 aa, Artificial Sequence
  Description of Artificial Sequence: Synthetic peptide
  Seed: FANCSVYDF (TYRP2_HUMAN)
FPNCSVYDL

SEQ ID NO: 190545 - protein, 9 aa, Artificial Sequence
  Description of Artificial Sequence: Synthetic peptide
  Seed: VVMGTLVAL (TYRP2_HUMAN)
VPMGTLVAS

SEQ ID NO: 190546 - protein, 10 aa, Artificial Sequence
  Description of Artificial Sequence: Synthetic peptide
  Seed: GTLDSQVMSL (TYRP2_HUMAN)
GFLDSQVMSV

SEQ ID NO: 190547 - protein, 9 aa, Artificial Sequence
  Description of Artificial Sequence: Synthetic peptide
  Seed: FFQNSTFSF (TYRP2_HUMAN)
FYQNSTFSA

SEQ ID NO: 190548 - protein, 9 aa, Artificial Sequence
  Description of Artificial Sequence: Synthetic peptide
  Seed: VTWHRYHLL (TYRP2_HUMAN)
VFWHRYHLF

SEQ ID NO: 190549 - protein, 10 aa, Artificial Sequence
  Description of Artificial Sequence: Synthetic peptide
  Seed: ALVGLFVLLA (TYRP2_HUMAN)
ATVGLFVLLV

SEQ ID NO: 190550 - protein, 9 aa, Artificial Sequence
  Description of Artificial Sequence: Synthetic peptide
  Seed: SPLWWGFLL (TYRP2_HUMAN)
SPLWWGFLV

SEQ ID NO: 190551 - protein, 9 aa, Artificial Sequence
  Description of Artificial Sequence: Synthetic peptide
  Seed: VLHSFTDAI (TYRP2_HUMAN)
VIHSFTDAF

SEQ ID NO: 190552 - protein, 10 aa, Artificial Sequence
  Description of Artificial Sequence: Synthetic peptide
  Seed: FLLSCLGCKI (TYRP2_HUMAN)
FVLSCLGCKV

SEQ ID NO: 190553 - protein, 9 aa, Artificial Sequence
  Description of Artificial Sequence: Synthetic peptide
  Seed: AFLQYRRLR (TYRP2_HUMAN)
ATLQYRRLR

SEQ ID NO: 190554 - protein, 9 aa, Artificial Sequence
  Description of Artificial Sequence: Synthetic peptide
  Seed: LVVMGTLVA (TYRP2_HUMAN)
LPVMGTLVA

SEQ ID NO: 190555 - protein, 9 aa, Artificial Sequence
  Description of Artificial Sequence: Synthetic peptide
  Seed: SLDDYNHLV (TYRP2_HUMAN)
SSDDYNHLH

SEQ ID NO: 190556 - protein, 9 aa, Artificial Sequence
  Description of Artificial Sequence: Synthetic peptide
  Seed: SVYDFFVWL (TYRP2_HUMAN)
SRYDFFVWI

SEQ ID NO: 190557 - protein, 9 aa, Artificial Sequence
  Description of Artificial Sequence: Synthetic peptide
  Seed: SLDDYNHLV (TYRP2_HUMAN)
SADDYNHLL

SEQ ID NO: 190558 - protein, 10 aa, Artificial Sequence
  Description of Artificial Sequence: Synthetic peptide
  Seed: MGRNSMKLPT (TYRP2_HUMAN)
MIRNSMKLPA

SEQ ID NO: 190559 - protein, 9 aa, Artificial Sequence
  Description of Artificial Sequence: Synthetic peptide
  Seed: RMYNMVPFF (TYRP2_HUMAN)
RYYNMVPFA

SEQ ID NO: 190560 - protein, 9 aa, Artificial Sequence
  Description of Artificial Sequence: Synthetic peptide
  Seed: HSAANDPIF (TYRP2_HUMAN)
HQAANDPIF

SEQ ID NO: 190561 - protein, 11 aa, Artificial Sequence
  Description of Artificial Sequence: Synthetic peptide
  Seed: RRLRKGYTPLM (TYRP2_HUMAN)
RQLRKGYTPLL

SEQ ID NO: 190562 - protein, 8 aa, Artificial Sequence
  Description of Artificial Sequence: Synthetic peptide
  Seed: RPDDPTLI (TYRP2_HUMAN)
RTDDPTLI

SEQ ID NO: 190563 - protein, 9 aa, Artificial Sequence
  Description of Artificial Sequence: Synthetic peptide
  Seed: LLSCLGCKI (TYRP2_HUMAN)
LLSCLGCKL

SEQ ID NO: 190564 - protein, 10 aa, Artificial Sequence
  Description of Artificial Sequence: Synthetic peptide
  Seed: HSFLNGTNAL (TYRP2_HUMAN)
HHFLNGTNAY

SEQ ID NO: 190565 - protein, 9 aa, Artificial Sequence
  Description of Artificial Sequence: Synthetic peptide
  Seed: VVMGTLVAL (TYRP2_HUMAN)
VAMGTLVAA

SEQ ID NO: 190566 - protein, 8 aa, Artificial Sequence
  Description of Artificial Sequence: Synthetic peptide
  Seed: KFDNPPFF (TYRP2_HUMAN)
KGDNPPFL

SEQ ID NO: 190567 - protein, 9 aa, Artificial Sequence
  Description of Artificial Sequence: Synthetic peptide
  Seed: NMVPFFPPV (TYRP2_HUMAN)
NSVPFFPPF

SEQ ID NO: 190568 - protein, 9 aa, Artificial Sequence
  Description of Artificial Sequence: Synthetic peptide
  Seed: MTVDSLVNK (TYRP2_HUMAN)
MAVDSLVNM

SEQ ID NO: 190569 - protein, 9 aa, Artificial Sequence
  Description of Artificial Sequence: Synthetic peptide
  Seed: YDFFVWLHY (TYRP2_HUMAN)
YVFFVWLHY

SEQ ID NO: 190570 - protein, 9 aa, Artificial Sequence
  Description of Artificial Sequence: Synthetic peptide
  Seed: STFSFRNAL (TYRP2_HUMAN)
SQFSFRNAR

SEQ ID NO: 190571 - protein, 9 aa, Artificial Sequence
  Description of Artificial Sequence: Synthetic peptide
  Seed: ALVGLFVLL (TYRP2_HUMAN)
AQVGLFVLV

SEQ ID NO: 190572 - protein, 11 aa, Artificial Sequence
  Description of Artificial Sequence: Synthetic peptide
  Seed: YNMVPFFPPVT (TYRP2_HUMAN)
YIMVPFFPPVH

SEQ ID NO: 190573 - protein, 11 aa, Artificial Sequence
  Description of Artificial Sequence: Synthetic peptide
  Seed: YTPLMETHLSS (TYRP2_HUMAN)
YWPLMETHLSM

SEQ ID NO: 190574 - protein, 9 aa, Artificial Sequence
  Description of Artificial Sequence: Synthetic peptide
  Seed: RKFFHRTCK (TYRP2_HUMAN)
RYFFHRTCK

SEQ ID NO: 190575 - protein, 10 aa, Artificial Sequence
  Description of Artificial Sequence: Synthetic peptide
  Seed: HYYSVRDTLL (TYRP2_HUMAN)
HYYSVRDTLW

SEQ ID NO: 190576 - protein, 10 aa, Artificial Sequence
  Description of Artificial Sequence: Synthetic peptide
  Seed: LGPGRPYRAI (TYRP2_HUMAN)
LVPGRPYRAL

SEQ ID NO: 190577 - protein, 10 aa, Artificial Sequence
  Description of Artificial Sequence: Synthetic peptide
  Seed: NSTFSFRNAL (TYRP2_HUMAN)
NWTFSFRNAV

SEQ ID NO: 190578 - protein, 10 aa, Artificial Sequence
  Description of Artificial Sequence: Synthetic peptide
  Seed: SRFSSWETVC (TYRP2_HUMAN)
SRFSSWETVM

SEQ ID NO: 190579 - protein, 10 aa, Artificial Sequence
  Description of Artificial Sequence: Synthetic peptide
  Seed: CCPRLGAESA (TYRP2_HUMAN)
CKPRLGAESM

SEQ ID NO: 190580 - protein, 11 aa, Artificial Sequence
  Description of Artificial Sequence: Synthetic peptide
  Seed: SLDDYNHLVTL (TYRP2_HUMAN)
SIDDYNHLVTY

SEQ ID NO: 190581 - protein, 9 aa, Artificial Sequence
  Description of Artificial Sequence: Synthetic peptide
  Seed: TLLGPGRPY (TYRP2_HUMAN)
TKLGPGRPM

SEQ ID NO: 190582 - protein, 9 aa, Artificial Sequence
  Description of Artificial Sequence: Synthetic peptide
  Seed: VVMGTLVAL (TYRP2_HUMAN)
VQMGTLVAI

SEQ ID NO: 190583 - protein, 11 aa, Artificial Sequence
  Description of Artificial Sequence: Synthetic peptide
  Seed: HPDYVITTQHW (TYRP2_HUMAN)
HYDYVITTQHF

SEQ ID NO: 190584 - protein, 9 aa, Artificial Sequence
  Description of Artificial Sequence: Synthetic peptide
  Seed: RNQDDRELW (TYRP2_HUMAN)
RLQDDRELW

SEQ ID NO: 190585 - protein, 9 aa, Artificial Sequence
  Description of Artificial Sequence: Synthetic peptide
  Seed: VIRQNIHSL (TYRP2_HUMAN)
VLRQNIHSM

SEQ ID NO: 190586 - protein, 10 aa, Artificial Sequence
  Description of Artificial Sequence: Synthetic peptide
  Seed: FVWLHYYSVR (TYRP2_HUMAN)
FLWLHYYSVM

SEQ ID NO: 190587 - protein, 10 aa, Artificial Sequence
  Description of Artificial Sequence: Synthetic peptide
  Seed: RELWPRKFFH (TYRP2_HUMAN)
RILWPRKFFY

SEQ ID NO: 190588 - protein, 9 aa, Artificial Sequence
  Description of Artificial Sequence: Synthetic peptide
  Seed: DFFVWLHYY (TYRP2_HUMAN)
DLFVWLHYR

SEQ ID NO: 190589 - protein, 10 aa, Artificial Sequence
  Description of Artificial Sequence: Synthetic peptide
  Seed: FSFRNALEGF (TYRP2_HUMAN)
FVFRNALEGF

SEQ ID NO: 190590 - protein, 10 aa, Artificial Sequence
  Description of Artificial Sequence: Synthetic peptide
  Seed: SVYDFFVWLH (TYRP2_HUMAN)
SKYDFFVWLR

SEQ ID NO: 190591 - protein, 10 aa, Artificial Sequence
  Description of Artificial Sequence: Synthetic peptide
  Seed: RRLRKGYTPL (TYRP2_HUMAN)
RRLRKGYTPF

SEQ ID NO: 190592 - protein, 9 aa, Artificial Sequence
  Description of Artificial Sequence: Synthetic peptide
  Seed: LLAFLQYRR (TYRP2_HUMAN)
LAAFLQYRK

SEQ ID NO: 190593 - protein, 9 aa, Artificial Sequence
  Description of Artificial Sequence: Synthetic peptide
  Seed: AWPQELAPI (TYRP2_HUMAN)
AYPQELAPL

SEQ ID NO: 190594 - protein, 9 aa, Artificial Sequence
  Description of Artificial Sequence: Synthetic peptide
  Seed: VTNEELFLT (TYRP2_HUMAN)
VQNEELFLV

SEQ ID NO: 190595 - protein, 9 aa, Artificial Sequence
  Description of Artificial Sequence: Synthetic peptide
  Seed: SQVMSLHNL (TYRP2_HUMAN)
SMVMSLHNY

SEQ ID NO: 190596 - protein, 9 aa, Artificial Sequence
  Description of Artificial Sequence: Synthetic peptide
  Seed: ANDPIFVVL (TYRP2_HUMAN)
AFDPIFVVY

SEQ ID NO: 190597 - protein, 10 aa, Artificial Sequence
  Description of Artificial Sequence: Synthetic peptide
  Seed: RLRKGYTPLM (TYRP2_HUMAN)
RVRKGYTPLP

SEQ ID NO: 190598 - protein, 9 aa, Artificial Sequence
  Description of Artificial Sequence: Synthetic peptide
  Seed: AANDPIFVV (TYRP2_HUMAN)
ARNDPIFVF

SEQ ID NO: 190599 - protein, 10 aa, Artificial Sequence
  Description of Artificial Sequence: Synthetic peptide
  Seed: SVYDFFVWLH (TYRP2_HUMAN)
SAYDFFVWLY

SEQ ID NO: 190600 - protein, 11 aa, Artificial Sequence
  Description of Artificial Sequence: Synthetic peptide
  Seed: VVMGTLVALVG (TYRP2_HUMAN)
VQMGTLVALVI

SEQ ID NO: 190601 - protein, 9 aa, Artificial Sequence
  Description of Artificial Sequence: Synthetic peptide
  Seed: FPPVTNEEL (TYRP2_HUMAN)
FPPVTNEEY

SEQ ID NO: 190602 - protein, 9 aa, Artificial Sequence
  Description of Artificial Sequence: Synthetic peptide
  Seed: NEELFLTSD (TYRP2_HUMAN)
NEELFLTSI

SEQ ID NO: 190603 - protein, 10 aa, Artificial Sequence
  Description of Artificial Sequence: Synthetic peptide
  Seed: SLDDYNHLVT (TYRP2_HUMAN)
SSDDYNHLVL

SEQ ID NO: 190604 - protein, 11 aa, Artificial Sequence
  Description of Artificial Sequence: Synthetic peptide
  Seed: EETPGWPTTLL (TYRP2_HUMAN)
EETPGWPTTLW

SEQ ID NO: 190605 - protein, 9 aa, Artificial Sequence
  Description of Artificial Sequence: Synthetic peptide
  Seed: YAIDLPVSV (TYRP2_HUMAN)
YDIDLPVSF

SEQ ID NO: 190606 - protein, 9 aa, Artificial Sequence
  Description of Artificial Sequence: Synthetic peptide
  Seed: FFQNSTFSF (TYRP2_HUMAN)
FEQNSTFSF

SEQ ID NO: 190607 - protein, 9 aa, Artificial Sequence
  Description of Artificial Sequence: Synthetic peptide
  Seed: VVMGTLVAL (TYRP2_HUMAN)
VMMGTLVAF

SEQ ID NO: 190608 - protein, 9 aa, Artificial Sequence
  Description of Artificial Sequence: Synthetic peptide
  Seed: FANCSVYDF (TYRP2_HUMAN)
FSNCSVYDM

SEQ ID NO: 190609 - protein, 9 aa, Artificial Sequence
  Description of Artificial Sequence: Synthetic peptide
  Seed: RVCMTVDSL (TYRP2_HUMAN)
RQCMTVDSV

SEQ ID NO: 190610 - protein, 10 aa, Artificial Sequence
  Description of Artificial Sequence: Synthetic peptide
  Seed: GTLDSQVMSL (TYRP2_HUMAN)
GALDSQVMSL

SEQ ID NO: 190611 - protein, 11 aa, Artificial Sequence
  Description of Artificial Sequence: Synthetic peptide
  Seed: YNMVPFFPPVT (TYRP2_HUMAN)
YLMVPFFPPVQ

SEQ ID NO: 190612 - protein, 9 aa, Artificial Sequence
  Description of Artificial Sequence: Synthetic peptide
  Seed: DDYNHLVTL (TYRP2_HUMAN)
DHYNHLVTI

SEQ ID NO: 190613 - protein, 9 aa, Artificial Sequence
  Description of Artificial Sequence: Synthetic peptide
  Seed: HSAANDPIF (TYRP2_HUMAN)
HPAANDPIM

SEQ ID NO: 190614 - protein, 11 aa, Artificial Sequence
  Description of Artificial Sequence: Synthetic peptide
  Seed: HSLSPQEREQF (TYRP2_HUMAN)
HQLSPQEREQW

SEQ ID NO: 190615 - protein, 9 aa, Artificial Sequence
  Description of Artificial Sequence: Synthetic peptide
  Seed: ETPGWPTTL (TYRP2_HUMAN)
EMPGWPTTY

SEQ ID NO: 190616 - protein, 10 aa, Artificial Sequence
  Description of Artificial Sequence: Synthetic peptide
  Seed: AFLQYRRLRK (TYRP2_HUMAN)
AYLQYRRLRR

SEQ ID NO: 190617 - protein, 9 aa, Artificial Sequence
  Description of Artificial Sequence: Synthetic peptide
  Seed: ISRNSRFSS (TYRP2_HUMAN)
ITRNSRFST

SEQ ID NO: 190618 - protein, 10 aa, Artificial Sequence
  Description of Artificial Sequence: Synthetic peptide
  Seed: SLHNLVHSFL (TYRP2_HUMAN)
SMHNLVHSFV

SEQ ID NO: 190619 - protein, 10 aa, Artificial Sequence
  Description of Artificial Sequence: Synthetic peptide
  Seed: RNQMGRNSMK (TYRP2_HUMAN)
RQQMGRNSMR

SEQ ID NO: 190620 - protein, 10 aa, Artificial Sequence
  Description of Artificial Sequence: Synthetic peptide
  Seed: CCPRLGAESA (TYRP2_HUMAN)
CYPRLGAESM

SEQ ID NO: 190621 - protein, 9 aa, Artificial Sequence
  Description of Artificial Sequence: Synthetic peptide
  Seed: FTDAIFDEW (TYRP2_HUMAN)
FLDAIFDEV

SEQ ID NO: 190622 - protein, 10 aa, Artificial Sequence
  Description of Artificial Sequence: Synthetic peptide
  Seed: NSTFSFRNAL (TYRP2_HUMAN)
NMTFSFRNAV

SEQ ID NO: 190623 - protein, 11 aa, Artificial Sequence
  Description of Artificial Sequence: Synthetic peptide
  Seed: SVYDFFVWLHY (TYRP2_HUMAN)
SVYDFFVWLHR

SEQ ID NO: 190624 - protein, 11 aa, Artificial Sequence
  Description of Artificial Sequence: Synthetic peptide
  Seed: MYNMVPFFPPV (TYRP2_HUMAN)
MQNMVPFFPPI

SEQ ID NO: 190625 - protein, 9 aa, Artificial Sequence
  Description of Artificial Sequence: Synthetic peptide
  Seed: SFALPYWNF (TYRP2_HUMAN)
SYALPYWNM

SEQ ID NO: 190626 - protein, 10 aa, Artificial Sequence
  Description of Artificial Sequence: Synthetic peptide
  Seed: IDFSHQGPAF (TYRP2_HUMAN)
IIFSHQGPAY

SEQ ID NO: 190627 - protein, 10 aa, Artificial Sequence
  Description of Artificial Sequence: Synthetic peptide
  Seed: RMYNMVPFFP (TYRP2_HUMAN)
RAYNMVPFFY

SEQ ID NO: 190628 - protein, 9 aa, Artificial Sequence
  Description of Artificial Sequence: Synthetic peptide
  Seed: VVMGTLVAL (TYRP2_HUMAN)
VKMGTLVAI

SEQ ID NO: 190629 - protein, 9 aa, Artificial Sequence
  Description of Artificial Sequence: Synthetic peptide
  Seed: DDYNHLVTL (TYRP2_HUMAN)
DRYNHLVTA

SEQ ID NO: 190630 - protein, 9 aa, Artificial Sequence
  Description of Artificial Sequence: Synthetic peptide
  Seed: FFQNSTFSF (TYRP2_HUMAN)
FPQNSTFST

SEQ ID NO: 190631 - protein, 9 aa, Artificial Sequence
  Description of Artificial Sequence: Synthetic peptide
  Seed: SFLNGTNAL (TYRP2_HUMAN)
SMLNGTNAY

SEQ ID NO: 190632 - protein, 10 aa, Artificial Sequence
  Description of Artificial Sequence: Synthetic peptide
  Seed: VLLAFLQYRR (TYRP2_HUMAN)
VSLAFLQYRK

SEQ ID NO: 190633 - protein, 10 aa, Artificial Sequence
  Description of Artificial Sequence: Synthetic peptide
  Seed: IDFSHQGPAF (TYRP2_HUMAN)
IYFSHQGPAF

SEQ ID NO: 190634 - protein, 9 aa, Artificial Sequence
  Description of Artificial Sequence: Synthetic peptide
  Seed: RLRKGYTPL (TYRP2_HUMAN)
RNRKGYTPK

SEQ ID NO: 190635 - protein, 9 aa, Artificial Sequence
  Description of Artificial Sequence: Synthetic peptide
  Seed: GFDKADGTL (TYRP2_HUMAN)
GADKADGTI

SEQ ID NO: 190636 - protein, 10 aa, Artificial Sequence
  Description of Artificial Sequence: Synthetic peptide
  Seed: RNSRFSSWET (TYRP2_HUMAN)
RRSRFSSWEM

SEQ ID NO: 190637 - protein, 9 aa, Artificial Sequence
  Description of Artificial Sequence: Synthetic peptide
  Seed: ILPGAQGQF (TYRP2_HUMAN)
IGPGAQGQL

SEQ ID NO: 190638 - protein, 9 aa, Artificial Sequence
  Description of Artificial Sequence: Synthetic peptide
  Seed: SFRNALEGF (TYRP2_HUMAN)
SARNALEGL

SEQ ID NO: 190639 - protein, 9 aa, Artificial Sequence
  Description of Artificial Sequence: Synthetic peptide
  Seed: ANDPIFVVL (TYRP2_HUMAN)
ATDPIFVVF

SEQ ID NO: 190640 - protein, 9 aa, Artificial Sequence
  Description of Artificial Sequence: Synthetic peptide
  Seed: RQNIHSLSP (TYRP2_HUMAN)
RINIHSLSY

SEQ ID NO: 190641 - protein, 9 aa, Artificial Sequence
  Description of Artificial Sequence: Synthetic peptide
  Seed: YVITTQHWL (TYRP2_HUMAN)
YMITTQHWM

SEQ ID NO: 190642 - protein, 10 aa, Artificial Sequence
  Description of Artificial Sequence: Synthetic peptide
  Seed: CMTVDSLVNK (TYRP2_HUMAN)
CSTVDSLVNK

SEQ ID NO: 190643 - protein, 9 aa, Artificial Sequence
  Description of Artificial Sequence: Synthetic peptide
  Seed: AIFDEWMKR (TYRP2_HUMAN)
ATFDEWMKY

SEQ ID NO: 190644 - protein, 9 aa, Artificial Sequence
  Description of Artificial Sequence: Synthetic peptide
  Seed: RQNIHSLSP (TYRP2_HUMAN)
RENIHSLSL

SEQ ID NO: 190645 - protein, 10 aa, Artificial Sequence
  Description of Artificial Sequence: Synthetic peptide
  Seed: SDQLGYSYAI (TYRP2_HUMAN)
SHQLGYSYAI

SEQ ID NO: 190646 - protein, 10 aa, Artificial Sequence
  Description of Artificial Sequence: Synthetic peptide
  Seed: YNMVPFFPPV (TYRP2_HUMAN)
YFMVPFFPPA

SEQ ID NO: 190647 - protein, 8 aa, Artificial Sequence
  Description of Artificial Sequence: Synthetic peptide
  Seed: LAPIGHNR (TYRP2_HUMAN)
LAPIGHNL

SEQ ID NO: 190648 - protein, 9 aa, Artificial Sequence
  Description of Artificial Sequence: Synthetic peptide
  Seed: RLRKGYTPL (TYRP2_HUMAN)
RLRKGYTPW

SEQ ID NO: 190649 - protein, 9 aa, Artificial Sequence
  Description of Artificial Sequence: Synthetic peptide
  Seed: GAQGQFPRV (TYRP2_HUMAN)
GMQGQFPRV

SEQ ID NO: 190650 - protein, 9 aa, Artificial Sequence
  Description of Artificial Sequence: Synthetic peptide
  Seed: ANDPIFVVL (TYRP2_HUMAN)
ALDPIFVVA

SEQ ID NO: 190651 - protein, 9 aa, Artificial Sequence
  Description of Artificial Sequence: Synthetic peptide
  Seed: SLDDYNHLV (TYRP2_HUMAN)
SMDDYNHLC

SEQ ID NO: 190652 - protein, 11 aa, Artificial Sequence
  Description of Artificial Sequence: Synthetic peptide
  Seed: WLHYYSVRDTL (TYRP2_HUMAN)
WCHYYSVRDTF

SEQ ID NO: 190653 - protein, 9 aa, Artificial Sequence
  Description of Artificial Sequence: Synthetic peptide
  Seed: NMVPFFPPV (TYRP2_HUMAN)
NTVPFFPPL

SEQ ID NO: 190654 - protein, 10 aa, Artificial Sequence
  Description of Artificial Sequence: Synthetic peptide
  Seed: ADTRPWSGPY (TYRP2_HUMAN)
ASTRPWSGPY

SEQ ID NO: 190655 - protein, 9 aa, Artificial Sequence
  Description of Artificial Sequence: Synthetic peptide
  Seed: RLRKGYTPL (TYRP2_HUMAN)
RPRKGYTPW

SEQ ID NO: 190656 - protein, 8 aa, Artificial Sequence
  Description of Artificial Sequence: Synthetic peptide
  Seed: ANDPIFVV (TYRP2_HUMAN)
ASDPIFVI

SEQ ID NO: 190657 - protein, 9 aa, Artificial Sequence
  Description of Artificial Sequence: Synthetic peptide
  Seed: FPPVTNEEL (TYRP2_HUMAN)
FMPVTNEEY

SEQ ID NO: 190658 - protein, 9 aa, Artificial Sequence
  Description of Artificial Sequence: Synthetic peptide
  Seed: RTCKCTGNF (TYRP2_HUMAN)
RFCKCTGNY

SEQ ID NO: 190659 - protein, 9 aa, Artificial Sequence
  Description of Artificial Sequence: Synthetic peptide
  Seed: DDYNHLVTL (TYRP2_HUMAN)
DEYNHLVTH

SEQ ID NO: 190660 - protein, 10 aa, Artificial Sequence
  Description of Artificial Sequence: Synthetic peptide
  Seed: CCPRLGAESA (TYRP2_HUMAN)
CPPRLGAESM

SEQ ID NO: 190661 - protein, 9 aa, Artificial Sequence
  Description of Artificial Sequence: Synthetic peptide
  Seed: ETPGWPTTL (TYRP2_HUMAN)
EYPGWPTTM

SEQ ID NO: 190662 - protein, 8 aa, Artificial Sequence
  Description of Artificial Sequence: Synthetic peptide
  Seed: IFVVLHSF (TYRP2_HUMAN)
IYVVLHSL

SEQ ID NO: 190663 - protein, 9 aa, Artificial Sequence
  Description of Artificial Sequence: Synthetic peptide
  Seed: SLDDYNHLV (TYRP2_HUMAN)
SIDDYNHLC

SEQ ID NO: 190664 - protein, 11 aa, Artificial Sequence
  Description of Artificial Sequence: Synthetic peptide
  Seed: FLTSDQLGYSY (TYRP2_HUMAN)
FNTSDQLGYSY

SEQ ID NO: 190665 - protein, 11 aa, Artificial Sequence
  Description of Artificial Sequence: Synthetic peptide
  Seed: MYNMVPFFPPV (TYRP2_HUMAN)
MLNMVPFFPPV

SEQ ID NO: 190666 - protein, 11 aa, Artificial Sequence
  Description of Artificial Sequence: Synthetic peptide
  Seed: VCMTVDSLVNK (TYRP2_HUMAN)
VMMTVDSLVNK

SEQ ID NO: 190667 - protein, 9 aa, Artificial Sequence
  Description of Artificial Sequence: Synthetic peptide
  Seed: STFSFRNAL (TYRP2_HUMAN)
SWFSFRNAV

SEQ ID NO: 190668 - protein, 9 aa, Artificial Sequence
  Description of Artificial Sequence: Synthetic peptide
  Seed: GPAFVTWHR (TYRP2_HUMAN)
GFAFVTWHR

SEQ ID NO: 190669 - protein, 10 aa, Artificial Sequence
  Description of Artificial Sequence: Synthetic peptide
  Seed: KILPGAQGQF (TYRP2_HUMAN)
KYLPGAQGQF

SEQ ID NO: 190670 - protein, 10 aa, Artificial Sequence
  Description of Artificial Sequence: Synthetic peptide
  Seed: MTVDSLVNKE (TYRP2_HUMAN)
MNVDSLVNKR

SEQ ID NO: 190671 - protein, 9 aa, Artificial Sequence
  Description of Artificial Sequence: Synthetic peptide
  Seed: VTWHRYHLL (TYRP2_HUMAN)
VQWHRYHLI

SEQ ID NO: 190672 - protein, 9 aa, Artificial Sequence
  Description of Artificial Sequence: Synthetic peptide
  Seed: WMKRFNPPA (TYRP2_HUMAN)
WEKRFNPPY

SEQ ID NO: 190673 - protein, 11 aa, Artificial Sequence
  Description of Artificial Sequence: Synthetic peptide
  Seed: YNMVPFFPPVT (TYRP2_HUMAN)
YTMVPFFPPVG

SEQ ID NO: 190674 - protein, 10 aa, Artificial Sequence
  Description of Artificial Sequence: Synthetic peptide
  Seed: FTDAIFDEWM (TYRP2_HUMAN)
FSDAIFDEWY

SEQ ID NO: 190675 - protein, 9 aa, Artificial Sequence
  Description of Artificial Sequence: Synthetic peptide
  Seed: FVLLAFLQY (TYRP2_HUMAN)
FTLLAFLQM

SEQ ID NO: 190676 - protein, 10 aa, Artificial Sequence
  Description of Artificial Sequence: Synthetic peptide
  Seed: DAIFDEWMKR (TYRP2_HUMAN)
DCIFDEWMKR

SEQ ID NO: 190677 - protein, 10 aa, Artificial Sequence
  Description of Artificial Sequence: Synthetic peptide
  Seed: VLHSFTDAIF (TYRP2_HUMAN)
VAHSFTDAIY

SEQ ID NO: 190678 - protein, 11 aa, Artificial Sequence
  Description of Artificial Sequence: Synthetic peptide
  Seed: VCDSLDDYNHL (TYRP2_HUMAN)
VVDSLDDYNHI

SEQ ID NO: 190679 - protein, 10 aa, Artificial Sequence
  Description of Artificial Sequence: Synthetic peptide
  Seed: AIDFSHQGPA (TYRP2_HUMAN)
AIDFSHQGPV

SEQ ID NO: 190680 - protein, 8 aa, Artificial Sequence
  Description of Artificial Sequence: Synthetic peptide
  Seed: LDDYNHLV (TYRP2_HUMAN)
LIDYNHLL

SEQ ID NO: 190681 - protein, 9 aa, Artificial Sequence
  Description of Artificial Sequence: Synthetic peptide
  Seed: NSMKLPTLK (TYRP2_HUMAN)
NWMKLPTLR

SEQ ID NO: 190682 - protein, 9 aa, Artificial Sequence
  Description of Artificial Sequence: Synthetic peptide
  Seed: ETPGWPTTL (TYRP2_HUMAN)
EAPGWPTTF

SEQ ID NO: 190683 - protein, 9 aa, Artificial Sequence
  Description of Artificial Sequence: Synthetic peptide
  Seed: RTCKCTGNF (TYRP2_HUMAN)
RICKCTGNW

SEQ ID NO: 190684 - protein, 9 aa, Artificial Sequence
  Description of Artificial Sequence: Synthetic peptide
  Seed: FANCSVYDF (TYRP2_HUMAN)
FANCSVYDI

SEQ ID NO: 190685 - protein, 11 aa, Artificial Sequence
  Description of Artificial Sequence: Synthetic peptide
  Seed: YVITTQHWLGL (TYRP2_HUMAN)
YQITTQHWLGV

SEQ ID NO: 190686 - protein, 9 aa, Artificial Sequence
  Description of Artificial Sequence: Synthetic peptide
  Seed: LQKFDNPPF (TYRP2_HUMAN)
LVKFDNPPF

SEQ ID NO: 190687 - protein, 11 aa, Artificial Sequence
  Description of Artificial Sequence: Synthetic peptide
  Seed: RNSRFSSWETV (TYRP2_HUMAN)
RMSRFSSWETI

SEQ ID NO: 190688 - protein, 9 aa, Artificial Sequence
  Description of Artificial Sequence: Synthetic peptide
  Seed: VHPDYVITT (TYRP2_HUMAN)
VQPDYVITM

SEQ ID NO: 190689 - protein, 9 aa, Artificial Sequence
  Description of Artificial Sequence: Synthetic peptide
  Seed: LLVVMGTLV (TYRP2_HUMAN)
LMVVMGTLI

SEQ ID NO: 190690 - protein, 10 aa, Artificial Sequence
  Description of Artificial Sequence: Synthetic peptide
  Seed: RLIGNESFAL (TYRP2_HUMAN)
RMIGNESFAW

SEQ ID NO: 190691 - protein, 9 aa, Artificial Sequence
  Description of Artificial Sequence: Synthetic peptide
  Seed: RAIDFSHQG (TYRP2_HUMAN)
RAIDFSHQF

SEQ ID NO: 190692 - protein, 9 aa, Artificial Sequence
  Description of Artificial Sequence: Synthetic peptide
  Seed: WHRYHLLCL (TYRP2_HUMAN)
WGRYHLLCL

SEQ ID NO: 190693 - protein, 9 aa, Artificial Sequence
  Description of Artificial Sequence: Synthetic peptide
  Seed: ISRNSRFSS (TYRP2_HUMAN)
IYRNSRFSK

SEQ ID NO: 190694 - protein, 9 aa, Artificial Sequence
  Description of Artificial Sequence: Synthetic peptide
  Seed: ANDPIFVVL (TYRP2_HUMAN)
ASDPIFVVV

SEQ ID NO: 190695 - protein, 9 aa, Artificial Sequence
  Description of Artificial Sequence: Synthetic peptide
  Seed: FQNSTFSFR (TYRP2_HUMAN)
FSNSTFSFR

SEQ ID NO: 190696 - protein, 11 aa, Artificial Sequence
  Description of Artificial Sequence: Synthetic peptide
  Seed: RADTRPWSGPY (TYRP2_HUMAN)
RNDTRPWSGPA

SEQ ID NO: 190697 - protein, 10 aa, Artificial Sequence
  Description of Artificial Sequence: Synthetic peptide
  Seed: YAIDLPVSVE (TYRP2_HUMAN)
YLIDLPVSVM

SEQ ID NO: 190698 - protein, 10 aa, Artificial Sequence
  Description of Artificial Sequence: Synthetic peptide
  Seed: SPLWWGFLLS (TYRP2_HUMAN)
SMLWWGFLLM

SEQ ID NO: 190699 - protein, 9 aa, Artificial Sequence
  Description of Artificial Sequence: Synthetic peptide
  Seed: SRFSSWETV (TYRP2_HUMAN)
SRFSSWETL

SEQ ID NO: 190700 - protein, 10 aa, Artificial Sequence
  Description of Artificial Sequence: Synthetic peptide
  Seed: KILPGAQGQF (TYRP2_HUMAN)
KMLPGAQGQW

SEQ ID NO: 190701 - protein, 9 aa, Artificial Sequence
  Description of Artificial Sequence: Synthetic peptide
  Seed: YSVRDTLLG (TYRP2_HUMAN)
YSVRDTLLI

SEQ ID NO: 190702 - protein, 9 aa, Artificial Sequence
  Description of Artificial Sequence: Synthetic peptide
  Seed: SFRNALEGF (TYRP2_HUMAN)
SLRNALEGY

SEQ ID NO: 190703 - protein, 10 aa, Artificial Sequence
  Description of Artificial Sequence: Synthetic peptide
  Seed: NSTFSFRNAL (TYRP2_HUMAN)
NYTFSFRNAL

SEQ ID NO: 190704 - protein, 9 aa, Artificial Sequence
  Description of Artificial Sequence: Synthetic peptide
  Seed: AESANVCGS (TYRP2_HUMAN)
AESANVCGL

SEQ ID NO: 190705 - protein, 9 aa, Artificial Sequence
  Description of Artificial Sequence: Synthetic peptide
  Seed: RLRKGYTPL (TYRP2_HUMAN)
RYRKGYTPM

SEQ ID NO: 190706 - protein, 9 aa, Artificial Sequence
  Description of Artificial Sequence: Synthetic peptide
  Seed: VIRQNIHSL (TYRP2_HUMAN)
VTRQNIHSF

SEQ ID NO: 190707 - protein, 9 aa, Artificial Sequence
  Description of Artificial Sequence: Synthetic peptide
  Seed: HYYSVRDTL (TYRP2_HUMAN)
HYYSVRDTW

SEQ ID NO: 190708 - protein, 11 aa, Artificial Sequence
  Description of Artificial Sequence: Synthetic peptide
  Seed: SVYDFFVWLHY (TYRP2_HUMAN)
SIYDFFVWLHK

SEQ ID NO: 190709 - protein, 9 aa, Artificial Sequence
  Description of Artificial Sequence: Synthetic peptide
  Seed: STFSFRNAL (TYRP2_HUMAN)
SLFSFRNAY

SEQ ID NO: 190710 - protein, 9 aa, Artificial Sequence
  Description of Artificial Sequence: Synthetic peptide
  Seed: SVYDFFVWL (TYRP2_HUMAN)
SQYDFFVWV

SEQ ID NO: 190711 - protein, 9 aa, Artificial Sequence
  Description of Artificial Sequence: Synthetic peptide
  Seed: FSHQGPAFV (TYRP2_HUMAN)
FMHQGPAFI

SEQ ID NO: 190712 - protein, 11 aa, Artificial Sequence
  Description of Artificial Sequence: Synthetic peptide
  Seed: ALPYWNFATGR (TYRP2_HUMAN)
AAPYWNFATGR

SEQ ID NO: 190713 - protein, 9 aa, Artificial Sequence
  Description of Artificial Sequence: Synthetic peptide
  Seed: YVITTQHWL (TYRP2_HUMAN)
YMITTQHWT

SEQ ID NO: 190714 - protein, 11 aa, Artificial Sequence
  Description of Artificial Sequence: Synthetic peptide
  Seed: YTPLMETHLSS (TYRP2_HUMAN)
YVPLMETHLST

SEQ ID NO: 190715 - protein, 10 aa, Artificial Sequence
  Description of Artificial Sequence: Synthetic peptide
  Seed: LGPNGTQPQF (TYRP2_HUMAN)
LDPNGTQPQW

SEQ ID NO: 190716 - protein, 8 aa, Artificial Sequence
  Description of Artificial Sequence: Synthetic peptide
  Seed: FLNGTNAL (TYRP2_HUMAN)
FFNGTNAM

SEQ ID NO: 190717 - protein, 11 aa, Artificial Sequence
  Description of Artificial Sequence: Synthetic peptide
  Seed: MSLHNLVHSFL (TYRP2_HUMAN)
MMLHNLVHSFI

SEQ ID NO: 190718 - protein, 11 aa, Artificial Sequence
  Description of Artificial Sequence: Synthetic peptide
  Seed: YTPLMETHLSS (TYRP2_HUMAN)
YEPLMETHLST

SEQ ID NO: 190719 - protein, 10 aa, Artificial Sequence
  Description of Artificial Sequence: Synthetic peptide
  Seed: VVMGTLVALV (TYRP2_HUMAN)
VWMGTLVALV

SEQ ID NO: 190720 - protein, 9 aa, Artificial Sequence
  Description of Artificial Sequence: Synthetic peptide
  Seed: SQVMSLHNL (TYRP2_HUMAN)
SKVMSLHNM

SEQ ID NO: 190721 - protein, 10 aa, Artificial Sequence
  Description of Artificial Sequence: Synthetic peptide
  Seed: TLVALVGLFV (TYRP2_HUMAN)
TLVALVGLFI

SEQ ID NO: 190722 - protein, 10 aa, Artificial Sequence
  Description of Artificial Sequence: Synthetic peptide
  Seed: LVVMGTLVAL (TYRP2_HUMAN)
LLVMGTLVAY

SEQ ID NO: 190723 - protein, 10 aa, Artificial Sequence
  Description of Artificial Sequence: Synthetic peptide
  Seed: NSRFSSWETV (TYRP2_HUMAN)
NNRFSSWETL

SEQ ID NO: 190724 - protein, 9 aa, Artificial Sequence
  Description of Artificial Sequence: Synthetic peptide
  Seed: ETPGWPTTL (TYRP2_HUMAN)
ETPGWPTTI

SEQ ID NO: 190725 - protein, 9 aa, Artificial Sequence
  Description of Artificial Sequence: Synthetic peptide
  Seed: YAIDLPVSV (TYRP2_HUMAN)
YMIDLPVSL

SEQ ID NO: 190726 - protein, 9 aa, Artificial Sequence
  Description of Artificial Sequence: Synthetic peptide
  Seed: ALVGLFVLL (TYRP2_HUMAN)
AQVGLFVLI

SEQ ID NO: 190727 - protein, 10 aa, Artificial Sequence
  Description of Artificial Sequence: Synthetic peptide
  Seed: SDQLGYSYAI (TYRP2_HUMAN)
SQQLGYSYAM

SEQ ID NO: 190728 - protein, 10 aa, Artificial Sequence
  Description of Artificial Sequence: Synthetic peptide
  Seed: SAANDPIFVV (TYRP2_HUMAN)
SVANDPIFVV

SEQ ID NO: 190729 - protein, 10 aa, Artificial Sequence
  Description of Artificial Sequence: Synthetic peptide
  Seed: YNMVPFFPPV (TYRP2_HUMAN)
YTMVPFFPPM

SEQ ID NO: 190730 - protein, 10 aa, Artificial Sequence
  Description of Artificial Sequence: Synthetic peptide
  Seed: LRNQDDRELW (TYRP2_HUMAN)
LANQDDRELW

SEQ ID NO: 190731 - protein, 10 aa, Artificial Sequence
  Description of Artificial Sequence: Synthetic peptide
  Seed: MGRNSMKLPT (TYRP2_HUMAN)
MVRNSMKLPI

SEQ ID NO: 190732 - protein, 10 aa, Artificial Sequence
  Description of Artificial Sequence: Synthetic peptide
  Seed: NGTYEGLLRR (TYRP2_HUMAN)
NKTYEGLLRR

SEQ ID NO: 190733 - protein, 11 aa, Artificial Sequence
  Description of Artificial Sequence: Synthetic peptide
  Seed: SLDDYNHLVTL (TYRP2_HUMAN)
STDDYNHLVTF

SEQ ID NO: 190734 - protein, 10 aa, Artificial Sequence
  Description of Artificial Sequence: Synthetic peptide
  Seed: HSFLNGTNAL (TYRP2_HUMAN)
HTFLNGTNAL

SEQ ID NO: 190735 - protein, 9 aa, Artificial Sequence
  Description of Artificial Sequence: Synthetic peptide
  Seed: GLFVLLAFL (TYRP2_HUMAN)
GVFVLLAFR

SEQ ID NO: 190736 - protein, 9 aa, Artificial Sequence
  Description of Artificial Sequence: Synthetic peptide
  Seed: FTDAIFDEW (TYRP2_HUMAN)
FVDAIFDEY

SEQ ID NO: 190737 - protein, 10 aa, Artificial Sequence
  Description of Artificial Sequence: Synthetic peptide
  Seed: FSFRNALEGF (TYRP2_HUMAN)
FFFRNALEGY

SEQ ID NO: 190738 - protein, 10 aa, Artificial Sequence
  Description of Artificial Sequence: Synthetic peptide
  Seed: AARPDDPTLI (TYRP2_HUMAN)
AARPDDPTLW

SEQ ID NO: 190739 - protein, 9 aa, Artificial Sequence
  Description of Artificial Sequence: Synthetic peptide
  Seed: LVHSFLNGT (TYRP2_HUMAN)
LVHSFLNGV

SEQ ID NO: 190740 - protein, 10 aa, Artificial Sequence
  Description of Artificial Sequence: Synthetic peptide
  Seed: HNRMYNMVPF (TYRP2_HUMAN)
HLRMYNMVPL

SEQ ID NO: 190741 - protein, 9 aa, Artificial Sequence
  Description of Artificial Sequence: Synthetic peptide
  Seed: KRFNPPADA (TYRP2_HUMAN)
KRFNPPADL

SEQ ID NO: 190742 - protein, 10 aa, Artificial Sequence
  Description of Artificial Sequence: Synthetic peptide
  Seed: SDQLGYSYAI (TYRP2_HUMAN)
SHQLGYSYAM

SEQ ID NO: 190743 - protein, 11 aa, Artificial Sequence
  Description of Artificial Sequence: Synthetic peptide
  Seed: QPQFANCSVYD (TYRP2_HUMAN)
QFQFANCSVYF

SEQ ID NO: 190744 - protein, 9 aa, Artificial Sequence
  Description of Artificial Sequence: Synthetic peptide
  Seed: VTWHRYHLL (TYRP2_HUMAN)
VWWHRYHLW

SEQ ID NO: 190745 - protein, 10 aa, Artificial Sequence
  Description of Artificial Sequence: Synthetic peptide
  Seed: ITTQHWLGLL (TYRP2_HUMAN)
IATQHWLGLW

SEQ ID NO: 190746 - protein, 8 aa, Artificial Sequence
  Description of Artificial Sequence: Synthetic peptide
  Seed: ANDPIFVV (TYRP2_HUMAN)
ATDPIFVM

SEQ ID NO: 190747 - protein, 9 aa, Artificial Sequence
  Description of Artificial Sequence: Synthetic peptide
  Seed: STFSFRNAL (TYRP2_HUMAN)
STFSFRNAA

SEQ ID NO: 190748 - protein, 9 aa, Artificial Sequence
  Description of Artificial Sequence: Synthetic peptide
  Seed: FLQYRRLRK (TYRP2_HUMAN)
FMQYRRLRR

SEQ ID NO: 190749 - protein, 11 aa, Artificial Sequence
  Description of Artificial Sequence: Synthetic peptide
  Seed: VEETPGWPTTL (TYRP2_HUMAN)
VEETPGWPTTW

SEQ ID NO: 190750 - protein, 10 aa, Artificial Sequence
  Description of Artificial Sequence: Synthetic peptide
  Seed: RMYNMVPFFP (TYRP2_HUMAN)
RYYNMVPFFK

SEQ ID NO: 190751 - protein, 10 aa, Artificial Sequence
  Description of Artificial Sequence: Synthetic peptide
  Seed: RNSRFSSWET (TYRP2_HUMAN)
RGSRFSSWEM

SEQ ID NO: 190752 - protein, 9 aa, Artificial Sequence
  Description of Artificial Sequence: Synthetic peptide
  Seed: APIGHNRMY (TYRP2_HUMAN)
APIGHNRMW

SEQ ID NO: 190753 - protein, 10 aa, Artificial Sequence
  Description of Artificial Sequence: Synthetic peptide
  Seed: SQVMSLHNLV (TYRP2_HUMAN)
SMVMSLHNLL

SEQ ID NO: 190754 - protein, 9 aa, Artificial Sequence
  Description of Artificial Sequence: Synthetic peptide
  Seed: SQVMSLHNL (TYRP2_HUMAN)
SRVMSLHNY

SEQ ID NO: 190755 - protein, 10 aa, Artificial Sequence
  Description of Artificial Sequence: Synthetic peptide
  Seed: HRYHLLCLER (TYRP2_HUMAN)
HIYHLLCLER

SEQ ID NO: 190756 - protein, 11 aa, Artificial Sequence
  Description of Artificial Sequence: Synthetic peptide
  Seed: YNMVPFFPPVT (TYRP2_HUMAN)
YMMVPFFPPVG

SEQ ID NO: 190757 - protein, 9 aa, Artificial Sequence
  Description of Artificial Sequence: Synthetic peptide
  Seed: ANDPIFVVL (TYRP2_HUMAN)
AIDPIFVVI

SEQ ID NO: 190758 - protein, 10 aa, Artificial Sequence
  Description of Artificial Sequence: Synthetic peptide
  Seed: SLQKFDNPPF (TYRP2_HUMAN)
SQQKFDNPPF

SEQ ID NO: 190759 - protein, 9 aa, Artificial Sequence
  Description of Artificial Sequence: Synthetic peptide
  Seed: RLRKGYTPL (TYRP2_HUMAN)
RNRKGYTPL

SEQ ID NO: 190760 - protein, 9 aa, Artificial Sequence
  Description of Artificial Sequence: Synthetic peptide
  Seed: RMYNMVPFF (TYRP2_HUMAN)
RIYNMVPFA

SEQ ID NO: 190761 - protein, 9 aa, Artificial Sequence
  Description of Artificial Sequence: Synthetic peptide
  Seed: ALVGLFVLL (TYRP2_HUMAN)
AIVGLFVLL

SEQ ID NO: 190762 - protein, 10 aa, Artificial Sequence
  Description of Artificial Sequence: Synthetic peptide
  Seed: LHYYSVRDTL (TYRP2_HUMAN)
LEYYSVRDTL

SEQ ID NO: 190763 - protein, 9 aa, Artificial Sequence
  Description of Artificial Sequence: Synthetic peptide
  Seed: VVMGTLVAL (TYRP2_HUMAN)
VLMGTLVAY

SEQ ID NO: 190764 - protein, 11 aa, Artificial Sequence
  Description of Artificial Sequence: Synthetic peptide
  Seed: RNSRFSSWETV (TYRP2_HUMAN)
RPSRFSSWETL

SEQ ID NO: 190765 - protein, 10 aa, Artificial Sequence
  Description of Artificial Sequence: Synthetic peptide
  Seed: SDQLGYSYAI (TYRP2_HUMAN)
SIQLGYSYAF

SEQ ID NO: 190766 - protein, 9 aa, Artificial Sequence
  Description of Artificial Sequence: Synthetic peptide
  Seed: TLLGPGRPY (TYRP2_HUMAN)
TILGPGRPF

SEQ ID NO: 190767 - protein, 9 aa, Artificial Sequence
  Description of Artificial Sequence: Synthetic peptide
  Seed: LVGLFVLLA (TYRP2_HUMAN)
LMGLFVLLL

SEQ ID NO: 190768 - protein, 10 aa, Artificial Sequence
  Description of Artificial Sequence: Synthetic peptide
  Seed: RNSMKLPTLK (TYRP2_HUMAN)
RWSMKLPTLK

SEQ ID NO: 190769 - protein, 9 aa, Artificial Sequence
  Description of Artificial Sequence: Synthetic peptide
  Seed: TLVALVGLF (TYRP2_HUMAN)
TMVALVGLM

SEQ ID NO: 190770 - protein, 11 aa, Artificial Sequence
  Description of Artificial Sequence: Synthetic peptide
  Seed: MYNMVPFFPPV (TYRP2_HUMAN)
MYNMVPFFPPI

SEQ ID NO: 190771 - protein, 10 aa, Artificial Sequence
  Description of Artificial Sequence: Synthetic peptide
  Seed: MGTLVALVGL (TYRP2_HUMAN)
MRTLVALVGV

SEQ ID NO: 190772 - protein, 9 aa, Artificial Sequence
  Description of Artificial Sequence: Synthetic peptide
  Seed: YYSVRDTLL (TYRP2_HUMAN)
YWSVRDTLY

SEQ ID NO: 190773 - protein, 9 aa, Artificial Sequence
  Description of Artificial Sequence: Synthetic peptide
  Seed: ISRNSRFSS (TYRP2_HUMAN)
ITRNSRFSG

SEQ ID NO: 190774 - protein, 9 aa, Artificial Sequence
  Description of Artificial Sequence: Synthetic peptide
  Seed: VHPDYVITT (TYRP2_HUMAN)
VMPDYVITL

SEQ ID NO: 190775 - protein, 10 aa, Artificial Sequence
  Description of Artificial Sequence: Synthetic peptide
  Seed: MGTLVALVGL (TYRP2_HUMAN)
MYTLVALVGV

SEQ ID NO: 190776 - protein, 9 aa, Artificial Sequence
  Description of Artificial Sequence: Synthetic peptide
  Seed: RVCMTVDSL (TYRP2_HUMAN)
RTCMTVDSW

SEQ ID NO: 190777 - protein, 10 aa, Artificial Sequence
  Description of Artificial Sequence: Synthetic peptide
  Seed: RLRKGYTPLM (TYRP2_HUMAN)
RMRKGYTPLV

SEQ ID NO: 190778 - protein, 10 aa, Artificial Sequence
  Description of Artificial Sequence: Synthetic peptide
  Seed: RNSRFSSWET (TYRP2_HUMAN)
RTSRFSSWES

SEQ ID NO: 190779 - protein, 10 aa, Artificial Sequence
  Description of Artificial Sequence: Synthetic peptide
  Seed: RPWSGPYILR (TYRP2_HUMAN)
RIWSGPYILK

SEQ ID NO: 190780 - protein, 9 aa, Artificial Sequence
  Description of Artificial Sequence: Synthetic peptide
  Seed: YYSVRDTLL (TYRP2_HUMAN)
YFSVRDTLF

SEQ ID NO: 190781 - protein, 9 aa, Artificial Sequence
  Description of Artificial Sequence: Synthetic peptide
  Seed: VALVGLFVL (TYRP2_HUMAN)
VMLVGLFVV

SEQ ID NO: 190782 - protein, 9 aa, Artificial Sequence
  Description of Artificial Sequence: Synthetic peptide
  Seed: VLHSFTDAI (TYRP2_HUMAN)
VQHSFTDAL

SEQ ID NO: 190783 - protein, 9 aa, Artificial Sequence
  Description of Artificial Sequence: Synthetic peptide
  Seed: ALVGLFVLL (TYRP2_HUMAN)
ALVGLFVLW

SEQ ID NO: 190784 - protein, 9 aa, Artificial Sequence
  Description of Artificial Sequence: Synthetic peptide
  Seed: LAPIGHNRM (TYRP2_HUMAN)
LYPIGHNRF

SEQ ID NO: 190785 - protein, 10 aa, Artificial Sequence
  Description of Artificial Sequence: Synthetic peptide
  Seed: CCPRLGAESA (TYRP2_HUMAN)
CPPRLGAESL

SEQ ID NO: 190786 - protein, 10 aa, Artificial Sequence
  Description of Artificial Sequence: Synthetic peptide
  Seed: MSPLWWGFLL (TYRP2_HUMAN)
MNPLWWGFLM

SEQ ID NO: 190787 - protein, 10 aa, Artificial Sequence
  Description of Artificial Sequence: Synthetic peptide
  Seed: MSLHNLVHSF (TYRP2_HUMAN)
MQLHNLVHSM

SEQ ID NO: 190788 - protein, 9 aa, Artificial Sequence
  Description of Artificial Sequence: Synthetic peptide
  Seed: RKFFHRTCK (TYRP2_HUMAN)
RWFFHRTCV

SEQ ID NO: 190789 - protein, 9 aa, Artificial Sequence
  Description of Artificial Sequence: Synthetic peptide
  Seed: DTRPWSGPY (TYRP2_HUMAN)
DVRPWSGPY

SEQ ID NO: 190790 - protein, 10 aa, Artificial Sequence
  Description of Artificial Sequence: Synthetic peptide
  Seed: HRYHLLCLER (TYRP2_HUMAN)
HSYHLLCLEK

SEQ ID NO: 190791 - protein, 9 aa, Artificial Sequence
  Description of Artificial Sequence: Synthetic peptide
  Seed: YAIDLPVSV (TYRP2_HUMAN)
YYIDLPVSF

SEQ ID NO: 190792 - protein, 10 aa, Artificial Sequence
  Description of Artificial Sequence: Synthetic peptide
  Seed: QFLGALDLAK (TYRP2_HUMAN)
QMLGALDLAR

SEQ ID NO: 190793 - protein, 9 aa, Artificial Sequence
  Description of Artificial Sequence: Synthetic peptide
  Seed: RLRKGYTPL (TYRP2_HUMAN)
RWRKGYTPV

SEQ ID NO: 190794 - protein, 10 aa, Artificial Sequence
  Description of Artificial Sequence: Synthetic peptide
  Seed: VVLHSFTDAI (TYRP2_HUMAN)
VYLHSFTDAV

SEQ ID NO: 190795 - protein, 10 aa, Artificial Sequence
  Description of Artificial Sequence: Synthetic peptide
  Seed: QPQFANCSVY (TYRP2_HUMAN)
QGQFANCSVF

SEQ ID NO: 190796 - protein, 10 aa, Artificial Sequence
  Description of Artificial Sequence: Synthetic peptide
  Seed: FVVLHSFTDA (TYRP2_HUMAN)
FLVLHSFTDV

SEQ ID NO: 190797 - protein, 10 aa, Artificial Sequence
  Description of Artificial Sequence: Synthetic peptide
  Seed: QELAPIGHNR (TYRP2_HUMAN)
QSLAPIGHNR

SEQ ID NO: 190798 - protein, 10 aa, Artificial Sequence
  Description of Artificial Sequence: Synthetic peptide
  Seed: VLLAFLQYRR (TYRP2_HUMAN)
VFLAFLQYRR

SEQ ID NO: 190799 - protein, 10 aa, Artificial Sequence
  Description of Artificial Sequence: Synthetic peptide
  Seed: RNQMGRNSMK (TYRP2_HUMAN)
RRQMGRNSML

SEQ ID NO: 190800 - protein, 9 aa, Artificial Sequence
  Description of Artificial Sequence: Synthetic peptide
  Seed: FQNSTFSFR (TYRP2_HUMAN)
FTNSTFSFK

SEQ ID NO: 190801 - protein, 9 aa, Artificial Sequence
  Description of Artificial Sequence: Synthetic peptide
  Seed: TLDSQVMSL (TYRP2_HUMAN)
THDSQVMSV

SEQ ID NO: 190802 - protein, 9 aa, Artificial Sequence
  Description of Artificial Sequence: Synthetic peptide
  Seed: RVCMTVDSL (TYRP2_HUMAN)
RACMTVDSF

SEQ ID NO: 190803 - protein, 11 aa, Artificial Sequence
  Description of Artificial Sequence: Synthetic peptide
  Seed: MYNMVPFFPPV (TYRP2_HUMAN)
MTNMVPFFPPI

SEQ ID NO: 190804 - protein, 10 aa, Artificial Sequence
  Description of Artificial Sequence: Synthetic peptide
  Seed: LGPNGTQPQF (TYRP2_HUMAN)
LIPNGTQPQM

SEQ ID NO: 190805 - protein, 9 aa, Artificial Sequence
  Description of Artificial Sequence: Synthetic peptide
  Seed: AKKRVHPDY (TYRP2_HUMAN)
AMKRVHPDY

SEQ ID NO: 190806 - protein, 9 aa, Artificial Sequence
  Description of Artificial Sequence: Synthetic peptide
  Seed: CPRLGAESA (TYRP2_HUMAN)
CPRLGAESF

SEQ ID NO: 190807 - protein, 10 aa, Artificial Sequence
  Description of Artificial Sequence: Synthetic peptide
  Seed: QPQFANCSVY (TYRP2_HUMAN)
QRQFANCSVL

SEQ ID NO: 190808 - protein, 9 aa, Artificial Sequence
  Description of Artificial Sequence: Synthetic peptide
  Seed: SRFSSWETV (TYRP2_HUMAN)
SLFSSWETL

SEQ ID NO: 190809 - protein, 10 aa, Artificial Sequence
  Description of Artificial Sequence: Synthetic peptide
  Seed: NSTFSFRNAL (TYRP2_HUMAN)
NKTFSFRNAV

SEQ ID NO: 190810 - protein, 10 aa, Artificial Sequence
  Description of Artificial Sequence: Synthetic peptide
  Seed: RLRKGYTPLM (TYRP2_HUMAN)
RGRKGYTPLV

SEQ ID NO: 190811 - protein, 9 aa, Artificial Sequence
  Description of Artificial Sequence: Synthetic peptide
  Seed: RMYNMVPFF (TYRP2_HUMAN)
RAYNMVPFV

SEQ ID NO: 190812 - protein, 9 aa, Artificial Sequence
  Description of Artificial Sequence: Synthetic peptide
  Seed: RVCMTVDSL (TYRP2_HUMAN)
RICMTVDSI

SEQ ID NO: 190813 - protein, 10 aa, Artificial Sequence
  Description of Artificial Sequence: Synthetic peptide
  Seed: NRMYNMVPFF (TYRP2_HUMAN)
NRMYNMVPFL

SEQ ID NO: 190814 - protein, 9 aa, Artificial Sequence
  Description of Artificial Sequence: Synthetic peptide
  Seed: LVALVGLFV (TYRP2_HUMAN)
LLALVGLFL

SEQ ID NO: 190815 - protein, 10 aa, Artificial Sequence
  Description of Artificial Sequence: Synthetic peptide
  Seed: GNESFALPYW (TYRP2_HUMAN)
GLESFALPYW

SEQ ID NO: 190816 - protein, 9 aa, Artificial Sequence
  Description of Artificial Sequence: Synthetic peptide
  Seed: AIFDEWMKR (TYRP2_HUMAN)
AQFDEWMKK

SEQ ID NO: 190817 - protein, 10 aa, Artificial Sequence
  Description of Artificial Sequence: Synthetic peptide
  Seed: PFFQNSTFSF (TYRP2_HUMAN)
PYFQNSTFSM

SEQ ID NO: 190818 - protein, 9 aa, Artificial Sequence
  Description of Artificial Sequence: Synthetic peptide
  Seed: ANDPIFVVL (TYRP2_HUMAN)
ADDPIFVVF

SEQ ID NO: 190819 - protein, 9 aa, Artificial Sequence
  Description of Artificial Sequence: Synthetic peptide
  Seed: FFQNSTFSF (TYRP2_HUMAN)
FAQNSTFSM

SEQ ID NO: 190820 - protein, 9 aa, Artificial Sequence
  Description of Artificial Sequence: Synthetic peptide
  Seed: RKFFHRTCK (TYRP2_HUMAN)
RMFFHRTCV

SEQ ID NO: 190821 - protein, 9 aa, Artificial Sequence
  Description of Artificial Sequence: Synthetic peptide
  Seed: SLDDYNHLV (TYRP2_HUMAN)
SDDDYNHLY

SEQ ID NO: 190822 - protein, 10 aa, Artificial Sequence
  Description of Artificial Sequence: Synthetic peptide
  Seed: VGLFVLLAFL (TYRP2_HUMAN)
VMLFVLLAFL

SEQ ID NO: 190823 - protein, 9 aa, Artificial Sequence
  Description of Artificial Sequence: Synthetic peptide
  Seed: VLHSFTDAI (TYRP2_HUMAN)
VTHSFTDAY

SEQ ID NO: 190824 - protein, 9 aa, Artificial Sequence
  Description of Artificial Sequence: Synthetic peptide
  Seed: TLLGPGRPY (TYRP2_HUMAN)
TALGPGRPI

SEQ ID NO: 190825 - protein, 11 aa, Artificial Sequence
  Description of Artificial Sequence: Synthetic peptide
  Seed: RELWPRKFFHR (TYRP2_HUMAN)
RSLWPRKFFHK

SEQ ID NO: 190826 - protein, 10 aa, Artificial Sequence
  Description of Artificial Sequence: Synthetic peptide
  Seed: SVYDFFVWLH (TYRP2_HUMAN)
SPYDFFVWLR

SEQ ID NO: 190827 - protein, 9 aa, Artificial Sequence
  Description of Artificial Sequence: Synthetic peptide
  Seed: RYHLLCLER (TYRP2_HUMAN)
RMHLLCLEK

SEQ ID NO: 190828 - protein, 10 aa, Artificial Sequence
  Description of Artificial Sequence: Synthetic peptide
  Seed: YNMVPFFPPV (TYRP2_HUMAN)
YQMVPFFPPV

SEQ ID NO: 190829 - protein, 9 aa, Artificial Sequence
  Description of Artificial Sequence: Synthetic peptide
  Seed: RLRKGYTPL (TYRP2_HUMAN)
RYRKGYTPK

SEQ ID NO: 190830 - protein, 10 aa, Artificial Sequence
  Description of Artificial Sequence: Synthetic peptide
  Seed: GQFPRVCMTV (TYRP2_HUMAN)
GTFPRVCMTV

SEQ ID NO: 190831 - protein, 9 aa, Artificial Sequence
  Description of Artificial Sequence: Synthetic peptide
  Seed: ISRNSRFSS (TYRP2_HUMAN)
ILRNSRFSA

SEQ ID NO: 190832 - protein, 9 aa, Artificial Sequence
  Description of Artificial Sequence: Synthetic peptide
  Seed: SFALPYWNF (TYRP2_HUMAN)
SMALPYWNF

SEQ ID NO: 190833 - protein, 9 aa, Artificial Sequence
  Description of Artificial Sequence: Synthetic peptide
  Seed: QFPRVCMTV (TYRP2_HUMAN)
QYPRVCMTV

SEQ ID NO: 190834 - protein, 9 aa, Artificial Sequence
  Description of Artificial Sequence: Synthetic peptide
  Seed: SLDDYNHLV (TYRP2_HUMAN)
SLDDYNHLY

SEQ ID NO: 190835 - protein, 9 aa, Artificial Sequence
  Description of Artificial Sequence: Synthetic peptide
  Seed: TLDSQVMSL (TYRP2_HUMAN)
TQDSQVMSW

SEQ ID NO: 190836 - protein, 10 aa, Artificial Sequence
  Description of Artificial Sequence: Synthetic peptide
  Seed: ELAPIGHNRM (TYRP2_HUMAN)
ETAPIGHNRK

SEQ ID NO: 190837 - protein, 10 aa, Artificial Sequence
  Description of Artificial Sequence: Synthetic peptide
  Seed: NPPFFQNSTF (TYRP2_HUMAN)
NYPFFQNSTF

SEQ ID NO: 190838 - protein, 10 aa, Artificial Sequence
  Description of Artificial Sequence: Synthetic peptide
  Seed: SRFSSWETVC (TYRP2_HUMAN)
SRFSSWETVL

SEQ ID NO: 190839 - protein, 10 aa, Artificial Sequence
  Description of Artificial Sequence: Synthetic peptide
  Seed: ELAPIGHNRM (TYRP2_HUMAN)
EIAPIGHNRF

SEQ ID NO: 190840 - protein, 9 aa, Artificial Sequence
  Description of Artificial Sequence: Synthetic peptide
  Seed: TSDQLGYSY (TYRP2_HUMAN)
TVDQLGYSY

SEQ ID NO: 190841 - protein, 8 aa, Artificial Sequence
  Description of Artificial Sequence: Synthetic peptide
  Seed: SLDDYNHL (TYRP2_HUMAN)
SADDYNHI

SEQ ID NO: 190842 - protein, 8 aa, Artificial Sequence
  Description of Artificial Sequence: Synthetic peptide
  Seed: SVYDFFVW (TYRP2_HUMAN)
STYDFFVW

SEQ ID NO: 190843 - protein, 10 aa, Artificial Sequence
  Description of Artificial Sequence: Synthetic peptide
  Seed: YDFFVWLHYY (TYRP2_HUMAN)
YTFFVWLHYF

SEQ ID NO: 190844 - protein, 10 aa, Artificial Sequence
  Description of Artificial Sequence: Synthetic peptide
  Seed: MGRNSMKLPT (TYRP2_HUMAN)
MSRNSMKLPA

SEQ ID NO: 190845 - protein, 11 aa, Artificial Sequence
  Description of Artificial Sequence: Synthetic peptide
  Seed: YTPLMETHLSS (TYRP2_HUMAN)
YDPLMETHLSM

SEQ ID NO: 190846 - protein, 10 aa, Artificial Sequence
  Description of Artificial Sequence: Synthetic peptide
  Seed: LVVMGTLVAL (TYRP2_HUMAN)
LGVMGTLVAI

SEQ ID NO: 190847 - protein, 9 aa, Artificial Sequence
  Description of Artificial Sequence: Synthetic peptide
  Seed: SLDDYNHLV (TYRP2_HUMAN)
SRDDYNHLM

SEQ ID NO: 190848 - protein, 9 aa, Artificial Sequence
  Description of Artificial Sequence: Synthetic peptide
  Seed: DFFVWLHYY (TYRP2_HUMAN)
DVFVWLHYK

SEQ ID NO: 190849 - protein, 10 aa, Artificial Sequence
  Description of Artificial Sequence: Synthetic peptide
  Seed: SYAIDLPVSV (TYRP2_HUMAN)
SFAIDLPVSM

SEQ ID NO: 190850 - protein, 10 aa, Artificial Sequence
  Description of Artificial Sequence: Synthetic peptide
  Seed: HNRMYNMVPF (TYRP2_HUMAN)
HSRMYNMVPY

SEQ ID NO: 190851 - protein, 9 aa, Artificial Sequence
  Description of Artificial Sequence: Synthetic peptide
  Seed: ANDPIFVVL (TYRP2_HUMAN)
AYDPIFVVV

SEQ ID NO: 190852 - protein, 9 aa, Artificial Sequence
  Description of Artificial Sequence: Synthetic peptide
  Seed: DSLDDYNHL (TYRP2_HUMAN)
DALDDYNHI

SEQ ID NO: 190853 - protein, 10 aa, Artificial Sequence
  Description of Artificial Sequence: Synthetic peptide
  Seed: ELAPIGHNRM (TYRP2_HUMAN)
EVAPIGHNRW

SEQ ID NO: 190854 - protein, 9 aa, Artificial Sequence
  Description of Artificial Sequence: Synthetic peptide
  Seed: RNQDDRELW (TYRP2_HUMAN)
RVQDDRELI

SEQ ID NO: 190855 - protein, 10 aa, Artificial Sequence
  Description of Artificial Sequence: Synthetic peptide
  Seed: RLRKGYTPLM (TYRP2_HUMAN)
RSRKGYTPLI

SEQ ID NO: 190856 - protein, 11 aa, Artificial Sequence
  Description of Artificial Sequence: Synthetic peptide
  Seed: LSLQKFDNPPF (TYRP2_HUMAN)
LSLQKFDNPPW

SEQ ID NO: 190857 - protein, 9 aa, Artificial Sequence
  Description of Artificial Sequence: Synthetic peptide
  Seed: FFQNSTFSF (TYRP2_HUMAN)
FTQNSTFSM

SEQ ID NO: 190858 - protein, 9 aa, Artificial Sequence
  Description of Artificial Sequence: Synthetic peptide
  Seed: TLVALVGLF (TYRP2_HUMAN)
TYVALVGLL

SEQ ID NO: 190859 - protein, 9 aa, Artificial Sequence
  Description of Artificial Sequence: Synthetic peptide
  Seed: SVYDFFVWL (TYRP2_HUMAN)
SAYDFFVWA

SEQ ID NO: 190860 - protein, 9 aa, Artificial Sequence
  Description of Artificial Sequence: Synthetic peptide
  Seed: AANDPIFVV (TYRP2_HUMAN)
AINDPIFVI

SEQ ID NO: 190861 - protein, 10 aa, Artificial Sequence
  Description of Artificial Sequence: Synthetic peptide
  Seed: SPLWWGFLLS (TYRP2_HUMAN)
SKLWWGFLLI

SEQ ID NO: 190862 - protein, 9 aa, Artificial Sequence
  Description of Artificial Sequence: Synthetic peptide
  Seed: RKFFHRTCK (TYRP2_HUMAN)
RTFFHRTCV

SEQ ID NO: 190863 - protein, 9 aa, Artificial Sequence
  Description of Artificial Sequence: Synthetic peptide
  Seed: ISRNSRFSS (TYRP2_HUMAN)
ITRNSRFSR

SEQ ID NO: 190864 - protein, 9 aa, Artificial Sequence
  Description of Artificial Sequence: Synthetic peptide
  Seed: FSHQGPAFV (TYRP2_HUMAN)
FMHQGPAFA

SEQ ID NO: 190865 - protein, 9 aa, Artificial Sequence
  Description of Artificial Sequence: Synthetic peptide
  Seed: FVWLHYYSV (TYRP2_HUMAN)
FMWLHYYSK

SEQ ID NO: 190866 - protein, 9 aa, Artificial Sequence
  Description of Artificial Sequence: Synthetic peptide
  Seed: TLDSQVMSL (TYRP2_HUMAN)
TEDSQVMSI

SEQ ID NO: 190867 - protein, 9 aa, Artificial Sequence
  Description of Artificial Sequence: Synthetic peptide
  Seed: VMGTLVALV (TYRP2_HUMAN)
VMGTLVALM

SEQ ID NO: 190868 - protein, 10 aa, Artificial Sequence
  Description of Artificial Sequence: Synthetic peptide
  Seed: NSTFSFRNAL (TYRP2_HUMAN)
NSTFSFRNAI

SEQ ID NO: 190869 - protein, 9 aa, Artificial Sequence
  Description of Artificial Sequence: Synthetic peptide
  Seed: APIGHNRMY (TYRP2_HUMAN)
AHIGHNRMY

SEQ ID NO: 190870 - protein, 10 aa, Artificial Sequence
  Description of Artificial Sequence: Synthetic peptide
  Seed: MSPLWWGFLL (TYRP2_HUMAN)
MLPLWWGFLW

SEQ ID NO: 190871 - protein, 10 aa, Artificial Sequence
  Description of Artificial Sequence: Synthetic peptide
  Seed: SLSPQEREQF (TYRP2_HUMAN)
SQSPQEREQW

SEQ ID NO: 190872 - protein, 9 aa, Artificial Sequence
  Description of Artificial Sequence: Synthetic peptide
  Seed: TNALPHSAA (TYRP2_HUMAN)
TRALPHSAA

SEQ ID NO: 190873 - protein, 9 aa, Artificial Sequence
  Description of Artificial Sequence: Synthetic peptide
  Seed: LVTLCNGTY (TYRP2_HUMAN)
LPTLCNGTM

SEQ ID NO: 190874 - protein, 10 aa, Artificial Sequence
  Description of Artificial Sequence: Synthetic peptide
  Seed: MSPLWWGFLL (TYRP2_HUMAN)
MYPLWWGFLL

SEQ ID NO: 190875 - protein, 10 aa, Artificial Sequence
  Description of Artificial Sequence: Synthetic peptide
  Seed: RLRKGYTPLM (TYRP2_HUMAN)
RSRKGYTPLH

SEQ ID NO: 190876 - protein, 9 aa, Artificial Sequence
  Description of Artificial Sequence: Synthetic peptide
  Seed: YTPLMETHL (TYRP2_HUMAN)
YAPLMETHM

SEQ ID NO: 190877 - protein, 10 aa, Artificial Sequence
  Description of Artificial Sequence: Synthetic peptide
  Seed: ADTRPWSGPY (TYRP2_HUMAN)
ASTRPWSGPK

SEQ ID NO: 190878 - protein, 11 aa, Artificial Sequence
  Description of Artificial Sequence: Synthetic peptide
  Seed: PPFFQNSTFSF (TYRP2_HUMAN)
PYFFQNSTFSW

SEQ ID NO: 190879 - protein, 9 aa, Artificial Sequence
  Description of Artificial Sequence: Synthetic peptide
  Seed: LWPRKFFHR (TYRP2_HUMAN)
LQPRKFFHR

SEQ ID NO: 190880 - protein, 9 aa, Artificial Sequence
  Description of Artificial Sequence: Synthetic peptide
  Seed: NQMGRNSMK (TYRP2_HUMAN)
NTMGRNSMR

SEQ ID NO: 190881 - protein, 9 aa, Artificial Sequence
  Description of Artificial Sequence: Synthetic peptide
  Seed: QKFDNPPFF (TYRP2_HUMAN)
QRFDNPPFY

SEQ ID NO: 190882 - protein, 9 aa, Artificial Sequence
  Description of Artificial Sequence: Synthetic peptide
  Seed: SVYDFFVWL (TYRP2_HUMAN)
SIYDFFVWR

SEQ ID NO: 190883 - protein, 9 aa, Artificial Sequence
  Description of Artificial Sequence: Synthetic peptide
  Seed: WMKRFNPPA (TYRP2_HUMAN)
WHKRFNPPY

SEQ ID NO: 190884 - protein, 9 aa, Artificial Sequence
  Description of Artificial Sequence: Synthetic peptide
  Seed: LLSCLGCKI (TYRP2_HUMAN)
LTSCLGCKV

SEQ ID NO: 190885 - protein, 10 aa, Artificial Sequence
  Description of Artificial Sequence: Synthetic peptide
  Seed: RMYNMVPFFP (TYRP2_HUMAN)
RQYNMVPFFR

SEQ ID NO: 190886 - protein, 10 aa, Artificial Sequence
  Description of Artificial Sequence: Synthetic peptide
  Seed: LVVMGTLVAL (TYRP2_HUMAN)
LMVMGTLVAV

SEQ ID NO: 190887 - protein, 10 aa, Artificial Sequence
  Description of Artificial Sequence: Synthetic peptide
  Seed: ITTQHWLGLL (TYRP2_HUMAN)
ITTQHWLGLF

SEQ ID NO: 190888 - protein, 11 aa, Artificial Sequence
  Description of Artificial Sequence: Synthetic peptide
  Seed: LLVVMGTLVAL (TYRP2_HUMAN)
LLVVMGTLVAA

SEQ ID NO: 190889 - protein, 9 aa, Artificial Sequence
  Description of Artificial Sequence: Synthetic peptide
  Seed: FFPPVTNEE (TYRP2_HUMAN)
FLPPVTNEY

SEQ ID NO: 190890 - protein, 10 aa, Artificial Sequence
  Description of Artificial Sequence: Synthetic peptide
  Seed: RNSRFSSWET (TYRP2_HUMAN)
RHSRFSSWEV

SEQ ID NO: 190891 - protein, 9 aa, Artificial Sequence
  Description of Artificial Sequence: Synthetic peptide
  Seed: VTWHRYHLL (TYRP2_HUMAN)
VTWHRYHLM

SEQ ID NO: 190892 - protein, 10 aa, Artificial Sequence
  Description of Artificial Sequence: Synthetic peptide
  Seed: FPPVTNEELF (TYRP2_HUMAN)
FIPVTNEELW

SEQ ID NO: 190893 - protein, 10 aa, Artificial Sequence
  Description of Artificial Sequence: Synthetic peptide
  Seed: REQFLGALDL (TYRP2_HUMAN)
RHQFLGALDF

SEQ ID NO: 190894 - protein, 11 aa, Artificial Sequence
  Description of Artificial Sequence: Synthetic peptide
  Seed: ELAPIGHNRMY (TYRP2_HUMAN)
EMAPIGHNRMR

SEQ ID NO: 190895 - protein, 9 aa, Artificial Sequence
  Description of Artificial Sequence: Synthetic peptide
  Seed: VTNEELFLT (TYRP2_HUMAN)
VANEELFLI

SEQ ID NO: 190896 - protein, 9 aa, Artificial Sequence
  Description of Artificial Sequence: Synthetic peptide
  Seed: TDQLFGAAR (TYRP2_HUMAN)
TVQLFGAAK

SEQ ID NO: 190897 - protein, 9 aa, Artificial Sequence
  Description of Artificial Sequence: Synthetic peptide
  Seed: GTYEGLLRR (TYRP2_HUMAN)
GSYEGLLRR

SEQ ID NO: 190898 - protein, 10 aa, Artificial Sequence
  Description of Artificial Sequence: Synthetic peptide
  Seed: QPQFANCSVY (TYRP2_HUMAN)
QCQFANCSVM

SEQ ID NO: 190899 - protein, 9 aa, Artificial Sequence
  Description of Artificial Sequence: Synthetic peptide
  Seed: VIRQNIHSL (TYRP2_HUMAN)
VARQNIHSF

SEQ ID NO: 190900 - protein, 10 aa, Artificial Sequence
  Description of Artificial Sequence: Synthetic peptide
  Seed: YAIDLPVSVE (TYRP2_HUMAN)
YLIDLPVSVS

SEQ ID NO: 190901 - protein, 9 aa, Artificial Sequence
  Description of Artificial Sequence: Synthetic peptide
  Seed: HQGPAFVTW (TYRP2_HUMAN)
HKGPAFVTF

SEQ ID NO: 190902 - protein, 9 aa, Artificial Sequence
  Description of Artificial Sequence: Synthetic peptide
  Seed: SRFSSWETV (TYRP2_HUMAN)
SLFSSWETV

SEQ ID NO: 190903 - protein, 11 aa, Artificial Sequence
  Description of Artificial Sequence: Synthetic peptide
  Seed: RNSRFSSWETV (TYRP2_HUMAN)
RLSRFSSWETI

SEQ ID NO: 190904 - protein, 10 aa, Artificial Sequence
  Description of Artificial Sequence: Synthetic peptide
  Seed: NLVHSFLNGT (TYRP2_HUMAN)
NLVHSFLNGA

SEQ ID NO: 190905 - protein, 9 aa, Artificial Sequence
  Description of Artificial Sequence: Synthetic peptide
  Seed: FLNGTNALP (TYRP2_HUMAN)
FINGTNALA

SEQ ID NO: 190906 - protein, 10 aa, Artificial Sequence
  Description of Artificial Sequence: Synthetic peptide
  Seed: NCSVYDFFVW (TYRP2_HUMAN)
NLSVYDFFVW

SEQ ID NO: 190907 - protein, 11 aa, Artificial Sequence
  Description of Artificial Sequence: Synthetic peptide
  Seed: TQPQFANCSVY (TYRP2_HUMAN)
TEPQFANCSVY

SEQ ID NO: 190908 - protein, 9 aa, Artificial Sequence
  Description of Artificial Sequence: Synthetic peptide
  Seed: DQLGYSYAI (TYRP2_HUMAN)
DILGYSYAL

SEQ ID NO: 190909 - protein, 9 aa, Artificial Sequence
  Description of Artificial Sequence: Synthetic peptide
  Seed: SLHNLVHSF (TYRP2_HUMAN)
SSHNLVHSW

SEQ ID NO: 190910 - protein, 10 aa, Artificial Sequence
  Description of Artificial Sequence: Synthetic peptide
  Seed: VALVGLFVLL (TYRP2_HUMAN)
VSLVGLFVLW

SEQ ID NO: 190911 - protein, 9 aa, Artificial Sequence
  Description of Artificial Sequence: Synthetic peptide
  Seed: LVTLCNGTY (TYRP2_HUMAN)
LSTLCNGTY

SEQ ID NO: 190912 - protein, 10 aa, Artificial Sequence
  Description of Artificial Sequence: Synthetic peptide
  Seed: CCPRLGAESA (TYRP2_HUMAN)
CEPRLGAESL

SEQ ID NO: 190913 - protein, 9 aa, Artificial Sequence
  Description of Artificial Sequence: Synthetic peptide
  Seed: RVCMTVDSL (TYRP2_HUMAN)
RICMTVDSF

SEQ ID NO: 190914 - protein, 9 aa, Artificial Sequence
  Description of Artificial Sequence: Synthetic peptide
  Seed: HRYHLLCLE (TYRP2_HUMAN)
HRYHLLCLR

SEQ ID NO: 190915 - protein, 9 aa, Artificial Sequence
  Description of Artificial Sequence: Synthetic peptide
  Seed: AANDPIFVV (TYRP2_HUMAN)
APNDPIFVV

SEQ ID NO: 190916 - protein, 10 aa, Artificial Sequence
  Description of Artificial Sequence: Synthetic peptide
  Seed: PFFQNSTFSF (TYRP2_HUMAN)
PYFQNSTFSI

SEQ ID NO: 190917 - protein, 9 aa, Artificial Sequence
  Description of Artificial Sequence: Synthetic peptide
  Seed: DIRDCLSLQ (TYRP2_HUMAN)
DMRDCLSLR

SEQ ID NO: 190918 - protein, 9 aa, Artificial Sequence
  Description of Artificial Sequence: Synthetic peptide
  Seed: LHSFTDAIF (TYRP2_HUMAN)
LMSFTDAIM

SEQ ID NO: 190919 - protein, 11 aa, Artificial Sequence
  Description of Artificial Sequence: Synthetic peptide
  Seed: MYNMVPFFPPV (TYRP2_HUMAN)
MPNMVPFFPPV

SEQ ID NO: 190920 - protein, 11 aa, Artificial Sequence
  Description of Artificial Sequence: Synthetic peptide
  Seed: TQPQFANCSVY (TYRP2_HUMAN)
TFPQFANCSVM

SEQ ID NO: 190921 - protein, 8 aa, Artificial Sequence
  Description of Artificial Sequence: Synthetic peptide
  Seed: ANDPIFVV (TYRP2_HUMAN)
AADPIFVL

SEQ ID NO: 190922 - protein, 10 aa, Artificial Sequence
  Description of Artificial Sequence: Synthetic peptide
  Seed: SVYDFFVWLH (TYRP2_HUMAN)
SLYDFFVWLY

SEQ ID NO: 190923 - protein, 10 aa, Artificial Sequence
  Description of Artificial Sequence: Synthetic peptide
  Seed: FLTSDQLGYS (TYRP2_HUMAN)
FMTSDQLGYT

SEQ ID NO: 190924 - protein, 10 aa, Artificial Sequence
  Description of Artificial Sequence: Synthetic peptide
  Seed: NGTYEGLLRR (TYRP2_HUMAN)
NETYEGLLRK

SEQ ID NO: 190925 - protein, 11 aa, Artificial Sequence
  Description of Artificial Sequence: Synthetic peptide
  Seed: QPQFANCSVYD (TYRP2_HUMAN)
QLQFANCSVYY

SEQ ID NO: 190926 - protein, 11 aa, Artificial Sequence
  Description of Artificial Sequence: Synthetic peptide
  Seed: RADTRPWSGPY (TYRP2_HUMAN)
RFDTRPWSGPF

SEQ ID NO: 190927 - protein, 9 aa, Artificial Sequence
  Description of Artificial Sequence: Synthetic peptide
  Seed: SVYDFFVWL (TYRP2_HUMAN)
SMYDFFVWA

SEQ ID NO: 190928 - protein, 9 aa, Artificial Sequence
  Description of Artificial Sequence: Synthetic peptide
  Seed: STFSFRNAL (TYRP2_HUMAN)
SVFSFRNAF

SEQ ID NO: 190929 - protein, 9 aa, Artificial Sequence
  Description of Artificial Sequence: Synthetic peptide
  Seed: LLAFLQYRR (TYRP2_HUMAN)
LLAFLQYRK

SEQ ID NO: 190930 - protein, 10 aa, Artificial Sequence
  Description of Artificial Sequence: Synthetic peptide
  Seed: SVRDTLLGPG (TYRP2_HUMAN)
SIRDTLLGPK

SEQ ID NO: 190931 - protein, 9 aa, Artificial Sequence
  Description of Artificial Sequence: Synthetic peptide
  Seed: SRNSRFSSW (TYRP2_HUMAN)
SENSRFSSY

SEQ ID NO: 190932 - protein, 9 aa, Artificial Sequence
  Description of Artificial Sequence: Synthetic peptide
  Seed: FVWLHYYSV (TYRP2_HUMAN)
FNWLHYYSL

SEQ ID NO: 190933 - protein, 9 aa, Artificial Sequence
  Description of Artificial Sequence: Synthetic peptide
  Seed: ALVGLFVLL (TYRP2_HUMAN)
ASVGLFVLR

SEQ ID NO: 190934 - protein, 9 aa, Artificial Sequence
  Description of Artificial Sequence: Synthetic peptide
  Seed: YYSVRDTLL (TYRP2_HUMAN)
YSSVRDTLF

SEQ ID NO: 190935 - protein, 10 aa, Artificial Sequence
  Description of Artificial Sequence: Synthetic peptide
  Seed: CMTVDSLVNK (TYRP2_HUMAN)
CGTVDSLVNK

SEQ ID NO: 190936 - protein, 9 aa, Artificial Sequence
  Description of Artificial Sequence: Synthetic peptide
  Seed: LVNKECCPR (TYRP2_HUMAN)
LMNKECCPR

SEQ ID NO: 190937 - protein, 10 aa, Artificial Sequence
  Description of Artificial Sequence: Synthetic peptide
  Seed: TRPWSGPYIL (TYRP2_HUMAN)
TIPWSGPYIY

SEQ ID NO: 190938 - protein, 9 aa, Artificial Sequence
  Description of Artificial Sequence: Synthetic peptide
  Seed: RLRKGYTPL (TYRP2_HUMAN)
RGRKGYTPF

SEQ ID NO: 190939 - protein, 9 aa, Artificial Sequence
  Description of Artificial Sequence: Synthetic peptide
  Seed: FLNGTNALP (TYRP2_HUMAN)
FLNGTNALF

SEQ ID NO: 190940 - protein, 10 aa, Artificial Sequence
  Description of Artificial Sequence: Synthetic peptide
  Seed: KRFNPPADAW (TYRP2_HUMAN)
KIFNPPADAF

SEQ ID NO: 190941 - protein, 9 aa, Artificial Sequence
  Description of Artificial Sequence: Synthetic peptide
  Seed: ARPDDPTLI (TYRP2_HUMAN)
AFPDDPTLF

SEQ ID NO: 190942 - protein, 10 aa, Artificial Sequence
  Description of Artificial Sequence: Synthetic peptide
  Seed: FPPVTNEELF (TYRP2_HUMAN)
FHPVTNEELY

SEQ ID NO: 190943 - protein, 10 aa, Artificial Sequence
  Description of Artificial Sequence: Synthetic peptide
  Seed: ELWPRKFFHR (TYRP2_HUMAN)
EFWPRKFFHR

SEQ ID NO: 190944 - protein, 9 aa, Artificial Sequence
  Description of Artificial Sequence: Synthetic peptide
  Seed: VVMGTLVAL (TYRP2_HUMAN)
VYMGTLVAF

SEQ ID NO: 190945 - protein, 11 aa, Artificial Sequence
  Description of Artificial Sequence: Synthetic peptide
  Seed: RNSRFSSWETV (TYRP2_HUMAN)
RNSRFSSWETM

SEQ ID NO: 190946 - protein, 10 aa, Artificial Sequence
  Description of Artificial Sequence: Synthetic peptide
  Seed: SDQLGYSYAI (TYRP2_HUMAN)
STQLGYSYAI

SEQ ID NO: 190947 - protein, 11 aa, Artificial Sequence
  Description of Artificial Sequence: Synthetic peptide
  Seed: YSYAIDLPVSV (TYRP2_HUMAN)
YLYAIDLPVSV

SEQ ID NO: 190948 - protein, 10 aa, Artificial Sequence
  Description of Artificial Sequence: Synthetic peptide
  Seed: GTLDSQVMSL (TYRP2_HUMAN)
GLLDSQVMSM

SEQ ID NO: 190949 - protein, 11 aa, Artificial Sequence
  Description of Artificial Sequence: Synthetic peptide
  Seed: WLHYYSVRDTL (TYRP2_HUMAN)
WFHYYSVRDTW

SEQ ID NO: 190950 - protein, 9 aa, Artificial Sequence
  Description of Artificial Sequence: Synthetic peptide
  Seed: SFALPYWNF (TYRP2_HUMAN)
SIALPYWNY

SEQ ID NO: 190951 - protein, 10 aa, Artificial Sequence
  Description of Artificial Sequence: Synthetic peptide
  Seed: VVLHSFTDAI (TYRP2_HUMAN)
VVLHSFTDAV

SEQ ID NO: 190952 - protein, 9 aa, Artificial Sequence
  Description of Artificial Sequence: Synthetic peptide
  Seed: ANDPIFVVL (TYRP2_HUMAN)
ARDPIFVVY

SEQ ID NO: 190953 - protein, 9 aa, Artificial Sequence
  Description of Artificial Sequence: Synthetic peptide
  Seed: RLRKGYTPL (TYRP2_HUMAN)
RWRKGYTPM

SEQ ID NO: 190954 - protein, 9 aa, Artificial Sequence
  Description of Artificial Sequence: Synthetic peptide
  Seed: RLRKGYTPL (TYRP2_HUMAN)
RGRKGYTPL

SEQ ID NO: 190955 - protein, 10 aa, Artificial Sequence
  Description of Artificial Sequence: Synthetic peptide
  Seed: QPQFANCSVY (TYRP2_HUMAN)
QYQFANCSVY

SEQ ID NO: 190956 - protein, 11 aa, Artificial Sequence
  Description of Artificial Sequence: Synthetic peptide
  Seed: YTPLMETHLSS (TYRP2_HUMAN)
YSPLMETHLSI

SEQ ID NO: 190957 - protein, 9 aa, Artificial Sequence
  Description of Artificial Sequence: Synthetic peptide
  Seed: FFQNSTFSF (TYRP2_HUMAN)
FMQNSTFSI

SEQ ID NO: 190958 - protein, 9 aa, Artificial Sequence
  Description of Artificial Sequence: Synthetic peptide
  Seed: HYYSVRDTL (TYRP2_HUMAN)
HWYSVRDTF

SEQ ID NO: 190959 - protein, 10 aa, Artificial Sequence
  Description of Artificial Sequence: Synthetic peptide
  Seed: ETPGWPTTLL (TYRP2_HUMAN)
ESPGWPTTLR

SEQ ID NO: 190960 - protein, 9 aa, Artificial Sequence
  Description of Artificial Sequence: Synthetic peptide
  Seed: YSYAIDLPV (TYRP2_HUMAN)
YHYAIDLPI

SEQ ID NO: 190961 - protein, 10 aa, Artificial Sequence
  Description of Artificial Sequence: Synthetic peptide
  Seed: SQVMSLHNLV (TYRP2_HUMAN)
SMVMSLHNLI

SEQ ID NO: 190962 - protein, 10 aa, Artificial Sequence
  Description of Artificial Sequence: Synthetic peptide
  Seed: FFQNSTFSFR (TYRP2_HUMAN)
FWQNSTFSFI

SEQ ID NO: 190963 - protein, 9 aa, Artificial Sequence
  Description of Artificial Sequence: Synthetic peptide
  Seed: VHPDYVITT (TYRP2_HUMAN)
VAPDYVITI

SEQ ID NO: 190964 - protein, 10 aa, Artificial Sequence
  Description of Artificial Sequence: Synthetic peptide
  Seed: RRLRKGYTPL (TYRP2_HUMAN)
RTLRKGYTPA

SEQ ID NO: 190965 - protein, 9 aa, Artificial Sequence
  Description of Artificial Sequence: Synthetic peptide
  Seed: AANDPIFVV (TYRP2_HUMAN)
AANDPIFVW

SEQ ID NO: 190966 - protein, 10 aa, Artificial Sequence
  Description of Artificial Sequence: Synthetic peptide
  Seed: FVWLHYYSVR (TYRP2_HUMAN)
FMWLHYYSVC

SEQ ID NO: 190967 - protein, 9 aa, Artificial Sequence
  Description of Artificial Sequence: Synthetic peptide
  Seed: VIRQNIHSL (TYRP2_HUMAN)
VVRQNIHSF

SEQ ID NO: 190968 - protein, 9 aa, Artificial Sequence
  Description of Artificial Sequence: Synthetic peptide
  Seed: FLNGTNALP (TYRP2_HUMAN)
FMNGTNALL

SEQ ID NO: 190969 - protein, 10 aa, Artificial Sequence
  Description of Artificial Sequence: Synthetic peptide
  Seed: SLQKFDNPPF (TYRP2_HUMAN)
SPQKFDNPPY

SEQ ID NO: 190970 - protein, 10 aa, Artificial Sequence
  Description of Artificial Sequence: Synthetic peptide
  Seed: HNRMYNMVPF (TYRP2_HUMAN)
HHRMYNMVPY

SEQ ID NO: 190971 - protein, 10 aa, Artificial Sequence
  Description of Artificial Sequence: Synthetic peptide
  Seed: LHYYSVRDTL (TYRP2_HUMAN)
LHYYSVRDTW

SEQ ID NO: 190972 - protein, 10 aa, Artificial Sequence
  Description of Artificial Sequence: Synthetic peptide
  Seed: LVVMGTLVAL (TYRP2_HUMAN)
LQVMGTLVAM

SEQ ID NO: 190973 - protein, 10 aa, Artificial Sequence
  Description of Artificial Sequence: Synthetic peptide
  Seed: NGTYEGLLRR (TYRP2_HUMAN)
NFTYEGLLRR

SEQ ID NO: 190974 - protein, 9 aa, Artificial Sequence
  Description of Artificial Sequence: Synthetic peptide
  Seed: WMKRFNPPA (TYRP2_HUMAN)
WLKRFNPPA

SEQ ID NO: 190975 - protein, 10 aa, Artificial Sequence
  Description of Artificial Sequence: Synthetic peptide
  Seed: LVVMGTLVAL (TYRP2_HUMAN)
LDVMGTLVAA

SEQ ID NO: 190976 - protein, 10 aa, Artificial Sequence
  Description of Artificial Sequence: Synthetic peptide
  Seed: TRPWSGPYIL (TYRP2_HUMAN)
TQPWSGPYIF

SEQ ID NO: 190977 - protein, 10 aa, Artificial Sequence
  Description of Artificial Sequence: Synthetic peptide
  Seed: SPLWWGFLLS (TYRP2_HUMAN)
SNLWWGFLLL

SEQ ID NO: 190978 - protein, 10 aa, Artificial Sequence
  Description of Artificial Sequence: Synthetic peptide
  Seed: FGWTGPNCER (TYRP2_HUMAN)
FVWTGPNCEK

SEQ ID NO: 190979 - protein, 8 aa, Artificial Sequence
  Description of Artificial Sequence: Synthetic peptide
  Seed: RLIGNESF (TYRP2_HUMAN)
RQIGNESF

SEQ ID NO: 190980 - protein, 9 aa, Artificial Sequence
  Description of Artificial Sequence: Synthetic peptide
  Seed: YAIDLPVSV (TYRP2_HUMAN)
YSIDLPVSA

SEQ ID NO: 190981 - protein, 9 aa, Artificial Sequence
  Description of Artificial Sequence: Synthetic peptide
  Seed: VVMGTLVAL (TYRP2_HUMAN)
VMMGTLVAT

SEQ ID NO: 190982 - protein, 9 aa, Artificial Sequence
  Description of Artificial Sequence: Synthetic peptide
  Seed: RDCLSLQKF (TYRP2_HUMAN)
RSCLSLQKF

SEQ ID NO: 190983 - protein, 10 aa, Artificial Sequence
  Description of Artificial Sequence: Synthetic peptide
  Seed: RLRKGYTPLM (TYRP2_HUMAN)
RSRKGYTPLM

SEQ ID NO: 190984 - protein, 9 aa, Artificial Sequence
  Description of Artificial Sequence: Synthetic peptide
  Seed: DIRDCLSLQ (TYRP2_HUMAN)
DSRDCLSLK

SEQ ID NO: 190985 - protein, 9 aa, Artificial Sequence
  Description of Artificial Sequence: Synthetic peptide
  Seed: VTWHRYHLL (TYRP2_HUMAN)
VAWHRYHLM

SEQ ID NO: 190986 - protein, 10 aa, Artificial Sequence
  Description of Artificial Sequence: Synthetic peptide
  Seed: FGWTGPNCER (TYRP2_HUMAN)
FAWTGPNCEM

SEQ ID NO: 190987 - protein, 9 aa, Artificial Sequence
  Description of Artificial Sequence: Synthetic peptide
  Seed: VYDFFVWLH (TYRP2_HUMAN)
VTDFFVWLY

SEQ ID NO: 190988 - protein, 9 aa, Artificial Sequence
  Description of Artificial Sequence: Synthetic peptide
  Seed: YYSVRDTLL (TYRP2_HUMAN)
YASVRDTLI

SEQ ID NO: 190989 - protein, 11 aa, Artificial Sequence
  Description of Artificial Sequence: Synthetic peptide
  Seed: VVMGTLVALVG (TYRP2_HUMAN)
VQMGTLVALVV

SEQ ID NO: 190990 - protein, 9 aa, Artificial Sequence
  Description of Artificial Sequence: Synthetic peptide
  Seed: RLRKGYTPL (TYRP2_HUMAN)
RIRKGYTPS

SEQ ID NO: 190991 - protein, 9 aa, Artificial Sequence
  Description of Artificial Sequence: Synthetic peptide
  Seed: NALEGFDKA (TYRP2_HUMAN)
NMLEGFDKV

SEQ ID NO: 190992 - protein, 10 aa, Artificial Sequence
  Description of Artificial Sequence: Synthetic peptide
  Seed: NSTFSFRNAL (TYRP2_HUMAN)
NETFSFRNAV

SEQ ID NO: 190993 - protein, 9 aa, Artificial Sequence
  Description of Artificial Sequence: Synthetic peptide
  Seed: VMSLHNLVH (TYRP2_HUMAN)
VQSLHNLVF

SEQ ID NO: 190994 - protein, 9 aa, Artificial Sequence
  Description of Artificial Sequence: Synthetic peptide
  Seed: DDYNHLVTL (TYRP2_HUMAN)
DAYNHLVTC

SEQ ID NO: 190995 - protein, 10 aa, Artificial Sequence
  Description of Artificial Sequence: Synthetic peptide
  Seed: MSPLWWGFLL (TYRP2_HUMAN)
MLPLWWGFLF

SEQ ID NO: 190996 - protein, 10 aa, Artificial Sequence
  Description of Artificial Sequence: Synthetic peptide
  Seed: MSPLWWGFLL (TYRP2_HUMAN)
MPPLWWGFLM

SEQ ID NO: 190997 - protein, 8 aa, Artificial Sequence
  Description of Artificial Sequence: Synthetic peptide
  Seed: RLIGNESF (TYRP2_HUMAN)
RQIGNESY

SEQ ID NO: 190998 - protein, 9 aa, Artificial Sequence
  Description of Artificial Sequence: Synthetic peptide
  Seed: SFRNALEGF (TYRP2_HUMAN)
SYRNALEGI

SEQ ID NO: 190999 - protein, 9 aa, Artificial Sequence
  Description of Artificial Sequence: Synthetic peptide
  Seed: VSVEETPGW (TYRP2_HUMAN)
VPVEETPGF

SEQ ID NO: 191000 - protein, 9 aa, Artificial Sequence
  Description of Artificial Sequence: Synthetic peptide
  Seed: RQNIHSLSP (TYRP2_HUMAN)
RKNIHSLSY

SEQ ID NO: 191001 - protein, 11 aa, Artificial Sequence
  Description of Artificial Sequence: Synthetic peptide
  Seed: RADTRPWSGPY (TYRP2_HUMAN)
RNDTRPWSGPW

SEQ ID NO: 191002 - protein, 10 aa, Artificial Sequence
  Description of Artificial Sequence: Synthetic peptide
  Seed: RNSRFSSWET (TYRP2_HUMAN)
RGSRFSSWEI

SEQ ID NO: 191003 - protein, 9 aa, Artificial Sequence
  Description of Artificial Sequence: Synthetic peptide
  Seed: MTVDSLVNK (TYRP2_HUMAN)
MMVDSLVNL

SEQ ID NO: 191004 - protein, 9 aa, Artificial Sequence
  Description of Artificial Sequence: Synthetic peptide
  Seed: APIGHNRMY (TYRP2_HUMAN)
AKIGHNRMF

SEQ ID NO: 191005 - protein, 9 aa, Artificial Sequence
  Description of Artificial Sequence: Synthetic peptide
  Seed: RVCMTVDSL (TYRP2_HUMAN)
RQCMTVDSF

SEQ ID NO: 191006 - protein, 9 aa, Artificial Sequence
  Description of Artificial Sequence: Synthetic peptide
  Seed: VHPDYVITT (TYRP2_HUMAN)
VEPDYVITL

SEQ ID NO: 191007 - protein, 10 aa, Artificial Sequence
  Description of Artificial Sequence: Synthetic peptide
  Seed: LKDIRDCLSL (TYRP2_HUMAN)
LMDIRDCLSF

SEQ ID NO: 191008 - protein, 9 aa, Artificial Sequence
  Description of Artificial Sequence: Synthetic peptide
  Seed: GPGRPYRAI (TYRP2_HUMAN)
GPGRPYRAV

SEQ ID NO: 191009 - protein, 9 aa, Artificial Sequence
  Description of Artificial Sequence: Synthetic peptide
  Seed: DTRPWSGPY (TYRP2_HUMAN)
DIRPWSGPK

SEQ ID NO: 191010 - protein, 10 aa, Artificial Sequence
  Description of Artificial Sequence: Synthetic peptide
  Seed: LTSDQLGYSY (TYRP2_HUMAN)
LTSDQLGYSK

SEQ ID NO: 191011 - protein, 9 aa, Artificial Sequence
  Description of Artificial Sequence: Synthetic peptide
  Seed: SQVMSLHNL (TYRP2_HUMAN)
SAVMSLHNY

SEQ ID NO: 191012 - protein, 9 aa, Artificial Sequence
  Description of Artificial Sequence: Synthetic peptide
  Seed: RLRKGYTPL (TYRP2_HUMAN)
RVRKGYTPK

SEQ ID NO: 191013 - protein, 11 aa, Artificial Sequence
  Description of Artificial Sequence: Synthetic peptide
  Seed: TQPQFANCSVY (TYRP2_HUMAN)
TGPQFANCSVM

SEQ ID NO: 191014 - protein, 10 aa, Artificial Sequence
  Description of Artificial Sequence: Synthetic peptide
  Seed: LDDYNHLVTL (TYRP2_HUMAN)
LVDYNHLVTL

SEQ ID NO: 191015 - protein, 9 aa, Artificial Sequence
  Description of Artificial Sequence: Synthetic peptide
  Seed: VTNEELFLT (TYRP2_HUMAN)
VMNEELFLL

SEQ ID NO: 191016 - protein, 9 aa, Artificial Sequence
  Description of Artificial Sequence: Synthetic peptide
  Seed: RLIGNESFA (TYRP2_HUMAN)
RIIGNESFL

SEQ ID NO: 191017 - protein, 9 aa, Artificial Sequence
  Description of Artificial Sequence: Synthetic peptide
  Seed: RELWPRKFF (TYRP2_HUMAN)
RMLWPRKFY

SEQ ID NO: 191018 - protein, 10 aa, Artificial Sequence
  Description of Artificial Sequence: Synthetic peptide
  Seed: FFVWLHYYSV (TYRP2_HUMAN)
FTVWLHYYSA

SEQ ID NO: 191019 - protein, 9 aa, Artificial Sequence
  Description of Artificial Sequence: Synthetic peptide
  Seed: LAPIGHNRM (TYRP2_HUMAN)
LLPIGHNRL

SEQ ID NO: 191020 - protein, 10 aa, Artificial Sequence
  Description of Artificial Sequence: Synthetic peptide
  Seed: YDFFVWLHYY (TYRP2_HUMAN)
YGFFVWLHYF

SEQ ID NO: 191021 - protein, 9 aa, Artificial Sequence
  Description of Artificial Sequence: Synthetic peptide
  Seed: ANDPIFVVL (TYRP2_HUMAN)
AVDPIFVVY

SEQ ID NO: 191022 - protein, 9 aa, Artificial Sequence
  Description of Artificial Sequence: Synthetic peptide
  Seed: RLRKGYTPL (TYRP2_HUMAN)
RYRKGYTPY

SEQ ID NO: 191023 - protein, 9 aa, Artificial Sequence
  Description of Artificial Sequence: Synthetic peptide
  Seed: GTLVALVGL (TYRP2_HUMAN)
GSLVALVGV

SEQ ID NO: 191024 - protein, 9 aa, Artificial Sequence
  Description of Artificial Sequence: Synthetic peptide
  Seed: RQNIHSLSP (TYRP2_HUMAN)
RQNIHSLSM

SEQ ID NO: 191025 - protein, 10 aa, Artificial Sequence
  Description of Artificial Sequence: Synthetic peptide
  Seed: YDFFVWLHYY (TYRP2_HUMAN)
YMFFVWLHYC

SEQ ID NO: 191026 - protein, 10 aa, Artificial Sequence
  Description of Artificial Sequence: Synthetic peptide
  Seed: REQFLGALDL (TYRP2_HUMAN)
RIQFLGALDM

SEQ ID NO: 191027 - protein, 10 aa, Artificial Sequence
  Description of Artificial Sequence: Synthetic peptide
  Seed: VVMGTLVALV (TYRP2_HUMAN)
VLMGTLVALM

SEQ ID NO: 191028 - protein, 10 aa, Artificial Sequence
  Description of Artificial Sequence: Synthetic peptide
  Seed: HRYHLLCLER (TYRP2_HUMAN)
HRYHLLCLEV

SEQ ID NO: 191029 - protein, 9 aa, Artificial Sequence
  Description of Artificial Sequence: Synthetic peptide
  Seed: RPWSGPYIL (TYRP2_HUMAN)
RHWSGPYIA

SEQ ID NO: 191030 - protein, 11 aa, Artificial Sequence
  Description of Artificial Sequence: Synthetic peptide
  Seed: YNMVPFFPPVT (TYRP2_HUMAN)
YVMVPFFPPVA

SEQ ID NO: 191031 - protein, 9 aa, Artificial Sequence
  Description of Artificial Sequence: Synthetic peptide
  Seed: FTDAIFDEW (TYRP2_HUMAN)
FVDAIFDEM

SEQ ID NO: 191032 - protein, 9 aa, Artificial Sequence
  Description of Artificial Sequence: Synthetic peptide
  Seed: ISRNSRFSS (TYRP2_HUMAN)
IVRNSRFSM

SEQ ID NO: 191033 - protein, 10 aa, Artificial Sequence
  Description of Artificial Sequence: Synthetic peptide
  Seed: MSPLWWGFLL (TYRP2_HUMAN)
MKPLWWGFLM

SEQ ID NO: 191034 - protein, 9 aa, Artificial Sequence
  Description of Artificial Sequence: Synthetic peptide
  Seed: YVITTQHWL (TYRP2_HUMAN)
YSITTQHWI

SEQ ID NO: 191035 - protein, 10 aa, Artificial Sequence
  Description of Artificial Sequence: Synthetic peptide
  Seed: RLRKGYTPLM (TYRP2_HUMAN)
RMRKGYTPLY

SEQ ID NO: 191036 - protein, 10 aa, Artificial Sequence
  Description of Artificial Sequence: Synthetic peptide
  Seed: FGWTGPNCER (TYRP2_HUMAN)
FIWTGPNCER

SEQ ID NO: 191037 - protein, 9 aa, Artificial Sequence
  Description of Artificial Sequence: Synthetic peptide
  Seed: YAIDLPVSV (TYRP2_HUMAN)
YDIDLPVSL

SEQ ID NO: 191038 - protein, 8 aa, Artificial Sequence
  Description of Artificial Sequence: Synthetic peptide
  Seed: RPDDPTLI (TYRP2_HUMAN)
RYDDPTLF

SEQ ID NO: 191039 - protein, 10 aa, Artificial Sequence
  Description of Artificial Sequence: Synthetic peptide
  Seed: FTDAIFDEWM (TYRP2_HUMAN)
FMDAIFDEWY

SEQ ID NO: 191040 - protein, 8 aa, Artificial Sequence
  Description of Artificial Sequence: Synthetic peptide
  Seed: NSMKLPTL (TYRP2_HUMAN)
NQMKLPTI

SEQ ID NO: 191041 - protein, 10 aa, Artificial Sequence
  Description of Artificial Sequence: Synthetic peptide
  Seed: KILPGAQGQF (TYRP2_HUMAN)
KTLPGAQGQY

SEQ ID NO: 191042 - protein, 10 aa, Artificial Sequence
  Description of Artificial Sequence: Synthetic peptide
  Seed: SYAIDLPVSV (TYRP2_HUMAN)
SMAIDLPVSI

SEQ ID NO: 191043 - protein, 9 aa, Artificial Sequence
  Description of Artificial Sequence: Synthetic peptide
  Seed: ITTQHWLGL (TYRP2_HUMAN)
ISTQHWLGI

SEQ ID NO: 191044 - protein, 9 aa, Artificial Sequence
  Description of Artificial Sequence: Synthetic peptide
  Seed: VIRQNIHSL (TYRP2_HUMAN)
VLRQNIHSK

SEQ ID NO: 191045 - protein, 10 aa, Artificial Sequence
  Description of Artificial Sequence: Synthetic peptide
  Seed: LHYYSVRDTL (TYRP2_HUMAN)
LMYYSVRDTY

SEQ ID NO: 191046 - protein, 10 aa, Artificial Sequence
  Description of Artificial Sequence: Synthetic peptide
  Seed: QELAPIGHNR (TYRP2_HUMAN)
QILAPIGHNK

SEQ ID NO: 191047 - protein, 9 aa, Artificial Sequence
  Description of Artificial Sequence: Synthetic peptide
  Seed: FLNGTNALP (TYRP2_HUMAN)
FTNGTNALV

SEQ ID NO: 191048 - protein, 11 aa, Artificial Sequence
  Description of Artificial Sequence: Synthetic peptide
  Seed: YNMVPFFPPVT (TYRP2_HUMAN)
YVMVPFFPPVY

SEQ ID NO: 191049 - protein, 11 aa, Artificial Sequence
  Description of Artificial Sequence: Synthetic peptide
  Seed: FVLLAFLQYRR (TYRP2_HUMAN)
FTLLAFLQYRR

SEQ ID NO: 191050 - protein, 9 aa, Artificial Sequence
  Description of Artificial Sequence: Synthetic peptide
  Seed: FTDAIFDEW (TYRP2_HUMAN)
FWDAIFDEM

SEQ ID NO: 191051 - protein, 10 aa, Artificial Sequence
  Description of Artificial Sequence: Synthetic peptide
  Seed: YSYAIDLPVS (TYRP2_HUMAN)
YQYAIDLPVM

SEQ ID NO: 191052 - protein, 9 aa, Artificial Sequence
  Description of Artificial Sequence: Synthetic peptide
  Seed: QRLIGNESF (TYRP2_HUMAN)
QQLIGNESF

SEQ ID NO: 191053 - protein, 9 aa, Artificial Sequence
  Description of Artificial Sequence: Synthetic peptide
  Seed: DSLDDYNHL (TYRP2_HUMAN)
DVLDDYNHR

SEQ ID NO: 191054 - protein, 9 aa, Artificial Sequence
  Description of Artificial Sequence: Synthetic peptide
  Seed: TLVALVGLF (TYRP2_HUMAN)
TYVALVGLW

SEQ ID NO: 191055 - protein, 9 aa, Artificial Sequence
  Description of Artificial Sequence: Synthetic peptide
  Seed: VVMGTLVAL (TYRP2_HUMAN)
VWMGTLVAI

SEQ ID NO: 191056 - protein, 9 aa, Artificial Sequence
  Description of Artificial Sequence: Synthetic peptide
  Seed: WPQELAPIG (TYRP2_HUMAN)
WAQELAPIY

SEQ ID NO: 191057 - protein, 9 aa, Artificial Sequence
  Description of Artificial Sequence: Synthetic peptide
  Seed: VIRQNIHSL (TYRP2_HUMAN)
VFRQNIHSF

SEQ ID NO: 191058 - protein, 10 aa, Artificial Sequence
  Description of Artificial Sequence: Synthetic peptide
  Seed: DIRDCLSLQK (TYRP2_HUMAN)
DTRDCLSLQR

SEQ ID NO: 191059 - protein, 9 aa, Artificial Sequence
  Description of Artificial Sequence: Synthetic peptide
  Seed: RLRKGYTPL (TYRP2_HUMAN)
RPRKGYTPA

SEQ ID NO: 191060 - protein, 10 aa, Artificial Sequence
  Description of Artificial Sequence: Synthetic peptide
  Seed: RNSRFSSWET (TYRP2_HUMAN)
RWSRFSSWEA

SEQ ID NO: 191061 - protein, 10 aa, Artificial Sequence
  Description of Artificial Sequence: Synthetic peptide
  Seed: FFVWLHYYSV (TYRP2_HUMAN)
FRVWLHYYSV

SEQ ID NO: 191062 - protein, 10 aa, Artificial Sequence
  Description of Artificial Sequence: Synthetic peptide
  Seed: MSPLWWGFLL (TYRP2_HUMAN)
MKPLWWGFLY

SEQ ID NO: 191063 - protein, 11 aa, Artificial Sequence
  Description of Artificial Sequence: Synthetic peptide
  Seed: WLHYYSVRDTL (TYRP2_HUMAN)
WTHYYSVRDTW

SEQ ID NO: 191064 - protein, 9 aa, Artificial Sequence
  Description of Artificial Sequence: Synthetic peptide
  Seed: LAPIGHNRM (TYRP2_HUMAN)
LGPIGHNRL

SEQ ID NO: 191065 - protein, 9 aa, Artificial Sequence
  Description of Artificial Sequence: Synthetic peptide
  Seed: NALEGFDKA (TYRP2_HUMAN)
NQLEGFDKV

SEQ ID NO: 191066 - protein, 10 aa, Artificial Sequence
  Description of Artificial Sequence: Synthetic peptide
  Seed: RNSRFSSWET (TYRP2_HUMAN)
RRSRFSSWEL

SEQ ID NO: 191067 - protein, 9 aa, Artificial Sequence
  Description of Artificial Sequence: Synthetic peptide
  Seed: FPPVTNEEL (TYRP2_HUMAN)
FFPVTNEEI

SEQ ID NO: 191068 - protein, 9 aa, Artificial Sequence
  Description of Artificial Sequence: Synthetic peptide
  Seed: LVALVGLFV (TYRP2_HUMAN)
LTALVGLFV

SEQ ID NO: 191069 - protein, 10 aa, Artificial Sequence
  Description of Artificial Sequence: Synthetic peptide
  Seed: MSLHNLVHSF (TYRP2_HUMAN)
MILHNLVHSW

SEQ ID NO: 191070 - protein, 9 aa, Artificial Sequence
  Description of Artificial Sequence: Synthetic peptide
  Seed: RMYNMVPFF (TYRP2_HUMAN)
RVYNMVPFR

SEQ ID NO: 191071 - protein, 10 aa, Artificial Sequence
  Description of Artificial Sequence: Synthetic peptide
  Seed: DIRDCLSLQK (TYRP2_HUMAN)
DVRDCLSLQR

SEQ ID NO: 191072 - protein, 9 aa, Artificial Sequence
  Description of Artificial Sequence: Synthetic peptide
  Seed: ETPGWPTTL (TYRP2_HUMAN)
EPPGWPTTV

SEQ ID NO: 191073 - protein, 11 aa, Artificial Sequence
  Description of Artificial Sequence: Synthetic peptide
  Seed: YTPLMETHLSS (TYRP2_HUMAN)
YPPLMETHLST

SEQ ID NO: 191074 - protein, 10 aa, Artificial Sequence
  Description of Artificial Sequence: Synthetic peptide
  Seed: NSRFSSWETV (TYRP2_HUMAN)
NWRFSSWETL

SEQ ID NO: 191075 - protein, 9 aa, Artificial Sequence
  Description of Artificial Sequence: Synthetic peptide
  Seed: ILPGAQGQF (TYRP2_HUMAN)
IFPGAQGQY

SEQ ID NO: 191076 - protein, 10 aa, Artificial Sequence
  Description of Artificial Sequence: Synthetic peptide
  Seed: HSFLNGTNAL (TYRP2_HUMAN)
HQFLNGTNAY

SEQ ID NO: 191077 - protein, 9 aa, Artificial Sequence
  Description of Artificial Sequence: Synthetic peptide
  Seed: RMYNMVPFF (TYRP2_HUMAN)
RTYNMVPFP

SEQ ID NO: 191078 - protein, 10 aa, Artificial Sequence
  Description of Artificial Sequence: Synthetic peptide
  Seed: FVWLHYYSVR (TYRP2_HUMAN)
FMWLHYYSVE

SEQ ID NO: 191079 - protein, 9 aa, Artificial Sequence
  Description of Artificial Sequence: Synthetic peptide
  Seed: RQNIHSLSP (TYRP2_HUMAN)
RMNIHSLSF

SEQ ID NO: 191080 - protein, 10 aa, Artificial Sequence
  Description of Artificial Sequence: Synthetic peptide
  Seed: FFPPVTNEEL (TYRP2_HUMAN)
FAPPVTNEEF

SEQ ID NO: 191081 - protein, 9 aa, Artificial Sequence
  Description of Artificial Sequence: Synthetic peptide
  Seed: NSMKLPTLK (TYRP2_HUMAN)
NAMKLPTLR

SEQ ID NO: 191082 - protein, 10 aa, Artificial Sequence
  Description of Artificial Sequence: Synthetic peptide
  Seed: AIFDEWMKRF (TYRP2_HUMAN)
AAFDEWMKRY

SEQ ID NO: 191083 - protein, 9 aa, Artificial Sequence
  Description of Artificial Sequence: Synthetic peptide
  Seed: AARPDDPTL (TYRP2_HUMAN)
AARPDDPTF

SEQ ID NO: 191084 - protein, 9 aa, Artificial Sequence
  Description of Artificial Sequence: Synthetic peptide
  Seed: RVCMTVDSL (TYRP2_HUMAN)
RMCMTVDSV

SEQ ID NO: 191085 - protein, 9 aa, Artificial Sequence
  Description of Artificial Sequence: Synthetic peptide
  Seed: RDCLSLQKF (TYRP2_HUMAN)
RKCLSLQKY

SEQ ID NO: 191086 - protein, 10 aa, Artificial Sequence
  Description of Artificial Sequence: Synthetic peptide
  Seed: LVVMGTLVAL (TYRP2_HUMAN)
LRVMGTLVAV

SEQ ID NO: 191087 - protein, 9 aa, Artificial Sequence
  Description of Artificial Sequence: Synthetic peptide
  Seed: RLRKGYTPL (TYRP2_HUMAN)
RSRKGYTPS

SEQ ID NO: 191088 - protein, 10 aa, Artificial Sequence
  Description of Artificial Sequence: Synthetic peptide
  Seed: SQVMSLHNLV (TYRP2_HUMAN)
SLVMSLHNLV

SEQ ID NO: 191089 - protein, 9 aa, Artificial Sequence
  Description of Artificial Sequence: Synthetic peptide
  Seed: LSPQEREQF (TYRP2_HUMAN)
LSPQEREQW

SEQ ID NO: 191090 - protein, 9 aa, Artificial Sequence
  Description of Artificial Sequence: Synthetic peptide
  Seed: FTDAIFDEW (TYRP2_HUMAN)
FTDAIFDEL

SEQ ID NO: 191091 - protein, 9 aa, Artificial Sequence
  Description of Artificial Sequence: Synthetic peptide
  Seed: SRNSRFSSW (TYRP2_HUMAN)
SLNSRFSSY

SEQ ID NO: 191092 - protein, 9 aa, Artificial Sequence
  Description of Artificial Sequence: Synthetic peptide
  Seed: VTWHRYHLL (TYRP2_HUMAN)
VQWHRYHLL

SEQ ID NO: 191093 - protein, 8 aa, Artificial Sequence
  Description of Artificial Sequence: Synthetic peptide
  Seed: FQNSTFSF (TYRP2_HUMAN)
FKNSTFSY

SEQ ID NO: 191094 - protein, 9 aa, Artificial Sequence
  Description of Artificial Sequence: Synthetic peptide
  Seed: VTWHRYHLL (TYRP2_HUMAN)
VMWHRYHLI

SEQ ID NO: 191095 - protein, 9 aa, Artificial Sequence
  Description of Artificial Sequence: Synthetic peptide
  Seed: LSPQEREQF (TYRP2_HUMAN)
LFPQEREQY

SEQ ID NO: 191096 - protein, 9 aa, Artificial Sequence
  Description of Artificial Sequence: Synthetic peptide
  Seed: AANDPIFVV (TYRP2_HUMAN)
AMNDPIFVA

SEQ ID NO: 191097 - protein, 9 aa, Artificial Sequence
  Description of Artificial Sequence: Synthetic peptide
  Seed: GWPTTLLVV (TYRP2_HUMAN)
GWPTTLLVW

SEQ ID NO: 191098 - protein, 9 aa, Artificial Sequence
  Description of Artificial Sequence: Synthetic peptide
  Seed: SLHNLVHSF (TYRP2_HUMAN)
SYHNLVHSL

SEQ ID NO: 191099 - protein, 10 aa, Artificial Sequence
  Description of Artificial Sequence: Synthetic peptide
  Seed: ETPGWPTTLL (TYRP2_HUMAN)
EVPGWPTTLY

SEQ ID NO: 191100 - protein, 9 aa, Artificial Sequence
  Description of Artificial Sequence: Synthetic peptide
  Seed: YAIDLPVSV (TYRP2_HUMAN)
YKIDLPVSF

SEQ ID NO: 191101 - protein, 9 aa, Artificial Sequence
  Description of Artificial Sequence: Synthetic peptide
  Seed: SLHNLVHSF (TYRP2_HUMAN)
SGHNLVHSM

SEQ ID NO: 191102 - protein, 9 aa, Artificial Sequence
  Description of Artificial Sequence: Synthetic peptide
  Seed: ALVGLFVLL (TYRP2_HUMAN)
AIVGLFVLR

SEQ ID NO: 191103 - protein, 9 aa, Artificial Sequence
  Description of Artificial Sequence: Synthetic peptide
  Seed: SRNSRFSSW (TYRP2_HUMAN)
SQNSRFSSF

SEQ ID NO: 191104 - protein, 11 aa, Artificial Sequence
  Description of Artificial Sequence: Synthetic peptide
  Seed: MYNMVPFFPPV (TYRP2_HUMAN)
MMNMVPFFPPI

SEQ ID NO: 191105 - protein, 9 aa, Artificial Sequence
  Description of Artificial Sequence: Synthetic peptide
  Seed: QVMSLHNLV (TYRP2_HUMAN)
QTMSLHNLI

SEQ ID NO: 191106 - protein, 9 aa, Artificial Sequence
  Description of Artificial Sequence: Synthetic peptide
  Seed: WMKRFNPPA (TYRP2_HUMAN)
WEKRFNPPF

SEQ ID NO: 191107 - protein, 9 aa, Artificial Sequence
  Description of Artificial Sequence: Synthetic peptide
  Seed: RYHLLCLER (TYRP2_HUMAN)
RIHLLCLER

SEQ ID NO: 191108 - protein, 9 aa, Artificial Sequence
  Description of Artificial Sequence: Synthetic peptide
  Seed: ESANVCGSQ (TYRP2_HUMAN)
EMANVCGSR

SEQ ID NO: 191109 - protein, 11 aa, Artificial Sequence
  Description of Artificial Sequence: Synthetic peptide
  Seed: HSLSPQEREQF (TYRP2_HUMAN)
HQLSPQEREQI

SEQ ID NO: 191110 - protein, 9 aa, Artificial Sequence
  Description of Artificial Sequence: Synthetic peptide
  Seed: LERDLQRLI (TYRP2_HUMAN)
LERDLQRLA

SEQ ID NO: 191111 - protein, 9 aa, Artificial Sequence
  Description of Artificial Sequence: Synthetic peptide
  Seed: FQNSTFSFR (TYRP2_HUMAN)
FANSTFSFR

SEQ ID NO: 191112 - protein, 9 aa, Artificial Sequence
  Description of Artificial Sequence: Synthetic peptide
  Seed: SVYDFFVWL (TYRP2_HUMAN)
STYDFFVWM

SEQ ID NO: 191113 - protein, 9 aa, Artificial Sequence
  Description of Artificial Sequence: Synthetic peptide
  Seed: LWPRKFFHR (TYRP2_HUMAN)
LMPRKFFHR

SEQ ID NO: 191114 - protein, 10 aa, Artificial Sequence
  Description of Artificial Sequence: Synthetic peptide
  Seed: RELWPRKFFH (TYRP2_HUMAN)
RMLWPRKFFH

SEQ ID NO: 191115 - protein, 9 aa, Artificial Sequence
  Description of Artificial Sequence: Synthetic peptide
  Seed: SLDDYNHLV (TYRP2_HUMAN)
SGDDYNHLL

SEQ ID NO: 191116 - protein, 11 aa, Artificial Sequence
  Description of Artificial Sequence: Synthetic peptide
  Seed: HSLSPQEREQF (TYRP2_HUMAN)
HQLSPQEREQF

SEQ ID NO: 191117 - protein, 10 aa, Artificial Sequence
  Description of Artificial Sequence: Synthetic peptide
  Seed: HSFLNGTNAL (TYRP2_HUMAN)
HMFLNGTNAF

SEQ ID NO: 191118 - protein, 10 aa, Artificial Sequence
  Description of Artificial Sequence: Synthetic peptide
  Seed: RNSRFSSWET (TYRP2_HUMAN)
RLSRFSSWEL

SEQ ID NO: 191119 - protein, 10 aa, Artificial Sequence
  Description of Artificial Sequence: Synthetic peptide
  Seed: FVWLHYYSVR (TYRP2_HUMAN)
FMWLHYYSVY

SEQ ID NO: 191120 - protein, 9 aa, Artificial Sequence
  Description of Artificial Sequence: Synthetic peptide
  Seed: RKFFHRTCK (TYRP2_HUMAN)
RAFFHRTCK

SEQ ID NO: 191121 - protein, 10 aa, Artificial Sequence
  Description of Artificial Sequence: Synthetic peptide
  Seed: RTCKCTGNFA (TYRP2_HUMAN)
RICKCTGNFA

SEQ ID NO: 191122 - protein, 9 aa, Artificial Sequence
  Description of Artificial Sequence: Synthetic peptide
  Seed: RAIDFSHQG (TYRP2_HUMAN)
RAIDFSHQM

SEQ ID NO: 191123 - protein, 9 aa, Artificial Sequence
  Description of Artificial Sequence: Synthetic peptide
  Seed: ALVGLFVLL (TYRP2_HUMAN)
ASVGLFVLV

SEQ ID NO: 191124 - protein, 9 aa, Artificial Sequence
  Description of Artificial Sequence: Synthetic peptide
  Seed: WPQELAPIG (TYRP2_HUMAN)
WIQELAPIY

SEQ ID NO: 191125 - protein, 10 aa, Artificial Sequence
  Description of Artificial Sequence: Synthetic peptide
  Seed: QELAPIGHNR (TYRP2_HUMAN)
QTLAPIGHNR

SEQ ID NO: 191126 - protein, 10 aa, Artificial Sequence
  Description of Artificial Sequence: Synthetic peptide
  Seed: QELAPIGHNR (TYRP2_HUMAN)
QFLAPIGHNR

SEQ ID NO: 191127 - protein, 9 aa, Artificial Sequence
  Description of Artificial Sequence: Synthetic peptide
  Seed: DDYNHLVTL (TYRP2_HUMAN)
DKYNHLVTM

SEQ ID NO: 191128 - protein, 10 aa, Artificial Sequence
  Description of Artificial Sequence: Synthetic peptide
  Seed: NESFALPYWN (TYRP2_HUMAN)
NESFALPYWW

SEQ ID NO: 191129 - protein, 10 aa, Artificial Sequence
  Description of Artificial Sequence: Synthetic peptide
  Seed: MSLHNLVHSF (TYRP2_HUMAN)
MYLHNLVHSW

SEQ ID NO: 191130 - protein, 10 aa, Artificial Sequence
  Description of Artificial Sequence: Synthetic peptide
  Seed: FVWLHYYSVR (TYRP2_HUMAN)
FMWLHYYSVD

SEQ ID NO: 191131 - protein, 10 aa, Artificial Sequence
  Description of Artificial Sequence: Synthetic peptide
  Seed: ELAPIGHNRM (TYRP2_HUMAN)
EMAPIGHNRK

SEQ ID NO: 191132 - protein, 9 aa, Artificial Sequence
  Description of Artificial Sequence: Synthetic peptide
  Seed: SVRDTLLGP (TYRP2_HUMAN)
SSRDTLLGK

SEQ ID NO: 191133 - protein, 9 aa, Artificial Sequence
  Description of Artificial Sequence: Synthetic peptide
  Seed: HQGPAFVTW (TYRP2_HUMAN)
HYGPAFVTF

SEQ ID NO: 191134 - protein, 10 aa, Artificial Sequence
  Description of Artificial Sequence: Synthetic peptide
  Seed: RELWPRKFFH (TYRP2_HUMAN)
RALWPRKFFH

SEQ ID NO: 191135 - protein, 9 aa, Artificial Sequence
  Description of Artificial Sequence: Synthetic peptide
  Seed: RKFFHRTCK (TYRP2_HUMAN)
RAFFHRTCY

SEQ ID NO: 191136 - protein, 9 aa, Artificial Sequence
  Description of Artificial Sequence: Synthetic peptide
  Seed: HQGPAFVTW (TYRP2_HUMAN)
HKGPAFVTM

SEQ ID NO: 191137 - protein, 10 aa, Artificial Sequence
  Description of Artificial Sequence: Synthetic peptide
  Seed: FPPVTNEELF (TYRP2_HUMAN)
FCPVTNEELF

SEQ ID NO: 191138 - protein, 10 aa, Artificial Sequence
  Description of Artificial Sequence: Synthetic peptide
  Seed: DAIFDEWMKR (TYRP2_HUMAN)
DVIFDEWMKK

SEQ ID NO: 191139 - protein, 9 aa, Artificial Sequence
  Description of Artificial Sequence: Synthetic peptide
  Seed: RLRKGYTPL (TYRP2_HUMAN)
RIRKGYTPN

SEQ ID NO: 191140 - protein, 9 aa, Artificial Sequence
  Description of Artificial Sequence: Synthetic peptide
  Seed: STFSFRNAL (TYRP2_HUMAN)
SFFSFRNAF

SEQ ID NO: 191141 - protein, 9 aa, Artificial Sequence
  Description of Artificial Sequence: Synthetic peptide
  Seed: HQGPAFVTW (TYRP2_HUMAN)
HTGPAFVTI

SEQ ID NO: 191142 - protein, 10 aa, Artificial Sequence
  Description of Artificial Sequence: Synthetic peptide
  Seed: RNSRFSSWET (TYRP2_HUMAN)
RTSRFSSWEM

SEQ ID NO: 191143 - protein, 11 aa, Artificial Sequence
  Description of Artificial Sequence: Synthetic peptide
  Seed: MYNMVPFFPPV (TYRP2_HUMAN)
MFNMVPFFPPL

SEQ ID NO: 191144 - protein, 9 aa, Artificial Sequence
  Description of Artificial Sequence: Synthetic peptide
  Seed: HSAANDPIF (TYRP2_HUMAN)
HMAANDPIM

SEQ ID NO: 191145 - protein, 9 aa, Artificial Sequence
  Description of Artificial Sequence: Synthetic peptide
  Seed: MSPLWWGFL (TYRP2_HUMAN)
MSPLWWGFY

SEQ ID NO: 191146 - protein, 9 aa, Artificial Sequence
  Description of Artificial Sequence: Synthetic peptide
  Seed: DDYNHLVTL (TYRP2_HUMAN)
DHYNHLVTC

SEQ ID NO: 191147 - protein, 9 aa, Artificial Sequence
  Description of Artificial Sequence: Synthetic peptide
  Seed: ISRNSRFSS (TYRP2_HUMAN)
IVRNSRFSA

SEQ ID NO: 191148 - protein, 10 aa, Artificial Sequence
  Description of Artificial Sequence: Synthetic peptide
  Seed: LVVMGTLVAL (TYRP2_HUMAN)
LLVMGTLVAI

SEQ ID NO: 191149 - protein, 9 aa, Artificial Sequence
  Description of Artificial Sequence: Synthetic peptide
  Seed: RLGAESANV (TYRP2_HUMAN)
RMGAESANV

SEQ ID NO: 191150 - protein, 9 aa, Artificial Sequence
  Description of Artificial Sequence: Synthetic peptide
  Seed: WPTTLLVVM (TYRP2_HUMAN)
WHTTLLVVM

SEQ ID NO: 191151 - protein, 9 aa, Artificial Sequence
  Description of Artificial Sequence: Synthetic peptide
  Seed: NALEGFDKA (TYRP2_HUMAN)
NSLEGFDKV

SEQ ID NO: 191152 - protein, 9 aa, Artificial Sequence
  Description of Artificial Sequence: Synthetic peptide
  Seed: WPTTLLVVM (TYRP2_HUMAN)
WPTTLLVVI

SEQ ID NO: 191153 - protein, 9 aa, Artificial Sequence
  Description of Artificial Sequence: Synthetic peptide
  Seed: YYSVRDTLL (TYRP2_HUMAN)
YTSVRDTLM

SEQ ID NO: 191154 - protein, 10 aa, Artificial Sequence
  Description of Artificial Sequence: Synthetic peptide
  Seed: TLLGPGRPYR (TYRP2_HUMAN)
TFLGPGRPYR

SEQ ID NO: 191155 - protein, 10 aa, Artificial Sequence
  Description of Artificial Sequence: Synthetic peptide
  Seed: LISRNSRFSS (TYRP2_HUMAN)
LKSRNSRFSK

SEQ ID NO: 191156 - protein, 11 aa, Artificial Sequence
  Description of Artificial Sequence: Synthetic peptide
  Seed: RMYNMVPFFPP (TYRP2_HUMAN)
RLYNMVPFFPM

SEQ ID NO: 191157 - protein, 9 aa, Artificial Sequence
  Description of Artificial Sequence: Synthetic peptide
  Seed: QFPRVCMTV (TYRP2_HUMAN)
QYPRVCMTF

SEQ ID NO: 191158 - protein, 11 aa, Artificial Sequence
  Description of Artificial Sequence: Synthetic peptide
  Seed: HPDYVITTQHW (TYRP2_HUMAN)
HLDYVITTQHF

SEQ ID NO: 191159 - protein, 9 aa, Artificial Sequence
  Description of Artificial Sequence: Synthetic peptide
  Seed: FFQNSTFSF (TYRP2_HUMAN)
FIQNSTFSF

SEQ ID NO: 191160 - protein, 9 aa, Artificial Sequence
  Description of Artificial Sequence: Synthetic peptide
  Seed: VIRQNIHSL (TYRP2_HUMAN)
VLRQNIHSF

SEQ ID NO: 191161 - protein, 9 aa, Artificial Sequence
  Description of Artificial Sequence: Synthetic peptide
  Seed: VTWHRYHLL (TYRP2_HUMAN)
VLWHRYHLV

SEQ ID NO: 191162 - protein, 8 aa, Artificial Sequence
  Description of Artificial Sequence: Synthetic peptide
  Seed: FLGALDLA (TYRP2_HUMAN)
FMGALDLV

SEQ ID NO: 191163 - protein, 9 aa, Artificial Sequence
  Description of Artificial Sequence: Synthetic peptide
  Seed: FANCSVYDF (TYRP2_HUMAN)
FYNCSVYDF

SEQ ID NO: 191164 - protein, 9 aa, Artificial Sequence
  Description of Artificial Sequence: Synthetic peptide
  Seed: DQLGYSYAI (TYRP2_HUMAN)
DQLGYSYAL

SEQ ID NO: 191165 - protein, 9 aa, Artificial Sequence
  Description of Artificial Sequence: Synthetic peptide
  Seed: ANDPIFVVL (TYRP2_HUMAN)
AYDPIFVVC

SEQ ID NO: 191166 - protein, 10 aa, Artificial Sequence
  Description of Artificial Sequence: Synthetic peptide
  Seed: RLIGNESFAL (TYRP2_HUMAN)
RTIGNESFAW

SEQ ID NO: 191167 - protein, 10 aa, Artificial Sequence
  Description of Artificial Sequence: Synthetic peptide
  Seed: SAANDPIFVV (TYRP2_HUMAN)
SMANDPIFVA

SEQ ID NO: 191168 - protein, 9 aa, Artificial Sequence
  Description of Artificial Sequence: Synthetic peptide
  Seed: TLLGPGRPY (TYRP2_HUMAN)
TSLGPGRPI

SEQ ID NO: 191169 - protein, 11 aa, Artificial Sequence
  Description of Artificial Sequence: Synthetic peptide
  Seed: FFPPVTNEELF (TYRP2_HUMAN)
FYPPVTNEELL

SEQ ID NO: 191170 - protein, 9 aa, Artificial Sequence
  Description of Artificial Sequence: Synthetic peptide
  Seed: AGYNCGDCK (TYRP2_HUMAN)
ATYNCGDCK

SEQ ID NO: 191171 - protein, 10 aa, Artificial Sequence
  Description of Artificial Sequence: Synthetic peptide
  Seed: RLIGNESFAL (TYRP2_HUMAN)
RQIGNESFAV

SEQ ID NO: 191172 - protein, 9 aa, Artificial Sequence
  Description of Artificial Sequence: Synthetic peptide
  Seed: RLRKGYTPL (TYRP2_HUMAN)
RVRKGYTPQ

SEQ ID NO: 191173 - protein, 11 aa, Artificial Sequence
  Description of Artificial Sequence: Synthetic peptide
  Seed: SLDDYNHLVTL (TYRP2_HUMAN)
SLDDYNHLVTM

SEQ ID NO: 191174 - protein, 9 aa, Artificial Sequence
  Description of Artificial Sequence: Synthetic peptide
  Seed: NSMKLPTLK (TYRP2_HUMAN)
NAMKLPTLY

SEQ ID NO: 191175 - protein, 10 aa, Artificial Sequence
  Description of Artificial Sequence: Synthetic peptide
  Seed: FLLSCLGCKI (TYRP2_HUMAN)
FNLSCLGCKL

SEQ ID NO: 191176 - protein, 10 aa, Artificial Sequence
  Description of Artificial Sequence: Synthetic peptide
  Seed: HSAANDPIFV (TYRP2_HUMAN)
HMAANDPIFI

SEQ ID NO: 191177 - protein, 11 aa, Artificial Sequence
  Description of Artificial Sequence: Synthetic peptide
  Seed: HSLSPQEREQF (TYRP2_HUMAN)
HTLSPQEREQF

SEQ ID NO: 191178 - protein, 10 aa, Artificial Sequence
  Description of Artificial Sequence: Synthetic peptide
  Seed: RRLRKGYTPL (TYRP2_HUMAN)
RHLRKGYTPK

SEQ ID NO: 191179 - protein, 9 aa, Artificial Sequence
  Description of Artificial Sequence: Synthetic peptide
  Seed: RFNPPADAW (TYRP2_HUMAN)
RMNPPADAL

SEQ ID NO: 191180 - protein, 9 aa, Artificial Sequence
  Description of Artificial Sequence: Synthetic peptide
  Seed: FLLSCLGCK (TYRP2_HUMAN)
FALSCLGCR

SEQ ID NO: 191181 - protein, 10 aa, Artificial Sequence
  Description of Artificial Sequence: Synthetic peptide
  Seed: RPDDPTLISR (TYRP2_HUMAN)
RVDDPTLISY

SEQ ID NO: 191182 - protein, 10 aa, Artificial Sequence
  Description of Artificial Sequence: Synthetic peptide
  Seed: SLVNKECCPR (TYRP2_HUMAN)
SAVNKECCPR

SEQ ID NO: 191183 - protein, 10 aa, Artificial Sequence
  Description of Artificial Sequence: Synthetic peptide
  Seed: RRLRKGYTPL (TYRP2_HUMAN)
RRLRKGYTPM

SEQ ID NO: 191184 - protein, 9 aa, Artificial Sequence
  Description of Artificial Sequence: Synthetic peptide
  Seed: YAIDLPVSV (TYRP2_HUMAN)
YGIDLPVSI

SEQ ID NO: 191185 - protein, 9 aa, Artificial Sequence
  Description of Artificial Sequence: Synthetic peptide
  Seed: VVMGTLVAL (TYRP2_HUMAN)
VGMGTLVAF

SEQ ID NO: 191186 - protein, 10 aa, Artificial Sequence
  Description of Artificial Sequence: Synthetic peptide
  Seed: RMYNMVPFFP (TYRP2_HUMAN)
RQYNMVPFFC

SEQ ID NO: 191187 - protein, 10 aa, Artificial Sequence
  Description of Artificial Sequence: Synthetic peptide
  Seed: TVDSLVNKEC (TYRP2_HUMAN)
TMDSLVNKEM

SEQ ID NO: 191188 - protein, 9 aa, Artificial Sequence
  Description of Artificial Sequence: Synthetic peptide
  Seed: FFQNSTFSF (TYRP2_HUMAN)
FQQNSTFSY

SEQ ID NO: 191189 - protein, 9 aa, Artificial Sequence
  Description of Artificial Sequence: Synthetic peptide
  Seed: TLLGPGRPY (TYRP2_HUMAN)
TQLGPGRPY

SEQ ID NO: 191190 - protein, 9 aa, Artificial Sequence
  Description of Artificial Sequence: Synthetic peptide
  Seed: TLDSQVMSL (TYRP2_HUMAN)
TNDSQVMSM

SEQ ID NO: 191191 - protein, 9 aa, Artificial Sequence
  Description of Artificial Sequence: Synthetic peptide
  Seed: VGLFVLLAF (TYRP2_HUMAN)
VTLFVLLAF

SEQ ID NO: 191192 - protein, 8 aa, Artificial Sequence
  Description of Artificial Sequence: Synthetic peptide
  Seed: YYSVRDTL (TYRP2_HUMAN)
YYSVRDTY

SEQ ID NO: 191193 - protein, 9 aa, Artificial Sequence
  Description of Artificial Sequence: Synthetic peptide
  Seed: YSVRDTLLG (TYRP2_HUMAN)
YSVRDTLLW

SEQ ID NO: 191194 - protein, 9 aa, Artificial Sequence
  Description of Artificial Sequence: Synthetic peptide
  Seed: RMYNMVPFF (TYRP2_HUMAN)
RWYNMVPFH

SEQ ID NO: 191195 - protein, 11 aa, Artificial Sequence
  Description of Artificial Sequence: Synthetic peptide
  Seed: YTPLMETHLSS (TYRP2_HUMAN)
YQPLMETHLSL

SEQ ID NO: 191196 - protein, 9 aa, Artificial Sequence
  Description of Artificial Sequence: Synthetic peptide
  Seed: VIRQNIHSL (TYRP2_HUMAN)
VRRQNIHSL

SEQ ID NO: 191197 - protein, 9 aa, Artificial Sequence
  Description of Artificial Sequence: Synthetic peptide
  Seed: RKFFHRTCK (TYRP2_HUMAN)
RTFFHRTCF

SEQ ID NO: 191198 - protein, 9 aa, Artificial Sequence
  Description of Artificial Sequence: Synthetic peptide
  Seed: ADAWPQELA (TYRP2_HUMAN)
AEAWPQELP

SEQ ID NO: 191199 - protein, 11 aa, Artificial Sequence
  Description of Artificial Sequence: Synthetic peptide
  Seed: YTPLMETHLSS (TYRP2_HUMAN)
YMPLMETHLSV

SEQ ID NO: 191200 - protein, 10 aa, Artificial Sequence
  Description of Artificial Sequence: Synthetic peptide
  Seed: NLVHSFLNGT (TYRP2_HUMAN)
NQVHSFLNGV

SEQ ID NO: 191201 - protein, 9 aa, Artificial Sequence
  Description of Artificial Sequence: Synthetic peptide
  Seed: DDYNHLVTL (TYRP2_HUMAN)
DEYNHLVTM

SEQ ID NO: 191202 - protein, 10 aa, Artificial Sequence
  Description of Artificial Sequence: Synthetic peptide
  Seed: RNSRFSSWET (TYRP2_HUMAN)
RQSRFSSWEM

SEQ ID NO: 191203 - protein, 10 aa, Artificial Sequence
  Description of Artificial Sequence: Synthetic peptide
  Seed: LVVMGTLVAL (TYRP2_HUMAN)
LHVMGTLVAL

SEQ ID NO: 191204 - protein, 9 aa, Artificial Sequence
  Description of Artificial Sequence: Synthetic peptide
  Seed: ANDPIFVVL (TYRP2_HUMAN)
AEDPIFVVL

SEQ ID NO: 191205 - protein, 9 aa, Artificial Sequence
  Description of Artificial Sequence: Synthetic peptide
  Seed: FSHQGPAFV (TYRP2_HUMAN)
FLHQGPAFT

SEQ ID NO: 191206 - protein, 10 aa, Artificial Sequence
  Description of Artificial Sequence: Synthetic peptide
  Seed: IGNESFALPY (TYRP2_HUMAN)
IMNESFALPF

SEQ ID NO: 191207 - protein, 9 aa, Artificial Sequence
  Description of Artificial Sequence: Synthetic peptide
  Seed: VLHSFTDAI (TYRP2_HUMAN)
VVHSFTDAV

SEQ ID NO: 191208 - protein, 9 aa, Artificial Sequence
  Description of Artificial Sequence: Synthetic peptide
  Seed: NMVPFFPPV (TYRP2_HUMAN)
NFVPFFPPI

SEQ ID NO: 191209 - protein, 9 aa, Artificial Sequence
  Description of Artificial Sequence: Synthetic peptide
  Seed: YAIDLPVSV (TYRP2_HUMAN)
YVIDLPVSF

SEQ ID NO: 191210 - protein, 9 aa, Artificial Sequence
  Description of Artificial Sequence: Synthetic peptide
  Seed: VALVGLFVL (TYRP2_HUMAN)
VTLVGLFVY

SEQ ID NO: 191211 - protein, 9 aa, Artificial Sequence
  Description of Artificial Sequence: Synthetic peptide
  Seed: WMKRFNPPA (TYRP2_HUMAN)
WQKRFNPPH

SEQ ID NO: 191212 - protein, 10 aa, Artificial Sequence
  Description of Artificial Sequence: Synthetic peptide
  Seed: HNRMYNMVPF (TYRP2_HUMAN)
HSRMYNMVPF

SEQ ID NO: 191213 - protein, 9 aa, Artificial Sequence
  Description of Artificial Sequence: Synthetic peptide
  Seed: STFSFRNAL (TYRP2_HUMAN)
SIFSFRNAM

SEQ ID NO: 191214 - protein, 10 aa, Artificial Sequence
  Description of Artificial Sequence: Synthetic peptide
  Seed: TDAIFDEWMK (TYRP2_HUMAN)
TIAIFDEWMK

SEQ ID NO: 191215 - protein, 10 aa, Artificial Sequence
  Description of Artificial Sequence: Synthetic peptide
  Seed: FFPPVTNEEL (TYRP2_HUMAN)
FIPPVTNEEL

SEQ ID NO: 191216 - protein, 10 aa, Artificial Sequence
  Description of Artificial Sequence: Synthetic peptide
  Seed: QELAPIGHNR (TYRP2_HUMAN)
QELAPIGHNY

SEQ ID NO: 191217 - protein, 10 aa, Artificial Sequence
  Description of Artificial Sequence: Synthetic peptide
  Seed: LHYYSVRDTL (TYRP2_HUMAN)
LFYYSVRDTY

SEQ ID NO: 191218 - protein, 9 aa, Artificial Sequence
  Description of Artificial Sequence: Synthetic peptide
  Seed: SFALPYWNF (TYRP2_HUMAN)
SFALPYWNL

SEQ ID NO: 191219 - protein, 9 aa, Artificial Sequence
  Description of Artificial Sequence: Synthetic peptide
  Seed: FTDAIFDEW (TYRP2_HUMAN)
FPDAIFDEL

SEQ ID NO: 191220 - protein, 10 aa, Artificial Sequence
  Description of Artificial Sequence: Synthetic peptide
  Seed: ETPGWPTTLL (TYRP2_HUMAN)
EVPGWPTTLR

SEQ ID NO: 191221 - protein, 9 aa, Artificial Sequence
  Description of Artificial Sequence: Synthetic peptide
  Seed: GNESFALPY (TYRP2_HUMAN)
GQESFALPF

SEQ ID NO: 191222 - protein, 9 aa, Artificial Sequence
  Description of Artificial Sequence: Synthetic peptide
  Seed: HQGPAFVTW (TYRP2_HUMAN)
HVGPAFVTL

SEQ ID NO: 191223 - protein, 9 aa, Artificial Sequence
  Description of Artificial Sequence: Synthetic peptide
  Seed: HYYSVRDTL (TYRP2_HUMAN)
HFYSVRDTL

SEQ ID NO: 191224 - protein, 9 aa, Artificial Sequence
  Description of Artificial Sequence: Synthetic peptide
  Seed: HYYSVRDTL (TYRP2_HUMAN)
HMYSVRDTM

SEQ ID NO: 191225 - protein, 10 aa, Artificial Sequence
  Description of Artificial Sequence: Synthetic peptide
  Seed: KILPGAQGQF (TYRP2_HUMAN)
KILPGAQGQY

SEQ ID NO: 191226 - protein, 10 aa, Artificial Sequence
  Description of Artificial Sequence: Synthetic peptide
  Seed: SPLWWGFLLS (TYRP2_HUMAN)
SELWWGFLLL

SEQ ID NO: 191227 - protein, 9 aa, Artificial Sequence
  Description of Artificial Sequence: Synthetic peptide
  Seed: YSVRDTLLG (TYRP2_HUMAN)
YLVRDTLLW

SEQ ID NO: 191228 - protein, 10 aa, Artificial Sequence
  Description of Artificial Sequence: Synthetic peptide
  Seed: RRLRKGYTPL (TYRP2_HUMAN)
RVLRKGYTPY

SEQ ID NO: 191229 - protein, 9 aa, Artificial Sequence
  Description of Artificial Sequence: Synthetic peptide
  Seed: YSYAIDLPV (TYRP2_HUMAN)
YNYAIDLPY

SEQ ID NO: 191230 - protein, 9 aa, Artificial Sequence
  Description of Artificial Sequence: Synthetic peptide
  Seed: VIRQNIHSL (TYRP2_HUMAN)
VQRQNIHSV

SEQ ID NO: 191231 - protein, 10 aa, Artificial Sequence
  Description of Artificial Sequence: Synthetic peptide
  Seed: VVLHSFTDAI (TYRP2_HUMAN)
VTLHSFTDAL

SEQ ID NO: 191232 - protein, 9 aa, Artificial Sequence
  Description of Artificial Sequence: Synthetic peptide
  Seed: RQNIHSLSP (TYRP2_HUMAN)
RKNIHSLSM

SEQ ID NO: 191233 - protein, 11 aa, Artificial Sequence
  Description of Artificial Sequence: Synthetic peptide
  Seed: VCMTVDSLVNK (TYRP2_HUMAN)
VTMTVDSLVNR

SEQ ID NO: 191234 - protein, 9 aa, Artificial Sequence
  Description of Artificial Sequence: Synthetic peptide
  Seed: SRNSRFSSW (TYRP2_HUMAN)
SKNSRFSSM

SEQ ID NO: 191235 - protein, 9 aa, Artificial Sequence
  Description of Artificial Sequence: Synthetic peptide
  Seed: VTWHRYHLL (TYRP2_HUMAN)
VLWHRYHLM

SEQ ID NO: 191236 - protein, 9 aa, Artificial Sequence
  Description of Artificial Sequence: Synthetic peptide
  Seed: ETPGWPTTL (TYRP2_HUMAN)
EMPGWPTTR

SEQ ID NO: 191237 - protein, 9 aa, Artificial Sequence
  Description of Artificial Sequence: Synthetic peptide
  Seed: RNQMGRNSM (TYRP2_HUMAN)
RSQMGRNSF

SEQ ID NO: 191238 - protein, 9 aa, Artificial Sequence
  Description of Artificial Sequence: Synthetic peptide
  Seed: IFDEWMKRF (TYRP2_HUMAN)
IVDEWMKRI

SEQ ID NO: 191239 - protein, 9 aa, Artificial Sequence
  Description of Artificial Sequence: Synthetic peptide
  Seed: DAIFDEWMK (TYRP2_HUMAN)
DIIFDEWMR

SEQ ID NO: 191240 - protein, 9 aa, Artificial Sequence
  Description of Artificial Sequence: Synthetic peptide
  Seed: NMVPFFPPV (TYRP2_HUMAN)
NFVPFFPPV

SEQ ID NO: 191241 - protein, 10 aa, Artificial Sequence
  Description of Artificial Sequence: Synthetic peptide
  Seed: FFQNSTFSFR (TYRP2_HUMAN)
FYQNSTFSFG

SEQ ID NO: 191242 - protein, 10 aa, Artificial Sequence
  Description of Artificial Sequence: Synthetic peptide
  Seed: MSLHNLVHSF (TYRP2_HUMAN)
MKLHNLVHSY

SEQ ID NO: 191243 - protein, 10 aa, Artificial Sequence
  Description of Artificial Sequence: Synthetic peptide
  Seed: MTVDSLVNKE (TYRP2_HUMAN)
MPVDSLVNKR

SEQ ID NO: 191244 - protein, 10 aa, Artificial Sequence
  Description of Artificial Sequence: Synthetic peptide
  Seed: NGTYEGLLRR (TYRP2_HUMAN)
NNTYEGLLRK

SEQ ID NO: 191245 - protein, 10 aa, Artificial Sequence
  Description of Artificial Sequence: Synthetic peptide
  Seed: HSFLNGTNAL (TYRP2_HUMAN)
HMFLNGTNAM

SEQ ID NO: 191246 - protein, 10 aa, Artificial Sequence
  Description of Artificial Sequence: Synthetic peptide
  Seed: NLVHSFLNGT (TYRP2_HUMAN)
NVVHSFLNGV

SEQ ID NO: 191247 - protein, 10 aa, Artificial Sequence
  Description of Artificial Sequence: Synthetic peptide
  Seed: QPQFANCSVY (TYRP2_HUMAN)
QSQFANCSVM

SEQ ID NO: 191248 - protein, 10 aa, Artificial Sequence
  Description of Artificial Sequence: Synthetic peptide
  Seed: SPLWWGFLLS (TYRP2_HUMAN)
SFLWWGFLLI

SEQ ID NO: 191249 - protein, 11 aa, Artificial Sequence
  Description of Artificial Sequence: Synthetic peptide
  Seed: WLHYYSVRDTL (TYRP2_HUMAN)
WCHYYSVRDTW

SEQ ID NO: 191250 - protein, 9 aa, Artificial Sequence
  Description of Artificial Sequence: Synthetic peptide
  Seed: FTDAIFDEW (TYRP2_HUMAN)
FIDAIFDEI

SEQ ID NO: 191251 - protein, 11 aa, Artificial Sequence
  Description of Artificial Sequence: Synthetic peptide
  Seed: FANCSVYDFFV (TYRP2_HUMAN)
FMNCSVYDFFV

SEQ ID NO: 191252 - protein, 9 aa, Artificial Sequence
  Description of Artificial Sequence: Synthetic peptide
  Seed: IFDEWMKRF (TYRP2_HUMAN)
ILDEWMKRV

SEQ ID NO: 191253 - protein, 9 aa, Artificial Sequence
  Description of Artificial Sequence: Synthetic peptide
  Seed: VTWHRYHLL (TYRP2_HUMAN)
VMWHRYHLK

SEQ ID NO: 191254 - protein, 9 aa, Artificial Sequence
  Description of Artificial Sequence: Synthetic peptide
  Seed: VMSLHNLVH (TYRP2_HUMAN)
VISLHNLVF

SEQ ID NO: 191255 - protein, 11 aa, Artificial Sequence
  Description of Artificial Sequence: Synthetic peptide
  Seed: YNMVPFFPPVT (TYRP2_HUMAN)
YIMVPFFPPVG

SEQ ID NO: 191256 - protein, 8 aa, Artificial Sequence
  Description of Artificial Sequence: Synthetic peptide
  Seed: RPYRAIDF (TYRP2_HUMAN)
RPYRAIDM

SEQ ID NO: 191257 - protein, 9 aa, Artificial Sequence
  Description of Artificial Sequence: Synthetic peptide
  Seed: VVMGTLVAL (TYRP2_HUMAN)
VPMGTLVAL

SEQ ID NO: 191258 - protein, 9 aa, Artificial Sequence
  Description of Artificial Sequence: Synthetic peptide
  Seed: NALEGFDKA (TYRP2_HUMAN)
NALEGFDKV

SEQ ID NO: 191259 - protein, 10 aa, Artificial Sequence
  Description of Artificial Sequence: Synthetic peptide
  Seed: QGPAFVTWHR (TYRP2_HUMAN)
QMPAFVTWHR

SEQ ID NO: 191260 - protein, 11 aa, Artificial Sequence
  Description of Artificial Sequence: Synthetic peptide
  Seed: YTPLMETHLSS (TYRP2_HUMAN)
YKPLMETHLSV

SEQ ID NO: 191261 - protein, 10 aa, Artificial Sequence
  Description of Artificial Sequence: Synthetic peptide
  Seed: SYAIDLPVSV (TYRP2_HUMAN)
SLAIDLPVSI

SEQ ID NO: 191262 - protein, 9 aa, Artificial Sequence
  Description of Artificial Sequence: Synthetic peptide
  Seed: SFALPYWNF (TYRP2_HUMAN)
SWALPYWNM

SEQ ID NO: 191263 - protein, 10 aa, Artificial Sequence
  Description of Artificial Sequence: Synthetic peptide
  Seed: LRNQDDRELW (TYRP2_HUMAN)
LVNQDDRELW

SEQ ID NO: 191264 - protein, 11 aa, Artificial Sequence
  Description of Artificial Sequence: Synthetic peptide
  Seed: HQGPAFVTWHR (TYRP2_HUMAN)
HAGPAFVTWHK

SEQ ID NO: 191265 - protein, 9 aa, Artificial Sequence
  Description of Artificial Sequence: Synthetic peptide
  Seed: YVITTQHWL (TYRP2_HUMAN)
YVITTQHWR

SEQ ID NO: 191266 - protein, 9 aa, Artificial Sequence
  Description of Artificial Sequence: Synthetic peptide
  Seed: FFQNSTFSF (TYRP2_HUMAN)
FPQNSTFSS

SEQ ID NO: 191267 - protein, 11 aa, Artificial Sequence
  Description of Artificial Sequence: Synthetic peptide
  Seed: ESFALPYWNFA (TYRP2_HUMAN)
EAFALPYWNFV

SEQ ID NO: 191268 - protein, 10 aa, Artificial Sequence
  Description of Artificial Sequence: Synthetic peptide
  Seed: FFQNSTFSFR (TYRP2_HUMAN)
FYQNSTFSFD

SEQ ID NO: 191269 - protein, 10 aa, Artificial Sequence
  Description of Artificial Sequence: Synthetic peptide
  Seed: VVLHSFTDAI (TYRP2_HUMAN)
VRLHSFTDAL

SEQ ID NO: 191270 - protein, 9 aa, Artificial Sequence
  Description of Artificial Sequence: Synthetic peptide
  Seed: FQNSTFSFR (TYRP2_HUMAN)
FYNSTFSFY

SEQ ID NO: 191271 - protein, 10 aa, Artificial Sequence
  Description of Artificial Sequence: Synthetic peptide
  Seed: HSFLNGTNAL (TYRP2_HUMAN)
HNFLNGTNAM

SEQ ID NO: 191272 - protein, 10 aa, Artificial Sequence
  Description of Artificial Sequence: Synthetic peptide
  Seed: VVMGTLVALV (TYRP2_HUMAN)
VEMGTLVALV

SEQ ID NO: 191273 - protein, 11 aa, Artificial Sequence
  Description of Artificial Sequence: Synthetic peptide
  Seed: RLIGNESFALP (TYRP2_HUMAN)
RMIGNESFALV

SEQ ID NO: 191274 - protein, 9 aa, Artificial Sequence
  Description of Artificial Sequence: Synthetic peptide
  Seed: EQFLGALDL (TYRP2_HUMAN)
EHFLGALDV

SEQ ID NO: 191275 - protein, 9 aa, Artificial Sequence
  Description of Artificial Sequence: Synthetic peptide
  Seed: AANDPIFVV (TYRP2_HUMAN)
APNDPIFVM

SEQ ID NO: 191276 - protein, 9 aa, Artificial Sequence
  Description of Artificial Sequence: Synthetic peptide
  Seed: RNQMGRNSM (TYRP2_HUMAN)
RLQMGRNSF

SEQ ID NO: 191277 - protein, 11 aa, Artificial Sequence
  Description of Artificial Sequence: Synthetic peptide
  Seed: LPHSAANDPIF (TYRP2_HUMAN)
LTHSAANDPIW

SEQ ID NO: 191278 - protein, 9 aa, Artificial Sequence
  Description of Artificial Sequence: Synthetic peptide
  Seed: RLRKGYTPL (TYRP2_HUMAN)
RARKGYTPL

SEQ ID NO: 191279 - protein, 10 aa, Artificial Sequence
  Description of Artificial Sequence: Synthetic peptide
  Seed: FLLSCLGCKI (TYRP2_HUMAN)
FGLSCLGCKV

SEQ ID NO: 191280 - protein, 11 aa, Artificial Sequence
  Description of Artificial Sequence: Synthetic peptide
  Seed: VVMGTLVALVG (TYRP2_HUMAN)
VMMGTLVALVV

SEQ ID NO: 191281 - protein, 9 aa, Artificial Sequence
  Description of Artificial Sequence: Synthetic peptide
  Seed: AANDPIFVV (TYRP2_HUMAN)
ASNDPIFVI

SEQ ID NO: 191282 - protein, 10 aa, Artificial Sequence
  Description of Artificial Sequence: Synthetic peptide
  Seed: VVMGTLVALV (TYRP2_HUMAN)
VLMGTLVALE

SEQ ID NO: 191283 - protein, 10 aa, Artificial Sequence
  Description of Artificial Sequence: Synthetic peptide
  Seed: SPLWWGFLLS (TYRP2_HUMAN)
SVLWWGFLLI

SEQ ID NO: 191284 - protein, 9 aa, Artificial Sequence
  Description of Artificial Sequence: Synthetic peptide
  Seed: VHPDYVITT (TYRP2_HUMAN)
VYPDYVITL

SEQ ID NO: 191285 - protein, 11 aa, Artificial Sequence
  Description of Artificial Sequence: Synthetic peptide
  Seed: SLDDYNHLVTL (TYRP2_HUMAN)
SFDDYNHLVTM

SEQ ID NO: 191286 - protein, 9 aa, Artificial Sequence
  Description of Artificial Sequence: Synthetic peptide
  Seed: ISRNSRFSS (TYRP2_HUMAN)
IARNSRFSA

SEQ ID NO: 191287 - protein, 10 aa, Artificial Sequence
  Description of Artificial Sequence: Synthetic peptide
  Seed: SDQLGYSYAI (TYRP2_HUMAN)
SKQLGYSYAV

SEQ ID NO: 191288 - protein, 11 aa, Artificial Sequence
  Description of Artificial Sequence: Synthetic peptide
  Seed: ALPYWNFATGR (TYRP2_HUMAN)
ARPYWNFATGR

SEQ ID NO: 191289 - protein, 9 aa, Artificial Sequence
  Description of Artificial Sequence: Synthetic peptide
  Seed: NMVPFFPPV (TYRP2_HUMAN)
NAVPFFPPI

SEQ ID NO: 191290 - protein, 10 aa, Artificial Sequence
  Description of Artificial Sequence: Synthetic peptide
  Seed: CCPRLGAESA (TYRP2_HUMAN)
CQPRLGAESL

SEQ ID NO: 191291 - protein, 9 aa, Artificial Sequence
  Description of Artificial Sequence: Synthetic peptide
  Seed: YSYAIDLPV (TYRP2_HUMAN)
YPYAIDLPH

SEQ ID NO: 191292 - protein, 10 aa, Artificial Sequence
  Description of Artificial Sequence: Synthetic peptide
  Seed: YDFFVWLHYY (TYRP2_HUMAN)
YVFFVWLHYM

SEQ ID NO: 191293 - protein, 10 aa, Artificial Sequence
  Description of Artificial Sequence: Synthetic peptide
  Seed: GRNSMKLPTL (TYRP2_HUMAN)
GRNSMKLPTM

SEQ ID NO: 191294 - protein, 10 aa, Artificial Sequence
  Description of Artificial Sequence: Synthetic peptide
  Seed: RNSRFSSWET (TYRP2_HUMAN)
RHSRFSSWEK

SEQ ID NO: 191295 - protein, 9 aa, Artificial Sequence
  Description of Artificial Sequence: Synthetic peptide
  Seed: GTYEGLLRR (TYRP2_HUMAN)
GGYEGLLRY

SEQ ID NO: 191296 - protein, 9 aa, Artificial Sequence
  Description of Artificial Sequence: Synthetic peptide
  Seed: QVMSLHNLV (TYRP2_HUMAN)
QTMSLHNLV

SEQ ID NO: 191297 - protein, 9 aa, Artificial Sequence
  Description of Artificial Sequence: Synthetic peptide
  Seed: FTDAIFDEW (TYRP2_HUMAN)
FPDAIFDEI

SEQ ID NO: 191298 - protein, 10 aa, Artificial Sequence
  Description of Artificial Sequence: Synthetic peptide
  Seed: RRLRKGYTPL (TYRP2_HUMAN)
RPLRKGYTPK

SEQ ID NO: 191299 - protein, 10 aa, Artificial Sequence
  Description of Artificial Sequence: Synthetic peptide
  Seed: RNQMGRNSMK (TYRP2_HUMAN)
RNQMGRNSMR

SEQ ID NO: 191300 - protein, 9 aa, Artificial Sequence
  Description of Artificial Sequence: Synthetic peptide
  Seed: SFLNGTNAL (TYRP2_HUMAN)
SALNGTNAH

SEQ ID NO: 191301 - protein, 10 aa, Artificial Sequence
  Description of Artificial Sequence: Synthetic peptide
  Seed: MTVDSLVNKE (TYRP2_HUMAN)
MTVDSLVNKK

SEQ ID NO: 191302 - protein, 9 aa, Artificial Sequence
  Description of Artificial Sequence: Synthetic peptide
  Seed: DTRPWSGPY (TYRP2_HUMAN)
DLRPWSGPR

SEQ ID NO: 191303 - protein, 11 aa, Artificial Sequence
  Description of Artificial Sequence: Synthetic peptide
  Seed: YTPLMETHLSS (TYRP2_HUMAN)
YNPLMETHLSA

SEQ ID NO: 191304 - protein, 10 aa, Artificial Sequence
  Description of Artificial Sequence: Synthetic peptide
  Seed: RELWPRKFFH (TYRP2_HUMAN)
RTLWPRKFFR

SEQ ID NO: 191305 - protein, 10 aa, Artificial Sequence
  Description of Artificial Sequence: Synthetic peptide
  Seed: LVVMGTLVAL (TYRP2_HUMAN)
LSVMGTLVAL

SEQ ID NO: 191306 - protein, 9 aa, Artificial Sequence
  Description of Artificial Sequence: Synthetic peptide
  Seed: FFPPVTNEE (TYRP2_HUMAN)
FTPPVTNEF

SEQ ID NO: 191307 - protein, 9 aa, Artificial Sequence
  Description of Artificial Sequence: Synthetic peptide
  Seed: YSYAIDLPV (TYRP2_HUMAN)
YVYAIDLPT

SEQ ID NO: 191308 - protein, 9 aa, Artificial Sequence
  Description of Artificial Sequence: Synthetic peptide
  Seed: WHRYHLLCL (TYRP2_HUMAN)
WQRYHLLCF

SEQ ID NO: 191309 - protein, 9 aa, Artificial Sequence
  Description of Artificial Sequence: Synthetic peptide
  Seed: RLRKGYTPL (TYRP2_HUMAN)
RARKGYTPM

SEQ ID NO: 191310 - protein, 9 aa, Artificial Sequence
  Description of Artificial Sequence: Synthetic peptide
  Seed: DQLGYSYAI (TYRP2_HUMAN)
DHLGYSYAF

SEQ ID NO: 191311 - protein, 9 aa, Artificial Sequence
  Description of Artificial Sequence: Synthetic peptide
  Seed: NMVPFFPPV (TYRP2_HUMAN)
NIVPFFPPV

SEQ ID NO: 191312 - protein, 9 aa, Artificial Sequence
  Description of Artificial Sequence: Synthetic peptide
  Seed: SLHNLVHSF (TYRP2_HUMAN)
SFHNLVHSW

SEQ ID NO: 191313 - protein, 9 aa, Artificial Sequence
  Description of Artificial Sequence: Synthetic peptide
  Seed: SFALPYWNF (TYRP2_HUMAN)
SSALPYWNY

SEQ ID NO: 191314 - protein, 8 aa, Artificial Sequence
  Description of Artificial Sequence: Synthetic peptide
  Seed: AIDLPVSV (TYRP2_HUMAN)
ATDLPVSV

SEQ ID NO: 191315 - protein, 8 aa, Artificial Sequence
  Description of Artificial Sequence: Synthetic peptide
  Seed: FSHQGPAF (TYRP2_HUMAN)
FTHQGPAI

SEQ ID NO: 191316 - protein, 9 aa, Artificial Sequence
  Description of Artificial Sequence: Synthetic peptide
  Seed: YSYAIDLPV (TYRP2_HUMAN)
YNYAIDLPL

SEQ ID NO: 191317 - protein, 9 aa, Artificial Sequence
  Description of Artificial Sequence: Synthetic peptide
  Seed: RNQDDRELW (TYRP2_HUMAN)
RIQDDRELW

SEQ ID NO: 191318 - protein, 9 aa, Artificial Sequence
  Description of Artificial Sequence: Synthetic peptide
  Seed: FFPPVTNEE (TYRP2_HUMAN)
FMPPVTNEI

SEQ ID NO: 191319 - protein, 9 aa, Artificial Sequence
  Description of Artificial Sequence: Synthetic peptide
  Seed: LLGPGRPYR (TYRP2_HUMAN)
LLGPGRPYK

SEQ ID NO: 191320 - protein, 9 aa, Artificial Sequence
  Description of Artificial Sequence: Synthetic peptide
  Seed: FTDAIFDEW (TYRP2_HUMAN)
FSDAIFDEF

SEQ ID NO: 191321 - protein, 10 aa, Artificial Sequence
  Description of Artificial Sequence: Synthetic peptide
  Seed: NSTFSFRNAL (TYRP2_HUMAN)
NATFSFRNAL

SEQ ID NO: 191322 - protein, 10 aa, Artificial Sequence
  Description of Artificial Sequence: Synthetic peptide
  Seed: YSYAIDLPVS (TYRP2_HUMAN)
YIYAIDLPVI

SEQ ID NO: 191323 - protein, 9 aa, Artificial Sequence
  Description of Artificial Sequence: Synthetic peptide
  Seed: YAIDLPVSV (TYRP2_HUMAN)
YSIDLPVSL

SEQ ID NO: 191324 - protein, 10 aa, Artificial Sequence
  Description of Artificial Sequence: Synthetic peptide
  Seed: MSPLWWGFLL (TYRP2_HUMAN)
MMPLWWGFLW

SEQ ID NO: 191325 - protein, 10 aa, Artificial Sequence
  Description of Artificial Sequence: Synthetic peptide
  Seed: LFVLLAFLQY (TYRP2_HUMAN)
LMVLLAFLQY

SEQ ID NO: 191326 - protein, 9 aa, Artificial Sequence
  Description of Artificial Sequence: Synthetic peptide
  Seed: NRMYNMVPF (TYRP2_HUMAN)
NQMYNMVPF

SEQ ID NO: 191327 - protein, 11 aa, Artificial Sequence
  Description of Artificial Sequence: Synthetic peptide
  Seed: TQPQFANCSVY (TYRP2_HUMAN)
TCPQFANCSVM

SEQ ID NO: 191328 - protein, 9 aa, Artificial Sequence
  Description of Artificial Sequence: Synthetic peptide
  Seed: WHRYHLLCL (TYRP2_HUMAN)
WKRYHLLCY

SEQ ID NO: 191329 - protein, 9 aa, Artificial Sequence
  Description of Artificial Sequence: Synthetic peptide
  Seed: RNSMKLPTL (TYRP2_HUMAN)
RSSMKLPTI

SEQ ID NO: 191330 - protein, 10 aa, Artificial Sequence
  Description of Artificial Sequence: Synthetic peptide
  Seed: KILPGAQGQF (TYRP2_HUMAN)
KQLPGAQGQF

SEQ ID NO: 191331 - protein, 10 aa, Artificial Sequence
  Description of Artificial Sequence: Synthetic peptide
  Seed: NCSVYDFFVW (TYRP2_HUMAN)
NFSVYDFFVW

SEQ ID NO: 191332 - protein, 9 aa, Artificial Sequence
  Description of Artificial Sequence: Synthetic peptide
  Seed: FVWLHYYSV (TYRP2_HUMAN)
FIWLHYYSM

SEQ ID NO: 191333 - protein, 9 aa, Artificial Sequence
  Description of Artificial Sequence: Synthetic peptide
  Seed: VTWHRYHLL (TYRP2_HUMAN)
VQWHRYHLY

SEQ ID NO: 191334 - protein, 9 aa, Artificial Sequence
  Description of Artificial Sequence: Synthetic peptide
  Seed: VMSLHNLVH (TYRP2_HUMAN)
VLSLHNLVM

SEQ ID NO: 191335 - protein, 9 aa, Artificial Sequence
  Description of Artificial Sequence: Synthetic peptide
  Seed: RLRKGYTPL (TYRP2_HUMAN)
RTRKGYTPS

SEQ ID NO: 191336 - protein, 10 aa, Artificial Sequence
  Description of Artificial Sequence: Synthetic peptide
  Seed: TRPWSGPYIL (TYRP2_HUMAN)
TFPWSGPYIF

SEQ ID NO: 191337 - protein, 8 aa, Artificial Sequence
  Description of Artificial Sequence: Synthetic peptide
  Seed: ANDPIFVV (TYRP2_HUMAN)
AVDPIFVL

SEQ ID NO: 191338 - protein, 10 aa, Artificial Sequence
  Description of Artificial Sequence: Synthetic peptide
  Seed: RNSMKLPTLK (TYRP2_HUMAN)
RVSMKLPTLK

SEQ ID NO: 191339 - protein, 9 aa, Artificial Sequence
  Description of Artificial Sequence: Synthetic peptide
  Seed: RLRKGYTPL (TYRP2_HUMAN)
RFRKGYTPP

SEQ ID NO: 191340 - protein, 11 aa, Artificial Sequence
  Description of Artificial Sequence: Synthetic peptide
  Seed: FVVLHSFTDAI (TYRP2_HUMAN)
FPVLHSFTDAL

SEQ ID NO: 191341 - protein, 10 aa, Artificial Sequence
  Description of Artificial Sequence: Synthetic peptide
  Seed: FLTSDQLGYS (TYRP2_HUMAN)
FKTSDQLGYV

SEQ ID NO: 191342 - protein, 10 aa, Artificial Sequence
  Description of Artificial Sequence: Synthetic peptide
  Seed: SVYDFFVWLH (TYRP2_HUMAN)
SQYDFFVWLR

SEQ ID NO: 191343 - protein, 10 aa, Artificial Sequence
  Description of Artificial Sequence: Synthetic peptide
  Seed: FFVWLHYYSV (TYRP2_HUMAN)
FVVWLHYYSL

SEQ ID NO: 191344 - protein, 10 aa, Artificial Sequence
  Description of Artificial Sequence: Synthetic peptide
  Seed: GQFPRVCMTV (TYRP2_HUMAN)
GMFPRVCMTA

SEQ ID NO: 191345 - protein, 9 aa, Artificial Sequence
  Description of Artificial Sequence: Synthetic peptide
  Seed: SVYDFFVWL (TYRP2_HUMAN)
SNYDFFVWV

SEQ ID NO: 191346 - protein, 9 aa, Artificial Sequence
  Description of Artificial Sequence: Synthetic peptide
  Seed: LAPIGHNRM (TYRP2_HUMAN)
LAPIGHNRI

SEQ ID NO: 191347 - protein, 10 aa, Artificial Sequence
  Description of Artificial Sequence: Synthetic peptide
  Seed: RNQMGRNSMK (TYRP2_HUMAN)
RSQMGRNSMK

SEQ ID NO: 191348 - protein, 10 aa, Artificial Sequence
  Description of Artificial Sequence: Synthetic peptide
  Seed: RNSRFSSWET (TYRP2_HUMAN)
RSSRFSSWEA

SEQ ID NO: 191349 - protein, 9 aa, Artificial Sequence
  Description of Artificial Sequence: Synthetic peptide
  Seed: ANDPIFVVL (TYRP2_HUMAN)
ATDPIFVVY

SEQ ID NO: 191350 - protein, 9 aa, Artificial Sequence
  Description of Artificial Sequence: Synthetic peptide
  Seed: VIRQNIHSL (TYRP2_HUMAN)
VVRQNIHSM

SEQ ID NO: 191351 - protein, 9 aa, Artificial Sequence
  Description of Artificial Sequence: Synthetic peptide
  Seed: TLDSQVMSL (TYRP2_HUMAN)
TSDSQVMSW

SEQ ID NO: 191352 - protein, 11 aa, Artificial Sequence
  Description of Artificial Sequence: Synthetic peptide
  Seed: MYNMVPFFPPV (TYRP2_HUMAN)
MYNMVPFFPPM

SEQ ID NO: 191353 - protein, 9 aa, Artificial Sequence
  Description of Artificial Sequence: Synthetic peptide
  Seed: NMVPFFPPV (TYRP2_HUMAN)
NTVPFFPPR

SEQ ID NO: 191354 - protein, 9 aa, Artificial Sequence
  Description of Artificial Sequence: Synthetic peptide
  Seed: VTWHRYHLL (TYRP2_HUMAN)
VMWHRYHLM

SEQ ID NO: 191355 - protein, 9 aa, Artificial Sequence
  Description of Artificial Sequence: Synthetic peptide
  Seed: YAIDLPVSV (TYRP2_HUMAN)
YKIDLPVSY

SEQ ID NO: 191356 - protein, 9 aa, Artificial Sequence
  Description of Artificial Sequence: Synthetic peptide
  Seed: ALVGLFVLL (TYRP2_HUMAN)
AVVGLFVLY

SEQ ID NO: 191357 - protein, 10 aa, Artificial Sequence
  Description of Artificial Sequence: Synthetic peptide
  Seed: NGTYEGLLRR (TYRP2_HUMAN)
NHTYEGLLRK

SEQ ID NO: 191358 - protein, 9 aa, Artificial Sequence
  Description of Artificial Sequence: Synthetic peptide
  Seed: WHRYHLLCL (TYRP2_HUMAN)
WPRYHLLCL

SEQ ID NO: 191359 - protein, 9 aa, Artificial Sequence
  Description of Artificial Sequence: Synthetic peptide
  Seed: SVYDFFVWL (TYRP2_HUMAN)
SLYDFFVWG

SEQ ID NO: 191360 - protein, 9 aa, Artificial Sequence
  Description of Artificial Sequence: Synthetic peptide
  Seed: SPQEREQFL (TYRP2_HUMAN)
SAQEREQFL

SEQ ID NO: 191361 - protein, 11 aa, Artificial Sequence
  Description of Artificial Sequence: Synthetic peptide
  Seed: WLHYYSVRDTL (TYRP2_HUMAN)
WEHYYSVRDTF

SEQ ID NO: 191362 - protein, 9 aa, Artificial Sequence
  Description of Artificial Sequence: Synthetic peptide
  Seed: FFQNSTFSF (TYRP2_HUMAN)
FFQNSTFSW

SEQ ID NO: 191363 - protein, 9 aa, Artificial Sequence
  Description of Artificial Sequence: Synthetic peptide
  Seed: RQNIHSLSP (TYRP2_HUMAN)
RKNIHSLSF

SEQ ID NO: 191364 - protein, 9 aa, Artificial Sequence
  Description of Artificial Sequence: Synthetic peptide
  Seed: EQFLGALDL (TYRP2_HUMAN)
EEFLGALDV

SEQ ID NO: 191365 - protein, 9 aa, Artificial Sequence
  Description of Artificial Sequence: Synthetic peptide
  Seed: VGLFVLLAF (TYRP2_HUMAN)
VTLFVLLAL

SEQ ID NO: 191366 - protein, 11 aa, Artificial Sequence
  Description of Artificial Sequence: Synthetic peptide
  Seed: RNSRFSSWETV (TYRP2_HUMAN)
RKSRFSSWETL

SEQ ID NO: 191367 - protein, 10 aa, Artificial Sequence
  Description of Artificial Sequence: Synthetic peptide
  Seed: LVVMGTLVAL (TYRP2_HUMAN)
LSVMGTLVAV

SEQ ID NO: 191368 - protein, 9 aa, Artificial Sequence
  Description of Artificial Sequence: Synthetic peptide
  Seed: FTDAIFDEW (TYRP2_HUMAN)
FQDAIFDEL

SEQ ID NO: 191369 - protein, 9 aa, Artificial Sequence
  Description of Artificial Sequence: Synthetic peptide
  Seed: TLLVVMGTL (TYRP2_HUMAN)
TMLVVMGTF

SEQ ID NO: 191370 - protein, 11 aa, Artificial Sequence
  Description of Artificial Sequence: Synthetic peptide
  Seed: RNSRFSSWETV (TYRP2_HUMAN)
RRSRFSSWETV

SEQ ID NO: 191371 - protein, 9 aa, Artificial Sequence
  Description of Artificial Sequence: Synthetic peptide
  Seed: MTVDSLVNK (TYRP2_HUMAN)
MYVDSLVNR

SEQ ID NO: 191372 - protein, 11 aa, Artificial Sequence
  Description of Artificial Sequence: Synthetic peptide
  Seed: FQNSTFSFRNA (TYRP2_HUMAN)
FVNSTFSFRNV

SEQ ID NO: 191373 - protein, 10 aa, Artificial Sequence
  Description of Artificial Sequence: Synthetic peptide
  Seed: FSFRNALEGF (TYRP2_HUMAN)
FFFRNALEGW

SEQ ID NO: 191374 - protein, 9 aa, Artificial Sequence
  Description of Artificial Sequence: Synthetic peptide
  Seed: MTVDSLVNK (TYRP2_HUMAN)
MQVDSLVNY

SEQ ID NO: 191375 - protein, 10 aa, Artificial Sequence
  Description of Artificial Sequence: Synthetic peptide
  Seed: NSRFSSWETV (TYRP2_HUMAN)
NERFSSWETL

SEQ ID NO: 191376 - protein, 11 aa, Artificial Sequence
  Description of Artificial Sequence: Synthetic peptide
  Seed: TQPQFANCSVY (TYRP2_HUMAN)
TEPQFANCSVF

SEQ ID NO: 191377 - protein, 9 aa, Artificial Sequence
  Description of Artificial Sequence: Synthetic peptide
  Seed: CSVYDFFVW (TYRP2_HUMAN)
CPVYDFFVW

SEQ ID NO: 191378 - protein, 10 aa, Artificial Sequence
  Description of Artificial Sequence: Synthetic peptide
  Seed: RLRKGYTPLM (TYRP2_HUMAN)
RRRKGYTPLL

SEQ ID NO: 191379 - protein, 8 aa, Artificial Sequence
  Description of Artificial Sequence: Synthetic peptide
  Seed: LDDYNHLV (TYRP2_HUMAN)
LTDYNHLL

SEQ ID NO: 191380 - protein, 9 aa, Artificial Sequence
  Description of Artificial Sequence: Synthetic peptide
  Seed: DQLGYSYAI (TYRP2_HUMAN)
DLLGYSYAI

SEQ ID NO: 191381 - protein, 9 aa, Artificial Sequence
  Description of Artificial Sequence: Synthetic peptide
  Seed: FVLLAFLQY (TYRP2_HUMAN)
FALLAFLQK

SEQ ID NO: 191382 - protein, 9 aa, Artificial Sequence
  Description of Artificial Sequence: Synthetic peptide
  Seed: FQNSTFSFR (TYRP2_HUMAN)
FGNSTFSFY

SEQ ID NO: 191383 - protein, 9 aa, Artificial Sequence
  Description of Artificial Sequence: Synthetic peptide
  Seed: NRMYNMVPF (TYRP2_HUMAN)
NQMYNMVPY

SEQ ID NO: 191384 - protein, 9 aa, Artificial Sequence
  Description of Artificial Sequence: Synthetic peptide
  Seed: RDCLSLQKF (TYRP2_HUMAN)
RECLSLQKY

SEQ ID NO: 191385 - protein, 10 aa, Artificial Sequence
  Description of Artificial Sequence: Synthetic peptide
  Seed: YNMVPFFPPV (TYRP2_HUMAN)
YYMVPFFPPV

SEQ ID NO: 191386 - protein, 9 aa, Artificial Sequence
  Description of Artificial Sequence: Synthetic peptide
  Seed: FTDAIFDEW (TYRP2_HUMAN)
FADAIFDEV

SEQ ID NO: 191387 - protein, 11 aa, Artificial Sequence
  Description of Artificial Sequence: Synthetic peptide
  Seed: MYNMVPFFPPV (TYRP2_HUMAN)
MCNMVPFFPPL

SEQ ID NO: 191388 - protein, 9 aa, Artificial Sequence
  Description of Artificial Sequence: Synthetic peptide
  Seed: IFDEWMKRF (TYRP2_HUMAN)
ILDEWMKRM

SEQ ID NO: 191389 - protein, 9 aa, Artificial Sequence
  Description of Artificial Sequence: Synthetic peptide
  Seed: VLLAFLQYR (TYRP2_HUMAN)
VGLAFLQYR

SEQ ID NO: 191390 - protein, 9 aa, Artificial Sequence
  Description of Artificial Sequence: Synthetic peptide
  Seed: VVMGTLVAL (TYRP2_HUMAN)
VLMGTLVAT

SEQ ID NO: 191391 - protein, 10 aa, Artificial Sequence
  Description of Artificial Sequence: Synthetic peptide
  Seed: FFPPVTNEEL (TYRP2_HUMAN)
FFPPVTNEEW

SEQ ID NO: 191392 - protein, 10 aa, Artificial Sequence
  Description of Artificial Sequence: Synthetic peptide
  Seed: RMYNMVPFFP (TYRP2_HUMAN)
RQYNMVPFFA

SEQ ID NO: 191393 - protein, 10 aa, Artificial Sequence
  Description of Artificial Sequence: Synthetic peptide
  Seed: HNRMYNMVPF (TYRP2_HUMAN)
HCRMYNMVPL

SEQ ID NO: 191394 - protein, 9 aa, Artificial Sequence
  Description of Artificial Sequence: Synthetic peptide
  Seed: ITTQHWLGL (TYRP2_HUMAN)
IATQHWLGM

SEQ ID NO: 191395 - protein, 11 aa, Artificial Sequence
  Description of Artificial Sequence: Synthetic peptide
  Seed: RLIGNESFALP (TYRP2_HUMAN)
RLIGNESFALL

SEQ ID NO: 191396 - protein, 9 aa, Artificial Sequence
  Description of Artificial Sequence: Synthetic peptide
  Seed: RLRKGYTPL (TYRP2_HUMAN)
RMRKGYTPQ

SEQ ID NO: 191397 - protein, 10 aa, Artificial Sequence
  Description of Artificial Sequence: Synthetic peptide
  Seed: SDQLGYSYAI (TYRP2_HUMAN)
STQLGYSYAV

SEQ ID NO: 191398 - protein, 10 aa, Artificial Sequence
  Description of Artificial Sequence: Synthetic peptide
  Seed: AANDPIFVVL (TYRP2_HUMAN)
ASNDPIFVVM

SEQ ID NO: 191399 - protein, 9 aa, Artificial Sequence
  Description of Artificial Sequence: Synthetic peptide
  Seed: MSPLWWGFL (TYRP2_HUMAN)
MTPLWWGFA

SEQ ID NO: 191400 - protein, 9 aa, Artificial Sequence
  Description of Artificial Sequence: Synthetic peptide
  Seed: SRNSRFSSW (TYRP2_HUMAN)
SNNSRFSSY

SEQ ID NO: 191401 - protein, 9 aa, Artificial Sequence
  Description of Artificial Sequence: Synthetic peptide
  Seed: HSFLNGTNA (TYRP2_HUMAN)
HAFLNGTNH

SEQ ID NO: 191402 - protein, 10 aa, Artificial Sequence
  Description of Artificial Sequence: Synthetic peptide
  Seed: RLIGNESFAL (TYRP2_HUMAN)
RQIGNESFAI

SEQ ID NO: 191403 - protein, 11 aa, Artificial Sequence
  Description of Artificial Sequence: Synthetic peptide
  Seed: YTPLMETHLSS (TYRP2_HUMAN)
YPPLMETHLSI

SEQ ID NO: 191404 - protein, 9 aa, Artificial Sequence
  Description of Artificial Sequence: Synthetic peptide
  Seed: YSYAIDLPV (TYRP2_HUMAN)
YVYAIDLPY

SEQ ID NO: 191405 - protein, 9 aa, Artificial Sequence
  Description of Artificial Sequence: Synthetic peptide
  Seed: VSVEETPGW (TYRP2_HUMAN)
VQVEETPGL

SEQ ID NO: 191406 - protein, 9 aa, Artificial Sequence
  Description of Artificial Sequence: Synthetic peptide
  Seed: VTWHRYHLL (TYRP2_HUMAN)
VWWHRYHLL

SEQ ID NO: 191407 - protein, 11 aa, Artificial Sequence
  Description of Artificial Sequence: Synthetic peptide
  Seed: RADTRPWSGPY (TYRP2_HUMAN)
RWDTRPWSGPA

SEQ ID NO: 191408 - protein, 9 aa, Artificial Sequence
  Description of Artificial Sequence: Synthetic peptide
  Seed: TDQLFGAAR (TYRP2_HUMAN)
TTQLFGAAR

SEQ ID NO: 191409 - protein, 9 aa, Artificial Sequence
  Description of Artificial Sequence: Synthetic peptide
  Seed: ANDPIFVVL (TYRP2_HUMAN)
AYDPIFVVL

SEQ ID NO: 191410 - protein, 11 aa, Artificial Sequence
  Description of Artificial Sequence: Synthetic peptide
  Seed: FFPPVTNEELF (TYRP2_HUMAN)
FPPPVTNEELW

SEQ ID NO: 191411 - protein, 9 aa, Artificial Sequence
  Description of Artificial Sequence: Synthetic peptide
  Seed: CSVYDFFVW (TYRP2_HUMAN)
CSVYDFFVY

SEQ ID NO: 191412 - protein, 10 aa, Artificial Sequence
  Description of Artificial Sequence: Synthetic peptide
  Seed: VYDFFVWLHY (TYRP2_HUMAN)
VFDFFVWLHY

SEQ ID NO: 191413 - protein, 9 aa, Artificial Sequence
  Description of Artificial Sequence: Synthetic peptide
  Seed: RPWSGPYIL (TYRP2_HUMAN)
RSWSGPYIV

SEQ ID NO: 191414 - protein, 9 aa, Artificial Sequence
  Description of Artificial Sequence: Synthetic peptide
  Seed: VIRQNIHSL (TYRP2_HUMAN)
VERQNIHSY

SEQ ID NO: 191415 - protein, 9 aa, Artificial Sequence
  Description of Artificial Sequence: Synthetic peptide
  Seed: RLRKGYTPL (TYRP2_HUMAN)
RERKGYTPY

SEQ ID NO: 191416 - protein, 10 aa, Artificial Sequence
  Description of Artificial Sequence: Synthetic peptide
  Seed: VLLAFLQYRR (TYRP2_HUMAN)
VGLAFLQYRR

SEQ ID NO: 191417 - protein, 9 aa, Artificial Sequence
  Description of Artificial Sequence: Synthetic peptide
  Seed: RMYNMVPFF (TYRP2_HUMAN)
RMYNMVPFT

SEQ ID NO: 191418 - protein, 9 aa, Artificial Sequence
  Description of Artificial Sequence: Synthetic peptide
  Seed: VTWHRYHLL (TYRP2_HUMAN)
VFWHRYHLL

SEQ ID NO: 191419 - protein, 9 aa, Artificial Sequence
  Description of Artificial Sequence: Synthetic peptide
  Seed: YSYAIDLPV (TYRP2_HUMAN)
YIYAIDLPV

SEQ ID NO: 191420 - protein, 9 aa, Artificial Sequence
  Description of Artificial Sequence: Synthetic peptide
  Seed: SFLNGTNAL (TYRP2_HUMAN)
SQLNGTNAM

SEQ ID NO: 191421 - protein, 10 aa, Artificial Sequence
  Description of Artificial Sequence: Synthetic peptide
  Seed: YDFFVWLHYY (TYRP2_HUMAN)
YFFFVWLHYI

SEQ ID NO: 191422 - protein, 9 aa, Artificial Sequence
  Description of Artificial Sequence: Synthetic peptide
  Seed: SSKRYTEEA (TYRP2_HUMAN)
SVKRYTEEK

SEQ ID NO: 191423 - protein, 9 aa, Artificial Sequence
  Description of Artificial Sequence: Synthetic peptide
  Seed: WHRYHLLCL (TYRP2_HUMAN)
WLRYHLLCM

SEQ ID NO: 191424 - protein, 11 aa, Artificial Sequence
  Description of Artificial Sequence: Synthetic peptide
  Seed: YNMVPFFPPVT (TYRP2_HUMAN)
YMMVPFFPPVN

SEQ ID NO: 191425 - protein, 9 aa, Artificial Sequence
  Description of Artificial Sequence: Synthetic peptide
  Seed: LRNQDDREL (TYRP2_HUMAN)
LHNQDDREI

SEQ ID NO: 191426 - protein, 10 aa, Artificial Sequence
  Description of Artificial Sequence: Synthetic peptide
  Seed: TRPWSGPYIL (TYRP2_HUMAN)
TFPWSGPYIL

SEQ ID NO: 191427 - protein, 9 aa, Artificial Sequence
  Description of Artificial Sequence: Synthetic peptide
  Seed: RNSMKLPTL (TYRP2_HUMAN)
RQSMKLPTI

SEQ ID NO: 191428 - protein, 9 aa, Artificial Sequence
  Description of Artificial Sequence: Synthetic peptide
  Seed: TPLMETHLS (TYRP2_HUMAN)
TPLMETHLA

SEQ ID NO: 191429 - protein, 9 aa, Artificial Sequence
  Description of Artificial Sequence: Synthetic peptide
  Seed: ALDLAKKRV (TYRP2_HUMAN)
AADLAKKRV

SEQ ID NO: 191430 - protein, 10 aa, Artificial Sequence
  Description of Artificial Sequence: Synthetic peptide
  Seed: FFVWLHYYSV (TYRP2_HUMAN)
FTVWLHYYSV

SEQ ID NO: 191431 - protein, 9 aa, Artificial Sequence
  Description of Artificial Sequence: Synthetic peptide
  Seed: YAIDLPVSV (TYRP2_HUMAN)
YPIDLPVSL

SEQ ID NO: 191432 - protein, 9 aa, Artificial Sequence
  Description of Artificial Sequence: Synthetic peptide
  Seed: FTDAIFDEW (TYRP2_HUMAN)
FADAIFDEY

SEQ ID NO: 191433 - protein, 11 aa, Artificial Sequence
  Description of Artificial Sequence: Synthetic peptide
  Seed: SQVMSLHNLVH (TYRP2_HUMAN)
SHVMSLHNLVY

SEQ ID NO: 191434 - protein, 9 aa, Artificial Sequence
  Description of Artificial Sequence: Synthetic peptide
  Seed: WHRYHLLCL (TYRP2_HUMAN)
WFRYHLLCL

SEQ ID NO: 191435 - protein, 9 aa, Artificial Sequence
  Description of Artificial Sequence: Synthetic peptide
  Seed: LLSCLGCKI (TYRP2_HUMAN)
LISCLGCKI

SEQ ID NO: 191436 - protein, 9 aa, Artificial Sequence
  Description of Artificial Sequence: Synthetic peptide
  Seed: VIRQNIHSL (TYRP2_HUMAN)
VSRQNIHSL

SEQ ID NO: 191437 - protein, 9 aa, Artificial Sequence
  Description of Artificial Sequence: Synthetic peptide
  Seed: VIRQNIHSL (TYRP2_HUMAN)
VYRQNIHSK

SEQ ID NO: 191438 - protein, 9 aa, Artificial Sequence
  Description of Artificial Sequence: Synthetic peptide
  Seed: RLRKGYTPL (TYRP2_HUMAN)
RSRKGYTPH

SEQ ID NO: 191439 - protein, 8 aa, Artificial Sequence
  Description of Artificial Sequence: Synthetic peptide
  Seed: SLDDYNHL (TYRP2_HUMAN)
SIDDYNHM

SEQ ID NO: 191440 - protein, 8 aa, Artificial Sequence
  Description of Artificial Sequence: Synthetic peptide
  Seed: LDDYNHLV (TYRP2_HUMAN)
LTDYNHLI

SEQ ID NO: 191441 - protein, 8 aa, Artificial Sequence
  Description of Artificial Sequence: Synthetic peptide
  Seed: YVITTQHW (TYRP2_HUMAN)
YSITTQHW

SEQ ID NO: 191442 - protein, 9 aa, Artificial Sequence
  Description of Artificial Sequence: Synthetic peptide
  Seed: SAANDPIFV (TYRP2_HUMAN)
SAANDPIFI

SEQ ID NO: 191443 - protein, 9 aa, Artificial Sequence
  Description of Artificial Sequence: Synthetic peptide
  Seed: YSYAIDLPV (TYRP2_HUMAN)
YAYAIDLPT

SEQ ID NO: 191444 - protein, 9 aa, Artificial Sequence
  Description of Artificial Sequence: Synthetic peptide
  Seed: FVLLAFLQY (TYRP2_HUMAN)
FMLLAFLQK

SEQ ID NO: 191445 - protein, 8 aa, Artificial Sequence
  Description of Artificial Sequence: Synthetic peptide
  Seed: FLGALDLA (TYRP2_HUMAN)
FLGALDLL

SEQ ID NO: 191446 - protein, 9 aa, Artificial Sequence
  Description of Artificial Sequence: Synthetic peptide
  Seed: RNQMGRNSM (TYRP2_HUMAN)
RLQMGRNSY

SEQ ID NO: 191447 - protein, 9 aa, Artificial Sequence
  Description of Artificial Sequence: Synthetic peptide
  Seed: VMSLHNLVH (TYRP2_HUMAN)
VTSLHNLVF

SEQ ID NO: 191448 - protein, 10 aa, Artificial Sequence
  Description of Artificial Sequence: Synthetic peptide
  Seed: YNMVPFFPPV (TYRP2_HUMAN)
YYMVPFFPPA

SEQ ID NO: 191449 - protein, 9 aa, Artificial Sequence
  Description of Artificial Sequence: Synthetic peptide
  Seed: ISRNSRFSS (TYRP2_HUMAN)
IMRNSRFSK

SEQ ID NO: 191450 - protein, 10 aa, Artificial Sequence
  Description of Artificial Sequence: Synthetic peptide
  Seed: CCPRLGAESA (TYRP2_HUMAN)
CTPRLGAESM

SEQ ID NO: 191451 - protein, 10 aa, Artificial Sequence
  Description of Artificial Sequence: Synthetic peptide
  Seed: LDDYNHLVTL (TYRP2_HUMAN)
LSDYNHLVTM

SEQ ID NO: 191452 - protein, 10 aa, Artificial Sequence
  Description of Artificial Sequence: Synthetic peptide
  Seed: SLDDYNHLVT (TYRP2_HUMAN)
SFDDYNHLVI

SEQ ID NO: 191453 - protein, 11 aa, Artificial Sequence
  Description of Artificial Sequence: Synthetic peptide
  Seed: RNSRFSSWETV (TYRP2_HUMAN)
RPSRFSSWETF

SEQ ID NO: 191454 - protein, 10 aa, Artificial Sequence
  Description of Artificial Sequence: Synthetic peptide
  Seed: SVYDFFVWLH (TYRP2_HUMAN)
SIYDFFVWLR

SEQ ID NO: 191455 - protein, 9 aa, Artificial Sequence
  Description of Artificial Sequence: Synthetic peptide
  Seed: FPPVTNEEL (TYRP2_HUMAN)
FHPVTNEEF

SEQ ID NO: 191456 - protein, 9 aa, Artificial Sequence
  Description of Artificial Sequence: Synthetic peptide
  Seed: GLFVLLAFL (TYRP2_HUMAN)
GLFVLLAFA

SEQ ID NO: 191457 - protein, 9 aa, Artificial Sequence
  Description of Artificial Sequence: Synthetic peptide
  Seed: SVYDFFVWL (TYRP2_HUMAN)
SNYDFFVWR

SEQ ID NO: 191458 - protein, 9 aa, Artificial Sequence
  Description of Artificial Sequence: Synthetic peptide
  Seed: WMKRFNPPA (TYRP2_HUMAN)
WIKRFNPPF

SEQ ID NO: 191459 - protein, 9 aa, Artificial Sequence
  Description of Artificial Sequence: Synthetic peptide
  Seed: SLHNLVHSF (TYRP2_HUMAN)
SWHNLVHSL

SEQ ID NO: 191460 - protein, 10 aa, Artificial Sequence
  Description of Artificial Sequence: Synthetic peptide
  Seed: YAIDLPVSVE (TYRP2_HUMAN)
YQIDLPVSVL

SEQ ID NO: 191461 - protein, 9 aa, Artificial Sequence
  Description of Artificial Sequence: Synthetic peptide
  Seed: HQGPAFVTW (TYRP2_HUMAN)
HHGPAFVTV

SEQ ID NO: 191462 - protein, 10 aa, Artificial Sequence
  Description of Artificial Sequence: Synthetic peptide
  Seed: ELAPIGHNRM (TYRP2_HUMAN)
EIAPIGHNRK

SEQ ID NO: 191463 - protein, 10 aa, Artificial Sequence
  Description of Artificial Sequence: Synthetic peptide
  Seed: RRLRKGYTPL (TYRP2_HUMAN)
RTLRKGYTPK

SEQ ID NO: 191464 - protein, 9 aa, Artificial Sequence
  Description of Artificial Sequence: Synthetic peptide
  Seed: VVMGTLVAL (TYRP2_HUMAN)
VAMGTLVAI

SEQ ID NO: 191465 - protein, 10 aa, Artificial Sequence
  Description of Artificial Sequence: Synthetic peptide
  Seed: YDFFVWLHYY (TYRP2_HUMAN)
YNFFVWLHYY

SEQ ID NO: 191466 - protein, 9 aa, Artificial Sequence
  Description of Artificial Sequence: Synthetic peptide
  Seed: FSHQGPAFV (TYRP2_HUMAN)
FYHQGPAFY

SEQ ID NO: 191467 - protein, 9 aa, Artificial Sequence
  Description of Artificial Sequence: Synthetic peptide
  Seed: GNESFALPY (TYRP2_HUMAN)
GMESFALPF

SEQ ID NO: 191468 - protein, 9 aa, Artificial Sequence
  Description of Artificial Sequence: Synthetic peptide
  Seed: FQNSTFSFR (TYRP2_HUMAN)
FMNSTFSFY

SEQ ID NO: 191469 - protein, 8 aa, Artificial Sequence
  Description of Artificial Sequence: Synthetic peptide
  Seed: RPDDPTLI (TYRP2_HUMAN)
RTDDPTLM

SEQ ID NO: 191470 - protein, 10 aa, Artificial Sequence
  Description of Artificial Sequence: Synthetic peptide
  Seed: MSLHNLVHSF (TYRP2_HUMAN)
MGLHNLVHSF

SEQ ID NO: 191471 - protein, 9 aa, Artificial Sequence
  Description of Artificial Sequence: Synthetic peptide
  Seed: LRKGYTPLM (TYRP2_HUMAN)
LEKGYTPLY

SEQ ID NO: 191472 - protein, 9 aa, Artificial Sequence
  Description of Artificial Sequence: Synthetic peptide
  Seed: DTRPWSGPY (TYRP2_HUMAN)
DMRPWSGPY

SEQ ID NO: 191473 - protein, 10 aa, Artificial Sequence
  Description of Artificial Sequence: Synthetic peptide
  Seed: VVLHSFTDAI (TYRP2_HUMAN)
VKLHSFTDAL

SEQ ID NO: 191474 - protein, 9 aa, Artificial Sequence
  Description of Artificial Sequence: Synthetic peptide
  Seed: RDCLSLQKF (TYRP2_HUMAN)
RLCLSLQKI

SEQ ID NO: 191475 - protein, 10 aa, Artificial Sequence
  Description of Artificial Sequence: Synthetic peptide
  Seed: YNMVPFFPPV (TYRP2_HUMAN)
YVMVPFFPPS

SEQ ID NO: 191476 - protein, 10 aa, Artificial Sequence
  Description of Artificial Sequence: Synthetic peptide
  Seed: DSLDDYNHLV (TYRP2_HUMAN)
DFLDDYNHLI

SEQ ID NO: 191477 - protein, 9 aa, Artificial Sequence
  Description of Artificial Sequence: Synthetic peptide
  Seed: AANDPIFVV (TYRP2_HUMAN)
AVNDPIFVW

SEQ ID NO: 191478 - protein, 9 aa, Artificial Sequence
  Description of Artificial Sequence: Synthetic peptide
  Seed: VDSLVNKEC (TYRP2_HUMAN)
VESLVNKEM

SEQ ID NO: 191479 - protein, 9 aa, Artificial Sequence
  Description of Artificial Sequence: Synthetic peptide
  Seed: APIGHNRMY (TYRP2_HUMAN)
AAIGHNRMI

SEQ ID NO: 191480 - protein, 11 aa, Artificial Sequence
  Description of Artificial Sequence: Synthetic peptide
  Seed: ALPYWNFATGR (TYRP2_HUMAN)
AFPYWNFATGR

SEQ ID NO: 191481 - protein, 9 aa, Artificial Sequence
  Description of Artificial Sequence: Synthetic peptide
  Seed: YSYAIDLPV (TYRP2_HUMAN)
YLYAIDLPG

SEQ ID NO: 191482 - protein, 10 aa, Artificial Sequence
  Description of Artificial Sequence: Synthetic peptide
  Seed: ESFALPYWNF (TYRP2_HUMAN)
EFFALPYWNF

SEQ ID NO: 191483 - protein, 11 aa, Artificial Sequence
  Description of Artificial Sequence: Synthetic peptide
  Seed: FANCSVYDFFV (TYRP2_HUMAN)
FLNCSVYDFFI

SEQ ID NO: 191484 - protein, 11 aa, Artificial Sequence
  Description of Artificial Sequence: Synthetic peptide
  Seed: RLIGNESFALP (TYRP2_HUMAN)
RMIGNESFALA

SEQ ID NO: 191485 - protein, 10 aa, Artificial Sequence
  Description of Artificial Sequence: Synthetic peptide
  Seed: GNESFALPYW (TYRP2_HUMAN)
GAESFALPYW

SEQ ID NO: 191486 - protein, 9 aa, Artificial Sequence
  Description of Artificial Sequence: Synthetic peptide
  Seed: LLSCLGCKI (TYRP2_HUMAN)
LMSCLGCKV

SEQ ID NO: 191487 - protein, 10 aa, Artificial Sequence
  Description of Artificial Sequence: Synthetic peptide
  Seed: SVYDFFVWLH (TYRP2_HUMAN)
SSYDFFVWLK

SEQ ID NO: 191488 - protein, 9 aa, Artificial Sequence
  Description of Artificial Sequence: Synthetic peptide
  Seed: TLISRNSRF (TYRP2_HUMAN)
TMISRNSRY

SEQ ID NO: 191489 - protein, 9 aa, Artificial Sequence
  Description of Artificial Sequence: Synthetic peptide
  Seed: AQGQFPRVC (TYRP2_HUMAN)
AQGQFPRVV

SEQ ID NO: 191490 - protein, 10 aa, Artificial Sequence
  Description of Artificial Sequence: Synthetic peptide
  Seed: SLDDYNHLVT (TYRP2_HUMAN)
SADDYNHLVI

SEQ ID NO: 191491 - protein, 10 aa, Artificial Sequence
  Description of Artificial Sequence: Synthetic peptide
  Seed: NPPFFQNSTF (TYRP2_HUMAN)
NMPFFQNSTF

SEQ ID NO: 191492 - protein, 9 aa, Artificial Sequence
  Description of Artificial Sequence: Synthetic peptide
  Seed: NRMYNMVPF (TYRP2_HUMAN)
NYMYNMVPF

SEQ ID NO: 191493 - protein, 9 aa, Artificial Sequence
  Description of Artificial Sequence: Synthetic peptide
  Seed: FTDAIFDEW (TYRP2_HUMAN)
FNDAIFDEM

SEQ ID NO: 191494 - protein, 9 aa, Artificial Sequence
  Description of Artificial Sequence: Synthetic peptide
  Seed: VPFFPPVTN (TYRP2_HUMAN)
VVFFPPVTY

SEQ ID NO: 191495 - protein, 10 aa, Artificial Sequence
  Description of Artificial Sequence: Synthetic peptide
  Seed: LQKFDNPPFF (TYRP2_HUMAN)
LKKFDNPPFY

SEQ ID NO: 191496 - protein, 9 aa, Artificial Sequence
  Description of Artificial Sequence: Synthetic peptide
  Seed: FVWLHYYSV (TYRP2_HUMAN)
FMWLHYYSM

SEQ ID NO: 191497 - protein, 11 aa, Artificial Sequence
  Description of Artificial Sequence: Synthetic peptide
  Seed: WLHYYSVRDTL (TYRP2_HUMAN)
WYHYYSVRDTF

SEQ ID NO: 191498 - protein, 11 aa, Artificial Sequence
  Description of Artificial Sequence: Synthetic peptide
  Seed: RADTRPWSGPY (TYRP2_HUMAN)
RQDTRPWSGPF

SEQ ID NO: 191499 - protein, 10 aa, Artificial Sequence
  Description of Artificial Sequence: Synthetic peptide
  Seed: MGTLVALVGL (TYRP2_HUMAN)
MVTLVALVGV

SEQ ID NO: 191500 - protein, 10 aa, Artificial Sequence
  Description of Artificial Sequence: Synthetic peptide
  Seed: ESANVCGSQQ (TYRP2_HUMAN)
ESANVCGSQK

SEQ ID NO: 191501 - protein, 9 aa, Artificial Sequence
  Description of Artificial Sequence: Synthetic peptide
  Seed: HSAANDPIF (TYRP2_HUMAN)
HQAANDPIM

SEQ ID NO: 191502 - protein, 9 aa, Artificial Sequence
  Description of Artificial Sequence: Synthetic peptide
  Seed: DQLGYSYAI (TYRP2_HUMAN)
DHLGYSYAI

SEQ ID NO: 191503 - protein, 10 aa, Artificial Sequence
  Description of Artificial Sequence: Synthetic peptide
  Seed: NGTYEGLLRR (TYRP2_HUMAN)
NHTYEGLLRR

SEQ ID NO: 191504 - protein, 10 aa, Artificial Sequence
  Description of Artificial Sequence: Synthetic peptide
  Seed: SLVNKECCPR (TYRP2_HUMAN)
SSVNKECCPR

SEQ ID NO: 191505 - protein, 9 aa, Artificial Sequence
  Description of Artificial Sequence: Synthetic peptide
  Seed: RLRKGYTPL (TYRP2_HUMAN)
RFRKGYTPI

SEQ ID NO: 191506 - protein, 9 aa, Artificial Sequence
  Description of Artificial Sequence: Synthetic peptide
  Seed: FANCSVYDF (TYRP2_HUMAN)
FKNCSVYDM

SEQ ID NO: 191507 - protein, 9 aa, Artificial Sequence
  Description of Artificial Sequence: Synthetic peptide
  Seed: DDYNHLVTL (TYRP2_HUMAN)
DQYNHLVTF

SEQ ID NO: 191508 - protein, 9 aa, Artificial Sequence
  Description of Artificial Sequence: Synthetic peptide
  Seed: FVWLHYYSV (TYRP2_HUMAN)
FSWLHYYSR

SEQ ID NO: 191509 - protein, 9 aa, Artificial Sequence
  Description of Artificial Sequence: Synthetic peptide
  Seed: WMKRFNPPA (TYRP2_HUMAN)
WIKRFNPPY

SEQ ID NO: 191510 - protein, 9 aa, Artificial Sequence
  Description of Artificial Sequence: Synthetic peptide
  Seed: QVMSLHNLV (TYRP2_HUMAN)
QMMSLHNLL

SEQ ID NO: 191511 - protein, 10 aa, Artificial Sequence
  Description of Artificial Sequence: Synthetic peptide
  Seed: YSYAIDLPVS (TYRP2_HUMAN)
YVYAIDLPVA

SEQ ID NO: 191512 - protein, 11 aa, Artificial Sequence
  Description of Artificial Sequence: Synthetic peptide
  Seed: SVYDFFVWLHY (TYRP2_HUMAN)
STYDFFVWLHW

SEQ ID NO: 191513 - protein, 9 aa, Artificial Sequence
  Description of Artificial Sequence: Synthetic peptide
  Seed: RLRKGYTPL (TYRP2_HUMAN)
RMRKGYTPW

SEQ ID NO: 191514 - protein, 9 aa, Artificial Sequence
  Description of Artificial Sequence: Synthetic peptide
  Seed: SFLNGTNAL (TYRP2_HUMAN)
SYLNGTNAL

SEQ ID NO: 191515 - protein, 9 aa, Artificial Sequence
  Description of Artificial Sequence: Synthetic peptide
  Seed: FLNGTNALP (TYRP2_HUMAN)
FMNGTNALM

SEQ ID NO: 191516 - protein, 9 aa, Artificial Sequence
  Description of Artificial Sequence: Synthetic peptide
  Seed: RKFFHRTCK (TYRP2_HUMAN)
RTFFHRTCT

SEQ ID NO: 191517 - protein, 11 aa, Artificial Sequence
  Description of Artificial Sequence: Synthetic peptide
  Seed: ALPYWNFATGR (TYRP2_HUMAN)
AVPYWNFATGR

SEQ ID NO: 191518 - protein, 9 aa, Artificial Sequence
  Description of Artificial Sequence: Synthetic peptide
  Seed: ANDPIFVVL (TYRP2_HUMAN)
AIDPIFVVL

SEQ ID NO: 191519 - protein, 9 aa, Artificial Sequence
  Description of Artificial Sequence: Synthetic peptide
  Seed: NRMYNMVPF (TYRP2_HUMAN)
NAMYNMVPM

SEQ ID NO: 191520 - protein, 10 aa, Artificial Sequence
  Description of Artificial Sequence: Synthetic peptide
  Seed: IGNESFALPY (TYRP2_HUMAN)
IMNESFALPM

SEQ ID NO: 191521 - protein, 8 aa, Artificial Sequence
  Description of Artificial Sequence: Synthetic peptide
  Seed: SLDDYNHL (TYRP2_HUMAN)
STDDYNHI

SEQ ID NO: 191522 - protein, 10 aa, Artificial Sequence
  Description of Artificial Sequence: Synthetic peptide
  Seed: YDFFVWLHYY (TYRP2_HUMAN)
YFFFVWLHYM

SEQ ID NO: 191523 - protein, 8 aa, Artificial Sequence
  Description of Artificial Sequence: Synthetic peptide
  Seed: FLNGTNAL (TYRP2_HUMAN)
FFNGTNAY

SEQ ID NO: 191524 - protein, 10 aa, Artificial Sequence
  Description of Artificial Sequence: Synthetic peptide
  Seed: LVVMGTLVAL (TYRP2_HUMAN)
LMVMGTLVAI

SEQ ID NO: 191525 - protein, 10 aa, Artificial Sequence
  Description of Artificial Sequence: Synthetic peptide
  Seed: REQFLGALDL (TYRP2_HUMAN)
RQQFLGALDL

SEQ ID NO: 191526 - protein, 9 aa, Artificial Sequence
  Description of Artificial Sequence: Synthetic peptide
  Seed: FLQYRRLRK (TYRP2_HUMAN)
FTQYRRLRR

SEQ ID NO: 191527 - protein, 10 aa, Artificial Sequence
  Description of Artificial Sequence: Synthetic peptide
  Seed: RELWPRKFFH (TYRP2_HUMAN)
RFLWPRKFFR

SEQ ID NO: 191528 - protein, 10 aa, Artificial Sequence
  Description of Artificial Sequence: Synthetic peptide
  Seed: VVMGTLVALV (TYRP2_HUMAN)
VFMGTLVALI

SEQ ID NO: 191529 - protein, 9 aa, Artificial Sequence
  Description of Artificial Sequence: Synthetic peptide
  Seed: STFSFRNAL (TYRP2_HUMAN)
SEFSFRNAM

SEQ ID NO: 191530 - protein, 10 aa, Artificial Sequence
  Description of Artificial Sequence: Synthetic peptide
  Seed: RRLRKGYTPL (TYRP2_HUMAN)
RPLRKGYTPL

SEQ ID NO: 191531 - protein, 10 aa, Artificial Sequence
  Description of Artificial Sequence: Synthetic peptide
  Seed: SDQLGYSYAI (TYRP2_HUMAN)
SRQLGYSYAY

SEQ ID NO: 191532 - protein, 11 aa, Artificial Sequence
  Description of Artificial Sequence: Synthetic peptide
  Seed: FVVLHSFTDAI (TYRP2_HUMAN)
FGVLHSFTDAI

SEQ ID NO: 191533 - protein, 9 aa, Artificial Sequence
  Description of Artificial Sequence: Synthetic peptide
  Seed: FSHQGPAFV (TYRP2_HUMAN)
FPHQGPAFV

SEQ ID NO: 191534 - protein, 10 aa, Artificial Sequence
  Description of Artificial Sequence: Synthetic peptide
  Seed: LVVMGTLVAL (TYRP2_HUMAN)
LKVMGTLVAA

SEQ ID NO: 191535 - protein, 10 aa, Artificial Sequence
  Description of Artificial Sequence: Synthetic peptide
  Seed: LQRLIGNESF (TYRP2_HUMAN)
LMRLIGNESF

SEQ ID NO: 191536 - protein, 9 aa, Artificial Sequence
  Description of Artificial Sequence: Synthetic peptide
  Seed: FVWLHYYSV (TYRP2_HUMAN)
FQWLHYYSM

SEQ ID NO: 191537 - protein, 10 aa, Artificial Sequence
  Description of Artificial Sequence: Synthetic peptide
  Seed: LVVMGTLVAL (TYRP2_HUMAN)
LAVMGTLVAY

SEQ ID NO: 191538 - protein, 10 aa, Artificial Sequence
  Description of Artificial Sequence: Synthetic peptide
  Seed: YDFFVWLHYY (TYRP2_HUMAN)
YFFFVWLHYE

SEQ ID NO: 191539 - protein, 11 aa, Artificial Sequence
  Description of Artificial Sequence: Synthetic peptide
  Seed: FSHQGPAFVTW (TYRP2_HUMAN)
FPHQGPAFVTF

SEQ ID NO: 191540 - protein, 10 aa, Artificial Sequence
  Description of Artificial Sequence: Synthetic peptide
  Seed: SDQLGYSYAI (TYRP2_HUMAN)
SIQLGYSYAI

SEQ ID NO: 191541 - protein, 9 aa, Artificial Sequence
  Description of Artificial Sequence: Synthetic peptide
  Seed: FQNSTFSFR (TYRP2_HUMAN)
FSNSTFSFY

SEQ ID NO: 191542 - protein, 10 aa, Artificial Sequence
  Description of Artificial Sequence: Synthetic peptide
  Seed: SLHNLVHSFL (TYRP2_HUMAN)
SQHNLVHSFV

SEQ ID NO: 191543 - protein, 10 aa, Artificial Sequence
  Description of Artificial Sequence: Synthetic peptide
  Seed: NCSVYDFFVW (TYRP2_HUMAN)
NWSVYDFFVW

SEQ ID NO: 191544 - protein, 9 aa, Artificial Sequence
  Description of Artificial Sequence: Synthetic peptide
  Seed: FLNGTNALP (TYRP2_HUMAN)
FINGTNALI

SEQ ID NO: 191545 - protein, 9 aa, Artificial Sequence
  Description of Artificial Sequence: Synthetic peptide
  Seed: KDIRDCLSL (TYRP2_HUMAN)
KEIRDCLSL

SEQ ID NO: 191546 - protein, 10 aa, Artificial Sequence
  Description of Artificial Sequence: Synthetic peptide
  Seed: ADTRPWSGPY (TYRP2_HUMAN)
AKTRPWSGPY

SEQ ID NO: 191547 - protein, 9 aa, Artificial Sequence
  Description of Artificial Sequence: Synthetic peptide
  Seed: VTWHRYHLL (TYRP2_HUMAN)
VGWHRYHLY

SEQ ID NO: 191548 - protein, 9 aa, Artificial Sequence
  Description of Artificial Sequence: Synthetic peptide
  Seed: FLTSDQLGY (TYRP2_HUMAN)
FYTSDQLGY

SEQ ID NO: 191549 - protein, 9 aa, Artificial Sequence
  Description of Artificial Sequence: Synthetic peptide
  Seed: FTDAIFDEW (TYRP2_HUMAN)
FIDAIFDEF

SEQ ID NO: 191550 - protein, 9 aa, Artificial Sequence
  Description of Artificial Sequence: Synthetic peptide
  Seed: YSYAIDLPV (TYRP2_HUMAN)
YGYAIDLPW

SEQ ID NO: 191551 - protein, 9 aa, Artificial Sequence
  Description of Artificial Sequence: Synthetic peptide
  Seed: RFNPPADAW (TYRP2_HUMAN)
RSNPPADAW

SEQ ID NO: 191552 - protein, 10 aa, Artificial Sequence
  Description of Artificial Sequence: Synthetic peptide
  Seed: TDAIFDEWMK (TYRP2_HUMAN)
TMAIFDEWMR

SEQ ID NO: 191553 - protein, 10 aa, Artificial Sequence
  Description of Artificial Sequence: Synthetic peptide
  Seed: FLLSCLGCKI (TYRP2_HUMAN)
FPLSCLGCKV

SEQ ID NO: 191554 - protein, 10 aa, Artificial Sequence
  Description of Artificial Sequence: Synthetic peptide
  Seed: QPQFANCSVY (TYRP2_HUMAN)
QMQFANCSVY

SEQ ID NO: 191555 - protein, 9 aa, Artificial Sequence
  Description of Artificial Sequence: Synthetic peptide
  Seed: AARPDDPTL (TYRP2_HUMAN)
AFRPDDPTL

SEQ ID NO: 191556 - protein, 11 aa, Artificial Sequence
  Description of Artificial Sequence: Synthetic peptide
  Seed: HPDYVITTQHW (TYRP2_HUMAN)
HEDYVITTQHF

SEQ ID NO: 191557 - protein, 10 aa, Artificial Sequence
  Description of Artificial Sequence: Synthetic peptide
  Seed: YNMVPFFPPV (TYRP2_HUMAN)
YCMVPFFPPL

SEQ ID NO: 191558 - protein, 9 aa, Artificial Sequence
  Description of Artificial Sequence: Synthetic peptide
  Seed: SFALPYWNF (TYRP2_HUMAN)
SWALPYWNF

SEQ ID NO: 191559 - protein, 10 aa, Artificial Sequence
  Description of Artificial Sequence: Synthetic peptide
  Seed: IGNESFALPY (TYRP2_HUMAN)
IQNESFALPM

SEQ ID NO: 191560 - protein, 9 aa, Artificial Sequence
  Description of Artificial Sequence: Synthetic peptide
  Seed: TSDQLGYSY (TYRP2_HUMAN)
TVDQLGYSF

SEQ ID NO: 191561 - protein, 9 aa, Artificial Sequence
  Description of Artificial Sequence: Synthetic peptide
  Seed: YAIDLPVSV (TYRP2_HUMAN)
YQIDLPVSV

SEQ ID NO: 191562 - protein, 9 aa, Artificial Sequence
  Description of Artificial Sequence: Synthetic peptide
  Seed: VVMGTLVAL (TYRP2_HUMAN)
VSMGTLVAA

SEQ ID NO: 191563 - protein, 9 aa, Artificial Sequence
  Description of Artificial Sequence: Synthetic peptide
  Seed: RQNIHSLSP (TYRP2_HUMAN)
RLNIHSLSF

SEQ ID NO: 191564 - protein, 10 aa, Artificial Sequence
  Description of Artificial Sequence: Synthetic peptide
  Seed: KRFNPPADAW (TYRP2_HUMAN)
KLFNPPADAY

SEQ ID NO: 191565 - protein, 10 aa, Artificial Sequence
  Description of Artificial Sequence: Synthetic peptide
  Seed: QPQFANCSVY (TYRP2_HUMAN)
QNQFANCSVY

SEQ ID NO: 191566 - protein, 10 aa, Artificial Sequence
  Description of Artificial Sequence: Synthetic peptide
  Seed: NMVPFFPPVT (TYRP2_HUMAN)
NMVPFFPPVV

SEQ ID NO: 191567 - protein, 9 aa, Artificial Sequence
  Description of Artificial Sequence: Synthetic peptide
  Seed: WMKRFNPPA (TYRP2_HUMAN)
WVKRFNPPF

SEQ ID NO: 191568 - protein, 9 aa, Artificial Sequence
  Description of Artificial Sequence: Synthetic peptide
  Seed: RVCMTVDSL (TYRP2_HUMAN)
RSCMTVDSW

SEQ ID NO: 191569 - protein, 10 aa, Artificial Sequence
  Description of Artificial Sequence: Synthetic peptide
  Seed: SVYDFFVWLH (TYRP2_HUMAN)
SNYDFFVWLY

SEQ ID NO: 191570 - protein, 10 aa, Artificial Sequence
  Description of Artificial Sequence: Synthetic peptide
  Seed: LTSDQLGYSY (TYRP2_HUMAN)
LGSDQLGYSW

SEQ ID NO: 191571 - protein, 10 aa, Artificial Sequence
  Description of Artificial Sequence: Synthetic peptide
  Seed: RNSMKLPTLK (TYRP2_HUMAN)
RCSMKLPTLK

SEQ ID NO: 191572 - protein, 10 aa, Artificial Sequence
  Description of Artificial Sequence: Synthetic peptide
  Seed: CMTVDSLVNK (TYRP2_HUMAN)
CRTVDSLVNK

SEQ ID NO: 191573 - protein, 10 aa, Artificial Sequence
  Description of Artificial Sequence: Synthetic peptide
  Seed: YNMVPFFPPV (TYRP2_HUMAN)
YCMVPFFPPA

SEQ ID NO: 191574 - protein, 11 aa, Artificial Sequence
  Description of Artificial Sequence: Synthetic peptide
  Seed: YTPLMETHLSS (TYRP2_HUMAN)
YVPLMETHLSL

SEQ ID NO: 191575 - protein, 9 aa, Artificial Sequence
  Description of Artificial Sequence: Synthetic peptide
  Seed: RLRKGYTPL (TYRP2_HUMAN)
RTRKGYTPQ

SEQ ID NO: 191576 - protein, 10 aa, Artificial Sequence
  Description of Artificial Sequence: Synthetic peptide
  Seed: YNMVPFFPPV (TYRP2_HUMAN)
YVMVPFFPPL

SEQ ID NO: 191577 - protein, 9 aa, Artificial Sequence
  Description of Artificial Sequence: Synthetic peptide
  Seed: LLAFLQYRR (TYRP2_HUMAN)
LTAFLQYRK

SEQ ID NO: 191578 - protein, 10 aa, Artificial Sequence
  Description of Artificial Sequence: Synthetic peptide
  Seed: RRLRKGYTPL (TYRP2_HUMAN)
RWLRKGYTPF

SEQ ID NO: 191579 - protein, 9 aa, Artificial Sequence
  Description of Artificial Sequence: Synthetic peptide
  Seed: RLRKGYTPL (TYRP2_HUMAN)
RKRKGYTPK

SEQ ID NO: 191580 - protein, 10 aa, Artificial Sequence
  Description of Artificial Sequence: Synthetic peptide
  Seed: RLRKGYTPLM (TYRP2_HUMAN)
RYRKGYTPLV

SEQ ID NO: 191581 - protein, 9 aa, Artificial Sequence
  Description of Artificial Sequence: Synthetic peptide
  Seed: AWPQELAPI (TYRP2_HUMAN)
AWPQELAPW

SEQ ID NO: 191582 - protein, 10 aa, Artificial Sequence
  Description of Artificial Sequence: Synthetic peptide
  Seed: SQVMSLHNLV (TYRP2_HUMAN)
SFVMSLHNLV

SEQ ID NO: 191583 - protein, 9 aa, Artificial Sequence
  Description of Artificial Sequence: Synthetic peptide
  Seed: STFSFRNAL (TYRP2_HUMAN)
SAFSFRNAV

SEQ ID NO: 191584 - protein, 10 aa, Artificial Sequence
  Description of Artificial Sequence: Synthetic peptide
  Seed: FPPVTNEELF (TYRP2_HUMAN)
FCPVTNEELY

SEQ ID NO: 191585 - protein, 9 aa, Artificial Sequence
  Description of Artificial Sequence: Synthetic peptide
  Seed: LAPIGHNRM (TYRP2_HUMAN)
LYPIGHNRY

SEQ ID NO: 191586 - protein, 10 aa, Artificial Sequence
  Description of Artificial Sequence: Synthetic peptide
  Seed: YNMVPFFPPV (TYRP2_HUMAN)
YYMVPFFPPI

SEQ ID NO: 191587 - protein, 10 aa, Artificial Sequence
  Description of Artificial Sequence: Synthetic peptide
  Seed: TLCNGTYEGL (TYRP2_HUMAN)
TMCNGTYEGL

SEQ ID NO: 191588 - protein, 9 aa, Artificial Sequence
  Description of Artificial Sequence: Synthetic peptide
  Seed: AARPDDPTL (TYRP2_HUMAN)
AVRPDDPTL

SEQ ID NO: 191589 - protein, 10 aa, Artificial Sequence
  Description of Artificial Sequence: Synthetic peptide
  Seed: SDQLGYSYAI (TYRP2_HUMAN)
SKQLGYSYAY

SEQ ID NO: 191590 - protein, 10 aa, Artificial Sequence
  Description of Artificial Sequence: Synthetic peptide
  Seed: LHYYSVRDTL (TYRP2_HUMAN)
LKYYSVRDTM

SEQ ID NO: 191591 - protein, 9 aa, Artificial Sequence
  Description of Artificial Sequence: Synthetic peptide
  Seed: GPNGTQPQF (TYRP2_HUMAN)
GPNGTQPQA

SEQ ID NO: 191592 - protein, 11 aa, Artificial Sequence
  Description of Artificial Sequence: Synthetic peptide
  Seed: YSYAIDLPVSV (TYRP2_HUMAN)
YAYAIDLPVSM

SEQ ID NO: 191593 - protein, 9 aa, Artificial Sequence
  Description of Artificial Sequence: Synthetic peptide
  Seed: LSCLGCKIL (TYRP2_HUMAN)
LTCLGCKIW

SEQ ID NO: 191594 - protein, 10 aa, Artificial Sequence
  Description of Artificial Sequence: Synthetic peptide
  Seed: QPQFANCSVY (TYRP2_HUMAN)
QYQFANCSVM

SEQ ID NO: 191595 - protein, 9 aa, Artificial Sequence
  Description of Artificial Sequence: Synthetic peptide
  Seed: SRNSRFSSW (TYRP2_HUMAN)
SLNSRFSSF

SEQ ID NO: 191596 - protein, 9 aa, Artificial Sequence
  Description of Artificial Sequence: Synthetic peptide
  Seed: AANDPIFVV (TYRP2_HUMAN)
AFNDPIFVL

SEQ ID NO: 191597 - protein, 8 aa, Artificial Sequence
  Description of Artificial Sequence: Synthetic peptide
  Seed: RPDDPTLI (TYRP2_HUMAN)
RIDDPTLI

SEQ ID NO: 191598 - protein, 9 aa, Artificial Sequence
  Description of Artificial Sequence: Synthetic peptide
  Seed: WPQELAPIG (TYRP2_HUMAN)
WPQELAPIF

SEQ ID NO: 191599 - protein, 9 aa, Artificial Sequence
  Description of Artificial Sequence: Synthetic peptide
  Seed: YSYAIDLPV (TYRP2_HUMAN)
YAYAIDLPI

SEQ ID NO: 191600 - protein, 9 aa, Artificial Sequence
  Description of Artificial Sequence: Synthetic peptide
  Seed: VVLHSFTDA (TYRP2_HUMAN)
VTLHSFTDV

SEQ ID NO: 191601 - protein, 9 aa, Artificial Sequence
  Description of Artificial Sequence: Synthetic peptide
  Seed: GTYEGLLRR (TYRP2_HUMAN)
GAYEGLLRK

SEQ ID NO: 191602 - protein, 9 aa, Artificial Sequence
  Description of Artificial Sequence: Synthetic peptide
  Seed: SRNSRFSSW (TYRP2_HUMAN)
SMNSRFSSY

SEQ ID NO: 191603 - protein, 9 aa, Artificial Sequence
  Description of Artificial Sequence: Synthetic peptide
  Seed: RLRKGYTPL (TYRP2_HUMAN)
RARKGYTPY

SEQ ID NO: 191604 - protein, 9 aa, Artificial Sequence
  Description of Artificial Sequence: Synthetic peptide
  Seed: RNQDDRELW (TYRP2_HUMAN)
RLQDDRELM

SEQ ID NO: 191605 - protein, 11 aa, Artificial Sequence
  Description of Artificial Sequence: Synthetic peptide
  Seed: ANCSVYDFFVW (TYRP2_HUMAN)
AGCSVYDFFVW

SEQ ID NO: 191606 - protein, 11 aa, Artificial Sequence
  Description of Artificial Sequence: Synthetic peptide
  Seed: SLSPQEREQFL (TYRP2_HUMAN)
SQSPQEREQFI

SEQ ID NO: 191607 - protein, 10 aa, Artificial Sequence
  Description of Artificial Sequence: Synthetic peptide
  Seed: NCSVYDFFVW (TYRP2_HUMAN)
NHSVYDFFVW

SEQ ID NO: 191608 - protein, 9 aa, Artificial Sequence
  Description of Artificial Sequence: Synthetic peptide
  Seed: DQLGYSYAI (TYRP2_HUMAN)
DALGYSYAL

SEQ ID NO: 191609 - protein, 10 aa, Artificial Sequence
  Description of Artificial Sequence: Synthetic peptide
  Seed: HNRMYNMVPF (TYRP2_HUMAN)
HQRMYNMVPW

SEQ ID NO: 191610 - protein, 9 aa, Artificial Sequence
  Description of Artificial Sequence: Synthetic peptide
  Seed: ELWPRKFFH (TYRP2_HUMAN)
ELWPRKFFK

SEQ ID NO: 191611 - protein, 11 aa, Artificial Sequence
  Description of Artificial Sequence: Synthetic peptide
  Seed: SLDDYNHLVTL (TYRP2_HUMAN)
SMDDYNHLVTV

SEQ ID NO: 191612 - protein, 9 aa, Artificial Sequence
  Description of Artificial Sequence: Synthetic peptide
  Seed: LQKFDNPPF (TYRP2_HUMAN)
LLKFDNPPM

SEQ ID NO: 191613 - protein, 10 aa, Artificial Sequence
  Description of Artificial Sequence: Synthetic peptide
  Seed: KILPGAQGQF (TYRP2_HUMAN)
KQLPGAQGQL

SEQ ID NO: 191614 - protein, 9 aa, Artificial Sequence
  Description of Artificial Sequence: Synthetic peptide
  Seed: ELWPRKFFH (TYRP2_HUMAN)
ESWPRKFFR

SEQ ID NO: 191615 - protein, 8 aa, Artificial Sequence
  Description of Artificial Sequence: Synthetic peptide
  Seed: SLDDYNHL (TYRP2_HUMAN)
SFDDYNHI

SEQ ID NO: 191616 - protein, 9 aa, Artificial Sequence
  Description of Artificial Sequence: Synthetic peptide
  Seed: ISRNSRFSS (TYRP2_HUMAN)
IMRNSRFSY

SEQ ID NO: 191617 - protein, 9 aa, Artificial Sequence
  Description of Artificial Sequence: Synthetic peptide
  Seed: LIGNESFAL (TYRP2_HUMAN)
LMGNESFAI

SEQ ID NO: 191618 - protein, 10 aa, Artificial Sequence
  Description of Artificial Sequence: Synthetic peptide
  Seed: VVMGTLVALV (TYRP2_HUMAN)
VLMGTLVALW

SEQ ID NO: 191619 - protein, 9 aa, Artificial Sequence
  Description of Artificial Sequence: Synthetic peptide
  Seed: VTWHRYHLL (TYRP2_HUMAN)
VWWHRYHLY

SEQ ID NO: 191620 - protein, 9 aa, Artificial Sequence
  Description of Artificial Sequence: Synthetic peptide
  Seed: RTCKCTGNF (TYRP2_HUMAN)
RTCKCTGNW

SEQ ID NO: 191621 - protein, 10 aa, Artificial Sequence
  Description of Artificial Sequence: Synthetic peptide
  Seed: LVVMGTLVAL (TYRP2_HUMAN)
LVVMGTLVAA

SEQ ID NO: 191622 - protein, 10 aa, Artificial Sequence
  Description of Artificial Sequence: Synthetic peptide
  Seed: RPWSGPYILR (TYRP2_HUMAN)
RKWSGPYILR

SEQ ID NO: 191623 - protein, 10 aa, Artificial Sequence
  Description of Artificial Sequence: Synthetic peptide
  Seed: DIRDCLSLQK (TYRP2_HUMAN)
DWRDCLSLQR

SEQ ID NO: 191624 - protein, 9 aa, Artificial Sequence
  Description of Artificial Sequence: Synthetic peptide
  Seed: YAIDLPVSV (TYRP2_HUMAN)
YPIDLPVSA

SEQ ID NO: 191625 - protein, 10 aa, Artificial Sequence
  Description of Artificial Sequence: Synthetic peptide
  Seed: RNSRFSSWET (TYRP2_HUMAN)
RVSRFSSWEM

SEQ ID NO: 191626 - protein, 10 aa, Artificial Sequence
  Description of Artificial Sequence: Synthetic peptide
  Seed: GQFPRVCMTV (TYRP2_HUMAN)
GLFPRVCMTM

SEQ ID NO: 191627 - protein, 9 aa, Artificial Sequence
  Description of Artificial Sequence: Synthetic peptide
  Seed: SVYDFFVWL (TYRP2_HUMAN)
SVYDFFVWA

SEQ ID NO: 191628 - protein, 9 aa, Artificial Sequence
  Description of Artificial Sequence: Synthetic peptide
  Seed: KRFNPPADA (TYRP2_HUMAN)
KYFNPPADM

SEQ ID NO: 191629 - protein, 10 aa, Artificial Sequence
  Description of Artificial Sequence: Synthetic peptide
  Seed: TVDSLVNKEC (TYRP2_HUMAN)
TIDSLVNKEL

SEQ ID NO: 191630 - protein, 9 aa, Artificial Sequence
  Description of Artificial Sequence: Synthetic peptide
  Seed: QKFDNPPFF (TYRP2_HUMAN)
QQFDNPPFI

SEQ ID NO: 191631 - protein, 9 aa, Artificial Sequence
  Description of Artificial Sequence: Synthetic peptide
  Seed: YAIDLPVSV (TYRP2_HUMAN)
YPIDLPVSC

SEQ ID NO: 191632 - protein, 9 aa, Artificial Sequence
  Description of Artificial Sequence: Synthetic peptide
  Seed: ITTQHWLGL (TYRP2_HUMAN)
IVTQHWLGF

SEQ ID NO: 191633 - protein, 10 aa, Artificial Sequence
  Description of Artificial Sequence: Synthetic peptide
  Seed: FVLLAFLQYR (TYRP2_HUMAN)
FFLLAFLQYR

SEQ ID NO: 191634 - protein, 10 aa, Artificial Sequence
  Description of Artificial Sequence: Synthetic peptide
  Seed: YEGLLRRNQM (TYRP2_HUMAN)
YMGLLRRNQL

SEQ ID NO: 191635 - protein, 10 aa, Artificial Sequence
  Description of Artificial Sequence: Synthetic peptide
  Seed: HNRMYNMVPF (TYRP2_HUMAN)
HSRMYNMVPL

SEQ ID NO: 191636 - protein, 10 aa, Artificial Sequence
  Description of Artificial Sequence: Synthetic peptide
  Seed: RLRKGYTPLM (TYRP2_HUMAN)
RRRKGYTPLR

SEQ ID NO: 191637 - protein, 10 aa, Artificial Sequence
  Description of Artificial Sequence: Synthetic peptide
  Seed: RLRKGYTPLM (TYRP2_HUMAN)
RMRKGYTPLR

SEQ ID NO: 191638 - protein, 9 aa, Artificial Sequence
  Description of Artificial Sequence: Synthetic peptide
  Seed: TQHWLGLLG (TYRP2_HUMAN)
TEHWLGLLY

SEQ ID NO: 191639 - protein, 9 aa, Artificial Sequence
  Description of Artificial Sequence: Synthetic peptide
  Seed: TDQLFGAAR (TYRP2_HUMAN)
TVQLFGAAR

SEQ ID NO: 191640 - protein, 10 aa, Artificial Sequence
  Description of Artificial Sequence: Synthetic peptide
  Seed: MSPLWWGFLL (TYRP2_HUMAN)
MYPLWWGFLF

SEQ ID NO: 191641 - protein, 10 aa, Artificial Sequence
  Description of Artificial Sequence: Synthetic peptide
  Seed: RNQMGRNSMK (TYRP2_HUMAN)
RCQMGRNSMR

SEQ ID NO: 191642 - protein, 10 aa, Artificial Sequence
  Description of Artificial Sequence: Synthetic peptide
  Seed: FGWTGPNCER (TYRP2_HUMAN)
FSWTGPNCEY

SEQ ID NO: 191643 - protein, 10 aa, Artificial Sequence
  Description of Artificial Sequence: Synthetic peptide
  Seed: GNESFALPYW (TYRP2_HUMAN)
GPESFALPYW

SEQ ID NO: 191644 - protein, 9 aa, Artificial Sequence
  Description of Artificial Sequence: Synthetic peptide
  Seed: ELWPRKFFH (TYRP2_HUMAN)
EMWPRKFFR

SEQ ID NO: 191645 - protein, 9 aa, Artificial Sequence
  Description of Artificial Sequence: Synthetic peptide
  Seed: SFLNGTNAL (TYRP2_HUMAN)
SALNGTNAL

SEQ ID NO: 191646 - protein, 11 aa, Artificial Sequence
  Description of Artificial Sequence: Synthetic peptide
  Seed: HQGPAFVTWHR (TYRP2_HUMAN)
HVGPAFVTWHK

SEQ ID NO: 191647 - protein, 9 aa, Artificial Sequence
  Description of Artificial Sequence: Synthetic peptide
  Seed: KRFNPPADA (TYRP2_HUMAN)
KYFNPPADL

SEQ ID NO: 191648 - protein, 11 aa, Artificial Sequence
  Description of Artificial Sequence: Synthetic peptide
  Seed: FSHQGPAFVTW (TYRP2_HUMAN)
FSHQGPAFVTY

SEQ ID NO: 191649 - protein, 9 aa, Artificial Sequence
  Description of Artificial Sequence: Synthetic peptide
  Seed: QPQFANCSV (TYRP2_HUMAN)
QPQFANCSM

SEQ ID NO: 191650 - protein, 9 aa, Artificial Sequence
  Description of Artificial Sequence: Synthetic peptide
  Seed: FVWLHYYSV (TYRP2_HUMAN)
FVWLHYYST

SEQ ID NO: 191651 - protein, 9 aa, Artificial Sequence
  Description of Artificial Sequence: Synthetic peptide
  Seed: STFSFRNAL (TYRP2_HUMAN)
STFSFRNAM

SEQ ID NO: 191652 - protein, 10 aa, Artificial Sequence
  Description of Artificial Sequence: Synthetic peptide
  Seed: SQVMSLHNLV (TYRP2_HUMAN)
SGVMSLHNLV

SEQ ID NO: 191653 - protein, 10 aa, Artificial Sequence
  Description of Artificial Sequence: Synthetic peptide
  Seed: HNRMYNMVPF (TYRP2_HUMAN)
HARMYNMVPY

SEQ ID NO: 191654 - protein, 11 aa, Artificial Sequence
  Description of Artificial Sequence: Synthetic peptide
  Seed: YTPLMETHLSS (TYRP2_HUMAN)
YSPLMETHLSL

SEQ ID NO: 191655 - protein, 11 aa, Artificial Sequence
  Description of Artificial Sequence: Synthetic peptide
  Seed: FFPPVTNEELF (TYRP2_HUMAN)
FAPPVTNEELY

SEQ ID NO: 191656 - protein, 10 aa, Artificial Sequence
  Description of Artificial Sequence: Synthetic peptide
  Seed: NIHSLSPQER (TYRP2_HUMAN)
NTHSLSPQER

SEQ ID NO: 191657 - protein, 9 aa, Artificial Sequence
  Description of Artificial Sequence: Synthetic peptide
  Seed: SFRNALEGF (TYRP2_HUMAN)
SWRNALEGF

SEQ ID NO: 191658 - protein, 9 aa, Artificial Sequence
  Description of Artificial Sequence: Synthetic peptide
  Seed: SRFSSWETV (TYRP2_HUMAN)
SHFSSWETV

SEQ ID NO: 191659 - protein, 10 aa, Artificial Sequence
  Description of Artificial Sequence: Synthetic peptide
  Seed: MSPLWWGFLL (TYRP2_HUMAN)
MLPLWWGFLA

SEQ ID NO: 191660 - protein, 9 aa, Artificial Sequence
  Description of Artificial Sequence: Synthetic peptide
  Seed: TTQHWLGLL (TYRP2_HUMAN)
TTQHWLGLY

SEQ ID NO: 191661 - protein, 10 aa, Artificial Sequence
  Description of Artificial Sequence: Synthetic peptide
  Seed: NLVHSFLNGT (TYRP2_HUMAN)
NIVHSFLNGV

SEQ ID NO: 191662 - protein, 10 aa, Artificial Sequence
  Description of Artificial Sequence: Synthetic peptide
  Seed: YDFFVWLHYY (TYRP2_HUMAN)
YYFFVWLHYF

SEQ ID NO: 191663 - protein, 11 aa, Artificial Sequence
  Description of Artificial Sequence: Synthetic peptide
  Seed: YTPLMETHLSS (TYRP2_HUMAN)
YDPLMETHLSA

SEQ ID NO: 191664 - protein, 9 aa, Artificial Sequence
  Description of Artificial Sequence: Synthetic peptide
  Seed: HQGPAFVTW (TYRP2_HUMAN)
HTGPAFVTM

SEQ ID NO: 191665 - protein, 10 aa, Artificial Sequence
  Description of Artificial Sequence: Synthetic peptide
  Seed: MSLHNLVHSF (TYRP2_HUMAN)
MNLHNLVHSF

SEQ ID NO: 191666 - protein, 9 aa, Artificial Sequence
  Description of Artificial Sequence: Synthetic peptide
  Seed: RTCKCTGNF (TYRP2_HUMAN)
RQCKCTGNF

SEQ ID NO: 191667 - protein, 11 aa, Artificial Sequence
  Description of Artificial Sequence: Synthetic peptide
  Seed: RMYNMVPFFPP (TYRP2_HUMAN)
RVYNMVPFFPV

SEQ ID NO: 191668 - protein, 9 aa, Artificial Sequence
  Description of Artificial Sequence: Synthetic peptide
  Seed: QKFDNPPFF (TYRP2_HUMAN)
QMFDNPPFI

SEQ ID NO: 191669 - protein, 9 aa, Artificial Sequence
  Description of Artificial Sequence: Synthetic peptide
  Seed: DFFVWLHYY (TYRP2_HUMAN)
DPFVWLHYR

SEQ ID NO: 191670 - protein, 11 aa, Artificial Sequence
  Description of Artificial Sequence: Synthetic peptide
  Seed: YTPLMETHLSS (TYRP2_HUMAN)
YFPLMETHLSA

SEQ ID NO: 191671 - protein, 10 aa, Artificial Sequence
  Description of Artificial Sequence: Synthetic peptide
  Seed: MGRNSMKLPT (TYRP2_HUMAN)
MQRNSMKLPK

SEQ ID NO: 191672 - protein, 10 aa, Artificial Sequence
  Description of Artificial Sequence: Synthetic peptide
  Seed: LISRNSRFSS (TYRP2_HUMAN)
LSSRNSRFSA

SEQ ID NO: 191673 - protein, 9 aa, Artificial Sequence
  Description of Artificial Sequence: Synthetic peptide
  Seed: SVYDFFVWL (TYRP2_HUMAN)
SSYDFFVWL

SEQ ID NO: 191674 - protein, 11 aa, Artificial Sequence
  Description of Artificial Sequence: Synthetic peptide
  Seed: LPVSVEETPGW (TYRP2_HUMAN)
LMVSVEETPGW

SEQ ID NO: 191675 - protein, 9 aa, Artificial Sequence
  Description of Artificial Sequence: Synthetic peptide
  Seed: VMSLHNLVH (TYRP2_HUMAN)
VKSLHNLVF

SEQ ID NO: 191676 - protein, 10 aa, Artificial Sequence
  Description of Artificial Sequence: Synthetic peptide
  Seed: GTLDSQVMSL (TYRP2_HUMAN)
GMLDSQVMSV

SEQ ID NO: 191677 - protein, 9 aa, Artificial Sequence
  Description of Artificial Sequence: Synthetic peptide
  Seed: FSHQGPAFV (TYRP2_HUMAN)
FAHQGPAFF

SEQ ID NO: 191678 - protein, 10 aa, Artificial Sequence
  Description of Artificial Sequence: Synthetic peptide
  Seed: GTLDSQVMSL (TYRP2_HUMAN)
GFLDSQVMSI

SEQ ID NO: 191679 - protein, 10 aa, Artificial Sequence
  Description of Artificial Sequence: Synthetic peptide
  Seed: AANDPIFVVL (TYRP2_HUMAN)
ALNDPIFVVW

SEQ ID NO: 191680 - protein, 10 aa, Artificial Sequence
  Description of Artificial Sequence: Synthetic peptide
  Seed: HYYSVRDTLL (TYRP2_HUMAN)
HRYSVRDTLF

SEQ ID NO: 191681 - protein, 10 aa, Artificial Sequence
  Description of Artificial Sequence: Synthetic peptide
  Seed: CMTVDSLVNK (TYRP2_HUMAN)
CYTVDSLVNR

SEQ ID NO: 191682 - protein, 11 aa, Artificial Sequence
  Description of Artificial Sequence: Synthetic peptide
  Seed: HSFTDAIFDEW (TYRP2_HUMAN)
HQFTDAIFDEL

SEQ ID NO: 191683 - protein, 9 aa, Artificial Sequence
  Description of Artificial Sequence: Synthetic peptide
  Seed: VLHSFTDAI (TYRP2_HUMAN)
VRHSFTDAF

SEQ ID NO: 191684 - protein, 9 aa, Artificial Sequence
  Description of Artificial Sequence: Synthetic peptide
  Seed: SQVMSLHNL (TYRP2_HUMAN)
SVVMSLHNF

SEQ ID NO: 191685 - protein, 9 aa, Artificial Sequence
  Description of Artificial Sequence: Synthetic peptide
  Seed: ETPGWPTTL (TYRP2_HUMAN)
EYPGWPTTY

SEQ ID NO: 191686 - protein, 9 aa, Artificial Sequence
  Description of Artificial Sequence: Synthetic peptide
  Seed: NESFALPYW (TYRP2_HUMAN)
NESFALPYY

SEQ ID NO: 191687 - protein, 9 aa, Artificial Sequence
  Description of Artificial Sequence: Synthetic peptide
  Seed: SLHNLVHSF (TYRP2_HUMAN)
SWHNLVHSI

SEQ ID NO: 191688 - protein, 9 aa, Artificial Sequence
  Description of Artificial Sequence: Synthetic peptide
  Seed: SQVMSLHNL (TYRP2_HUMAN)
SMVMSLHNM

SEQ ID NO: 191689 - protein, 9 aa, Artificial Sequence
  Description of Artificial Sequence: Synthetic peptide
  Seed: YAIDLPVSV (TYRP2_HUMAN)
YIIDLPVSF

SEQ ID NO: 191690 - protein, 10 aa, Artificial Sequence
  Description of Artificial Sequence: Synthetic peptide
  Seed: HSFLNGTNAL (TYRP2_HUMAN)
HRFLNGTNAY

SEQ ID NO: 191691 - protein, 10 aa, Artificial Sequence
  Description of Artificial Sequence: Synthetic peptide
  Seed: MSPLWWGFLL (TYRP2_HUMAN)
MKPLWWGFLL

SEQ ID NO: 191692 - protein, 9 aa, Artificial Sequence
  Description of Artificial Sequence: Synthetic peptide
  Seed: AGYNCGDCK (TYRP2_HUMAN)
AVYNCGDCK

SEQ ID NO: 191693 - protein, 10 aa, Artificial Sequence
  Description of Artificial Sequence: Synthetic peptide
  Seed: LVVMGTLVAL (TYRP2_HUMAN)
LKVMGTLVAY

SEQ ID NO: 191694 - protein, 9 aa, Artificial Sequence
  Description of Artificial Sequence: Synthetic peptide
  Seed: RKFFHRTCK (TYRP2_HUMAN)
RIFFHRTCS

SEQ ID NO: 191695 - protein, 9 aa, Artificial Sequence
  Description of Artificial Sequence: Synthetic peptide
  Seed: TLVALVGLF (TYRP2_HUMAN)
TIVALVGLY

SEQ ID NO: 191696 - protein, 9 aa, Artificial Sequence
  Description of Artificial Sequence: Synthetic peptide
  Seed: QVMSLHNLV (TYRP2_HUMAN)
QLMSLHNLA

SEQ ID NO: 191697 - protein, 9 aa, Artificial Sequence
  Description of Artificial Sequence: Synthetic peptide
  Seed: TSDQLGYSY (TYRP2_HUMAN)
TNDQLGYSL

SEQ ID NO: 191698 - protein, 9 aa, Artificial Sequence
  Description of Artificial Sequence: Synthetic peptide
  Seed: QKFDNPPFF (TYRP2_HUMAN)
QQFDNPPFY

SEQ ID NO: 191699 - protein, 9 aa, Artificial Sequence
  Description of Artificial Sequence: Synthetic peptide
  Seed: VVMGTLVAL (TYRP2_HUMAN)
VLMGTLVAC

SEQ ID NO: 191700 - protein, 11 aa, Artificial Sequence
  Description of Artificial Sequence: Synthetic peptide
  Seed: VMSLHNLVHSF (TYRP2_HUMAN)
VQSLHNLVHSF

SEQ ID NO: 191701 - protein, 9 aa, Artificial Sequence
  Description of Artificial Sequence: Synthetic peptide
  Seed: YAIDLPVSV (TYRP2_HUMAN)
YLIDLPVSA

SEQ ID NO: 191702 - protein, 9 aa, Artificial Sequence
  Description of Artificial Sequence: Synthetic peptide
  Seed: ISRNSRFSS (TYRP2_HUMAN)
ISRNSRFSM

SEQ ID NO: 191703 - protein, 11 aa, Artificial Sequence
  Description of Artificial Sequence: Synthetic peptide
  Seed: YTPLMETHLSS (TYRP2_HUMAN)
YDPLMETHLSL

SEQ ID NO: 191704 - protein, 9 aa, Artificial Sequence
  Description of Artificial Sequence: Synthetic peptide
  Seed: SLDDYNHLV (TYRP2_HUMAN)
SWDDYNHLF

SEQ ID NO: 191705 - protein, 10 aa, Artificial Sequence
  Description of Artificial Sequence: Synthetic peptide
  Seed: RPDDPTLISR (TYRP2_HUMAN)
RIDDPTLISF

SEQ ID NO: 191706 - protein, 9 aa, Artificial Sequence
  Description of Artificial Sequence: Synthetic peptide
  Seed: RAIDFSHQG (TYRP2_HUMAN)
RLIDFSHQY

SEQ ID NO: 191707 - protein, 10 aa, Artificial Sequence
  Description of Artificial Sequence: Synthetic peptide
  Seed: FPPVTNEELF (TYRP2_HUMAN)
FCPVTNEELW

SEQ ID NO: 191708 - protein, 9 aa, Artificial Sequence
  Description of Artificial Sequence: Synthetic peptide
  Seed: HYYSVRDTL (TYRP2_HUMAN)
HRYSVRDTM

SEQ ID NO: 191709 - protein, 9 aa, Artificial Sequence
  Description of Artificial Sequence: Synthetic peptide
  Seed: TTQHWLGLL (TYRP2_HUMAN)
TVQHWLGLV

SEQ ID NO: 191710 - protein, 10 aa, Artificial Sequence
  Description of Artificial Sequence: Synthetic peptide
  Seed: FPPVTNEELF (TYRP2_HUMAN)
FRPVTNEELY

SEQ ID NO: 191711 - protein, 9 aa, Artificial Sequence
  Description of Artificial Sequence: Synthetic peptide
  Seed: GAQGQFPRV (TYRP2_HUMAN)
GIQGQFPRV

SEQ ID NO: 191712 - protein, 10 aa, Artificial Sequence
  Description of Artificial Sequence: Synthetic peptide
  Seed: GQFPRVCMTV (TYRP2_HUMAN)
GKFPRVCMTY

SEQ ID NO: 191713 - protein, 10 aa, Artificial Sequence
  Description of Artificial Sequence: Synthetic peptide
  Seed: NLVHSFLNGT (TYRP2_HUMAN)
NLVHSFLNGI

SEQ ID NO: 191714 - protein, 11 aa, Artificial Sequence
  Description of Artificial Sequence: Synthetic peptide
  Seed: MSLHNLVHSFL (TYRP2_HUMAN)
MVLHNLVHSFW

SEQ ID NO: 191715 - protein, 9 aa, Artificial Sequence
  Description of Artificial Sequence: Synthetic peptide
  Seed: SVRDTLLGP (TYRP2_HUMAN)
SVRDTLLGV

SEQ ID NO: 191716 - protein, 9 aa, Artificial Sequence
  Description of Artificial Sequence: Synthetic peptide
  Seed: KDIRDCLSL (TYRP2_HUMAN)
KLIRDCLSL

SEQ ID NO: 191717 - protein, 11 aa, Artificial Sequence
  Description of Artificial Sequence: Synthetic peptide
  Seed: ANCSVYDFFVW (TYRP2_HUMAN)
ATCSVYDFFVW

SEQ ID NO: 191718 - protein, 9 aa, Artificial Sequence
  Description of Artificial Sequence: Synthetic peptide
  Seed: SLHNLVHSF (TYRP2_HUMAN)
STHNLVHSR

SEQ ID NO: 191719 - protein, 10 aa, Artificial Sequence
  Description of Artificial Sequence: Synthetic peptide
  Seed: YSYAIDLPVS (TYRP2_HUMAN)
YMYAIDLPVT

SEQ ID NO: 191720 - protein, 10 aa, Artificial Sequence
  Description of Artificial Sequence: Synthetic peptide
  Seed: LVALVGLFVL (TYRP2_HUMAN)
LLALVGLFVL

SEQ ID NO: 191721 - protein, 11 aa, Artificial Sequence
  Description of Artificial Sequence: Synthetic peptide
  Seed: RNSRFSSWETV (TYRP2_HUMAN)
RISRFSSWETF

SEQ ID NO: 191722 - protein, 10 aa, Artificial Sequence
  Description of Artificial Sequence: Synthetic peptide
  Seed: MGRNSMKLPT (TYRP2_HUMAN)
MVRNSMKLPA

SEQ ID NO: 191723 - protein, 9 aa, Artificial Sequence
  Description of Artificial Sequence: Synthetic peptide
  Seed: RQNIHSLSP (TYRP2_HUMAN)
RQNIHSLSG

SEQ ID NO: 191724 - protein, 9 aa, Artificial Sequence
  Description of Artificial Sequence: Synthetic peptide
  Seed: VLHSFTDAI (TYRP2_HUMAN)
VQHSFTDAF

SEQ ID NO: 191725 - protein, 9 aa, Artificial Sequence
  Description of Artificial Sequence: Synthetic peptide
  Seed: GPNGTQPQF (TYRP2_HUMAN)
GLNGTQPQF

SEQ ID NO: 191726 - protein, 10 aa, Artificial Sequence
  Description of Artificial Sequence: Synthetic peptide
  Seed: QELAPIGHNR (TYRP2_HUMAN)
QALAPIGHNK

SEQ ID NO: 191727 - protein, 9 aa, Artificial Sequence
  Description of Artificial Sequence: Synthetic peptide
  Seed: RLRKGYTPL (TYRP2_HUMAN)
RMRKGYTPY

SEQ ID NO: 191728 - protein, 9 aa, Artificial Sequence
  Description of Artificial Sequence: Synthetic peptide
  Seed: NEELFLTSD (TYRP2_HUMAN)
NEELFLTST

SEQ ID NO: 191729 - protein, 10 aa, Artificial Sequence
  Description of Artificial Sequence: Synthetic peptide
  Seed: CTDQLFGAAR (TYRP2_HUMAN)
CVDQLFGAAY

SEQ ID NO: 191730 - protein, 9 aa, Artificial Sequence
  Description of Artificial Sequence: Synthetic peptide
  Seed: SRNSRFSSW (TYRP2_HUMAN)
SYNSRFSSF

SEQ ID NO: 191731 - protein, 9 aa, Artificial Sequence
  Description of Artificial Sequence: Synthetic peptide
  Seed: VTWHRYHLL (TYRP2_HUMAN)
VAWHRYHLV

SEQ ID NO: 191732 - protein, 9 aa, Artificial Sequence
  Description of Artificial Sequence: Synthetic peptide
  Seed: SFALPYWNF (TYRP2_HUMAN)
SRALPYWNF

SEQ ID NO: 191733 - protein, 11 aa, Artificial Sequence
  Description of Artificial Sequence: Synthetic peptide
  Seed: LLVVMGTLVAL (TYRP2_HUMAN)
LQVVMGTLVAV

SEQ ID NO: 191734 - protein, 9 aa, Artificial Sequence
  Description of Artificial Sequence: Synthetic peptide
  Seed: SVYDFFVWL (TYRP2_HUMAN)
SQYDFFVWM

SEQ ID NO: 191735 - protein, 9 aa, Artificial Sequence
  Description of Artificial Sequence: Synthetic peptide
  Seed: DQLGYSYAI (TYRP2_HUMAN)
DQLGYSYAM

SEQ ID NO: 191736 - protein, 10 aa, Artificial Sequence
  Description of Artificial Sequence: Synthetic peptide
  Seed: YDFFVWLHYY (TYRP2_HUMAN)
YDFFVWLHYF

SEQ ID NO: 191737 - protein, 9 aa, Artificial Sequence
  Description of Artificial Sequence: Synthetic peptide
  Seed: SLDDYNHLV (TYRP2_HUMAN)
SVDDYNHLY

SEQ ID NO: 191738 - protein, 9 aa, Artificial Sequence
  Description of Artificial Sequence: Synthetic peptide
  Seed: SFLNGTNAL (TYRP2_HUMAN)
SLLNGTNAL

SEQ ID NO: 191739 - protein, 9 aa, Artificial Sequence
  Description of Artificial Sequence: Synthetic peptide
  Seed: VALVGLFVL (TYRP2_HUMAN)
VSLVGLFVM

SEQ ID NO: 191740 - protein, 9 aa, Artificial Sequence
  Description of Artificial Sequence: Synthetic peptide
  Seed: SAANDPIFV (TYRP2_HUMAN)
SMANDPIFV

SEQ ID NO: 191741 - protein, 10 aa, Artificial Sequence
  Description of Artificial Sequence: Synthetic peptide
  Seed: HSFLNGTNAL (TYRP2_HUMAN)
HVFLNGTNAF

SEQ ID NO: 191742 - protein, 10 aa, Artificial Sequence
  Description of Artificial Sequence: Synthetic peptide
  Seed: AQGQFPRVCM (TYRP2_HUMAN)
AQGQFPRVCY

SEQ ID NO: 191743 - protein, 9 aa, Artificial Sequence
  Description of Artificial Sequence: Synthetic peptide
  Seed: TSDQLGYSY (TYRP2_HUMAN)
TSDQLGYSF

SEQ ID NO: 191744 - protein, 10 aa, Artificial Sequence
  Description of Artificial Sequence: Synthetic peptide
  Seed: HSFLNGTNAL (TYRP2_HUMAN)
HKFLNGTNAM

SEQ ID NO: 191745 - protein, 9 aa, Artificial Sequence
  Description of Artificial Sequence: Synthetic peptide
  Seed: YSYAIDLPV (TYRP2_HUMAN)
YPYAIDLPC

SEQ ID NO: 191746 - protein, 9 aa, Artificial Sequence
  Description of Artificial Sequence: Synthetic peptide
  Seed: SFLNGTNAL (TYRP2_HUMAN)
SWLNGTNAL

SEQ ID NO: 191747 - protein, 10 aa, Artificial Sequence
  Description of Artificial Sequence: Synthetic peptide
  Seed: SPLWWGFLLS (TYRP2_HUMAN)
SWLWWGFLLV

SEQ ID NO: 191748 - protein, 11 aa, Artificial Sequence
  Description of Artificial Sequence: Synthetic peptide
  Seed: VLLAFLQYRRL (TYRP2_HUMAN)
VLLAFLQYRRI

SEQ ID NO: 191749 - protein, 8 aa, Artificial Sequence
  Description of Artificial Sequence: Synthetic peptide
  Seed: SLDDYNHL (TYRP2_HUMAN)
SFDDYNHF

SEQ ID NO: 191750 - protein, 9 aa, Artificial Sequence
  Description of Artificial Sequence: Synthetic peptide
  Seed: DDRELWPRK (TYRP2_HUMAN)
DARELWPRR

SEQ ID NO: 191751 - protein, 10 aa, Artificial Sequence
  Description of Artificial Sequence: Synthetic peptide
  Seed: VVLHSFTDAI (TYRP2_HUMAN)
VNLHSFTDAV

SEQ ID NO: 191752 - protein, 9 aa, Artificial Sequence
  Description of Artificial Sequence: Synthetic peptide
  Seed: YSYAIDLPV (TYRP2_HUMAN)
YHYAIDLPM

SEQ ID NO: 191753 - protein, 9 aa, Artificial Sequence
  Description of Artificial Sequence: Synthetic peptide
  Seed: SVYDFFVWL (TYRP2_HUMAN)
STYDFFVWA

SEQ ID NO: 191754 - protein, 9 aa, Artificial Sequence
  Description of Artificial Sequence: Synthetic peptide
  Seed: AIFDEWMKR (TYRP2_HUMAN)
AWFDEWMKY

SEQ ID NO: 191755 - protein, 9 aa, Artificial Sequence
  Description of Artificial Sequence: Synthetic peptide
  Seed: TDQLFGAAR (TYRP2_HUMAN)
TSQLFGAAR

SEQ ID NO: 191756 - protein, 10 aa, Artificial Sequence
  Description of Artificial Sequence: Synthetic peptide
  Seed: ALVGLFVLLA (TYRP2_HUMAN)
AQVGLFVLLV

SEQ ID NO: 191757 - protein, 10 aa, Artificial Sequence
  Description of Artificial Sequence: Synthetic peptide
  Seed: IGNESFALPY (TYRP2_HUMAN)
ITNESFALPY

SEQ ID NO: 191758 - protein, 10 aa, Artificial Sequence
  Description of Artificial Sequence: Synthetic peptide
  Seed: SSWETVCDSL (TYRP2_HUMAN)
STWETVCDSW

SEQ ID NO: 191759 - protein, 9 aa, Artificial Sequence
  Description of Artificial Sequence: Synthetic peptide
  Seed: AWPQELAPI (TYRP2_HUMAN)
AWPQELAPF

SEQ ID NO: 191760 - protein, 9 aa, Artificial Sequence
  Description of Artificial Sequence: Synthetic peptide
  Seed: RLRKGYTPL (TYRP2_HUMAN)
RLRKGYTPI

SEQ ID NO: 191761 - protein, 10 aa, Artificial Sequence
  Description of Artificial Sequence: Synthetic peptide
  Seed: YNMVPFFPPV (TYRP2_HUMAN)
YIMVPFFPPA

SEQ ID NO: 191762 - protein, 9 aa, Artificial Sequence
  Description of Artificial Sequence: Synthetic peptide
  Seed: SFLNGTNAL (TYRP2_HUMAN)
SQLNGTNAL

SEQ ID NO: 191763 - protein, 9 aa, Artificial Sequence
  Description of Artificial Sequence: Synthetic peptide
  Seed: FSHQGPAFV (TYRP2_HUMAN)
FVHQGPAFL

SEQ ID NO: 191764 - protein, 9 aa, Artificial Sequence
  Description of Artificial Sequence: Synthetic peptide
  Seed: QKFDNPPFF (TYRP2_HUMAN)
QLFDNPPFW

SEQ ID NO: 191765 - protein, 9 aa, Artificial Sequence
  Description of Artificial Sequence: Synthetic peptide
  Seed: TSDQLGYSY (TYRP2_HUMAN)
TVDQLGYSM

SEQ ID NO: 191766 - protein, 9 aa, Artificial Sequence
  Description of Artificial Sequence: Synthetic peptide
  Seed: RVCMTVDSL (TYRP2_HUMAN)
RLCMTVDSY

SEQ ID NO: 191767 - protein, 9 aa, Artificial Sequence
  Description of Artificial Sequence: Synthetic peptide
  Seed: VSVEETPGW (TYRP2_HUMAN)
VTVEETPGF

SEQ ID NO: 191768 - protein, 9 aa, Artificial Sequence
  Description of Artificial Sequence: Synthetic peptide
  Seed: FANCSVYDF (TYRP2_HUMAN)
FYNCSVYDM

SEQ ID NO: 191769 - protein, 11 aa, Artificial Sequence
  Description of Artificial Sequence: Synthetic peptide
  Seed: LPVSVEETPGW (TYRP2_HUMAN)
LTVSVEETPGW

SEQ ID NO: 191770 - protein, 9 aa, Artificial Sequence
  Description of Artificial Sequence: Synthetic peptide
  Seed: VEETPGWPT (TYRP2_HUMAN)
VEETPGWPL

SEQ ID NO: 191771 - protein, 10 aa, Artificial Sequence
  Description of Artificial Sequence: Synthetic peptide
  Seed: NRMYNMVPFF (TYRP2_HUMAN)
NQMYNMVPFF

SEQ ID NO: 191772 - protein, 10 aa, Artificial Sequence
  Description of Artificial Sequence: Synthetic peptide
  Seed: KILPGAQGQF (TYRP2_HUMAN)
KYLPGAQGQY

SEQ ID NO: 191773 - protein, 9 aa, Artificial Sequence
  Description of Artificial Sequence: Synthetic peptide
  Seed: YSYAIDLPV (TYRP2_HUMAN)
YNYAIDLPW

SEQ ID NO: 191774 - protein, 10 aa, Artificial Sequence
  Description of Artificial Sequence: Synthetic peptide
  Seed: ISRNSRFSSW (TYRP2_HUMAN)
IQRNSRFSSW

SEQ ID NO: 191775 - protein, 9 aa, Artificial Sequence
  Description of Artificial Sequence: Synthetic peptide
  Seed: PADAWPQEL (TYRP2_HUMAN)
PTDAWPQEL

SEQ ID NO: 191776 - protein, 11 aa, Artificial Sequence
  Description of Artificial Sequence: Synthetic peptide
  Seed: YNMVPFFPPVT (TYRP2_HUMAN)
YSMVPFFPPVV

SEQ ID NO: 191777 - protein, 9 aa, Artificial Sequence
  Description of Artificial Sequence: Synthetic peptide
  Seed: STFSFRNAL (TYRP2_HUMAN)
SSFSFRNAR

SEQ ID NO: 191778 - protein, 10 aa, Artificial Sequence
  Description of Artificial Sequence: Synthetic peptide
  Seed: KRFNPPADAW (TYRP2_HUMAN)
KEFNPPADAW

SEQ ID NO: 191779 - protein, 9 aa, Artificial Sequence
  Description of Artificial Sequence: Synthetic peptide
  Seed: GLFVLLAFL (TYRP2_HUMAN)
GSFVLLAFV

SEQ ID NO: 191780 - protein, 9 aa, Artificial Sequence
  Description of Artificial Sequence: Synthetic peptide
  Seed: YYSVRDTLL (TYRP2_HUMAN)
YRSVRDTLM

SEQ ID NO: 191781 - protein, 9 aa, Artificial Sequence
  Description of Artificial Sequence: Synthetic peptide
  Seed: LLSCLGCKI (TYRP2_HUMAN)
LLSCLGCKA

SEQ ID NO: 191782 - protein, 10 aa, Artificial Sequence
  Description of Artificial Sequence: Synthetic peptide
  Seed: FPPVTNEELF (TYRP2_HUMAN)
FHPVTNEELW

SEQ ID NO: 191783 - protein, 9 aa, Artificial Sequence
  Description of Artificial Sequence: Synthetic peptide
  Seed: YSYAIDLPV (TYRP2_HUMAN)
YMYAIDLPS

SEQ ID NO: 191784 - protein, 10 aa, Artificial Sequence
  Description of Artificial Sequence: Synthetic peptide
  Seed: LVVMGTLVAL (TYRP2_HUMAN)
LQVMGTLVAV

SEQ ID NO: 191785 - protein, 9 aa, Artificial Sequence
  Description of Artificial Sequence: Synthetic peptide
  Seed: VLHSFTDAI (TYRP2_HUMAN)
VAHSFTDAF

SEQ ID NO: 191786 - protein, 9 aa, Artificial Sequence
  Description of Artificial Sequence: Synthetic peptide
  Seed: TLLGPGRPY (TYRP2_HUMAN)
TYLGPGRPF

SEQ ID NO: 191787 - protein, 9 aa, Artificial Sequence
  Description of Artificial Sequence: Synthetic peptide
  Seed: EGLLRRNQM (TYRP2_HUMAN)
EQLLRRNQL

SEQ ID NO: 191788 - protein, 8 aa, Artificial Sequence
  Description of Artificial Sequence: Synthetic peptide
  Seed: NESFALPY (TYRP2_HUMAN)
NESFALPM

SEQ ID NO: 191789 - protein, 10 aa, Artificial Sequence
  Description of Artificial Sequence: Synthetic peptide
  Seed: RLRKGYTPLM (TYRP2_HUMAN)
RYRKGYTPLA

SEQ ID NO: 191790 - protein, 9 aa, Artificial Sequence
  Description of Artificial Sequence: Synthetic peptide
  Seed: NMVPFFPPV (TYRP2_HUMAN)
NQVPFFPPL

SEQ ID NO: 191791 - protein, 10 aa, Artificial Sequence
  Description of Artificial Sequence: Synthetic peptide
  Seed: RELWPRKFFH (TYRP2_HUMAN)
RELWPRKFFR

SEQ ID NO: 191792 - protein, 9 aa, Artificial Sequence
  Description of Artificial Sequence: Synthetic peptide
  Seed: SFLNGTNAL (TYRP2_HUMAN)
SFLNGTNAV

SEQ ID NO: 191793 - protein, 9 aa, Artificial Sequence
  Description of Artificial Sequence: Synthetic peptide
  Seed: ALVGLFVLL (TYRP2_HUMAN)
ASVGLFVLL

SEQ ID NO: 191794 - protein, 9 aa, Artificial Sequence
  Description of Artificial Sequence: Synthetic peptide
  Seed: RTCKCTGNF (TYRP2_HUMAN)
RSCKCTGNY

SEQ ID NO: 191795 - protein, 10 aa, Artificial Sequence
  Description of Artificial Sequence: Synthetic peptide
  Seed: MSPLWWGFLL (TYRP2_HUMAN)
MQPLWWGFLF

SEQ ID NO: 191796 - protein, 9 aa, Artificial Sequence
  Description of Artificial Sequence: Synthetic peptide
  Seed: VMSLHNLVH (TYRP2_HUMAN)
VKSLHNLVM

SEQ ID NO: 191797 - protein, 10 aa, Artificial Sequence
  Description of Artificial Sequence: Synthetic peptide
  Seed: TRPWSGPYIL (TYRP2_HUMAN)
TVPWSGPYIY

SEQ ID NO: 191798 - protein, 10 aa, Artificial Sequence
  Description of Artificial Sequence: Synthetic peptide
  Seed: LHYYSVRDTL (TYRP2_HUMAN)
LIYYSVRDTF

SEQ ID NO: 191799 - protein, 9 aa, Artificial Sequence
  Description of Artificial Sequence: Synthetic peptide
  Seed: RNQDDRELW (TYRP2_HUMAN)
REQDDRELW

SEQ ID NO: 191800 - protein, 9 aa, Artificial Sequence
  Description of Artificial Sequence: Synthetic peptide
  Seed: TSDQLGYSY (TYRP2_HUMAN)
TTDQLGYSW

SEQ ID NO: 191801 - protein, 9 aa, Artificial Sequence
  Description of Artificial Sequence: Synthetic peptide
  Seed: LSPQEREQF (TYRP2_HUMAN)
LSPQEREQM

SEQ ID NO: 191802 - protein, 10 aa, Artificial Sequence
  Description of Artificial Sequence: Synthetic peptide
  Seed: AANDPIFVVL (TYRP2_HUMAN)
AMNDPIFVVL

SEQ ID NO: 191803 - protein, 10 aa, Artificial Sequence
  Description of Artificial Sequence: Synthetic peptide
  Seed: RPDDPTLISR (TYRP2_HUMAN)
RIDDPTLISL

SEQ ID NO: 191804 - protein, 9 aa, Artificial Sequence
  Description of Artificial Sequence: Synthetic peptide
  Seed: TLDSQVMSL (TYRP2_HUMAN)
TQDSQVMSM

SEQ ID NO: 191805 - protein, 11 aa, Artificial Sequence
  Description of Artificial Sequence: Synthetic peptide
  Seed: YTPLMETHLSS (TYRP2_HUMAN)
YVPLMETHLSI

SEQ ID NO: 191806 - protein, 9 aa, Artificial Sequence
  Description of Artificial Sequence: Synthetic peptide
  Seed: NMVPFFPPV (TYRP2_HUMAN)
NYVPFFPPL

SEQ ID NO: 191807 - protein, 10 aa, Artificial Sequence
  Description of Artificial Sequence: Synthetic peptide
  Seed: RRLRKGYTPL (TYRP2_HUMAN)
RSLRKGYTPY

SEQ ID NO: 191808 - protein, 9 aa, Artificial Sequence
  Description of Artificial Sequence: Synthetic peptide
  Seed: RLRKGYTPL (TYRP2_HUMAN)
RMRKGYTPN

SEQ ID NO: 191809 - protein, 10 aa, Artificial Sequence
  Description of Artificial Sequence: Synthetic peptide
  Seed: RRLRKGYTPL (TYRP2_HUMAN)
RSLRKGYTPS

SEQ ID NO: 191810 - protein, 9 aa, Artificial Sequence
  Description of Artificial Sequence: Synthetic peptide
  Seed: ARPDDPTLI (TYRP2_HUMAN)
AYPDDPTLF

SEQ ID NO: 191811 - protein, 9 aa, Artificial Sequence
  Description of Artificial Sequence: Synthetic peptide
  Seed: MTVDSLVNK (TYRP2_HUMAN)
MAVDSLVNF

SEQ ID NO: 191812 - protein, 9 aa, Artificial Sequence
  Description of Artificial Sequence: Synthetic peptide
  Seed: WMKRFNPPA (TYRP2_HUMAN)
WLKRFNPPL

SEQ ID NO: 191813 - protein, 9 aa, Artificial Sequence
  Description of Artificial Sequence: Synthetic peptide
  Seed: GLFVLLAFL (TYRP2_HUMAN)
GLFVLLAFM

SEQ ID NO: 191814 - protein, 9 aa, Artificial Sequence
  Description of Artificial Sequence: Synthetic peptide
  Seed: ALVGLFVLL (TYRP2_HUMAN)
ALVGLFVLK

SEQ ID NO: 191815 - protein, 10 aa, Artificial Sequence
  Description of Artificial Sequence: Synthetic peptide
  Seed: SYAIDLPVSV (TYRP2_HUMAN)
SLAIDLPVSA

SEQ ID NO: 191816 - protein, 9 aa, Artificial Sequence
  Description of Artificial Sequence: Synthetic peptide
  Seed: LWPRKFFHR (TYRP2_HUMAN)
LTPRKFFHR

SEQ ID NO: 191817 - protein, 9 aa, Artificial Sequence
  Description of Artificial Sequence: Synthetic peptide
  Seed: SVYDFFVWL (TYRP2_HUMAN)
SAYDFFVWM

SEQ ID NO: 191818 - protein, 10 aa, Artificial Sequence
  Description of Artificial Sequence: Synthetic peptide
  Seed: SLSPQEREQF (TYRP2_HUMAN)
STSPQEREQF

SEQ ID NO: 191819 - protein, 9 aa, Artificial Sequence
  Description of Artificial Sequence: Synthetic peptide
  Seed: LVGLFVLLA (TYRP2_HUMAN)
LLGLFVLLV

SEQ ID NO: 191820 - protein, 9 aa, Artificial Sequence
  Description of Artificial Sequence: Synthetic peptide
  Seed: FVLLAFLQY (TYRP2_HUMAN)
FSLLAFLQY

SEQ ID NO: 191821 - protein, 11 aa, Artificial Sequence
  Description of Artificial Sequence: Synthetic peptide
  Seed: MYNMVPFFPPV (TYRP2_HUMAN)
MTNMVPFFPPL

SEQ ID NO: 191822 - protein, 9 aa, Artificial Sequence
  Description of Artificial Sequence: Synthetic peptide
  Seed: WMKRFNPPA (TYRP2_HUMAN)
WFKRFNPPK

SEQ ID NO: 191823 - protein, 10 aa, Artificial Sequence
  Description of Artificial Sequence: Synthetic peptide
  Seed: RNSMKLPTLK (TYRP2_HUMAN)
RPSMKLPTLK

SEQ ID NO: 191824 - protein, 11 aa, Artificial Sequence
  Description of Artificial Sequence: Synthetic peptide
  Seed: YNMVPFFPPVT (TYRP2_HUMAN)
YLMVPFFPPVH

SEQ ID NO: 191825 - protein, 8 aa, Artificial Sequence
  Description of Artificial Sequence: Synthetic peptide
  Seed: AIDLPVSV (TYRP2_HUMAN)
AFDLPVSI

SEQ ID NO: 191826 - protein, 9 aa, Artificial Sequence
  Description of Artificial Sequence: Synthetic peptide
  Seed: QRLIGNESF (TYRP2_HUMAN)
QHLIGNESI

SEQ ID NO: 191827 - protein, 9 aa, Artificial Sequence
  Description of Artificial Sequence: Synthetic peptide
  Seed: RNQMGRNSM (TYRP2_HUMAN)
RQQMGRNSM

SEQ ID NO: 191828 - protein, 10 aa, Artificial Sequence
  Description of Artificial Sequence: Synthetic peptide
  Seed: MSLHNLVHSF (TYRP2_HUMAN)
MWLHNLVHSF

SEQ ID NO: 191829 - protein, 9 aa, Artificial Sequence
  Description of Artificial Sequence: Synthetic peptide
  Seed: ITTQHWLGL (TYRP2_HUMAN)
IATQHWLGF

SEQ ID NO: 191830 - protein, 11 aa, Artificial Sequence
  Description of Artificial Sequence: Synthetic peptide
  Seed: LLVVMGTLVAL (TYRP2_HUMAN)
LFVVMGTLVAV

SEQ ID NO: 191831 - protein, 10 aa, Artificial Sequence
  Description of Artificial Sequence: Synthetic peptide
  Seed: KILPGAQGQF (TYRP2_HUMAN)
KGLPGAQGQY

SEQ ID NO: 191832 - protein, 9 aa, Artificial Sequence
  Description of Artificial Sequence: Synthetic peptide
  Seed: CSVYDFFVW (TYRP2_HUMAN)
CTVYDFFVF

SEQ ID NO: 191833 - protein, 10 aa, Artificial Sequence
  Description of Artificial Sequence: Synthetic peptide
  Seed: FQNSTFSFRN (TYRP2_HUMAN)
FYNSTFSFRR

SEQ ID NO: 191834 - protein, 9 aa, Artificial Sequence
  Description of Artificial Sequence: Synthetic peptide
  Seed: AANDPIFVV (TYRP2_HUMAN)
AANDPIFVM

SEQ ID NO: 191835 - protein, 9 aa, Artificial Sequence
  Description of Artificial Sequence: Synthetic peptide
  Seed: LPVSVEETP (TYRP2_HUMAN)
LPVSVEETA

SEQ ID NO: 191836 - protein, 9 aa, Artificial Sequence
  Description of Artificial Sequence: Synthetic peptide
  Seed: PADAWPQEL (TYRP2_HUMAN)
PYDAWPQEM

SEQ ID NO: 191837 - protein, 9 aa, Artificial Sequence
  Description of Artificial Sequence: Synthetic peptide
  Seed: FVWLHYYSV (TYRP2_HUMAN)
FMWLHYYSS

SEQ ID NO: 191838 - protein, 10 aa, Artificial Sequence
  Description of Artificial Sequence: Synthetic peptide
  Seed: RRLRKGYTPL (TYRP2_HUMAN)
RLLRKGYTPY

SEQ ID NO: 191839 - protein, 9 aa, Artificial Sequence
  Description of Artificial Sequence: Synthetic peptide
  Seed: SQVMSLHNL (TYRP2_HUMAN)
SRVMSLHNV

SEQ ID NO: 191840 - protein, 10 aa, Artificial Sequence
  Description of Artificial Sequence: Synthetic peptide
  Seed: AIFDEWMKRF (TYRP2_HUMAN)
AGFDEWMKRW

SEQ ID NO: 191841 - protein, 10 aa, Artificial Sequence
  Description of Artificial Sequence: Synthetic peptide
  Seed: IDFSHQGPAF (TYRP2_HUMAN)
IQFSHQGPAF

SEQ ID NO: 191842 - protein, 9 aa, Artificial Sequence
  Description of Artificial Sequence: Synthetic peptide
  Seed: HQGPAFVTW (TYRP2_HUMAN)
HEGPAFVTL

SEQ ID NO: 191843 - protein, 10 aa, Artificial Sequence
  Description of Artificial Sequence: Synthetic peptide
  Seed: GTLDSQVMSL (TYRP2_HUMAN)
GALDSQVMSV

SEQ ID NO: 191844 - protein, 9 aa, Artificial Sequence
  Description of Artificial Sequence: Synthetic peptide
  Seed: VVMGTLVAL (TYRP2_HUMAN)
VMMGTLVAI

SEQ ID NO: 191845 - protein, 10 aa, Artificial Sequence
  Description of Artificial Sequence: Synthetic peptide
  Seed: MSLHNLVHSF (TYRP2_HUMAN)
MMLHNLVHSM

SEQ ID NO: 191846 - protein, 9 aa, Artificial Sequence
  Description of Artificial Sequence: Synthetic peptide
  Seed: VLLAFLQYR (TYRP2_HUMAN)
VFLAFLQYK

SEQ ID NO: 191847 - protein, 9 aa, Artificial Sequence
  Description of Artificial Sequence: Synthetic peptide
  Seed: YSYAIDLPV (TYRP2_HUMAN)
YFYAIDLPI

SEQ ID NO: 191848 - protein, 9 aa, Artificial Sequence
  Description of Artificial Sequence: Synthetic peptide
  Seed: HQGPAFVTW (TYRP2_HUMAN)
HEGPAFVTV

SEQ ID NO: 191849 - protein, 9 aa, Artificial Sequence
  Description of Artificial Sequence: Synthetic peptide
  Seed: ANDPIFVVL (TYRP2_HUMAN)
AEDPIFVVA

SEQ ID NO: 191850 - protein, 9 aa, Artificial Sequence
  Description of Artificial Sequence: Synthetic peptide
  Seed: NMVPFFPPV (TYRP2_HUMAN)
NFVPFFPPM

SEQ ID NO: 191851 - protein, 9 aa, Artificial Sequence
  Description of Artificial Sequence: Synthetic peptide
  Seed: GTYEGLLRR (TYRP2_HUMAN)
GTYEGLLRH

SEQ ID NO: 191852 - protein, 9 aa, Artificial Sequence
  Description of Artificial Sequence: Synthetic peptide
  Seed: ALVGLFVLL (TYRP2_HUMAN)
ATVGLFVLW

SEQ ID NO: 191853 - protein, 9 aa, Artificial Sequence
  Description of Artificial Sequence: Synthetic peptide
  Seed: YSYAIDLPV (TYRP2_HUMAN)
YMYAIDLPC

SEQ ID NO: 191854 - protein, 10 aa, Artificial Sequence
  Description of Artificial Sequence: Synthetic peptide
  Seed: FFPPVTNEEL (TYRP2_HUMAN)
FSPPVTNEEY

SEQ ID NO: 191855 - protein, 10 aa, Artificial Sequence
  Description of Artificial Sequence: Synthetic peptide
  Seed: MSPLWWGFLL (TYRP2_HUMAN)
MWPLWWGFLA

SEQ ID NO: 191856 - protein, 11 aa, Artificial Sequence
  Description of Artificial Sequence: Synthetic peptide
  Seed: TQPQFANCSVY (TYRP2_HUMAN)
TQPQFANCSVM

SEQ ID NO: 191857 - protein, 10 aa, Artificial Sequence
  Description of Artificial Sequence: Synthetic peptide
  Seed: TDAIFDEWMK (TYRP2_HUMAN)
TIAIFDEWMR

SEQ ID NO: 191858 - protein, 9 aa, Artificial Sequence
  Description of Artificial Sequence: Synthetic peptide
  Seed: SLDDYNHLV (TYRP2_HUMAN)
SPDDYNHLL

SEQ ID NO: 191859 - protein, 9 aa, Artificial Sequence
  Description of Artificial Sequence: Synthetic peptide
  Seed: FLNGTNALP (TYRP2_HUMAN)
FINGTNALV

SEQ ID NO: 191860 - protein, 10 aa, Artificial Sequence
  Description of Artificial Sequence: Synthetic peptide
  Seed: FVLLAFLQYR (TYRP2_HUMAN)
FVLLAFLQYK

SEQ ID NO: 191861 - protein, 10 aa, Artificial Sequence
  Description of Artificial Sequence: Synthetic peptide
  Seed: RNSRFSSWET (TYRP2_HUMAN)
RDSRFSSWEI

SEQ ID NO: 191862 - protein, 9 aa, Artificial Sequence
  Description of Artificial Sequence: Synthetic peptide
  Seed: RMYNMVPFF (TYRP2_HUMAN)
RSYNMVPFH

SEQ ID NO: 191863 - protein, 10 aa, Artificial Sequence
  Description of Artificial Sequence: Synthetic peptide
  Seed: NECDVCTDQL (TYRP2_HUMAN)
NHCDVCTDQL

SEQ ID NO: 191864 - protein, 9 aa, Artificial Sequence
  Description of Artificial Sequence: Synthetic peptide
  Seed: SVYDFFVWL (TYRP2_HUMAN)
SSYDFFVWA

SEQ ID NO: 191865 - protein, 10 aa, Artificial Sequence
  Description of Artificial Sequence: Synthetic peptide
  Seed: AANDPIFVVL (TYRP2_HUMAN)
AANDPIFVVM

SEQ ID NO: 191866 - protein, 9 aa, Artificial Sequence
  Description of Artificial Sequence: Synthetic peptide
  Seed: ARPDDPTLI (TYRP2_HUMAN)
AFPDDPTLY

SEQ ID NO: 191867 - protein, 11 aa, Artificial Sequence
  Description of Artificial Sequence: Synthetic peptide
  Seed: RADTRPWSGPY (TYRP2_HUMAN)
RTDTRPWSGPK

SEQ ID NO: 191868 - protein, 9 aa, Artificial Sequence
  Description of Artificial Sequence: Synthetic peptide
  Seed: VHPDYVITT (TYRP2_HUMAN)
VHPDYVITV

SEQ ID NO: 191869 - protein, 10 aa, Artificial Sequence
  Description of Artificial Sequence: Synthetic peptide
  Seed: LVVMGTLVAL (TYRP2_HUMAN)
LNVMGTLVAV

SEQ ID NO: 191870 - protein, 10 aa, Artificial Sequence
  Description of Artificial Sequence: Synthetic peptide
  Seed: TQPQFANCSV (TYRP2_HUMAN)
TGPQFANCSL

SEQ ID NO: 191871 - protein, 9 aa, Artificial Sequence
  Description of Artificial Sequence: Synthetic peptide
  Seed: ARPDDPTLI (TYRP2_HUMAN)
AAPDDPTLL

SEQ ID NO: 191872 - protein, 9 aa, Artificial Sequence
  Description of Artificial Sequence: Synthetic peptide
  Seed: SLDDYNHLV (TYRP2_HUMAN)
STDDYNHLF

SEQ ID NO: 191873 - protein, 10 aa, Artificial Sequence
  Description of Artificial Sequence: Synthetic peptide
  Seed: RNSRFSSWET (TYRP2_HUMAN)
RNSRFSSWEI

SEQ ID NO: 191874 - protein, 11 aa, Artificial Sequence
  Description of Artificial Sequence: Synthetic peptide
  Seed: CDSLDDYNHLV (TYRP2_HUMAN)
CASLDDYNHLV

SEQ ID NO: 191875 - protein, 9 aa, Artificial Sequence
  Description of Artificial Sequence: Synthetic peptide
  Seed: KDIRDCLSL (TYRP2_HUMAN)
KMIRDCLSL

SEQ ID NO: 191876 - protein, 10 aa, Artificial Sequence
  Description of Artificial Sequence: Synthetic peptide
  Seed: FFQNSTFSFR (TYRP2_HUMAN)
FYQNSTFSFH

SEQ ID NO: 191877 - protein, 9 aa, Artificial Sequence
  Description of Artificial Sequence: Synthetic peptide
  Seed: MSPLWWGFL (TYRP2_HUMAN)
MVPLWWGFI

SEQ ID NO: 191878 - protein, 9 aa, Artificial Sequence
  Description of Artificial Sequence: Synthetic peptide
  Seed: RLRKGYTPL (TYRP2_HUMAN)
RYRKGYTPE

SEQ ID NO: 191879 - protein, 9 aa, Artificial Sequence
  Description of Artificial Sequence: Synthetic peptide
  Seed: HQGPAFVTW (TYRP2_HUMAN)
HQGPAFVTM

SEQ ID NO: 191880 - protein, 9 aa, Artificial Sequence
  Description of Artificial Sequence: Synthetic peptide
  Seed: TLVALVGLF (TYRP2_HUMAN)
TQVALVGLY

SEQ ID NO: 191881 - protein, 9 aa, Artificial Sequence
  Description of Artificial Sequence: Synthetic peptide
  Seed: RNQDDRELW (TYRP2_HUMAN)
RQQDDRELM

SEQ ID NO: 191882 - protein, 8 aa, Artificial Sequence
  Description of Artificial Sequence: Synthetic peptide
  Seed: AIDLPVSV (TYRP2_HUMAN)
AFDLPVSM

SEQ ID NO: 191883 - protein, 10 aa, Artificial Sequence
  Description of Artificial Sequence: Synthetic peptide
  Seed: RNSRFSSWET (TYRP2_HUMAN)
RVSRFSSWEI

SEQ ID NO: 191884 - protein, 10 aa, Artificial Sequence
  Description of Artificial Sequence: Synthetic peptide
  Seed: RLRKGYTPLM (TYRP2_HUMAN)
RVRKGYTPLQ

SEQ ID NO: 191885 - protein, 10 aa, Artificial Sequence
  Description of Artificial Sequence: Synthetic peptide
  Seed: FVWLHYYSVR (TYRP2_HUMAN)
FSWLHYYSVR

SEQ ID NO: 191886 - protein, 10 aa, Artificial Sequence
  Description of Artificial Sequence: Synthetic peptide
  Seed: DSLDDYNHLV (TYRP2_HUMAN)
DFLDDYNHLL

SEQ ID NO: 191887 - protein, 10 aa, Artificial Sequence
  Description of Artificial Sequence: Synthetic peptide
  Seed: LVVMGTLVAL (TYRP2_HUMAN)
LAVMGTLVAV

SEQ ID NO: 191888 - protein, 10 aa, Artificial Sequence
  Description of Artificial Sequence: Synthetic peptide
  Seed: QVMSLHNLVH (TYRP2_HUMAN)
QMMSLHNLVK

SEQ ID NO: 191889 - protein, 9 aa, Artificial Sequence
  Description of Artificial Sequence: Synthetic peptide
  Seed: YAIDLPVSV (TYRP2_HUMAN)
YNIDLPVSY

SEQ ID NO: 191890 - protein, 9 aa, Artificial Sequence
  Description of Artificial Sequence: Synthetic peptide
  Seed: TSDQLGYSY (TYRP2_HUMAN)
TTDQLGYSF

SEQ ID NO: 191891 - protein, 9 aa, Artificial Sequence
  Description of Artificial Sequence: Synthetic peptide
  Seed: RNQDDRELW (TYRP2_HUMAN)
RQQDDRELL

SEQ ID NO: 191892 - protein, 9 aa, Artificial Sequence
  Description of Artificial Sequence: Synthetic peptide
  Seed: LVHSFLNGT (TYRP2_HUMAN)
LLHSFLNGL

SEQ ID NO: 191893 - protein, 11 aa, Artificial Sequence
  Description of Artificial Sequence: Synthetic peptide
  Seed: FFPPVTNEELF (TYRP2_HUMAN)
FYPPVTNEELY

SEQ ID NO: 191894 - protein, 10 aa, Artificial Sequence
  Description of Artificial Sequence: Synthetic peptide
  Seed: SDQLGYSYAI (TYRP2_HUMAN)
SDQLGYSYAM

SEQ ID NO: 191895 - protein, 9 aa, Artificial Sequence
  Description of Artificial Sequence: Synthetic peptide
  Seed: DDYNHLVTL (TYRP2_HUMAN)
DHYNHLVTP

SEQ ID NO: 191896 - protein, 10 aa, Artificial Sequence
  Description of Artificial Sequence: Synthetic peptide
  Seed: CMTVDSLVNK (TYRP2_HUMAN)
CITVDSLVNR

SEQ ID NO: 191897 - protein, 10 aa, Artificial Sequence
  Description of Artificial Sequence: Synthetic peptide
  Seed: MSPLWWGFLL (TYRP2_HUMAN)
MAPLWWGFLA

SEQ ID NO: 191898 - protein, 10 aa, Artificial Sequence
  Description of Artificial Sequence: Synthetic peptide
  Seed: REQFLGALDL (TYRP2_HUMAN)
RLQFLGALDF

SEQ ID NO: 191899 - protein, 10 aa, Artificial Sequence
  Description of Artificial Sequence: Synthetic peptide
  Seed: LVVMGTLVAL (TYRP2_HUMAN)
LEVMGTLVAA

SEQ ID NO: 191900 - protein, 10 aa, Artificial Sequence
  Description of Artificial Sequence: Synthetic peptide
  Seed: FLTSDQLGYS (TYRP2_HUMAN)
FVTSDQLGYI

SEQ ID NO: 191901 - protein, 9 aa, Artificial Sequence
  Description of Artificial Sequence: Synthetic peptide
  Seed: SFRNALEGF (TYRP2_HUMAN)
SYRNALEGL

SEQ ID NO: 191902 - protein, 9 aa, Artificial Sequence
  Description of Artificial Sequence: Synthetic peptide
  Seed: QVMSLHNLV (TYRP2_HUMAN)
QLMSLHNLM

SEQ ID NO: 191903 - protein, 10 aa, Artificial Sequence
  Description of Artificial Sequence: Synthetic peptide
  Seed: VVMGTLVALV (TYRP2_HUMAN)
VQMGTLVALV

SEQ ID NO: 191904 - protein, 9 aa, Artificial Sequence
  Description of Artificial Sequence: Synthetic peptide
  Seed: YVITTQHWL (TYRP2_HUMAN)
YLITTQHWL

SEQ ID NO: 191905 - protein, 9 aa, Artificial Sequence
  Description of Artificial Sequence: Synthetic peptide
  Seed: GTYEGLLRR (TYRP2_HUMAN)
GAYEGLLRI

SEQ ID NO: 191906 - protein, 9 aa, Artificial Sequence
  Description of Artificial Sequence: Synthetic peptide
  Seed: DDYNHLVTL (TYRP2_HUMAN)
DQYNHLVTA

SEQ ID NO: 191907 - protein, 9 aa, Artificial Sequence
  Description of Artificial Sequence: Synthetic peptide
  Seed: FLTSDQLGY (TYRP2_HUMAN)
FATSDQLGY

SEQ ID NO: 191908 - protein, 10 aa, Artificial Sequence
  Description of Artificial Sequence: Synthetic peptide
  Seed: YAIDLPVSVE (TYRP2_HUMAN)
YMIDLPVSVK

SEQ ID NO: 191909 - protein, 9 aa, Artificial Sequence
  Description of Artificial Sequence: Synthetic peptide
  Seed: YSYAIDLPV (TYRP2_HUMAN)
YVYAIDLPI

SEQ ID NO: 191910 - protein, 9 aa, Artificial Sequence
  Description of Artificial Sequence: Synthetic peptide
  Seed: ANDPIFVVL (TYRP2_HUMAN)
ARDPIFVVL

SEQ ID NO: 191911 - protein, 8 aa, Artificial Sequence
  Description of Artificial Sequence: Synthetic peptide
  Seed: AANDPIFV (TYRP2_HUMAN)
AANDPIFL

SEQ ID NO: 191912 - protein, 9 aa, Artificial Sequence
  Description of Artificial Sequence: Synthetic peptide
  Seed: TLLGPGRPY (TYRP2_HUMAN)
TMLGPGRPW

SEQ ID NO: 191913 - protein, 9 aa, Artificial Sequence
  Description of Artificial Sequence: Synthetic peptide
  Seed: GTNALPHSA (TYRP2_HUMAN)
GINALPHSV

SEQ ID NO: 191914 - protein, 9 aa, Artificial Sequence
  Description of Artificial Sequence: Synthetic peptide
  Seed: KRVHPDYVI (TYRP2_HUMAN)
KRVHPDYVF

SEQ ID NO: 191915 - protein, 11 aa, Artificial Sequence
  Description of Artificial Sequence: Synthetic peptide
  Seed: RADTRPWSGPY (TYRP2_HUMAN)
RIDTRPWSGPW

SEQ ID NO: 191916 - protein, 9 aa, Artificial Sequence
  Description of Artificial Sequence: Synthetic peptide
  Seed: VWLHYYSVR (TYRP2_HUMAN)
VTLHYYSVR

SEQ ID NO: 191917 - protein, 9 aa, Artificial Sequence
  Description of Artificial Sequence: Synthetic peptide
  Seed: YTPLMETHL (TYRP2_HUMAN)
YRPLMETHF

SEQ ID NO: 191918 - protein, 10 aa, Artificial Sequence
  Description of Artificial Sequence: Synthetic peptide
  Seed: LPVSVEETPG (TYRP2_HUMAN)
LPVSVEETPA

SEQ ID NO: 191919 - protein, 10 aa, Artificial Sequence
  Description of Artificial Sequence: Synthetic peptide
  Seed: SHQGPAFVTW (TYRP2_HUMAN)
SQQGPAFVTW

SEQ ID NO: 191920 - protein, 9 aa, Artificial Sequence
  Description of Artificial Sequence: Synthetic peptide
  Seed: TLDSQVMSL (TYRP2_HUMAN)
TTDSQVMSL

SEQ ID NO: 191921 - protein, 9 aa, Artificial Sequence
  Description of Artificial Sequence: Synthetic peptide
  Seed: LAPIGHNRM (TYRP2_HUMAN)
LFPIGHNRM

SEQ ID NO: 191922 - protein, 8 aa, Artificial Sequence
  Description of Artificial Sequence: Synthetic peptide
  Seed: SVYDFFVW (TYRP2_HUMAN)
SAYDFFVW

SEQ ID NO: 191923 - protein, 9 aa, Artificial Sequence
  Description of Artificial Sequence: Synthetic peptide
  Seed: RFNPPADAW (TYRP2_HUMAN)
RINPPADAF

SEQ ID NO: 191924 - protein, 9 aa, Artificial Sequence
  Description of Artificial Sequence: Synthetic peptide
  Seed: LIGNESFAL (TYRP2_HUMAN)
LIGNESFAV

SEQ ID NO: 191925 - protein, 9 aa, Artificial Sequence
  Description of Artificial Sequence: Synthetic peptide
  Seed: LWPRKFFHR (TYRP2_HUMAN)
LVPRKFFHR

SEQ ID NO: 191926 - protein, 10 aa, Artificial Sequence
  Description of Artificial Sequence: Synthetic peptide
  Seed: AIFDEWMKRF (TYRP2_HUMAN)
AVFDEWMKRW

SEQ ID NO: 191927 - protein, 9 aa, Artificial Sequence
  Description of Artificial Sequence: Synthetic peptide
  Seed: RKFFHRTCK (TYRP2_HUMAN)
RFFFHRTCV

SEQ ID NO: 191928 - protein, 11 aa, Artificial Sequence
  Description of Artificial Sequence: Synthetic peptide
  Seed: FFQNSTFSFRN (TYRP2_HUMAN)
FMQNSTFSFRR

SEQ ID NO: 191929 - protein, 9 aa, Artificial Sequence
  Description of Artificial Sequence: Synthetic peptide
  Seed: LQKFDNPPF (TYRP2_HUMAN)
LHKFDNPPY

SEQ ID NO: 191930 - protein, 9 aa, Artificial Sequence
  Description of Artificial Sequence: Synthetic peptide
  Seed: SVYDFFVWL (TYRP2_HUMAN)
SLYDFFVWL

SEQ ID NO: 191931 - protein, 9 aa, Artificial Sequence
  Description of Artificial Sequence: Synthetic peptide
  Seed: HSFLNGTNA (TYRP2_HUMAN)
HVFLNGTNY

SEQ ID NO: 191932 - protein, 11 aa, Artificial Sequence
  Description of Artificial Sequence: Synthetic peptide
  Seed: LLAFLQYRRLR (TYRP2_HUMAN)
LTAFLQYRRLR

SEQ ID NO: 191933 - protein, 9 aa, Artificial Sequence
  Description of Artificial Sequence: Synthetic peptide
  Seed: NRMYNMVPF (TYRP2_HUMAN)
NKMYNMVPL

SEQ ID NO: 191934 - protein, 10 aa, Artificial Sequence
  Description of Artificial Sequence: Synthetic peptide
  Seed: RMYNMVPFFP (TYRP2_HUMAN)
RGYNMVPFFK

SEQ ID NO: 191935 - protein, 9 aa, Artificial Sequence
  Description of Artificial Sequence: Synthetic peptide
  Seed: YDFFVWLHY (TYRP2_HUMAN)
YIFFVWLHF

SEQ ID NO: 191936 - protein, 9 aa, Artificial Sequence
  Description of Artificial Sequence: Synthetic peptide
  Seed: RPWSGPYIL (TYRP2_HUMAN)
RPWSGPYIY

SEQ ID NO: 191937 - protein, 11 aa, Artificial Sequence
  Description of Artificial Sequence: Synthetic peptide
  Seed: RADTRPWSGPY (TYRP2_HUMAN)
RTDTRPWSGPW

SEQ ID NO: 191938 - protein, 11 aa, Artificial Sequence
  Description of Artificial Sequence: Synthetic peptide
  Seed: RNSRFSSWETV (TYRP2_HUMAN)
RQSRFSSWETI

SEQ ID NO: 191939 - protein, 10 aa, Artificial Sequence
  Description of Artificial Sequence: Synthetic peptide
  Seed: HNRMYNMVPF (TYRP2_HUMAN)
HARMYNMVPL

SEQ ID NO: 191940 - protein, 9 aa, Artificial Sequence
  Description of Artificial Sequence: Synthetic peptide
  Seed: LQKFDNPPF (TYRP2_HUMAN)
LQKFDNPPY

SEQ ID NO: 191941 - protein, 10 aa, Artificial Sequence
  Description of Artificial Sequence: Synthetic peptide
  Seed: HSFLNGTNAL (TYRP2_HUMAN)
HEFLNGTNAY

SEQ ID NO: 191942 - protein, 9 aa, Artificial Sequence
  Description of Artificial Sequence: Synthetic peptide
  Seed: HSAANDPIF (TYRP2_HUMAN)
HTAANDPIY

SEQ ID NO: 191943 - protein, 10 aa, Artificial Sequence
  Description of Artificial Sequence: Synthetic peptide
  Seed: LVVMGTLVAL (TYRP2_HUMAN)
LTVMGTLVAA

SEQ ID NO: 191944 - protein, 11 aa, Artificial Sequence
  Description of Artificial Sequence: Synthetic peptide
  Seed: RNSRFSSWETV (TYRP2_HUMAN)
RSSRFSSWETV

SEQ ID NO: 191945 - protein, 9 aa, Artificial Sequence
  Description of Artificial Sequence: Synthetic peptide
  Seed: YAIDLPVSV (TYRP2_HUMAN)
YTIDLPVSF

SEQ ID NO: 191946 - protein, 9 aa, Artificial Sequence
  Description of Artificial Sequence: Synthetic peptide
  Seed: ALDLAKKRV (TYRP2_HUMAN)
AADLAKKRM

SEQ ID NO: 191947 - protein, 9 aa, Artificial Sequence
  Description of Artificial Sequence: Synthetic peptide
  Seed: RLRKGYTPL (TYRP2_HUMAN)
RARKGYTPA

SEQ ID NO: 191948 - protein, 9 aa, Artificial Sequence
  Description of Artificial Sequence: Synthetic peptide
  Seed: SRNSRFSSW (TYRP2_HUMAN)
SKNSRFSSY

SEQ ID NO: 191949 - protein, 9 aa, Artificial Sequence
  Description of Artificial Sequence: Synthetic peptide
  Seed: SQVMSLHNL (TYRP2_HUMAN)
SVVMSLHNA

SEQ ID NO: 191950 - protein, 9 aa, Artificial Sequence
  Description of Artificial Sequence: Synthetic peptide
  Seed: ANDPIFVVL (TYRP2_HUMAN)
ATDPIFVVM

SEQ ID NO: 191951 - protein, 10 aa, Artificial Sequence
  Description of Artificial Sequence: Synthetic peptide
  Seed: RNSMKLPTLK (TYRP2_HUMAN)
RFSMKLPTLR

SEQ ID NO: 191952 - protein, 10 aa, Artificial Sequence
  Description of Artificial Sequence: Synthetic peptide
  Seed: LVVMGTLVAL (TYRP2_HUMAN)
LLVMGTLVAA

SEQ ID NO: 191953 - protein, 9 aa, Artificial Sequence
  Description of Artificial Sequence: Synthetic peptide
  Seed: TSDQLGYSY (TYRP2_HUMAN)
TVDQLGYSL

SEQ ID NO: 191954 - protein, 10 aa, Artificial Sequence
  Description of Artificial Sequence: Synthetic peptide
  Seed: FFPPVTNEEL (TYRP2_HUMAN)
FWPPVTNEEY

SEQ ID NO: 191955 - protein, 9 aa, Artificial Sequence
  Description of Artificial Sequence: Synthetic peptide
  Seed: VTNEELFLT (TYRP2_HUMAN)
VINEELFLA

SEQ ID NO: 191956 - protein, 9 aa, Artificial Sequence
  Description of Artificial Sequence: Synthetic peptide
  Seed: FANCSVYDF (TYRP2_HUMAN)
FLNCSVYDY

SEQ ID NO: 191957 - protein, 10 aa, Artificial Sequence
  Description of Artificial Sequence: Synthetic peptide
  Seed: VVLHSFTDAI (TYRP2_HUMAN)
VLLHSFTDAL

SEQ ID NO: 191958 - protein, 9 aa, Artificial Sequence
  Description of Artificial Sequence: Synthetic peptide
  Seed: TLDSQVMSL (TYRP2_HUMAN)
TMDSQVMSF

SEQ ID NO: 191959 - protein, 10 aa, Artificial Sequence
  Description of Artificial Sequence: Synthetic peptide
  Seed: REQFLGALDL (TYRP2_HUMAN)
RLQFLGALDM

SEQ ID NO: 191960 - protein, 9 aa, Artificial Sequence
  Description of Artificial Sequence: Synthetic peptide
  Seed: ETPGWPTTL (TYRP2_HUMAN)
EWPGWPTTF

SEQ ID NO: 191961 - protein, 9 aa, Artificial Sequence
  Description of Artificial Sequence: Synthetic peptide
  Seed: DSLDDYNHL (TYRP2_HUMAN)
DLLDDYNHR

SEQ ID NO: 191962 - protein, 10 aa, Artificial Sequence
  Description of Artificial Sequence: Synthetic peptide
  Seed: RLRKGYTPLM (TYRP2_HUMAN)
RERKGYTPLF

SEQ ID NO: 191963 - protein, 9 aa, Artificial Sequence
  Description of Artificial Sequence: Synthetic peptide
  Seed: GNESFALPY (TYRP2_HUMAN)
GFESFALPY

SEQ ID NO: 191964 - protein, 9 aa, Artificial Sequence
  Description of Artificial Sequence: Synthetic peptide
  Seed: GTYEGLLRR (TYRP2_HUMAN)
GGYEGLLRR

SEQ ID NO: 191965 - protein, 9 aa, Artificial Sequence
  Description of Artificial Sequence: Synthetic peptide
  Seed: RKFFHRTCK (TYRP2_HUMAN)
RTFFHRTCN

SEQ ID NO: 191966 - protein, 9 aa, Artificial Sequence
  Description of Artificial Sequence: Synthetic peptide
  Seed: FTDAIFDEW (TYRP2_HUMAN)
FLDAIFDEF

SEQ ID NO: 191967 - protein, 9 aa, Artificial Sequence
  Description of Artificial Sequence: Synthetic peptide
  Seed: FPPVTNEEL (TYRP2_HUMAN)
FLPVTNEEM

SEQ ID NO: 191968 - protein, 9 aa, Artificial Sequence
  Description of Artificial Sequence: Synthetic peptide
  Seed: VTNEELFLT (TYRP2_HUMAN)
VMNEELFLV

SEQ ID NO: 191969 - protein, 9 aa, Artificial Sequence
  Description of Artificial Sequence: Synthetic peptide
  Seed: STFSFRNAL (TYRP2_HUMAN)
SPFSFRNAM

SEQ ID NO: 191970 - protein, 11 aa, Artificial Sequence
  Description of Artificial Sequence: Synthetic peptide
  Seed: VHSFLNGTNAL (TYRP2_HUMAN)
VYSFLNGTNAM

SEQ ID NO: 191971 - protein, 11 aa, Artificial Sequence
  Description of Artificial Sequence: Synthetic peptide
  Seed: WLHYYSVRDTL (TYRP2_HUMAN)
WYHYYSVRDTW

SEQ ID NO: 191972 - protein, 11 aa, Artificial Sequence
  Description of Artificial Sequence: Synthetic peptide
  Seed: RRNQMGRNSMK (TYRP2_HUMAN)
RVNQMGRNSMR

SEQ ID NO: 191973 - protein, 11 aa, Artificial Sequence
  Description of Artificial Sequence: Synthetic peptide
  Seed: YTPLMETHLSS (TYRP2_HUMAN)
YEPLMETHLSI

SEQ ID NO: 191974 - protein, 8 aa, Artificial Sequence
  Description of Artificial Sequence: Synthetic peptide
  Seed: KFDNPPFF (TYRP2_HUMAN)
KTDNPPFI

SEQ ID NO: 191975 - protein, 9 aa, Artificial Sequence
  Description of Artificial Sequence: Synthetic peptide
  Seed: TSDQLGYSY (TYRP2_HUMAN)
TADQLGYSW

SEQ ID NO: 191976 - protein, 10 aa, Artificial Sequence
  Description of Artificial Sequence: Synthetic peptide
  Seed: YDFFVWLHYY (TYRP2_HUMAN)
YPFFVWLHYY

SEQ ID NO: 191977 - protein, 9 aa, Artificial Sequence
  Description of Artificial Sequence: Synthetic peptide
  Seed: DDYNHLVTL (TYRP2_HUMAN)
DCYNHLVTV

SEQ ID NO: 191978 - protein, 9 aa, Artificial Sequence
  Description of Artificial Sequence: Synthetic peptide
  Seed: MTVDSLVNK (TYRP2_HUMAN)
MGVDSLVNR

SEQ ID NO: 191979 - protein, 11 aa, Artificial Sequence
  Description of Artificial Sequence: Synthetic peptide
  Seed: RADTRPWSGPY (TYRP2_HUMAN)
RQDTRPWSGPW

SEQ ID NO: 191980 - protein, 11 aa, Artificial Sequence
  Description of Artificial Sequence: Synthetic peptide
  Seed: MYNMVPFFPPV (TYRP2_HUMAN)
MWNMVPFFPPV

SEQ ID NO: 191981 - protein, 9 aa, Artificial Sequence
  Description of Artificial Sequence: Synthetic peptide
  Seed: DFFVWLHYY (TYRP2_HUMAN)
DSFVWLHYK

SEQ ID NO: 191982 - protein, 10 aa, Artificial Sequence
  Description of Artificial Sequence: Synthetic peptide
  Seed: SVYDFFVWLH (TYRP2_HUMAN)
SMYDFFVWLY

SEQ ID NO: 191983 - protein, 9 aa, Artificial Sequence
  Description of Artificial Sequence: Synthetic peptide
  Seed: LLAFLQYRR (TYRP2_HUMAN)
LGAFLQYRR

SEQ ID NO: 191984 - protein, 9 aa, Artificial Sequence
  Description of Artificial Sequence: Synthetic peptide
  Seed: YSYAIDLPV (TYRP2_HUMAN)
YLYAIDLPA

SEQ ID NO: 191985 - protein, 9 aa, Artificial Sequence
  Description of Artificial Sequence: Synthetic peptide
  Seed: DAIFDEWMK (TYRP2_HUMAN)
DIIFDEWMK

SEQ ID NO: 191986 - protein, 9 aa, Artificial Sequence
  Description of Artificial Sequence: Synthetic peptide
  Seed: RLRKGYTPL (TYRP2_HUMAN)
RWRKGYTPL

SEQ ID NO: 191987 - protein, 10 aa, Artificial Sequence
  Description of Artificial Sequence: Synthetic peptide
  Seed: SVYDFFVWLH (TYRP2_HUMAN)
SLYDFFVWLK

SEQ ID NO: 191988 - protein, 9 aa, Artificial Sequence
  Description of Artificial Sequence: Synthetic peptide
  Seed: KCTGNFAGY (TYRP2_HUMAN)
KQTGNFAGY

SEQ ID NO: 191989 - protein, 10 aa, Artificial Sequence
  Description of Artificial Sequence: Synthetic peptide
  Seed: YSYAIDLPVS (TYRP2_HUMAN)
YVYAIDLPVL

SEQ ID NO: 191990 - protein, 9 aa, Artificial Sequence
  Description of Artificial Sequence: Synthetic peptide
  Seed: ISRNSRFSS (TYRP2_HUMAN)
IQRNSRFSK

SEQ ID NO: 191991 - protein, 10 aa, Artificial Sequence
  Description of Artificial Sequence: Synthetic peptide
  Seed: LVALVGLFVL (TYRP2_HUMAN)
LMALVGLFVI

SEQ ID NO: 191992 - protein, 9 aa, Artificial Sequence
  Description of Artificial Sequence: Synthetic peptide
  Seed: RDCLSLQKF (TYRP2_HUMAN)
RKCLSLQKF

SEQ ID NO: 191993 - protein, 10 aa, Artificial Sequence
  Description of Artificial Sequence: Synthetic peptide
  Seed: DAIFDEWMKR (TYRP2_HUMAN)
DRIFDEWMKR

SEQ ID NO: 191994 - protein, 9 aa, Artificial Sequence
  Description of Artificial Sequence: Synthetic peptide
  Seed: YVITTQHWL (TYRP2_HUMAN)
YTITTQHWA

SEQ ID NO: 191995 - protein, 11 aa, Artificial Sequence
  Description of Artificial Sequence: Synthetic peptide
  Seed: YSYAIDLPVSV (TYRP2_HUMAN)
YMYAIDLPVSL

SEQ ID NO: 191996 - protein, 10 aa, Artificial Sequence
  Description of Artificial Sequence: Synthetic peptide
  Seed: IDFSHQGPAF (TYRP2_HUMAN)
ITFSHQGPAF

SEQ ID NO: 191997 - protein, 10 aa, Artificial Sequence
  Description of Artificial Sequence: Synthetic peptide
  Seed: PFFQNSTFSF (TYRP2_HUMAN)
PRFQNSTFSF

SEQ ID NO: 191998 - protein, 9 aa, Artificial Sequence
  Description of Artificial Sequence: Synthetic peptide
  Seed: EETPGWPTT (TYRP2_HUMAN)
EETPGWPTI

SEQ ID NO: 191999 - protein, 11 aa, Artificial Sequence
  Description of Artificial Sequence: Synthetic peptide
  Seed: SVYDFFVWLHY (TYRP2_HUMAN)
SWYDFFVWLHY

SEQ ID NO: 192000 - protein, 9 aa, Artificial Sequence
  Description of Artificial Sequence: Synthetic peptide
  Seed: RLRKGYTPL (TYRP2_HUMAN)
RERKGYTPL

SEQ ID NO: 192001 - protein, 9 aa, Artificial Sequence
  Description of Artificial Sequence: Synthetic peptide
  Seed: AIFDEWMKR (TYRP2_HUMAN)
AFFDEWMKR

SEQ ID NO: 192002 - protein, 10 aa, Artificial Sequence
  Description of Artificial Sequence: Synthetic peptide
  Seed: LHYYSVRDTL (TYRP2_HUMAN)
LEYYSVRDTI

SEQ ID NO: 192003 - protein, 9 aa, Artificial Sequence
  Description of Artificial Sequence: Synthetic peptide
  Seed: FVWLHYYSV (TYRP2_HUMAN)
FQWLHYYSI

SEQ ID NO: 192004 - protein, 10 aa, Artificial Sequence
  Description of Artificial Sequence: Synthetic peptide
  Seed: SVYDFFVWLH (TYRP2_HUMAN)
STYDFFVWLK

SEQ ID NO: 192005 - protein, 10 aa, Artificial Sequence
  Description of Artificial Sequence: Synthetic peptide
  Seed: NMVPFFPPVT (TYRP2_HUMAN)
NMVPFFPPVL

SEQ ID NO: 192006 - protein, 9 aa, Artificial Sequence
  Description of Artificial Sequence: Synthetic peptide
  Seed: SRFSSWETV (TYRP2_HUMAN)
SRFSSWETF

SEQ ID NO: 192007 - protein, 10 aa, Artificial Sequence
  Description of Artificial Sequence: Synthetic peptide
  Seed: GTLDSQVMSL (TYRP2_HUMAN)
GALDSQVMSF

SEQ ID NO: 192008 - protein, 10 aa, Artificial Sequence
  Description of Artificial Sequence: Synthetic peptide
  Seed: RNSRFSSWET (TYRP2_HUMAN)
RISRFSSWEA

SEQ ID NO: 192009 - protein, 10 aa, Artificial Sequence
  Description of Artificial Sequence: Synthetic peptide
  Seed: VLHSFTDAIF (TYRP2_HUMAN)
VIHSFTDAIY

SEQ ID NO: 192010 - protein, 9 aa, Artificial Sequence
  Description of Artificial Sequence: Synthetic peptide
  Seed: FLNGTNALP (TYRP2_HUMAN)
FVNGTNALV

SEQ ID NO: 192011 - protein, 9 aa, Artificial Sequence
  Description of Artificial Sequence: Synthetic peptide
  Seed: HYYSVRDTL (TYRP2_HUMAN)
HHYSVRDTM

SEQ ID NO: 192012 - protein, 10 aa, Artificial Sequence
  Description of Artificial Sequence: Synthetic peptide
  Seed: YDFFVWLHYY (TYRP2_HUMAN)
YYFFVWLHYV

SEQ ID NO: 192013 - protein, 10 aa, Artificial Sequence
  Description of Artificial Sequence: Synthetic peptide
  Seed: SDQLGYSYAI (TYRP2_HUMAN)
SHQLGYSYAF

SEQ ID NO: 192014 - protein, 9 aa, Artificial Sequence
  Description of Artificial Sequence: Synthetic peptide
  Seed: MSPLWWGFL (TYRP2_HUMAN)
MTPLWWGFI

SEQ ID NO: 192015 - protein, 9 aa, Artificial Sequence
  Description of Artificial Sequence: Synthetic peptide
  Seed: VVMGTLVAL (TYRP2_HUMAN)
VMMGTLVAV

SEQ ID NO: 192016 - protein, 9 aa, Artificial Sequence
  Description of Artificial Sequence: Synthetic peptide
  Seed: FFQNSTFSF (TYRP2_HUMAN)
FKQNSTFSM

SEQ ID NO: 192017 - protein, 10 aa, Artificial Sequence
  Description of Artificial Sequence: Synthetic peptide
  Seed: RLRKGYTPLM (TYRP2_HUMAN)
RIRKGYTPLS

SEQ ID NO: 192018 - protein, 9 aa, Artificial Sequence
  Description of Artificial Sequence: Synthetic peptide
  Seed: RKFFHRTCK (TYRP2_HUMAN)
RQFFHRTCA

SEQ ID NO: 192019 - protein, 9 aa, Artificial Sequence
  Description of Artificial Sequence: Synthetic peptide
  Seed: FLGALDLAK (TYRP2_HUMAN)
FAGALDLAM

SEQ ID NO: 192020 - protein, 10 aa, Artificial Sequence
  Description of Artificial Sequence: Synthetic peptide
  Seed: VALVGLFVLL (TYRP2_HUMAN)
VHLVGLFVLV

SEQ ID NO: 192021 - protein, 9 aa, Artificial Sequence
  Description of Artificial Sequence: Synthetic peptide
  Seed: DSLDDYNHL (TYRP2_HUMAN)
DTLDDYNHW

SEQ ID NO: 192022 - protein, 8 aa, Artificial Sequence
  Description of Artificial Sequence: Synthetic peptide
  Seed: FSHQGPAF (TYRP2_HUMAN)
FTHQGPAM

SEQ ID NO: 192023 - protein, 11 aa, Artificial Sequence
  Description of Artificial Sequence: Synthetic peptide
  Seed: MYNMVPFFPPV (TYRP2_HUMAN)
MENMVPFFPPI

SEQ ID NO: 192024 - protein, 10 aa, Artificial Sequence
  Description of Artificial Sequence: Synthetic peptide
  Seed: YDFFVWLHYY (TYRP2_HUMAN)
YTFFVWLHYY

SEQ ID NO: 192025 - protein, 10 aa, Artificial Sequence
  Description of Artificial Sequence: Synthetic peptide
  Seed: AANDPIFVVL (TYRP2_HUMAN)
AINDPIFVVW

SEQ ID NO: 192026 - protein, 9 aa, Artificial Sequence
  Description of Artificial Sequence: Synthetic peptide
  Seed: AARPDDPTL (TYRP2_HUMAN)
AMRPDDPTY

SEQ ID NO: 192027 - protein, 8 aa, Artificial Sequence
  Description of Artificial Sequence: Synthetic peptide
  Seed: FSHQGPAF (TYRP2_HUMAN)
FYHQGPAF

SEQ ID NO: 192028 - protein, 10 aa, Artificial Sequence
  Description of Artificial Sequence: Synthetic peptide
  Seed: MSPLWWGFLL (TYRP2_HUMAN)
MRPLWWGFLL

SEQ ID NO: 192029 - protein, 9 aa, Artificial Sequence
  Description of Artificial Sequence: Synthetic peptide
  Seed: LAPIGHNRM (TYRP2_HUMAN)
LSPIGHNRL

SEQ ID NO: 192030 - protein, 9 aa, Artificial Sequence
  Description of Artificial Sequence: Synthetic peptide
  Seed: VEETPGWPT (TYRP2_HUMAN)
VEETPGWPA

SEQ ID NO: 192031 - protein, 11 aa, Artificial Sequence
  Description of Artificial Sequence: Synthetic peptide
  Seed: RNQDDRELWPR (TYRP2_HUMAN)
RQQDDRELWPR

SEQ ID NO: 192032 - protein, 9 aa, Artificial Sequence
  Description of Artificial Sequence: Synthetic peptide
  Seed: SVYDFFVWL (TYRP2_HUMAN)
SLYDFFVWI

SEQ ID NO: 192033 - protein, 10 aa, Artificial Sequence
  Description of Artificial Sequence: Synthetic peptide
  Seed: AARPDDPTLI (TYRP2_HUMAN)
AIRPDDPTLY

SEQ ID NO: 192034 - protein, 10 aa, Artificial Sequence
  Description of Artificial Sequence: Synthetic peptide
  Seed: SDQLGYSYAI (TYRP2_HUMAN)
SVQLGYSYAY

SEQ ID NO: 192035 - protein, 9 aa, Artificial Sequence
  Description of Artificial Sequence: Synthetic peptide
  Seed: SVYDFFVWL (TYRP2_HUMAN)
SQYDFFVWW

SEQ ID NO: 192036 - protein, 9 aa, Artificial Sequence
  Description of Artificial Sequence: Synthetic peptide
  Seed: HSFLNGTNA (TYRP2_HUMAN)
HVFLNGTNV

SEQ ID NO: 192037 - protein, 11 aa, Artificial Sequence
  Description of Artificial Sequence: Synthetic peptide
  Seed: SLDDYNHLVTL (TYRP2_HUMAN)
SYDDYNHLVTL

SEQ ID NO: 192038 - protein, 10 aa, Artificial Sequence
  Description of Artificial Sequence: Synthetic peptide
  Seed: FFPPVTNEEL (TYRP2_HUMAN)
FQPPVTNEEY

SEQ ID NO: 192039 - protein, 10 aa, Artificial Sequence
  Description of Artificial Sequence: Synthetic peptide
  Seed: QGPAFVTWHR (TYRP2_HUMAN)
QIPAFVTWHR

SEQ ID NO: 192040 - protein, 10 aa, Artificial Sequence
  Description of Artificial Sequence: Synthetic peptide
  Seed: MSPLWWGFLL (TYRP2_HUMAN)
MNPLWWGFLL

SEQ ID NO: 192041 - protein, 10 aa, Artificial Sequence
  Description of Artificial Sequence: Synthetic peptide
  Seed: RPWSGPYILR (TYRP2_HUMAN)
RYWSGPYILK

SEQ ID NO: 192042 - protein, 9 aa, Artificial Sequence
  Description of Artificial Sequence: Synthetic peptide
  Seed: DFFVWLHYY (TYRP2_HUMAN)
DTFVWLHYK

SEQ ID NO: 192043 - protein, 9 aa, Artificial Sequence
  Description of Artificial Sequence: Synthetic peptide
  Seed: KRVHPDYVI (TYRP2_HUMAN)
KRVHPDYVM

SEQ ID NO: 192044 - protein, 9 aa, Artificial Sequence
  Description of Artificial Sequence: Synthetic peptide
  Seed: FPPVTNEEL (TYRP2_HUMAN)
FTPVTNEEL

SEQ ID NO: 192045 - protein, 10 aa, Artificial Sequence
  Description of Artificial Sequence: Synthetic peptide
  Seed: YEGLLRRNQM (TYRP2_HUMAN)
YLGLLRRNQL

SEQ ID NO: 192046 - protein, 9 aa, Artificial Sequence
  Description of Artificial Sequence: Synthetic peptide
  Seed: AIFDEWMKR (TYRP2_HUMAN)
AFFDEWMKY

SEQ ID NO: 192047 - protein, 10 aa, Artificial Sequence
  Description of Artificial Sequence: Synthetic peptide
  Seed: RRLRKGYTPL (TYRP2_HUMAN)
RFLRKGYTPV

SEQ ID NO: 192048 - protein, 10 aa, Artificial Sequence
  Description of Artificial Sequence: Synthetic peptide
  Seed: YNMVPFFPPV (TYRP2_HUMAN)
YAMVPFFPPI

SEQ ID NO: 192049 - protein, 9 aa, Artificial Sequence
  Description of Artificial Sequence: Synthetic peptide
  Seed: RQNIHSLSP (TYRP2_HUMAN)
RHNIHSLSY

SEQ ID NO: 192050 - protein, 9 aa, Artificial Sequence
  Description of Artificial Sequence: Synthetic peptide
  Seed: MTVDSLVNK (TYRP2_HUMAN)
MTVDSLVNM

SEQ ID NO: 192051 - protein, 10 aa, Artificial Sequence
  Description of Artificial Sequence: Synthetic peptide
  Seed: REQFLGALDL (TYRP2_HUMAN)
RYQFLGALDF

SEQ ID NO: 192052 - protein, 9 aa, Artificial Sequence
  Description of Artificial Sequence: Synthetic peptide
  Seed: PIFVVLHSF (TYRP2_HUMAN)
PYFVVLHSF

SEQ ID NO: 192053 - protein, 9 aa, Artificial Sequence
  Description of Artificial Sequence: Synthetic peptide
  Seed: RNQDDRELW (TYRP2_HUMAN)
RIQDDRELF

SEQ ID NO: 192054 - protein, 8 aa, Artificial Sequence
  Description of Artificial Sequence: Synthetic peptide
  Seed: LHNLVHSF (TYRP2_HUMAN)
LMNLVHSF

SEQ ID NO: 192055 - protein, 10 aa, Artificial Sequence
  Description of Artificial Sequence: Synthetic peptide
  Seed: MGRNSMKLPT (TYRP2_HUMAN)
MVRNSMKLPK

SEQ ID NO: 192056 - protein, 10 aa, Artificial Sequence
  Description of Artificial Sequence: Synthetic peptide
  Seed: SVYDFFVWLH (TYRP2_HUMAN)
SFYDFFVWLY

SEQ ID NO: 192057 - protein, 10 aa, Artificial Sequence
  Description of Artificial Sequence: Synthetic peptide
  Seed: SQVMSLHNLV (TYRP2_HUMAN)
SCVMSLHNLV

SEQ ID NO: 192058 - protein, 9 aa, Artificial Sequence
  Description of Artificial Sequence: Synthetic peptide
  Seed: RDCLSLQKF (TYRP2_HUMAN)
RACLSLQKW

SEQ ID NO: 192059 - protein, 10 aa, Artificial Sequence
  Description of Artificial Sequence: Synthetic peptide
  Seed: LVVMGTLVAL (TYRP2_HUMAN)
LIVMGTLVAM

SEQ ID NO: 192060 - protein, 9 aa, Artificial Sequence
  Description of Artificial Sequence: Synthetic peptide
  Seed: AANDPIFVV (TYRP2_HUMAN)
AYNDPIFVY

SEQ ID NO: 192061 - protein, 10 aa, Artificial Sequence
  Description of Artificial Sequence: Synthetic peptide
  Seed: RPDDPTLISR (TYRP2_HUMAN)
RPDDPTLISL

SEQ ID NO: 192062 - protein, 10 aa, Artificial Sequence
  Description of Artificial Sequence: Synthetic peptide
  Seed: SVRDTLLGPG (TYRP2_HUMAN)
SFRDTLLGPK

SEQ ID NO: 192063 - protein, 9 aa, Artificial Sequence
  Description of Artificial Sequence: Synthetic peptide
  Seed: SWETVCDSL (TYRP2_HUMAN)
SFETVCDSL

SEQ ID NO: 192064 - protein, 10 aa, Artificial Sequence
  Description of Artificial Sequence: Synthetic peptide
  Seed: LHYYSVRDTL (TYRP2_HUMAN)
LSYYSVRDTY

SEQ ID NO: 192065 - protein, 11 aa, Artificial Sequence
  Description of Artificial Sequence: Synthetic peptide
  Seed: TQPQFANCSVY (TYRP2_HUMAN)
TPPQFANCSVM

SEQ ID NO: 192066 - protein, 9 aa, Artificial Sequence
  Description of Artificial Sequence: Synthetic peptide
  Seed: ANCSVYDFF (TYRP2_HUMAN)
ATCSVYDFW

SEQ ID NO: 192067 - protein, 10 aa, Artificial Sequence
  Description of Artificial Sequence: Synthetic peptide
  Seed: LGPNGTQPQF (TYRP2_HUMAN)
LMPNGTQPQL

SEQ ID NO: 192068 - protein, 11 aa, Artificial Sequence
  Description of Artificial Sequence: Synthetic peptide
  Seed: SLDDYNHLVTL (TYRP2_HUMAN)
SADDYNHLVTY

SEQ ID NO: 192069 - protein, 10 aa, Artificial Sequence
  Description of Artificial Sequence: Synthetic peptide
  Seed: AANDPIFVVL (TYRP2_HUMAN)
AINDPIFVVV

SEQ ID NO: 192070 - protein, 9 aa, Artificial Sequence
  Description of Artificial Sequence: Synthetic peptide
  Seed: LVTLCNGTY (TYRP2_HUMAN)
LQTLCNGTF

SEQ ID NO: 192071 - protein, 9 aa, Artificial Sequence
  Description of Artificial Sequence: Synthetic peptide
  Seed: DTRPWSGPY (TYRP2_HUMAN)
DARPWSGPK

SEQ ID NO: 192072 - protein, 9 aa, Artificial Sequence
  Description of Artificial Sequence: Synthetic peptide
  Seed: FPPVTNEEL (TYRP2_HUMAN)
FVPVTNEEL

SEQ ID NO: 192073 - protein, 10 aa, Artificial Sequence
  Description of Artificial Sequence: Synthetic peptide
  Seed: RLRKGYTPLM (TYRP2_HUMAN)
RMRKGYTPLI

SEQ ID NO: 192074 - protein, 10 aa, Artificial Sequence
  Description of Artificial Sequence: Synthetic peptide
  Seed: RNSRFSSWET (TYRP2_HUMAN)
RASRFSSWEV

SEQ ID NO: 192075 - protein, 10 aa, Artificial Sequence
  Description of Artificial Sequence: Synthetic peptide
  Seed: VLLAFLQYRR (TYRP2_HUMAN)
VILAFLQYRK

SEQ ID NO: 192076 - protein, 10 aa, Artificial Sequence
  Description of Artificial Sequence: Synthetic peptide
  Seed: SHQGPAFVTW (TYRP2_HUMAN)
SFQGPAFVTF

SEQ ID NO: 192077 - protein, 9 aa, Artificial Sequence
  Description of Artificial Sequence: Synthetic peptide
  Seed: YSYAIDLPV (TYRP2_HUMAN)
YRYAIDLPM

SEQ ID NO: 192078 - protein, 10 aa, Artificial Sequence
  Description of Artificial Sequence: Synthetic peptide
  Seed: RMYNMVPFFP (TYRP2_HUMAN)
RAYNMVPFFV

SEQ ID NO: 192079 - protein, 9 aa, Artificial Sequence
  Description of Artificial Sequence: Synthetic peptide
  Seed: NMVPFFPPV (TYRP2_HUMAN)
NLVPFFPPF

SEQ ID NO: 192080 - protein, 9 aa, Artificial Sequence
  Description of Artificial Sequence: Synthetic peptide
  Seed: ISRNSRFSS (TYRP2_HUMAN)
ISRNSRFSV

SEQ ID NO: 192081 - protein, 9 aa, Artificial Sequence
  Description of Artificial Sequence: Synthetic peptide
  Seed: NALEGFDKA (TYRP2_HUMAN)
NMLEGFDKL

SEQ ID NO: 192082 - protein, 10 aa, Artificial Sequence
  Description of Artificial Sequence: Synthetic peptide
  Seed: LQKFDNPPFF (TYRP2_HUMAN)
LQKFDNPPFY

SEQ ID NO: 192083 - protein, 10 aa, Artificial Sequence
  Description of Artificial Sequence: Synthetic peptide
  Seed: YDFFVWLHYY (TYRP2_HUMAN)
YVFFVWLHYF

SEQ ID NO: 192084 - protein, 9 aa, Artificial Sequence
  Description of Artificial Sequence: Synthetic peptide
  Seed: RLRKGYTPL (TYRP2_HUMAN)
RTRKGYTPH

SEQ ID NO: 192085 - protein, 9 aa, Artificial Sequence
  Description of Artificial Sequence: Synthetic peptide
  Seed: HQGPAFVTW (TYRP2_HUMAN)
HVGPAFVTY

SEQ ID NO: 192086 - protein, 9 aa, Artificial Sequence
  Description of Artificial Sequence: Synthetic peptide
  Seed: VMGTLVALV (TYRP2_HUMAN)
VVGTLVALV

SEQ ID NO: 192087 - protein, 11 aa, Artificial Sequence
  Description of Artificial Sequence: Synthetic peptide
  Seed: YNMVPFFPPVT (TYRP2_HUMAN)
YQMVPFFPPVN

SEQ ID NO: 192088 - protein, 10 aa, Artificial Sequence
  Description of Artificial Sequence: Synthetic peptide
  Seed: TLCNGTYEGL (TYRP2_HUMAN)
TMCNGTYEGI

SEQ ID NO: 192089 - protein, 10 aa, Artificial Sequence
  Description of Artificial Sequence: Synthetic peptide
  Seed: FPPVTNEELF (TYRP2_HUMAN)
FIPVTNEELF

SEQ ID NO: 192090 - protein, 10 aa, Artificial Sequence
  Description of Artificial Sequence: Synthetic peptide
  Seed: SDQLGYSYAI (TYRP2_HUMAN)
SRQLGYSYAL

SEQ ID NO: 192091 - protein, 9 aa, Artificial Sequence
  Description of Artificial Sequence: Synthetic peptide
  Seed: APIGHNRMY (TYRP2_HUMAN)
ALIGHNRMF

SEQ ID NO: 192092 - protein, 9 aa, Artificial Sequence
  Description of Artificial Sequence: Synthetic peptide
  Seed: RKFFHRTCK (TYRP2_HUMAN)
RCFFHRTCR

SEQ ID NO: 192093 - protein, 10 aa, Artificial Sequence
  Description of Artificial Sequence: Synthetic peptide
  Seed: DSLDDYNHLV (TYRP2_HUMAN)
DFLDDYNHLV

SEQ ID NO: 192094 - protein, 9 aa, Artificial Sequence
  Description of Artificial Sequence: Synthetic peptide
  Seed: LVALVGLFV (TYRP2_HUMAN)
LMALVGLFL

SEQ ID NO: 192095 - protein, 10 aa, Artificial Sequence
  Description of Artificial Sequence: Synthetic peptide
  Seed: FVWLHYYSVR (TYRP2_HUMAN)
FMWLHYYSVM

SEQ ID NO: 192096 - protein, 9 aa, Artificial Sequence
  Description of Artificial Sequence: Synthetic peptide
  Seed: NRMYNMVPF (TYRP2_HUMAN)
NEMYNMVPL

SEQ ID NO: 192097 - protein, 10 aa, Artificial Sequence
  Description of Artificial Sequence: Synthetic peptide
  Seed: RELWPRKFFH (TYRP2_HUMAN)
RMLWPRKFFR

SEQ ID NO: 192098 - protein, 9 aa, Artificial Sequence
  Description of Artificial Sequence: Synthetic peptide
  Seed: STFSFRNAL (TYRP2_HUMAN)
SYFSFRNAK

SEQ ID NO: 192099 - protein, 10 aa, Artificial Sequence
  Description of Artificial Sequence: Synthetic peptide
  Seed: TSDQLGYSYA (TYRP2_HUMAN)
TTDQLGYSYY

SEQ ID NO: 192100 - protein, 11 aa, Artificial Sequence
  Description of Artificial Sequence: Synthetic peptide
  Seed: YTPLMETHLSS (TYRP2_HUMAN)
YYPLMETHLSI

SEQ ID NO: 192101 - protein, 9 aa, Artificial Sequence
  Description of Artificial Sequence: Synthetic peptide
  Seed: DDYNHLVTL (TYRP2_HUMAN)
DEYNHLVTP

SEQ ID NO: 192102 - protein, 9 aa, Artificial Sequence
  Description of Artificial Sequence: Synthetic peptide
  Seed: SLDDYNHLV (TYRP2_HUMAN)
SIDDYNHLF

SEQ ID NO: 192103 - protein, 9 aa, Artificial Sequence
  Description of Artificial Sequence: Synthetic peptide
  Seed: GQFPRVCMT (TYRP2_HUMAN)
GLFPRVCML

SEQ ID NO: 192104 - protein, 9 aa, Artificial Sequence
  Description of Artificial Sequence: Synthetic peptide
  Seed: FVLLAFLQY (TYRP2_HUMAN)
FSLLAFLQM

SEQ ID NO: 192105 - protein, 10 aa, Artificial Sequence
  Description of Artificial Sequence: Synthetic peptide
  Seed: SVYDFFVWLH (TYRP2_HUMAN)
SCYDFFVWLR

SEQ ID NO: 192106 - protein, 11 aa, Artificial Sequence
  Description of Artificial Sequence: Synthetic peptide
  Seed: TQPQFANCSVY (TYRP2_HUMAN)
TLPQFANCSVM

SEQ ID NO: 192107 - protein, 10 aa, Artificial Sequence
  Description of Artificial Sequence: Synthetic peptide
  Seed: RELWPRKFFH (TYRP2_HUMAN)
RLLWPRKFFR

SEQ ID NO: 192108 - protein, 8 aa, Artificial Sequence
  Description of Artificial Sequence: Synthetic peptide
  Seed: RPDDPTLI (TYRP2_HUMAN)
RFDDPTLL

SEQ ID NO: 192109 - protein, 9 aa, Artificial Sequence
  Description of Artificial Sequence: Synthetic peptide
  Seed: SRFSSWETV (TYRP2_HUMAN)
SMFSSWETV

SEQ ID NO: 192110 - protein, 9 aa, Artificial Sequence
  Description of Artificial Sequence: Synthetic peptide
  Seed: RNQDDRELW (TYRP2_HUMAN)
RMQDDRELI

SEQ ID NO: 192111 - protein, 10 aa, Artificial Sequence
  Description of Artificial Sequence: Synthetic peptide
  Seed: VVLHSFTDAI (TYRP2_HUMAN)
VSLHSFTDAL

SEQ ID NO: 192112 - protein, 11 aa, Artificial Sequence
  Description of Artificial Sequence: Synthetic peptide
  Seed: YNMVPFFPPVT (TYRP2_HUMAN)
YTMVPFFPPVK

SEQ ID NO: 192113 - protein, 9 aa, Artificial Sequence
  Description of Artificial Sequence: Synthetic peptide
  Seed: FSHQGPAFV (TYRP2_HUMAN)
FAHQGPAFV

SEQ ID NO: 192114 - protein, 11 aa, Artificial Sequence
  Description of Artificial Sequence: Synthetic peptide
  Seed: IGNESFALPYW (TYRP2_HUMAN)
ITNESFALPYW

SEQ ID NO: 192115 - protein, 10 aa, Artificial Sequence
  Description of Artificial Sequence: Synthetic peptide
  Seed: LVVMGTLVAL (TYRP2_HUMAN)
LKVMGTLVAF

SEQ ID NO: 192116 - protein, 9 aa, Artificial Sequence
  Description of Artificial Sequence: Synthetic peptide
  Seed: GTYEGLLRR (TYRP2_HUMAN)
GFYEGLLRR

SEQ ID NO: 192117 - protein, 10 aa, Artificial Sequence
  Description of Artificial Sequence: Synthetic peptide
  Seed: FVVLHSFTDA (TYRP2_HUMAN)
FLVLHSFTDA

SEQ ID NO: 192118 - protein, 9 aa, Artificial Sequence
  Description of Artificial Sequence: Synthetic peptide
  Seed: SPQEREQFL (TYRP2_HUMAN)
SHQEREQFL

SEQ ID NO: 192119 - protein, 10 aa, Artificial Sequence
  Description of Artificial Sequence: Synthetic peptide
  Seed: FLLSCLGCKI (TYRP2_HUMAN)
FTLSCLGCKI

SEQ ID NO: 192120 - protein, 9 aa, Artificial Sequence
  Description of Artificial Sequence: Synthetic peptide
  Seed: YVITTQHWL (TYRP2_HUMAN)
YVITTQHWI

SEQ ID NO: 192121 - protein, 9 aa, Artificial Sequence
  Description of Artificial Sequence: Synthetic peptide
  Seed: GTNALPHSA (TYRP2_HUMAN)
GQNALPHSV

SEQ ID NO: 192122 - protein, 11 aa, Artificial Sequence
  Description of Artificial Sequence: Synthetic peptide
  Seed: RNSRFSSWETV (TYRP2_HUMAN)
RSSRFSSWETI

SEQ ID NO: 192123 - protein, 9 aa, Artificial Sequence
  Description of Artificial Sequence: Synthetic peptide
  Seed: ANDPIFVVL (TYRP2_HUMAN)
ACDPIFVVM

SEQ ID NO: 192124 - protein, 9 aa, Artificial Sequence
  Description of Artificial Sequence: Synthetic peptide
  Seed: FPPVTNEEL (TYRP2_HUMAN)
FAPVTNEEM

SEQ ID NO: 192125 - protein, 9 aa, Artificial Sequence
  Description of Artificial Sequence: Synthetic peptide
  Seed: RDCLSLQKF (TYRP2_HUMAN)
RMCLSLQKI

SEQ ID NO: 192126 - protein, 9 aa, Artificial Sequence
  Description of Artificial Sequence: Synthetic peptide
  Seed: EETPGWPTT (TYRP2_HUMAN)
EETPGWPTP

SEQ ID NO: 192127 - protein, 9 aa, Artificial Sequence
  Description of Artificial Sequence: Synthetic peptide
  Seed: RLRKGYTPL (TYRP2_HUMAN)
RGRKGYTPY

SEQ ID NO: 192128 - protein, 9 aa, Artificial Sequence
  Description of Artificial Sequence: Synthetic peptide
  Seed: ANDPIFVVL (TYRP2_HUMAN)
ASDPIFVVI

SEQ ID NO: 192129 - protein, 10 aa, Artificial Sequence
  Description of Artificial Sequence: Synthetic peptide
  Seed: HSFLNGTNAL (TYRP2_HUMAN)
HVFLNGTNAY

SEQ ID NO: 192130 - protein, 10 aa, Artificial Sequence
  Description of Artificial Sequence: Synthetic peptide
  Seed: ADTRPWSGPY (TYRP2_HUMAN)
AWTRPWSGPY

SEQ ID NO: 192131 - protein, 10 aa, Artificial Sequence
  Description of Artificial Sequence: Synthetic peptide
  Seed: LQKFDNPPFF (TYRP2_HUMAN)
LHKFDNPPFF

SEQ ID NO: 192132 - protein, 9 aa, Artificial Sequence
  Description of Artificial Sequence: Synthetic peptide
  Seed: RLRKGYTPL (TYRP2_HUMAN)
RMRKGYTPT

SEQ ID NO: 192133 - protein, 10 aa, Artificial Sequence
  Description of Artificial Sequence: Synthetic peptide
  Seed: ELWPRKFFHR (TYRP2_HUMAN)
EYWPRKFFHR

SEQ ID NO: 192134 - protein, 9 aa, Artificial Sequence
  Description of Artificial Sequence: Synthetic peptide
  Seed: YSYAIDLPV (TYRP2_HUMAN)
YLYAIDLPF

SEQ ID NO: 192135 - protein, 9 aa, Artificial Sequence
  Description of Artificial Sequence: Synthetic peptide
  Seed: RLRKGYTPL (TYRP2_HUMAN)
RMRKGYTPL

SEQ ID NO: 192136 - protein, 10 aa, Artificial Sequence
  Description of Artificial Sequence: Synthetic peptide
  Seed: SLSPQEREQF (TYRP2_HUMAN)
SQSPQEREQM

SEQ ID NO: 192137 - protein, 9 aa, Artificial Sequence
  Description of Artificial Sequence: Synthetic peptide
  Seed: VVMGTLVAL (TYRP2_HUMAN)
VAMGTLVAH

SEQ ID NO: 192138 - protein, 9 aa, Artificial Sequence
  Description of Artificial Sequence: Synthetic peptide
  Seed: FFQNSTFSF (TYRP2_HUMAN)
FPQNSTFSV

SEQ ID NO: 192139 - protein, 10 aa, Artificial Sequence
  Description of Artificial Sequence: Synthetic peptide
  Seed: VVLHSFTDAI (TYRP2_HUMAN)
VDLHSFTDAV

SEQ ID NO: 192140 - protein, 9 aa, Artificial Sequence
  Description of Artificial Sequence: Synthetic peptide
  Seed: ETPGWPTTL (TYRP2_HUMAN)
EFPGWPTTL

SEQ ID NO: 192141 - protein, 9 aa, Artificial Sequence
  Description of Artificial Sequence: Synthetic peptide
  Seed: NMVPFFPPV (TYRP2_HUMAN)
NIVPFFPPI

SEQ ID NO: 192142 - protein, 9 aa, Artificial Sequence
  Description of Artificial Sequence: Synthetic peptide
  Seed: FLNGTNALP (TYRP2_HUMAN)
FMNGTNALV

SEQ ID NO: 192143 - protein, 9 aa, Artificial Sequence
  Description of Artificial Sequence: Synthetic peptide
  Seed: RNQDDRELW (TYRP2_HUMAN)
RIQDDRELM

SEQ ID NO: 192144 - protein, 9 aa, Artificial Sequence
  Description of Artificial Sequence: Synthetic peptide
  Seed: ELWPRKFFH (TYRP2_HUMAN)
ETWPRKFFR

SEQ ID NO: 192145 - protein, 9 aa, Artificial Sequence
  Description of Artificial Sequence: Synthetic peptide
  Seed: FVWLHYYSV (TYRP2_HUMAN)
FQWLHYYSS

SEQ ID NO: 192146 - protein, 10 aa, Artificial Sequence
  Description of Artificial Sequence: Synthetic peptide
  Seed: RPWSGPYILR (TYRP2_HUMAN)
RTWSGPYILK

SEQ ID NO: 192147 - protein, 9 aa, Artificial Sequence
  Description of Artificial Sequence: Synthetic peptide
  Seed: GNESFALPY (TYRP2_HUMAN)
GKESFALPF

SEQ ID NO: 192148 - protein, 11 aa, Artificial Sequence
  Description of Artificial Sequence: Synthetic peptide
  Seed: QFANCSVYDFF (TYRP2_HUMAN)
QYANCSVYDFF

SEQ ID NO: 192149 - protein, 9 aa, Artificial Sequence
  Description of Artificial Sequence: Synthetic peptide
  Seed: EQFLGALDL (TYRP2_HUMAN)
EHFLGALDM

SEQ ID NO: 192150 - protein, 9 aa, Artificial Sequence
  Description of Artificial Sequence: Synthetic peptide
  Seed: YTPLMETHL (TYRP2_HUMAN)
YLPLMETHV

SEQ ID NO: 192151 - protein, 9 aa, Artificial Sequence
  Description of Artificial Sequence: Synthetic peptide
  Seed: GTLVALVGL (TYRP2_HUMAN)
GLLVALVGV

SEQ ID NO: 192152 - protein, 9 aa, Artificial Sequence
  Description of Artificial Sequence: Synthetic peptide
  Seed: RLRKGYTPL (TYRP2_HUMAN)
RVRKGYTPH

SEQ ID NO: 192153 - protein, 11 aa, Artificial Sequence
  Description of Artificial Sequence: Synthetic peptide
  Seed: FVVLHSFTDAI (TYRP2_HUMAN)
FTVLHSFTDAL

SEQ ID NO: 192154 - protein, 9 aa, Artificial Sequence
  Description of Artificial Sequence: Synthetic peptide
  Seed: FVLLAFLQY (TYRP2_HUMAN)
FALLAFLQF

SEQ ID NO: 192155 - protein, 10 aa, Artificial Sequence
  Description of Artificial Sequence: Synthetic peptide
  Seed: SAANDPIFVV (TYRP2_HUMAN)
SLANDPIFVM

SEQ ID NO: 192156 - protein, 10 aa, Artificial Sequence
  Description of Artificial Sequence: Synthetic peptide
  Seed: MGTLVALVGL (TYRP2_HUMAN)
MTTLVALVGI

SEQ ID NO: 192157 - protein, 11 aa, Artificial Sequence
  Description of Artificial Sequence: Synthetic peptide
  Seed: RELWPRKFFHR (TYRP2_HUMAN)
RRLWPRKFFHK

SEQ ID NO: 192158 - protein, 9 aa, Artificial Sequence
  Description of Artificial Sequence: Synthetic peptide
  Seed: RTCKCTGNF (TYRP2_HUMAN)
RTCKCTGNY

SEQ ID NO: 192159 - protein, 10 aa, Artificial Sequence
  Description of Artificial Sequence: Synthetic peptide
  Seed: TLDSQVMSLH (TYRP2_HUMAN)
TLDSQVMSLY

SEQ ID NO: 192160 - protein, 10 aa, Artificial Sequence
  Description of Artificial Sequence: Synthetic peptide
  Seed: AGYNCGDCKF (TYRP2_HUMAN)
AYYNCGDCKW

SEQ ID NO: 192161 - protein, 11 aa, Artificial Sequence
  Description of Artificial Sequence: Synthetic peptide
  Seed: MYNMVPFFPPV (TYRP2_HUMAN)
MANMVPFFPPI

SEQ ID NO: 192162 - protein, 11 aa, Artificial Sequence
  Description of Artificial Sequence: Synthetic peptide
  Seed: RRLRKGYTPLM (TYRP2_HUMAN)
RRLRKGYTPLY

SEQ ID NO: 192163 - protein, 10 aa, Artificial Sequence
  Description of Artificial Sequence: Synthetic peptide
  Seed: YSYAIDLPVS (TYRP2_HUMAN)
YTYAIDLPVL

SEQ ID NO: 192164 - protein, 9 aa, Artificial Sequence
  Description of Artificial Sequence: Synthetic peptide
  Seed: HRYHLLCLE (TYRP2_HUMAN)
HRYHLLCLI

SEQ ID NO: 192165 - protein, 9 aa, Artificial Sequence
  Description of Artificial Sequence: Synthetic peptide
  Seed: ALPYWNFAT (TYRP2_HUMAN)
AMPYWNFAT

SEQ ID NO: 192166 - protein, 10 aa, Artificial Sequence
  Description of Artificial Sequence: Synthetic peptide
  Seed: RELWPRKFFH (TYRP2_HUMAN)
RSLWPRKFFR

SEQ ID NO: 192167 - protein, 10 aa, Artificial Sequence
  Description of Artificial Sequence: Synthetic peptide
  Seed: QVMSLHNLVH (TYRP2_HUMAN)
QTMSLHNLVK

SEQ ID NO: 192168 - protein, 9 aa, Artificial Sequence
  Description of Artificial Sequence: Synthetic peptide
  Seed: WHRYHLLCL (TYRP2_HUMAN)
WYRYHLLCF

SEQ ID NO: 192169 - protein, 10 aa, Artificial Sequence
  Description of Artificial Sequence: Synthetic peptide
  Seed: YAIDLPVSVE (TYRP2_HUMAN)
YMIDLPVSVH

SEQ ID NO: 192170 - protein, 9 aa, Artificial Sequence
  Description of Artificial Sequence: Synthetic peptide
  Seed: YAIDLPVSV (TYRP2_HUMAN)
YWIDLPVSV

SEQ ID NO: 192171 - protein, 10 aa, Artificial Sequence
  Description of Artificial Sequence: Synthetic peptide
  Seed: LVVMGTLVAL (TYRP2_HUMAN)
LMVMGTLVAM

SEQ ID NO: 192172 - protein, 9 aa, Artificial Sequence
  Description of Artificial Sequence: Synthetic peptide
  Seed: TLDSQVMSL (TYRP2_HUMAN)
TCDSQVMSI

SEQ ID NO: 192173 - protein, 10 aa, Artificial Sequence
  Description of Artificial Sequence: Synthetic peptide
  Seed: LHYYSVRDTL (TYRP2_HUMAN)
LKYYSVRDTL

SEQ ID NO: 192174 - protein, 10 aa, Artificial Sequence
  Description of Artificial Sequence: Synthetic peptide
  Seed: GTLDSQVMSL (TYRP2_HUMAN)
GFLDSQVMSL

SEQ ID NO: 192175 - protein, 10 aa, Artificial Sequence
  Description of Artificial Sequence: Synthetic peptide
  Seed: KILPGAQGQF (TYRP2_HUMAN)
KALPGAQGQF

SEQ ID NO: 192176 - protein, 10 aa, Artificial Sequence
  Description of Artificial Sequence: Synthetic peptide
  Seed: RMYNMVPFFP (TYRP2_HUMAN)
REYNMVPFFY

SEQ ID NO: 192177 - protein, 8 aa, Artificial Sequence
  Description of Artificial Sequence: Synthetic peptide
  Seed: AIDLPVSV (TYRP2_HUMAN)
ASDLPVSL

SEQ ID NO: 192178 - protein, 9 aa, Artificial Sequence
  Description of Artificial Sequence: Synthetic peptide
  Seed: SSKRYTEEA (TYRP2_HUMAN)
STKRYTEEK

SEQ ID NO: 192179 - protein, 11 aa, Artificial Sequence
  Description of Artificial Sequence: Synthetic peptide
  Seed: RNQDDRELWPR (TYRP2_HUMAN)
RTQDDRELWPR

SEQ ID NO: 192180 - protein, 9 aa, Artificial Sequence
  Description of Artificial Sequence: Synthetic peptide
  Seed: TNALPHSAA (TYRP2_HUMAN)
THALPHSAL

SEQ ID NO: 192181 - protein, 9 aa, Artificial Sequence
  Description of Artificial Sequence: Synthetic peptide
  Seed: APIGHNRMY (TYRP2_HUMAN)
ASIGHNRMY

SEQ ID NO: 192182 - protein, 9 aa, Artificial Sequence
  Description of Artificial Sequence: Synthetic peptide
  Seed: RELWPRKFF (TYRP2_HUMAN)
RELWPRKFL

SEQ ID NO: 192183 - protein, 10 aa, Artificial Sequence
  Description of Artificial Sequence: Synthetic peptide
  Seed: AIDFSHQGPA (TYRP2_HUMAN)
ALDFSHQGPA

SEQ ID NO: 192184 - protein, 10 aa, Artificial Sequence
  Description of Artificial Sequence: Synthetic peptide
  Seed: SPLWWGFLLS (TYRP2_HUMAN)
SCLWWGFLLA

SEQ ID NO: 192185 - protein, 9 aa, Artificial Sequence
  Description of Artificial Sequence: Synthetic peptide
  Seed: VTWHRYHLL (TYRP2_HUMAN)
VTWHRYHLY

SEQ ID NO: 192186 - protein, 9 aa, Artificial Sequence
  Description of Artificial Sequence: Synthetic peptide
  Seed: FFPPVTNEE (TYRP2_HUMAN)
FMPPVTNEL

SEQ ID NO: 192187 - protein, 9 aa, Artificial Sequence
  Description of Artificial Sequence: Synthetic peptide
  Seed: GTYEGLLRR (TYRP2_HUMAN)
GSYEGLLRL

SEQ ID NO: 192188 - protein, 9 aa, Artificial Sequence
  Description of Artificial Sequence: Synthetic peptide
  Seed: RQNIHSLSP (TYRP2_HUMAN)
RTNIHSLSM

SEQ ID NO: 192189 - protein, 11 aa, Artificial Sequence
  Description of Artificial Sequence: Synthetic peptide
  Seed: TQPQFANCSVY (TYRP2_HUMAN)
TRPQFANCSVM

SEQ ID NO: 192190 - protein, 11 aa, Artificial Sequence
  Description of Artificial Sequence: Synthetic peptide
  Seed: SLDDYNHLVTL (TYRP2_HUMAN)
SQDDYNHLVTL

SEQ ID NO: 192191 - protein, 10 aa, Artificial Sequence
  Description of Artificial Sequence: Synthetic peptide
  Seed: NGTYEGLLRR (TYRP2_HUMAN)
NWTYEGLLRR

SEQ ID NO: 192192 - protein, 10 aa, Artificial Sequence
  Description of Artificial Sequence: Synthetic peptide
  Seed: SLDDYNHLVT (TYRP2_HUMAN)
STDDYNHLVM

SEQ ID NO: 192193 - protein, 9 aa, Artificial Sequence
  Description of Artificial Sequence: Synthetic peptide
  Seed: TSDQLGYSY (TYRP2_HUMAN)
TTDQLGYSV

SEQ ID NO: 192194 - protein, 10 aa, Artificial Sequence
  Description of Artificial Sequence: Synthetic peptide
  Seed: SDQLGYSYAI (TYRP2_HUMAN)
SCQLGYSYAM

SEQ ID NO: 192195 - protein, 9 aa, Artificial Sequence
  Description of Artificial Sequence: Synthetic peptide
  Seed: YVITTQHWL (TYRP2_HUMAN)
YMITTQHWK

SEQ ID NO: 192196 - protein, 9 aa, Artificial Sequence
  Description of Artificial Sequence: Synthetic peptide
  Seed: EREQFLGAL (TYRP2_HUMAN)
EHEQFLGAI

SEQ ID NO: 192197 - protein, 9 aa, Artificial Sequence
  Description of Artificial Sequence: Synthetic peptide
  Seed: FFPPVTNEE (TYRP2_HUMAN)
FVPPVTNEL

SEQ ID NO: 192198 - protein, 11 aa, Artificial Sequence
  Description of Artificial Sequence: Synthetic peptide
  Seed: YTPLMETHLSS (TYRP2_HUMAN)
YLPLMETHLSV

SEQ ID NO: 192199 - protein, 10 aa, Artificial Sequence
  Description of Artificial Sequence: Synthetic peptide
  Seed: NLVHSFLNGT (TYRP2_HUMAN)
NMVHSFLNGV

SEQ ID NO: 192200 - protein, 10 aa, Artificial Sequence
  Description of Artificial Sequence: Synthetic peptide
  Seed: LISRNSRFSS (TYRP2_HUMAN)
LESRNSRFSK

SEQ ID NO: 192201 - protein, 9 aa, Artificial Sequence
  Description of Artificial Sequence: Synthetic peptide
  Seed: DDRELWPRK (TYRP2_HUMAN)
DIRELWPRR

SEQ ID NO: 192202 - protein, 9 aa, Artificial Sequence
  Description of Artificial Sequence: Synthetic peptide
  Seed: NSMKLPTLK (TYRP2_HUMAN)
NAMKLPTLL

SEQ ID NO: 192203 - protein, 9 aa, Artificial Sequence
  Description of Artificial Sequence: Synthetic peptide
  Seed: STFSFRNAL (TYRP2_HUMAN)
SQFSFRNAV

SEQ ID NO: 192204 - protein, 9 aa, Artificial Sequence
  Description of Artificial Sequence: Synthetic peptide
  Seed: RQNIHSLSP (TYRP2_HUMAN)
RANIHSLSM

SEQ ID NO: 192205 - protein, 10 aa, Artificial Sequence
  Description of Artificial Sequence: Synthetic peptide
  Seed: VLHSFTDAIF (TYRP2_HUMAN)
VMHSFTDAIL

SEQ ID NO: 192206 - protein, 9 aa, Artificial Sequence
  Description of Artificial Sequence: Synthetic peptide
  Seed: LHNLVHSFL (TYRP2_HUMAN)
LQNLVHSFM

SEQ ID NO: 192207 - protein, 8 aa, Artificial Sequence
  Description of Artificial Sequence: Synthetic peptide
  Seed: TPGWPTTL (TYRP2_HUMAN)
TAGWPTTL

SEQ ID NO: 192208 - protein, 10 aa, Artificial Sequence
  Description of Artificial Sequence: Synthetic peptide
  Seed: AQGQFPRVCM (TYRP2_HUMAN)
AMGQFPRVCY

SEQ ID NO: 192209 - protein, 11 aa, Artificial Sequence
  Description of Artificial Sequence: Synthetic peptide
  Seed: ANCSVYDFFVW (TYRP2_HUMAN)
AWCSVYDFFVW

SEQ ID NO: 192210 - protein, 10 aa, Artificial Sequence
  Description of Artificial Sequence: Synthetic peptide
  Seed: FFPPVTNEEL (TYRP2_HUMAN)
FQPPVTNEEF

SEQ ID NO: 192211 - protein, 10 aa, Artificial Sequence
  Description of Artificial Sequence: Synthetic peptide
  Seed: NCSVYDFFVW (TYRP2_HUMAN)
NGSVYDFFVW

SEQ ID NO: 192212 - protein, 10 aa, Artificial Sequence
  Description of Artificial Sequence: Synthetic peptide
  Seed: SDQLGYSYAI (TYRP2_HUMAN)
SLQLGYSYAL

SEQ ID NO: 192213 - protein, 9 aa, Artificial Sequence
  Description of Artificial Sequence: Synthetic peptide
  Seed: SVYDFFVWL (TYRP2_HUMAN)
SIYDFFVWL

SEQ ID NO: 192214 - protein, 11 aa, Artificial Sequence
  Description of Artificial Sequence: Synthetic peptide
  Seed: SQVMSLHNLVH (TYRP2_HUMAN)
SQVMSLHNLVY

SEQ ID NO: 192215 - protein, 9 aa, Artificial Sequence
  Description of Artificial Sequence: Synthetic peptide
  Seed: TDQLFGAAR (TYRP2_HUMAN)
TMQLFGAAR

SEQ ID NO: 192216 - protein, 10 aa, Artificial Sequence
  Description of Artificial Sequence: Synthetic peptide
  Seed: HNRMYNMVPF (TYRP2_HUMAN)
HNRMYNMVPL

SEQ ID NO: 192217 - protein, 10 aa, Artificial Sequence
  Description of Artificial Sequence: Synthetic peptide
  Seed: RMYNMVPFFP (TYRP2_HUMAN)
RQYNMVPFFG

SEQ ID NO: 192218 - protein, 9 aa, Artificial Sequence
  Description of Artificial Sequence: Synthetic peptide
  Seed: RKFFHRTCK (TYRP2_HUMAN)
RLFFHRTCA

SEQ ID NO: 192219 - protein, 9 aa, Artificial Sequence
  Description of Artificial Sequence: Synthetic peptide
  Seed: TQHWLGLLG (TYRP2_HUMAN)
TMHWLGLLY

SEQ ID NO: 192220 - protein, 9 aa, Artificial Sequence
  Description of Artificial Sequence: Synthetic peptide
  Seed: SVYDFFVWL (TYRP2_HUMAN)
SGYDFFVWV

SEQ ID NO: 192221 - protein, 9 aa, Artificial Sequence
  Description of Artificial Sequence: Synthetic peptide
  Seed: RDCLSLQKF (TYRP2_HUMAN)
RECLSLQKW

SEQ ID NO: 192222 - protein, 9 aa, Artificial Sequence
  Description of Artificial Sequence: Synthetic peptide
  Seed: RDCLSLQKF (TYRP2_HUMAN)
RECLSLQKV

SEQ ID NO: 192223 - protein, 8 aa, Artificial Sequence
  Description of Artificial Sequence: Synthetic peptide
  Seed: RPDDPTLI (TYRP2_HUMAN)
RMDDPTLL

SEQ ID NO: 192224 - protein, 9 aa, Artificial Sequence
  Description of Artificial Sequence: Synthetic peptide
  Seed: QEREQFLGA (TYRP2_HUMAN)
QEREQFLGM

SEQ ID NO: 192225 - protein, 9 aa, Artificial Sequence
  Description of Artificial Sequence: Synthetic peptide
  Seed: MSPLWWGFL (TYRP2_HUMAN)
MYPLWWGFF

SEQ ID NO: 192226 - protein, 8 aa, Artificial Sequence
  Description of Artificial Sequence: Synthetic peptide
  Seed: KFDNPPFF (TYRP2_HUMAN)
KTDNPPFL

SEQ ID NO: 192227 - protein, 10 aa, Artificial Sequence
  Description of Artificial Sequence: Synthetic peptide
  Seed: LGPGRPYRAI (TYRP2_HUMAN)
LLPGRPYRAL

SEQ ID NO: 192228 - protein, 9 aa, Artificial Sequence
  Description of Artificial Sequence: Synthetic peptide
  Seed: LVHSFLNGT (TYRP2_HUMAN)
LAHSFLNGV

SEQ ID NO: 192229 - protein, 9 aa, Artificial Sequence
  Description of Artificial Sequence: Synthetic peptide
  Seed: NMVPFFPPV (TYRP2_HUMAN)
NAVPFFPPY

SEQ ID NO: 192230 - protein, 11 aa, Artificial Sequence
  Description of Artificial Sequence: Synthetic peptide
  Seed: RELWPRKFFHR (TYRP2_HUMAN)
RYLWPRKFFHR

SEQ ID NO: 192231 - protein, 9 aa, Artificial Sequence
  Description of Artificial Sequence: Synthetic peptide
  Seed: VVMGTLVAL (TYRP2_HUMAN)
VYMGTLVAA

SEQ ID NO: 192232 - protein, 9 aa, Artificial Sequence
  Description of Artificial Sequence: Synthetic peptide
  Seed: TLLGPGRPY (TYRP2_HUMAN)
TKLGPGRPF

SEQ ID NO: 192233 - protein, 9 aa, Artificial Sequence
  Description of Artificial Sequence: Synthetic peptide
  Seed: ETPGWPTTL (TYRP2_HUMAN)
EGPGWPTTL

SEQ ID NO: 192234 - protein, 10 aa, Artificial Sequence
  Description of Artificial Sequence: Synthetic peptide
  Seed: QPQFANCSVY (TYRP2_HUMAN)
QFQFANCSVL

SEQ ID NO: 192235 - protein, 10 aa, Artificial Sequence
  Description of Artificial Sequence: Synthetic peptide
  Seed: RNQMGRNSMK (TYRP2_HUMAN)
RWQMGRNSMR

SEQ ID NO: 192236 - protein, 10 aa, Artificial Sequence
  Description of Artificial Sequence: Synthetic peptide
  Seed: RNSMKLPTLK (TYRP2_HUMAN)
RLSMKLPTLK

SEQ ID NO: 192237 - protein, 10 aa, Artificial Sequence
  Description of Artificial Sequence: Synthetic peptide
  Seed: YNMVPFFPPV (TYRP2_HUMAN)
YTMVPFFPPV

SEQ ID NO: 192238 - protein, 10 aa, Artificial Sequence
  Description of Artificial Sequence: Synthetic peptide
  Seed: FGWTGPNCER (TYRP2_HUMAN)
FSWTGPNCEL

SEQ ID NO: 192239 - protein, 10 aa, Artificial Sequence
  Description of Artificial Sequence: Synthetic peptide
  Seed: RLRKGYTPLM (TYRP2_HUMAN)
RYRKGYTPLR

SEQ ID NO: 192240 - protein, 9 aa, Artificial Sequence
  Description of Artificial Sequence: Synthetic peptide
  Seed: SRFSSWETV (TYRP2_HUMAN)
SLFSSWETY

SEQ ID NO: 192241 - protein, 9 aa, Artificial Sequence
  Description of Artificial Sequence: Synthetic peptide
  Seed: TSDQLGYSY (TYRP2_HUMAN)
TSDQLGYSV

SEQ ID NO: 192242 - protein, 9 aa, Artificial Sequence
  Description of Artificial Sequence: Synthetic peptide
  Seed: GLFVLLAFL (TYRP2_HUMAN)
GVFVLLAFL

SEQ ID NO: 192243 - protein, 9 aa, Artificial Sequence
  Description of Artificial Sequence: Synthetic peptide
  Seed: AFLQYRRLR (TYRP2_HUMAN)
AGLQYRRLR

SEQ ID NO: 192244 - protein, 10 aa, Artificial Sequence
  Description of Artificial Sequence: Synthetic peptide
  Seed: ADTRPWSGPY (TYRP2_HUMAN)
AQTRPWSGPM

SEQ ID NO: 192245 - protein, 11 aa, Artificial Sequence
  Description of Artificial Sequence: Synthetic peptide
  Seed: FVVLHSFTDAI (TYRP2_HUMAN)
FHVLHSFTDAL

SEQ ID NO: 192246 - protein, 10 aa, Artificial Sequence
  Description of Artificial Sequence: Synthetic peptide
  Seed: RRLRKGYTPL (TYRP2_HUMAN)
RCLRKGYTPF

SEQ ID NO: 192247 - protein, 9 aa, Artificial Sequence
  Description of Artificial Sequence: Synthetic peptide
  Seed: NALEGFDKA (TYRP2_HUMAN)
NPLEGFDKA

SEQ ID NO: 192248 - protein, 10 aa, Artificial Sequence
  Description of Artificial Sequence: Synthetic peptide
  Seed: SQVMSLHNLV (TYRP2_HUMAN)
SAVMSLHNLV

SEQ ID NO: 192249 - protein, 10 aa, Artificial Sequence
  Description of Artificial Sequence: Synthetic peptide
  Seed: SVYDFFVWLH (TYRP2_HUMAN)
SGYDFFVWLK

SEQ ID NO: 192250 - protein, 9 aa, Artificial Sequence
  Description of Artificial Sequence: Synthetic peptide
  Seed: NMVPFFPPV (TYRP2_HUMAN)
NIVPFFPPF

SEQ ID NO: 192251 - protein, 9 aa, Artificial Sequence
  Description of Artificial Sequence: Synthetic peptide
  Seed: RQNIHSLSP (TYRP2_HUMAN)
RFNIHSLSY

SEQ ID NO: 192252 - protein, 10 aa, Artificial Sequence
  Description of Artificial Sequence: Synthetic peptide
  Seed: LHYYSVRDTL (TYRP2_HUMAN)
LFYYSVRDTF

SEQ ID NO: 192253 - protein, 10 aa, Artificial Sequence
  Description of Artificial Sequence: Synthetic peptide
  Seed: ELWPRKFFHR (TYRP2_HUMAN)
EVWPRKFFHK

SEQ ID NO: 192254 - protein, 10 aa, Artificial Sequence
  Description of Artificial Sequence: Synthetic peptide
  Seed: NSTFSFRNAL (TYRP2_HUMAN)
NLTFSFRNAI

SEQ ID NO: 192255 - protein, 10 aa, Artificial Sequence
  Description of Artificial Sequence: Synthetic peptide
  Seed: RELWPRKFFH (TYRP2_HUMAN)
RYLWPRKFFY

SEQ ID NO: 192256 - protein, 9 aa, Artificial Sequence
  Description of Artificial Sequence: Synthetic peptide
  Seed: TLISRNSRF (TYRP2_HUMAN)
TAISRNSRY

SEQ ID NO: 192257 - protein, 8 aa, Artificial Sequence
  Description of Artificial Sequence: Synthetic peptide
  Seed: FSHQGPAF (TYRP2_HUMAN)
FAHQGPAF

SEQ ID NO: 192258 - protein, 9 aa, Artificial Sequence
  Description of Artificial Sequence: Synthetic peptide
  Seed: FFQNSTFSF (TYRP2_HUMAN)
FKQNSTFSY

SEQ ID NO: 192259 - protein, 10 aa, Artificial Sequence
  Description of Artificial Sequence: Synthetic peptide
  Seed: NSTFSFRNAL (TYRP2_HUMAN)
NRTFSFRNAI

SEQ ID NO: 192260 - protein, 9 aa, Artificial Sequence
  Description of Artificial Sequence: Synthetic peptide
  Seed: SRFSSWETV (TYRP2_HUMAN)
SQFSSWETL

SEQ ID NO: 192261 - protein, 10 aa, Artificial Sequence
  Description of Artificial Sequence: Synthetic peptide
  Seed: SFTDAIFDEW (TYRP2_HUMAN)
SVTDAIFDEW

SEQ ID NO: 192262 - protein, 10 aa, Artificial Sequence
  Description of Artificial Sequence: Synthetic peptide
  Seed: GTLDSQVMSL (TYRP2_HUMAN)
GMLDSQVMSR

SEQ ID NO: 192263 - protein, 9 aa, Artificial Sequence
  Description of Artificial Sequence: Synthetic peptide
  Seed: FTDAIFDEW (TYRP2_HUMAN)
FNDAIFDEV

SEQ ID NO: 192264 - protein, 10 aa, Artificial Sequence
  Description of Artificial Sequence: Synthetic peptide
  Seed: FFQNSTFSFR (TYRP2_HUMAN)
FTQNSTFSFK

SEQ ID NO: 192265 - protein, 10 aa, Artificial Sequence
  Description of Artificial Sequence: Synthetic peptide
  Seed: VVMGTLVALV (TYRP2_HUMAN)
VMMGTLVALW

SEQ ID NO: 192266 - protein, 10 aa, Artificial Sequence
  Description of Artificial Sequence: Synthetic peptide
  Seed: YNMVPFFPPV (TYRP2_HUMAN)
YTMVPFFPPT

SEQ ID NO: 192267 - protein, 10 aa, Artificial Sequence
  Description of Artificial Sequence: Synthetic peptide
  Seed: YDFFVWLHYY (TYRP2_HUMAN)
YFFFVWLHYC

SEQ ID NO: 192268 - protein, 9 aa, Artificial Sequence
  Description of Artificial Sequence: Synthetic peptide
  Seed: ETPGWPTTL (TYRP2_HUMAN)
EMPGWPTTK

SEQ ID NO: 192269 - protein, 8 aa, Artificial Sequence
  Description of Artificial Sequence: Synthetic peptide
  Seed: RPDDPTLI (TYRP2_HUMAN)
RYDDPTLL

SEQ ID NO: 192270 - protein, 9 aa, Artificial Sequence
  Description of Artificial Sequence: Synthetic peptide
  Seed: FQNSTFSFR (TYRP2_HUMAN)
FTNSTFSFM

SEQ ID NO: 192271 - protein, 9 aa, Artificial Sequence
  Description of Artificial Sequence: Synthetic peptide
  Seed: SFALPYWNF (TYRP2_HUMAN)
SVALPYWNY

SEQ ID NO: 192272 - protein, 9 aa, Artificial Sequence
  Description of Artificial Sequence: Synthetic peptide
  Seed: VVMGTLVAL (TYRP2_HUMAN)
VRMGTLVAV

SEQ ID NO: 192273 - protein, 9 aa, Artificial Sequence
  Description of Artificial Sequence: Synthetic peptide
  Seed: VALVGLFVL (TYRP2_HUMAN)
VSLVGLFVY

SEQ ID NO: 192274 - protein, 10 aa, Artificial Sequence
  Description of Artificial Sequence: Synthetic peptide
  Seed: NPPFFQNSTF (TYRP2_HUMAN)
NRPFFQNSTY

SEQ ID NO: 192275 - protein, 10 aa, Artificial Sequence
  Description of Artificial Sequence: Synthetic peptide
  Seed: YSYAIDLPVS (TYRP2_HUMAN)
YMYAIDLPVI

SEQ ID NO: 192276 - protein, 9 aa, Artificial Sequence
  Description of Artificial Sequence: Synthetic peptide
  Seed: RPWSGPYIL (TYRP2_HUMAN)
RRWSGPYIF

SEQ ID NO: 192277 - protein, 10 aa, Artificial Sequence
  Description of Artificial Sequence: Synthetic peptide
  Seed: RRLRKGYTPL (TYRP2_HUMAN)
RSLRKGYTPV

SEQ ID NO: 192278 - protein, 11 aa, Artificial Sequence
  Description of Artificial Sequence: Synthetic peptide
  Seed: ANCSVYDFFVW (TYRP2_HUMAN)
ALCSVYDFFVW

SEQ ID NO: 192279 - protein, 10 aa, Artificial Sequence
  Description of Artificial Sequence: Synthetic peptide
  Seed: SLVNKECCPR (TYRP2_HUMAN)
SVVNKECCPK

SEQ ID NO: 192280 - protein, 9 aa, Artificial Sequence
  Description of Artificial Sequence: Synthetic peptide
  Seed: FPPVTNEEL (TYRP2_HUMAN)
FTPVTNEEY

SEQ ID NO: 192281 - protein, 9 aa, Artificial Sequence
  Description of Artificial Sequence: Synthetic peptide
  Seed: RDCLSLQKF (TYRP2_HUMAN)
RLCLSLQKL

SEQ ID NO: 192282 - protein, 10 aa, Artificial Sequence
  Description of Artificial Sequence: Synthetic peptide
  Seed: HNRMYNMVPF (TYRP2_HUMAN)
HKRMYNMVPL

SEQ ID NO: 192283 - protein, 9 aa, Artificial Sequence
  Description of Artificial Sequence: Synthetic peptide
  Seed: LRKGYTPLM (TYRP2_HUMAN)
LLKGYTPLY

SEQ ID NO: 192284 - protein, 9 aa, Artificial Sequence
  Description of Artificial Sequence: Synthetic peptide
  Seed: ECDVCTDQL (TYRP2_HUMAN)
EWDVCTDQL

SEQ ID NO: 192285 - protein, 10 aa, Artificial Sequence
  Description of Artificial Sequence: Synthetic peptide
  Seed: SYAIDLPVSV (TYRP2_HUMAN)
STAIDLPVSI

SEQ ID NO: 192286 - protein, 8 aa, Artificial Sequence
  Description of Artificial Sequence: Synthetic peptide
  Seed: FLNGTNAL (TYRP2_HUMAN)
FANGTNAL

SEQ ID NO: 192287 - protein, 10 aa, Artificial Sequence
  Description of Artificial Sequence: Synthetic peptide
  Seed: HSFLNGTNAL (TYRP2_HUMAN)
HAFLNGTNAF

SEQ ID NO: 192288 - protein, 9 aa, Artificial Sequence
  Description of Artificial Sequence: Synthetic peptide
  Seed: YVITTQHWL (TYRP2_HUMAN)
YMITTQHWY

SEQ ID NO: 192289 - protein, 10 aa, Artificial Sequence
  Description of Artificial Sequence: Synthetic peptide
  Seed: SLQKFDNPPF (TYRP2_HUMAN)
SKQKFDNPPY

SEQ ID NO: 192290 - protein, 11 aa, Artificial Sequence
  Description of Artificial Sequence: Synthetic peptide
  Seed: RNSRFSSWETV (TYRP2_HUMAN)
RVSRFSSWETF

SEQ ID NO: 192291 - protein, 10 aa, Artificial Sequence
  Description of Artificial Sequence: Synthetic peptide
  Seed: SDQLGYSYAI (TYRP2_HUMAN)
SKQLGYSYAI

SEQ ID NO: 192292 - protein, 9 aa, Artificial Sequence
  Description of Artificial Sequence: Synthetic peptide
  Seed: VVMGTLVAL (TYRP2_HUMAN)
VMMGTLVAK

SEQ ID NO: 192293 - protein, 10 aa, Artificial Sequence
  Description of Artificial Sequence: Synthetic peptide
  Seed: RPWSGPYILR (TYRP2_HUMAN)
RHWSGPYILR

SEQ ID NO: 192294 - protein, 9 aa, Artificial Sequence
  Description of Artificial Sequence: Synthetic peptide
  Seed: SLDDYNHLV (TYRP2_HUMAN)
SWDDYNHLC

SEQ ID NO: 192295 - protein, 8 aa, Artificial Sequence
  Description of Artificial Sequence: Synthetic peptide
  Seed: FSHQGPAF (TYRP2_HUMAN)
FAHQGPAI

SEQ ID NO: 192296 - protein, 9 aa, Artificial Sequence
  Description of Artificial Sequence: Synthetic peptide
  Seed: YSVRDTLLG (TYRP2_HUMAN)
YGVRDTLLW

SEQ ID NO: 192297 - protein, 8 aa, Artificial Sequence
  Description of Artificial Sequence: Synthetic peptide
  Seed: QFANCSVY (TYRP2_HUMAN)
QQANCSVF

SEQ ID NO: 192298 - protein, 9 aa, Artificial Sequence
  Description of Artificial Sequence: Synthetic peptide
  Seed: VGLFVLLAF (TYRP2_HUMAN)
VMLFVLLAM

SEQ ID NO: 192299 - protein, 9 aa, Artificial Sequence
  Description of Artificial Sequence: Synthetic peptide
  Seed: GYTPLMETH (TYRP2_HUMAN)
GYTPLMETM

SEQ ID NO: 192300 - protein, 9 aa, Artificial Sequence
  Description of Artificial Sequence: Synthetic peptide
  Seed: FSHQGPAFV (TYRP2_HUMAN)
FQHQGPAFL

SEQ ID NO: 192301 - protein, 10 aa, Artificial Sequence
  Description of Artificial Sequence: Synthetic peptide
  Seed: TLLGPGRPYR (TYRP2_HUMAN)
TLLGPGRPYK

SEQ ID NO: 192302 - protein, 9 aa, Artificial Sequence
  Description of Artificial Sequence: Synthetic peptide
  Seed: TLLGPGRPY (TYRP2_HUMAN)
TSLGPGRPY

SEQ ID NO: 192303 - protein, 9 aa, Artificial Sequence
  Description of Artificial Sequence: Synthetic peptide
  Seed: GAQGQFPRV (TYRP2_HUMAN)
GLQGQFPRA

SEQ ID NO: 192304 - protein, 9 aa, Artificial Sequence
  Description of Artificial Sequence: Synthetic peptide
  Seed: EQFLGALDL (TYRP2_HUMAN)
EQFLGALDY

SEQ ID NO: 192305 - protein, 10 aa, Artificial Sequence
  Description of Artificial Sequence: Synthetic peptide
  Seed: NPPFFQNSTF (TYRP2_HUMAN)
NLPFFQNSTY

SEQ ID NO: 192306 - protein, 9 aa, Artificial Sequence
  Description of Artificial Sequence: Synthetic peptide
  Seed: ANDPIFVVL (TYRP2_HUMAN)
AMDPIFVVW

SEQ ID NO: 192307 - protein, 10 aa, Artificial Sequence
  Description of Artificial Sequence: Synthetic peptide
  Seed: VVLHSFTDAI (TYRP2_HUMAN)
VMLHSFTDAV

SEQ ID NO: 192308 - protein, 10 aa, Artificial Sequence
  Description of Artificial Sequence: Synthetic peptide
  Seed: TQPQFANCSV (TYRP2_HUMAN)
TLPQFANCSL

SEQ ID NO: 192309 - protein, 10 aa, Artificial Sequence
  Description of Artificial Sequence: Synthetic peptide
  Seed: MGTLVALVGL (TYRP2_HUMAN)
MTTLVALVGA

SEQ ID NO: 192310 - protein, 10 aa, Artificial Sequence
  Description of Artificial Sequence: Synthetic peptide
  Seed: FLLSCLGCKI (TYRP2_HUMAN)
FMLSCLGCKI

SEQ ID NO: 192311 - protein, 10 aa, Artificial Sequence
  Description of Artificial Sequence: Synthetic peptide
  Seed: SYAIDLPVSV (TYRP2_HUMAN)
SQAIDLPVSV

SEQ ID NO: 192312 - protein, 9 aa, Artificial Sequence
  Description of Artificial Sequence: Synthetic peptide
  Seed: ILPGAQGQF (TYRP2_HUMAN)
IAPGAQGQM

SEQ ID NO: 192313 - protein, 9 aa, Artificial Sequence
  Description of Artificial Sequence: Synthetic peptide
  Seed: SRNSRFSSW (TYRP2_HUMAN)
SSNSRFSSM

SEQ ID NO: 192314 - protein, 9 aa, Artificial Sequence
  Description of Artificial Sequence: Synthetic peptide
  Seed: RLRKGYTPL (TYRP2_HUMAN)
RMRKGYTPH

SEQ ID NO: 192315 - protein, 10 aa, Artificial Sequence
  Description of Artificial Sequence: Synthetic peptide
  Seed: YAIDLPVSVE (TYRP2_HUMAN)
YMIDLPVSVV

SEQ ID NO: 192316 - protein, 10 aa, Artificial Sequence
  Description of Artificial Sequence: Synthetic peptide
  Seed: MSPLWWGFLL (TYRP2_HUMAN)
MHPLWWGFLY

SEQ ID NO: 192317 - protein, 9 aa, Artificial Sequence
  Description of Artificial Sequence: Synthetic peptide
  Seed: TSDQLGYSY (TYRP2_HUMAN)
TADQLGYSY

SEQ ID NO: 192318 - protein, 10 aa, Artificial Sequence
  Description of Artificial Sequence: Synthetic peptide
  Seed: QFLGALDLAK (TYRP2_HUMAN)
QYLGALDLAR

SEQ ID NO: 192319 - protein, 9 aa, Artificial Sequence
  Description of Artificial Sequence: Synthetic peptide
  Seed: YAIDLPVSV (TYRP2_HUMAN)
YSIDLPVSI

SEQ ID NO: 192320 - protein, 9 aa, Artificial Sequence
  Description of Artificial Sequence: Synthetic peptide
  Seed: ILPGAQGQF (TYRP2_HUMAN)
IAPGAQGQY

SEQ ID NO: 192321 - protein, 9 aa, Artificial Sequence
  Description of Artificial Sequence: Synthetic peptide
  Seed: SLHNLVHSF (TYRP2_HUMAN)
SQHNLVHSM

SEQ ID NO: 192322 - protein, 9 aa, Artificial Sequence
  Description of Artificial Sequence: Synthetic peptide
  Seed: RLRKGYTPL (TYRP2_HUMAN)
RCRKGYTPA

SEQ ID NO: 192323 - protein, 9 aa, Artificial Sequence
  Description of Artificial Sequence: Synthetic peptide
  Seed: DAWPQELAP (TYRP2_HUMAN)
DAWPQELAV

SEQ ID NO: 192324 - protein, 9 aa, Artificial Sequence
  Description of Artificial Sequence: Synthetic peptide
  Seed: ETPGWPTTL (TYRP2_HUMAN)
EAPGWPTTK

SEQ ID NO: 192325 - protein, 9 aa, Artificial Sequence
  Description of Artificial Sequence: Synthetic peptide
  Seed: LSPQEREQF (TYRP2_HUMAN)
LQPQEREQL

SEQ ID NO: 192326 - protein, 10 aa, Artificial Sequence
  Description of Artificial Sequence: Synthetic peptide
  Seed: ADTRPWSGPY (TYRP2_HUMAN)
ADTRPWSGPK

SEQ ID NO: 192327 - protein, 9 aa, Artificial Sequence
  Description of Artificial Sequence: Synthetic peptide
  Seed: TTQHWLGLL (TYRP2_HUMAN)
TLQHWLGLV

SEQ ID NO: 192328 - protein, 10 aa, Artificial Sequence
  Description of Artificial Sequence: Synthetic peptide
  Seed: RRLRKGYTPL (TYRP2_HUMAN)
RELRKGYTPY

SEQ ID NO: 192329 - protein, 9 aa, Artificial Sequence
  Description of Artificial Sequence: Synthetic peptide
  Seed: VTWHRYHLL (TYRP2_HUMAN)
VIWHRYHLK

SEQ ID NO: 192330 - protein, 10 aa, Artificial Sequence
  Description of Artificial Sequence: Synthetic peptide
  Seed: CCPRLGAESA (TYRP2_HUMAN)
CNPRLGAESM

SEQ ID NO: 192331 - protein, 10 aa, Artificial Sequence
  Description of Artificial Sequence: Synthetic peptide
  Seed: GNESFALPYW (TYRP2_HUMAN)
GCESFALPYW

SEQ ID NO: 192332 - protein, 9 aa, Artificial Sequence
  Description of Artificial Sequence: Synthetic peptide
  Seed: RAIDFSHQG (TYRP2_HUMAN)
RMIDFSHQY

SEQ ID NO: 192333 - protein, 9 aa, Artificial Sequence
  Description of Artificial Sequence: Synthetic peptide
  Seed: ISRNSRFSS (TYRP2_HUMAN)
IFRNSRFSA

SEQ ID NO: 192334 - protein, 11 aa, Artificial Sequence
  Description of Artificial Sequence: Synthetic peptide
  Seed: FLTSDQLGYSY (TYRP2_HUMAN)
FWTSDQLGYSY

SEQ ID NO: 192335 - protein, 11 aa, Artificial Sequence
  Description of Artificial Sequence: Synthetic peptide
  Seed: YTPLMETHLSS (TYRP2_HUMAN)
YDPLMETHLSV

SEQ ID NO: 192336 - protein, 9 aa, Artificial Sequence
  Description of Artificial Sequence: Synthetic peptide
  Seed: WPQELAPIG (TYRP2_HUMAN)
WAQELAPIM

SEQ ID NO: 192337 - protein, 11 aa, Artificial Sequence
  Description of Artificial Sequence: Synthetic peptide
  Seed: YTPLMETHLSS (TYRP2_HUMAN)
YPPLMETHLSM

SEQ ID NO: 192338 - protein, 10 aa, Artificial Sequence
  Description of Artificial Sequence: Synthetic peptide
  Seed: HLVTLCNGTY (TYRP2_HUMAN)
HKVTLCNGTY

SEQ ID NO: 192339 - protein, 11 aa, Artificial Sequence
  Description of Artificial Sequence: Synthetic peptide
  Seed: CDSLDDYNHLV (TYRP2_HUMAN)
CSSLDDYNHLV

SEQ ID NO: 192340 - protein, 10 aa, Artificial Sequence
  Description of Artificial Sequence: Synthetic peptide
  Seed: SHQGPAFVTW (TYRP2_HUMAN)
SWQGPAFVTW

SEQ ID NO: 192341 - protein, 10 aa, Artificial Sequence
  Description of Artificial Sequence: Synthetic peptide
  Seed: RMYNMVPFFP (TYRP2_HUMAN)
RQYNMVPFFH

SEQ ID NO: 192342 - protein, 9 aa, Artificial Sequence
  Description of Artificial Sequence: Synthetic peptide
  Seed: VVMGTLVAL (TYRP2_HUMAN)
VTMGTLVAA

SEQ ID NO: 192343 - protein, 9 aa, Artificial Sequence
  Description of Artificial Sequence: Synthetic peptide
  Seed: RQNIHSLSP (TYRP2_HUMAN)
RKNIHSLSL

SEQ ID NO: 192344 - protein, 9 aa, Artificial Sequence
  Description of Artificial Sequence: Synthetic peptide
  Seed: LQKFDNPPF (TYRP2_HUMAN)
LHKFDNPPF

SEQ ID NO: 192345 - protein, 9 aa, Artificial Sequence
  Description of Artificial Sequence: Synthetic peptide
  Seed: SPLWWGFLL (TYRP2_HUMAN)
SALWWGFLY

SEQ ID NO: 192346 - protein, 9 aa, Artificial Sequence
  Description of Artificial Sequence: Synthetic peptide
  Seed: SVYDFFVWL (TYRP2_HUMAN)
SMYDFFVWC

SEQ ID NO: 192347 - protein, 9 aa, Artificial Sequence
  Description of Artificial Sequence: Synthetic peptide
  Seed: VALVGLFVL (TYRP2_HUMAN)
VTLVGLFVV

SEQ ID NO: 192348 - protein, 10 aa, Artificial Sequence
  Description of Artificial Sequence: Synthetic peptide
  Seed: YDFFVWLHYY (TYRP2_HUMAN)
YHFFVWLHYY

SEQ ID NO: 192349 - protein, 9 aa, Artificial Sequence
  Description of Artificial Sequence: Synthetic peptide
  Seed: EQFLGALDL (TYRP2_HUMAN)
EMFLGALDY

SEQ ID NO: 192350 - protein, 9 aa, Artificial Sequence
  Description of Artificial Sequence: Synthetic peptide
  Seed: AARPDDPTL (TYRP2_HUMAN)
AYRPDDPTY

SEQ ID NO: 192351 - protein, 11 aa, Artificial Sequence
  Description of Artificial Sequence: Synthetic peptide
  Seed: YTPLMETHLSS (TYRP2_HUMAN)
YPPLMETHLSL

SEQ ID NO: 192352 - protein, 9 aa, Artificial Sequence
  Description of Artificial Sequence: Synthetic peptide
  Seed: RKFFHRTCK (TYRP2_HUMAN)
RAFFHRTCV

SEQ ID NO: 192353 - protein, 10 aa, Artificial Sequence
  Description of Artificial Sequence: Synthetic peptide
  Seed: RELWPRKFFH (TYRP2_HUMAN)
RWLWPRKFFH

SEQ ID NO: 192354 - protein, 9 aa, Artificial Sequence
  Description of Artificial Sequence: Synthetic peptide
  Seed: VVMGTLVAL (TYRP2_HUMAN)
VWMGTLVAL

SEQ ID NO: 192355 - protein, 9 aa, Artificial Sequence
  Description of Artificial Sequence: Synthetic peptide
  Seed: STFSFRNAL (TYRP2_HUMAN)
STFSFRNAK

SEQ ID NO: 192356 - protein, 10 aa, Artificial Sequence
  Description of Artificial Sequence: Synthetic peptide
  Seed: SAANDPIFVV (TYRP2_HUMAN)
SIANDPIFVL

SEQ ID NO: 192357 - protein, 11 aa, Artificial Sequence
  Description of Artificial Sequence: Synthetic peptide
  Seed: YNMVPFFPPVT (TYRP2_HUMAN)
YIMVPFFPPVS

SEQ ID NO: 192358 - protein, 9 aa, Artificial Sequence
  Description of Artificial Sequence: Synthetic peptide
  Seed: TRPWSGPYI (TYRP2_HUMAN)
THPWSGPYL

SEQ ID NO: 192359 - protein, 9 aa, Artificial Sequence
  Description of Artificial Sequence: Synthetic peptide
  Seed: ANDPIFVVL (TYRP2_HUMAN)
AWDPIFVVF

SEQ ID NO: 192360 - protein, 10 aa, Artificial Sequence
  Description of Artificial Sequence: Synthetic peptide
  Seed: RNQMGRNSMK (TYRP2_HUMAN)
RTQMGRNSMA

SEQ ID NO: 192361 - protein, 10 aa, Artificial Sequence
  Description of Artificial Sequence: Synthetic peptide
  Seed: RRNQMGRNSM (TYRP2_HUMAN)
RQNQMGRNSL

SEQ ID NO: 192362 - protein, 9 aa, Artificial Sequence
  Description of Artificial Sequence: Synthetic peptide
  Seed: VALVGLFVL (TYRP2_HUMAN)
VTLVGLFVM

SEQ ID NO: 192363 - protein, 10 aa, Artificial Sequence
  Description of Artificial Sequence: Synthetic peptide
  Seed: YAIDLPVSVE (TYRP2_HUMAN)
YMIDLPVSVI

SEQ ID NO: 192364 - protein, 9 aa, Artificial Sequence
  Description of Artificial Sequence: Synthetic peptide
  Seed: IFDEWMKRF (TYRP2_HUMAN)
ILDEWMKRF

SEQ ID NO: 192365 - protein, 10 aa, Artificial Sequence
  Description of Artificial Sequence: Synthetic peptide
  Seed: LISRNSRFSS (TYRP2_HUMAN)
LISRNSRFSK

SEQ ID NO: 192366 - protein, 9 aa, Artificial Sequence
  Description of Artificial Sequence: Synthetic peptide
  Seed: FTDAIFDEW (TYRP2_HUMAN)
FIDAIFDEM

SEQ ID NO: 192367 - protein, 9 aa, Artificial Sequence
  Description of Artificial Sequence: Synthetic peptide
  Seed: SLHNLVHSF (TYRP2_HUMAN)
SLHNLVHSK

SEQ ID NO: 192368 - protein, 10 aa, Artificial Sequence
  Description of Artificial Sequence: Synthetic peptide
  Seed: MSPLWWGFLL (TYRP2_HUMAN)
MVPLWWGFLL

SEQ ID NO: 192369 - protein, 10 aa, Artificial Sequence
  Description of Artificial Sequence: Synthetic peptide
  Seed: FSFRNALEGF (TYRP2_HUMAN)
FEFRNALEGF

SEQ ID NO: 192370 - protein, 10 aa, Artificial Sequence
  Description of Artificial Sequence: Synthetic peptide
  Seed: QPQFANCSVY (TYRP2_HUMAN)
QAQFANCSVM

SEQ ID NO: 192371 - protein, 9 aa, Artificial Sequence
  Description of Artificial Sequence: Synthetic peptide
  Seed: IFDEWMKRF (TYRP2_HUMAN)
ICDEWMKRL

SEQ ID NO: 192372 - protein, 9 aa, Artificial Sequence
  Description of Artificial Sequence: Synthetic peptide
  Seed: HQGPAFVTW (TYRP2_HUMAN)
HWGPAFVTV

SEQ ID NO: 192373 - protein, 9 aa, Artificial Sequence
  Description of Artificial Sequence: Synthetic peptide
  Seed: RLRKGYTPL (TYRP2_HUMAN)
RARKGYTPI

SEQ ID NO: 192374 - protein, 10 aa, Artificial Sequence
  Description of Artificial Sequence: Synthetic peptide
  Seed: REQFLGALDL (TYRP2_HUMAN)
RCQFLGALDF

SEQ ID NO: 192375 - protein, 9 aa, Artificial Sequence
  Description of Artificial Sequence: Synthetic peptide
  Seed: GLFVLLAFL (TYRP2_HUMAN)
GMFVLLAFA

SEQ ID NO: 192376 - protein, 8 aa, Artificial Sequence
  Description of Artificial Sequence: Synthetic peptide
  Seed: WPTTLLVV (TYRP2_HUMAN)
WPTTLLVL

SEQ ID NO: 192377 - protein, 9 aa, Artificial Sequence
  Description of Artificial Sequence: Synthetic peptide
  Seed: YVITTQHWL (TYRP2_HUMAN)
YTITTQHWY

SEQ ID NO: 192378 - protein, 11 aa, Artificial Sequence
  Description of Artificial Sequence: Synthetic peptide
  Seed: YVITTQHWLGL (TYRP2_HUMAN)
YQITTQHWLGI

SEQ ID NO: 192379 - protein, 9 aa, Artificial Sequence
  Description of Artificial Sequence: Synthetic peptide
  Seed: LVTLCNGTY (TYRP2_HUMAN)
LATLCNGTM

SEQ ID NO: 192380 - protein, 9 aa, Artificial Sequence
  Description of Artificial Sequence: Synthetic peptide
  Seed: HSFLNGTNA (TYRP2_HUMAN)
HTFLNGTNK

SEQ ID NO: 192381 - protein, 9 aa, Artificial Sequence
  Description of Artificial Sequence: Synthetic peptide
  Seed: FFQNSTFSF (TYRP2_HUMAN)
FWQNSTFSI

SEQ ID NO: 192382 - protein, 9 aa, Artificial Sequence
  Description of Artificial Sequence: Synthetic peptide
  Seed: VMSLHNLVH (TYRP2_HUMAN)
VASLHNLVM

SEQ ID NO: 192383 - protein, 10 aa, Artificial Sequence
  Description of Artificial Sequence: Synthetic peptide
  Seed: SDQLGYSYAI (TYRP2_HUMAN)
SWQLGYSYAY

SEQ ID NO: 192384 - protein, 9 aa, Artificial Sequence
  Description of Artificial Sequence: Synthetic peptide
  Seed: VMSLHNLVH (TYRP2_HUMAN)
VMSLHNLVK

SEQ ID NO: 192385 - protein, 10 aa, Artificial Sequence
  Description of Artificial Sequence: Synthetic peptide
  Seed: RLRKGYTPLM (TYRP2_HUMAN)
RSRKGYTPLR

SEQ ID NO: 192386 - protein, 10 aa, Artificial Sequence
  Description of Artificial Sequence: Synthetic peptide
  Seed: TVDSLVNKEC (TYRP2_HUMAN)
TVDSLVNKEM

SEQ ID NO: 192387 - protein, 9 aa, Artificial Sequence
  Description of Artificial Sequence: Synthetic peptide
  Seed: ISRNSRFSS (TYRP2_HUMAN)
IIRNSRFSM

SEQ ID NO: 192388 - protein, 10 aa, Artificial Sequence
  Description of Artificial Sequence: Synthetic peptide
  Seed: QPQFANCSVY (TYRP2_HUMAN)
QQQFANCSVM

SEQ ID NO: 192389 - protein, 10 aa, Artificial Sequence
  Description of Artificial Sequence: Synthetic peptide
  Seed: SSWETVCDSL (TYRP2_HUMAN)
SVWETVCDSL

SEQ ID NO: 192390 - protein, 9 aa, Artificial Sequence
  Description of Artificial Sequence: Synthetic peptide
  Seed: APIGHNRMY (TYRP2_HUMAN)
AEIGHNRMY

SEQ ID NO: 192391 - protein, 11 aa, Artificial Sequence
  Description of Artificial Sequence: Synthetic peptide
  Seed: CDSLDDYNHLV (TYRP2_HUMAN)
CRSLDDYNHLV

SEQ ID NO: 192392 - protein, 9 aa, Artificial Sequence
  Description of Artificial Sequence: Synthetic peptide
  Seed: RLRKGYTPL (TYRP2_HUMAN)
RTRKGYTPP

SEQ ID NO: 192393 - protein, 9 aa, Artificial Sequence
  Description of Artificial Sequence: Synthetic peptide
  Seed: STFSFRNAL (TYRP2_HUMAN)
SWFSFRNAM

SEQ ID NO: 192394 - protein, 8 aa, Artificial Sequence
  Description of Artificial Sequence: Synthetic peptide
  Seed: AIDLPVSV (TYRP2_HUMAN)
AVDLPVSV

SEQ ID NO: 192395 - protein, 10 aa, Artificial Sequence
  Description of Artificial Sequence: Synthetic peptide
  Seed: RMYNMVPFFP (TYRP2_HUMAN)
RTYNMVPFFI

SEQ ID NO: 192396 - protein, 10 aa, Artificial Sequence
  Description of Artificial Sequence: Synthetic peptide
  Seed: LVVMGTLVAL (TYRP2_HUMAN)
LGVMGTLVAV

SEQ ID NO: 192397 - protein, 9 aa, Artificial Sequence
  Description of Artificial Sequence: Synthetic peptide
  Seed: SRFSSWETV (TYRP2_HUMAN)
SRFSSWETI

SEQ ID NO: 192398 - protein, 11 aa, Artificial Sequence
  Description of Artificial Sequence: Synthetic peptide
  Seed: VCMTVDSLVNK (TYRP2_HUMAN)
VMMTVDSLVNR

SEQ ID NO: 192399 - protein, 9 aa, Artificial Sequence
  Description of Artificial Sequence: Synthetic peptide
  Seed: SVYDFFVWL (TYRP2_HUMAN)
SMYDFFVWT

SEQ ID NO: 192400 - protein, 9 aa, Artificial Sequence
  Description of Artificial Sequence: Synthetic peptide
  Seed: VVMGTLVAL (TYRP2_HUMAN)
VVMGTLVAV

SEQ ID NO: 192401 - protein, 10 aa, Artificial Sequence
  Description of Artificial Sequence: Synthetic peptide
  Seed: FPPVTNEELF (TYRP2_HUMAN)
FGPVTNEELW

SEQ ID NO: 192402 - protein, 9 aa, Artificial Sequence
  Description of Artificial Sequence: Synthetic peptide
  Seed: RFNPPADAW (TYRP2_HUMAN)
RINPPADAY

SEQ ID NO: 192403 - protein, 11 aa, Artificial Sequence
  Description of Artificial Sequence: Synthetic peptide
  Seed: LISRNSRFSSW (TYRP2_HUMAN)
LSSRNSRFSSW

SEQ ID NO: 192404 - protein, 11 aa, Artificial Sequence
  Description of Artificial Sequence: Synthetic peptide
  Seed: MYNMVPFFPPV (TYRP2_HUMAN)
MGNMVPFFPPV

SEQ ID NO: 192405 - protein, 10 aa, Artificial Sequence
  Description of Artificial Sequence: Synthetic peptide
  Seed: RLRKGYTPLM (TYRP2_HUMAN)
RWRKGYTPLA

SEQ ID NO: 192406 - protein, 10 aa, Artificial Sequence
  Description of Artificial Sequence: Synthetic peptide
  Seed: HNRMYNMVPF (TYRP2_HUMAN)
HMRMYNMVPF

SEQ ID NO: 192407 - protein, 9 aa, Artificial Sequence
  Description of Artificial Sequence: Synthetic peptide
  Seed: LAFLQYRRL (TYRP2_HUMAN)
LTFLQYRRL

SEQ ID NO: 192408 - protein, 9 aa, Artificial Sequence
  Description of Artificial Sequence: Synthetic peptide
  Seed: SQVMSLHNL (TYRP2_HUMAN)
SKVMSLHNY

SEQ ID NO: 192409 - protein, 10 aa, Artificial Sequence
  Description of Artificial Sequence: Synthetic peptide
  Seed: DIRDCLSLQK (TYRP2_HUMAN)
DMRDCLSLQR

SEQ ID NO: 192410 - protein, 10 aa, Artificial Sequence
  Description of Artificial Sequence: Synthetic peptide
  Seed: RTCKCTGNFA (TYRP2_HUMAN)
RTCKCTGNFL

SEQ ID NO: 192411 - protein, 10 aa, Artificial Sequence
  Description of Artificial Sequence: Synthetic peptide
  Seed: SLSPQEREQF (TYRP2_HUMAN)
SQSPQEREQF

SEQ ID NO: 192412 - protein, 11 aa, Artificial Sequence
  Description of Artificial Sequence: Synthetic peptide
  Seed: RNSRFSSWETV (TYRP2_HUMAN)
RLSRFSSWETF

SEQ ID NO: 192413 - protein, 10 aa, Artificial Sequence
  Description of Artificial Sequence: Synthetic peptide
  Seed: RRLRKGYTPL (TYRP2_HUMAN)
RMLRKGYTPM

SEQ ID NO: 192414 - protein, 10 aa, Artificial Sequence
  Description of Artificial Sequence: Synthetic peptide
  Seed: MGTLVALVGL (TYRP2_HUMAN)
MFTLVALVGV

SEQ ID NO: 192415 - protein, 10 aa, Artificial Sequence
  Description of Artificial Sequence: Synthetic peptide
  Seed: RLRKGYTPLM (TYRP2_HUMAN)
RPRKGYTPLL

SEQ ID NO: 192416 - protein, 10 aa, Artificial Sequence
  Description of Artificial Sequence: Synthetic peptide
  Seed: LVVMGTLVAL (TYRP2_HUMAN)
LIVMGTLVAL

SEQ ID NO: 192417 - protein, 10 aa, Artificial Sequence
  Description of Artificial Sequence: Synthetic peptide
  Seed: NSTFSFRNAL (TYRP2_HUMAN)
NCTFSFRNAI

SEQ ID NO: 192418 - protein, 10 aa, Artificial Sequence
  Description of Artificial Sequence: Synthetic peptide
  Seed: AANDPIFVVL (TYRP2_HUMAN)
AMNDPIFVVW

SEQ ID NO: 192419 - protein, 8 aa, Artificial Sequence
  Description of Artificial Sequence: Synthetic peptide
  Seed: FSHQGPAF (TYRP2_HUMAN)
FFHQGPAL

SEQ ID NO: 192420 - protein, 9 aa, Artificial Sequence
  Description of Artificial Sequence: Synthetic peptide
  Seed: ITTQHWLGL (TYRP2_HUMAN)
IATQHWLGY

SEQ ID NO: 192421 - protein, 10 aa, Artificial Sequence
  Description of Artificial Sequence: Synthetic peptide
  Seed: TDAIFDEWMK (TYRP2_HUMAN)
TTAIFDEWMK

SEQ ID NO: 192422 - protein, 10 aa, Artificial Sequence
  Description of Artificial Sequence: Synthetic peptide
  Seed: HSFLNGTNAL (TYRP2_HUMAN)
HGFLNGTNAY

SEQ ID NO: 192423 - protein, 9 aa, Artificial Sequence
  Description of Artificial Sequence: Synthetic peptide
  Seed: APIGHNRMY (TYRP2_HUMAN)
ATIGHNRML

SEQ ID NO: 192424 - protein, 10 aa, Artificial Sequence
  Description of Artificial Sequence: Synthetic peptide
  Seed: VYDFFVWLHY (TYRP2_HUMAN)
VLDFFVWLHY

SEQ ID NO: 192425 - protein, 10 aa, Artificial Sequence
  Description of Artificial Sequence: Synthetic peptide
  Seed: RLRKGYTPLM (TYRP2_HUMAN)
RCRKGYTPLK

SEQ ID NO: 192426 - protein, 10 aa, Artificial Sequence
  Description of Artificial Sequence: Synthetic peptide
  Seed: LHYYSVRDTL (TYRP2_HUMAN)
LPYYSVRDTI

SEQ ID NO: 192427 - protein, 11 aa, Artificial Sequence
  Description of Artificial Sequence: Synthetic peptide
  Seed: YNMVPFFPPVT (TYRP2_HUMAN)
YQMVPFFPPVY

SEQ ID NO: 192428 - protein, 10 aa, Artificial Sequence
  Description of Artificial Sequence: Synthetic peptide
  Seed: FFPPVTNEEL (TYRP2_HUMAN)
FIPPVTNEEY

SEQ ID NO: 192429 - protein, 10 aa, Artificial Sequence
  Description of Artificial Sequence: Synthetic peptide
  Seed: RLRKGYTPLM (TYRP2_HUMAN)
RLRKGYTPLA

SEQ ID NO: 192430 - protein, 11 aa, Artificial Sequence
  Description of Artificial Sequence: Synthetic peptide
  Seed: SLDDYNHLVTL (TYRP2_HUMAN)
SLDDYNHLVTI

SEQ ID NO: 192431 - protein, 9 aa, Artificial Sequence
  Description of Artificial Sequence: Synthetic peptide
  Seed: FTDAIFDEW (TYRP2_HUMAN)
FFDAIFDEM

SEQ ID NO: 192432 - protein, 9 aa, Artificial Sequence
  Description of Artificial Sequence: Synthetic peptide
  Seed: IGHNRMYNM (TYRP2_HUMAN)
IRHNRMYNL

SEQ ID NO: 192433 - protein, 9 aa, Artificial Sequence
  Description of Artificial Sequence: Synthetic peptide
  Seed: TTQHWLGLL (TYRP2_HUMAN)
TTQHWLGLF

SEQ ID NO: 192434 - protein, 9 aa, Artificial Sequence
  Description of Artificial Sequence: Synthetic peptide
  Seed: ISRNSRFSS (TYRP2_HUMAN)
ISRNSRFST

SEQ ID NO: 192435 - protein, 9 aa, Artificial Sequence
  Description of Artificial Sequence: Synthetic peptide
  Seed: AARPDDPTL (TYRP2_HUMAN)
AYRPDDPTM

SEQ ID NO: 192436 - protein, 9 aa, Artificial Sequence
  Description of Artificial Sequence: Synthetic peptide
  Seed: YAIDLPVSV (TYRP2_HUMAN)
YVIDLPVST

SEQ ID NO: 192437 - protein, 9 aa, Artificial Sequence
  Description of Artificial Sequence: Synthetic peptide
  Seed: DQLGYSYAI (TYRP2_HUMAN)
DELGYSYAA

SEQ ID NO: 192438 - protein, 9 aa, Artificial Sequence
  Description of Artificial Sequence: Synthetic peptide
  Seed: FFQNSTFSF (TYRP2_HUMAN)
FTQNSTFSV

SEQ ID NO: 192439 - protein, 9 aa, Artificial Sequence
  Description of Artificial Sequence: Synthetic peptide
  Seed: ETPGWPTTL (TYRP2_HUMAN)
EIPGWPTTW

SEQ ID NO: 192440 - protein, 9 aa, Artificial Sequence
  Description of Artificial Sequence: Synthetic peptide
  Seed: HQGPAFVTW (TYRP2_HUMAN)
HAGPAFVTV

SEQ ID NO: 192441 - protein, 10 aa, Artificial Sequence
  Description of Artificial Sequence: Synthetic peptide
  Seed: SLSPQEREQF (TYRP2_HUMAN)
SQSPQEREQL

SEQ ID NO: 192442 - protein, 9 aa, Artificial Sequence
  Description of Artificial Sequence: Synthetic peptide
  Seed: WHRYHLLCL (TYRP2_HUMAN)
WKRYHLLCF

SEQ ID NO: 192443 - protein, 11 aa, Artificial Sequence
  Description of Artificial Sequence: Synthetic peptide
  Seed: FVVLHSFTDAI (TYRP2_HUMAN)
FQVLHSFTDAL

SEQ ID NO: 192444 - protein, 10 aa, Artificial Sequence
  Description of Artificial Sequence: Synthetic peptide
  Seed: QGPAFVTWHR (TYRP2_HUMAN)
QQPAFVTWHR

SEQ ID NO: 192445 - protein, 8 aa, Artificial Sequence
  Description of Artificial Sequence: Synthetic peptide
  Seed: FSHQGPAF (TYRP2_HUMAN)
FSHQGPAV

SEQ ID NO: 192446 - protein, 10 aa, Artificial Sequence
  Description of Artificial Sequence: Synthetic peptide
  Seed: SPLWWGFLLS (TYRP2_HUMAN)
SRLWWGFLLV

SEQ ID NO: 192447 - protein, 10 aa, Artificial Sequence
  Description of Artificial Sequence: Synthetic peptide
  Seed: ELAPIGHNRM (TYRP2_HUMAN)
EIAPIGHNRM

SEQ ID NO: 192448 - protein, 10 aa, Artificial Sequence
  Description of Artificial Sequence: Synthetic peptide
  Seed: CCPRLGAESA (TYRP2_HUMAN)
CVPRLGAESL

SEQ ID NO: 192449 - protein, 10 aa, Artificial Sequence
  Description of Artificial Sequence: Synthetic peptide
  Seed: LHYYSVRDTL (TYRP2_HUMAN)
LIYYSVRDTL

SEQ ID NO: 192450 - protein, 10 aa, Artificial Sequence
  Description of Artificial Sequence: Synthetic peptide
  Seed: RLRKGYTPLM (TYRP2_HUMAN)
RKRKGYTPLF

SEQ ID NO: 192451 - protein, 9 aa, Artificial Sequence
  Description of Artificial Sequence: Synthetic peptide
  Seed: NMVPFFPPV (TYRP2_HUMAN)
NMVPFFPPI

SEQ ID NO: 192452 - protein, 9 aa, Artificial Sequence
  Description of Artificial Sequence: Synthetic peptide
  Seed: ILPGAQGQF (TYRP2_HUMAN)
IFPGAQGQM

SEQ ID NO: 192453 - protein, 10 aa, Artificial Sequence
  Description of Artificial Sequence: Synthetic peptide
  Seed: RLIGNESFAL (TYRP2_HUMAN)
RSIGNESFAY

SEQ ID NO: 192454 - protein, 9 aa, Artificial Sequence
  Description of Artificial Sequence: Synthetic peptide
  Seed: LSPQEREQF (TYRP2_HUMAN)
LAPQEREQL

SEQ ID NO: 192455 - protein, 11 aa, Artificial Sequence
  Description of Artificial Sequence: Synthetic peptide
  Seed: YRRLRKGYTPL (TYRP2_HUMAN)
YLRLRKGYTPV

SEQ ID NO: 192456 - protein, 9 aa, Artificial Sequence
  Description of Artificial Sequence: Synthetic peptide
  Seed: ELWPRKFFH (TYRP2_HUMAN)
EGWPRKFFK

SEQ ID NO: 192457 - protein, 10 aa, Artificial Sequence
  Description of Artificial Sequence: Synthetic peptide
  Seed: YNMVPFFPPV (TYRP2_HUMAN)
YMMVPFFPPV

SEQ ID NO: 192458 - protein, 9 aa, Artificial Sequence
  Description of Artificial Sequence: Synthetic peptide
  Seed: SQVMSLHNL (TYRP2_HUMAN)
SDVMSLHNL

SEQ ID NO: 192459 - protein, 9 aa, Artificial Sequence
  Description of Artificial Sequence: Synthetic peptide
  Seed: SLDDYNHLV (TYRP2_HUMAN)
SYDDYNHLF

SEQ ID NO: 192460 - protein, 9 aa, Artificial Sequence
  Description of Artificial Sequence: Synthetic peptide
  Seed: MTVDSLVNK (TYRP2_HUMAN)
MAVDSLVNV

SEQ ID NO: 192461 - protein, 10 aa, Artificial Sequence
  Description of Artificial Sequence: Synthetic peptide
  Seed: GQFPRVCMTV (TYRP2_HUMAN)
GMFPRVCMTM

SEQ ID NO: 192462 - protein, 9 aa, Artificial Sequence
  Description of Artificial Sequence: Synthetic peptide
  Seed: YAIDLPVSV (TYRP2_HUMAN)
YIIDLPVSA

SEQ ID NO: 192463 - protein, 10 aa, Artificial Sequence
  Description of Artificial Sequence: Synthetic peptide
  Seed: FGWTGPNCER (TYRP2_HUMAN)
FFWTGPNCER

SEQ ID NO: 192464 - protein, 10 aa, Artificial Sequence
  Description of Artificial Sequence: Synthetic peptide
  Seed: PFFQNSTFSF (TYRP2_HUMAN)
PKFQNSTFSF

SEQ ID NO: 192465 - protein, 11 aa, Artificial Sequence
  Description of Artificial Sequence: Synthetic peptide
  Seed: FVVLHSFTDAI (TYRP2_HUMAN)
FDVLHSFTDAI

SEQ ID NO: 192466 - protein, 10 aa, Artificial Sequence
  Description of Artificial Sequence: Synthetic peptide
  Seed: SPLWWGFLLS (TYRP2_HUMAN)
SSLWWGFLLL

SEQ ID NO: 192467 - protein, 9 aa, Artificial Sequence
  Description of Artificial Sequence: Synthetic peptide
  Seed: GTYEGLLRR (TYRP2_HUMAN)
GSYEGLLRK

SEQ ID NO: 192468 - protein, 9 aa, Artificial Sequence
  Description of Artificial Sequence: Synthetic peptide
  Seed: DSLDDYNHL (TYRP2_HUMAN)
DVLDDYNHV

SEQ ID NO: 192469 - protein, 9 aa, Artificial Sequence
  Description of Artificial Sequence: Synthetic peptide
  Seed: YDFFVWLHY (TYRP2_HUMAN)
YFFFVWLHM

SEQ ID NO: 192470 - protein, 10 aa, Artificial Sequence
  Description of Artificial Sequence: Synthetic peptide
  Seed: LHYYSVRDTL (TYRP2_HUMAN)
LMYYSVRDTW

SEQ ID NO: 192471 - protein, 9 aa, Artificial Sequence
  Description of Artificial Sequence: Synthetic peptide
  Seed: VMGTLVALV (TYRP2_HUMAN)
VLGTLVALA

SEQ ID NO: 192472 - protein, 9 aa, Artificial Sequence
  Description of Artificial Sequence: Synthetic peptide
  Seed: DDYNHLVTL (TYRP2_HUMAN)
DPYNHLVTL

SEQ ID NO: 192473 - protein, 9 aa, Artificial Sequence
  Description of Artificial Sequence: Synthetic peptide
  Seed: WMKRFNPPA (TYRP2_HUMAN)
WVKRFNPPK

SEQ ID NO: 192474 - protein, 9 aa, Artificial Sequence
  Description of Artificial Sequence: Synthetic peptide
  Seed: CERKKPPVI (TYRP2_HUMAN)
CERKKPPVA

SEQ ID NO: 192475 - protein, 9 aa, Artificial Sequence
  Description of Artificial Sequence: Synthetic peptide
  Seed: VVMGTLVAL (TYRP2_HUMAN)
VTMGTLVAY

SEQ ID NO: 192476 - protein, 10 aa, Artificial Sequence
  Description of Artificial Sequence: Synthetic peptide
  Seed: RPDDPTLISR (TYRP2_HUMAN)
RPDDPTLISF

SEQ ID NO: 192477 - protein, 9 aa, Artificial Sequence
  Description of Artificial Sequence: Synthetic peptide
  Seed: RQNIHSLSP (TYRP2_HUMAN)
RLNIHSLSL

SEQ ID NO: 192478 - protein, 10 aa, Artificial Sequence
  Description of Artificial Sequence: Synthetic peptide
  Seed: LDDYNHLVTL (TYRP2_HUMAN)
LADYNHLVTM

SEQ ID NO: 192479 - protein, 10 aa, Artificial Sequence
  Description of Artificial Sequence: Synthetic peptide
  Seed: HYYSVRDTLL (TYRP2_HUMAN)
HYYSVRDTLF

SEQ ID NO: 192480 - protein, 9 aa, Artificial Sequence
  Description of Artificial Sequence: Synthetic peptide
  Seed: YSYAIDLPV (TYRP2_HUMAN)
YHYAIDLPF

SEQ ID NO: 192481 - protein, 10 aa, Artificial Sequence
  Description of Artificial Sequence: Synthetic peptide
  Seed: MSLHNLVHSF (TYRP2_HUMAN)
MYLHNLVHSL

SEQ ID NO: 192482 - protein, 9 aa, Artificial Sequence
  Description of Artificial Sequence: Synthetic peptide
  Seed: VVMGTLVAL (TYRP2_HUMAN)
VNMGTLVAF

SEQ ID NO: 192483 - protein, 10 aa, Artificial Sequence
  Description of Artificial Sequence: Synthetic peptide
  Seed: RNSRFSSWET (TYRP2_HUMAN)
RRSRFSSWEV

SEQ ID NO: 192484 - protein, 9 aa, Artificial Sequence
  Description of Artificial Sequence: Synthetic peptide
  Seed: PADAWPQEL (TYRP2_HUMAN)
PYDAWPQEV

SEQ ID NO: 192485 - protein, 9 aa, Artificial Sequence
  Description of Artificial Sequence: Synthetic peptide
  Seed: SRNSRFSSW (TYRP2_HUMAN)
SQNSRFSSY

SEQ ID NO: 192486 - protein, 11 aa, Artificial Sequence
  Description of Artificial Sequence: Synthetic peptide
  Seed: RELWPRKFFHR (TYRP2_HUMAN)
RQLWPRKFFHK

SEQ ID NO: 192487 - protein, 11 aa, Artificial Sequence
  Description of Artificial Sequence: Synthetic peptide
  Seed: RADTRPWSGPY (TYRP2_HUMAN)
RHDTRPWSGPW

SEQ ID NO: 192488 - protein, 9 aa, Artificial Sequence
  Description of Artificial Sequence: Synthetic peptide
  Seed: IFDEWMKRF (TYRP2_HUMAN)
IQDEWMKRM

SEQ ID NO: 192489 - protein, 11 aa, Artificial Sequence
  Description of Artificial Sequence: Synthetic peptide
  Seed: CDSLDDYNHLV (TYRP2_HUMAN)
CISLDDYNHLV

SEQ ID NO: 192490 - protein, 11 aa, Artificial Sequence
  Description of Artificial Sequence: Synthetic peptide
  Seed: RDTLLGPGRPY (TYRP2_HUMAN)
RMTLLGPGRPY

SEQ ID NO: 192491 - protein, 10 aa, Artificial Sequence
  Description of Artificial Sequence: Synthetic peptide
  Seed: LHYYSVRDTL (TYRP2_HUMAN)
LCYYSVRDTF

SEQ ID NO: 192492 - protein, 9 aa, Artificial Sequence
  Description of Artificial Sequence: Synthetic peptide
  Seed: EQFLGALDL (TYRP2_HUMAN)
EHFLGALDI

SEQ ID NO: 192493 - protein, 9 aa, Artificial Sequence
  Description of Artificial Sequence: Synthetic peptide
  Seed: TLLGPGRPY (TYRP2_HUMAN)
TMLGPGRPM

SEQ ID NO: 192494 - protein, 10 aa, Artificial Sequence
  Description of Artificial Sequence: Synthetic peptide
  Seed: LHYYSVRDTL (TYRP2_HUMAN)
LHYYSVRDTY

SEQ ID NO: 192495 - protein, 9 aa, Artificial Sequence
  Description of Artificial Sequence: Synthetic peptide
  Seed: RYHLLCLER (TYRP2_HUMAN)
RIHLLCLEK

SEQ ID NO: 192496 - protein, 9 aa, Artificial Sequence
  Description of Artificial Sequence: Synthetic peptide
  Seed: SQVMSLHNL (TYRP2_HUMAN)
STVMSLHNV

SEQ ID NO: 192497 - protein, 9 aa, Artificial Sequence
  Description of Artificial Sequence: Synthetic peptide
  Seed: TPGWPTTLL (TYRP2_HUMAN)
TPGWPTTLW

SEQ ID NO: 192498 - protein, 10 aa, Artificial Sequence
  Description of Artificial Sequence: Synthetic peptide
  Seed: FVWLHYYSVR (TYRP2_HUMAN)
FLWLHYYSVA

SEQ ID NO: 192499 - protein, 10 aa, Artificial Sequence
  Description of Artificial Sequence: Synthetic peptide
  Seed: RLRKGYTPLM (TYRP2_HUMAN)
RTRKGYTPLV

SEQ ID NO: 192500 - protein, 9 aa, Artificial Sequence
  Description of Artificial Sequence: Synthetic peptide
  Seed: VIRQNIHSL (TYRP2_HUMAN)
VSRQNIHSA

SEQ ID NO: 192501 - protein, 10 aa, Artificial Sequence
  Description of Artificial Sequence: Synthetic peptide
  Seed: SSWETVCDSL (TYRP2_HUMAN)
SAWETVCDSW

SEQ ID NO: 192502 - protein, 11 aa, Artificial Sequence
  Description of Artificial Sequence: Synthetic peptide
  Seed: YTPLMETHLSS (TYRP2_HUMAN)
YAPLMETHLST

SEQ ID NO: 192503 - protein, 9 aa, Artificial Sequence
  Description of Artificial Sequence: Synthetic peptide
  Seed: VWLHYYSVR (TYRP2_HUMAN)
VILHYYSVR

SEQ ID NO: 192504 - protein, 9 aa, Artificial Sequence
  Description of Artificial Sequence: Synthetic peptide
  Seed: YSYAIDLPV (TYRP2_HUMAN)
YKYAIDLPY

SEQ ID NO: 192505 - protein, 9 aa, Artificial Sequence
  Description of Artificial Sequence: Synthetic peptide
  Seed: VTWHRYHLL (TYRP2_HUMAN)
VSWHRYHLY

SEQ ID NO: 192506 - protein, 10 aa, Artificial Sequence
  Description of Artificial Sequence: Synthetic peptide
  Seed: LPGAQGQFPR (TYRP2_HUMAN)
LAGAQGQFPR

SEQ ID NO: 192507 - protein, 9 aa, Artificial Sequence
  Description of Artificial Sequence: Synthetic peptide
  Seed: RPWSGPYIL (TYRP2_HUMAN)
RPWSGPYII

SEQ ID NO: 192508 - protein, 8 aa, Artificial Sequence
  Description of Artificial Sequence: Synthetic peptide
  Seed: AIDLPVSV (TYRP2_HUMAN)
ACDLPVSL

SEQ ID NO: 192509 - protein, 9 aa, Artificial Sequence
  Description of Artificial Sequence: Synthetic peptide
  Seed: YVITTQHWL (TYRP2_HUMAN)
YAITTQHWL

SEQ ID NO: 192510 - protein, 9 aa, Artificial Sequence
  Description of Artificial Sequence: Synthetic peptide
  Seed: GTNALPHSA (TYRP2_HUMAN)
GLNALPHSI

SEQ ID NO: 192511 - protein, 9 aa, Artificial Sequence
  Description of Artificial Sequence: Synthetic peptide
  Seed: ETPGWPTTL (TYRP2_HUMAN)
ELPGWPTTV

SEQ ID NO: 192512 - protein, 10 aa, Artificial Sequence
  Description of Artificial Sequence: Synthetic peptide
  Seed: RNSMKLPTLK (TYRP2_HUMAN)
RMSMKLPTLY

SEQ ID NO: 192513 - protein, 9 aa, Artificial Sequence
  Description of Artificial Sequence: Synthetic peptide
  Seed: RQNIHSLSP (TYRP2_HUMAN)
RNNIHSLSY

SEQ ID NO: 192514 - protein, 9 aa, Artificial Sequence
  Description of Artificial Sequence: Synthetic peptide
  Seed: VPFFPPVTN (TYRP2_HUMAN)
VPFFPPVTL

SEQ ID NO: 192515 - protein, 9 aa, Artificial Sequence
  Description of Artificial Sequence: Synthetic peptide
  Seed: RLRKGYTPL (TYRP2_HUMAN)
RQRKGYTPW

SEQ ID NO: 192516 - protein, 10 aa, Artificial Sequence
  Description of Artificial Sequence: Synthetic peptide
  Seed: RRNQMGRNSM (TYRP2_HUMAN)
RKNQMGRNSM

SEQ ID NO: 192517 - protein, 9 aa, Artificial Sequence
  Description of Artificial Sequence: Synthetic peptide
  Seed: YSYAIDLPV (TYRP2_HUMAN)
YMYAIDLPI

SEQ ID NO: 192518 - protein, 10 aa, Artificial Sequence
  Description of Artificial Sequence: Synthetic peptide
  Seed: YDFFVWLHYY (TYRP2_HUMAN)
YMFFVWLHYH

SEQ ID NO: 192519 - protein, 10 aa, Artificial Sequence
  Description of Artificial Sequence: Synthetic peptide
  Seed: RRLRKGYTPL (TYRP2_HUMAN)
RRLRKGYTPY

SEQ ID NO: 192520 - protein, 10 aa, Artificial Sequence
  Description of Artificial Sequence: Synthetic peptide
  Seed: HSFLNGTNAL (TYRP2_HUMAN)
HTFLNGTNAM

SEQ ID NO: 192521 - protein, 9 aa, Artificial Sequence
  Description of Artificial Sequence: Synthetic peptide
  Seed: ANCSVYDFF (TYRP2_HUMAN)
AQCSVYDFM

SEQ ID NO: 192522 - protein, 9 aa, Artificial Sequence
  Description of Artificial Sequence: Synthetic peptide
  Seed: DSLDDYNHL (TYRP2_HUMAN)
DALDDYNHY

SEQ ID NO: 192523 - protein, 11 aa, Artificial Sequence
  Description of Artificial Sequence: Synthetic peptide
  Seed: SLDDYNHLVTL (TYRP2_HUMAN)
SSDDYNHLVTV

SEQ ID NO: 192524 - protein, 9 aa, Artificial Sequence
  Description of Artificial Sequence: Synthetic peptide
  Seed: SWETVCDSL (TYRP2_HUMAN)
SYETVCDSM

SEQ ID NO: 192525 - protein, 9 aa, Artificial Sequence
  Description of Artificial Sequence: Synthetic peptide
  Seed: VTWHRYHLL (TYRP2_HUMAN)
VLWHRYHLR

SEQ ID NO: 192526 - protein, 9 aa, Artificial Sequence
  Description of Artificial Sequence: Synthetic peptide
  Seed: VALVGLFVL (TYRP2_HUMAN)
VMLVGLFVI

SEQ ID NO: 192527 - protein, 10 aa, Artificial Sequence
  Description of Artificial Sequence: Synthetic peptide
  Seed: FANCSVYDFF (TYRP2_HUMAN)
FPNCSVYDFI

SEQ ID NO: 192528 - protein, 9 aa, Artificial Sequence
  Description of Artificial Sequence: Synthetic peptide
  Seed: FFQNSTFSF (TYRP2_HUMAN)
FAQNSTFSI

SEQ ID NO: 192529 - protein, 9 aa, Artificial Sequence
  Description of Artificial Sequence: Synthetic peptide
  Seed: GLFVLLAFL (TYRP2_HUMAN)
GLFVLLAFV

SEQ ID NO: 192530 - protein, 11 aa, Artificial Sequence
  Description of Artificial Sequence: Synthetic peptide
  Seed: HQGPAFVTWHR (TYRP2_HUMAN)
HYGPAFVTWHR

SEQ ID NO: 192531 - protein, 10 aa, Artificial Sequence
  Description of Artificial Sequence: Synthetic peptide
  Seed: MSPLWWGFLL (TYRP2_HUMAN)
MEPLWWGFLM

SEQ ID NO: 192532 - protein, 9 aa, Artificial Sequence
  Description of Artificial Sequence: Synthetic peptide
  Seed: VMSLHNLVH (TYRP2_HUMAN)
VASLHNLVL

SEQ ID NO: 192533 - protein, 11 aa, Artificial Sequence
  Description of Artificial Sequence: Synthetic peptide
  Seed: PFFQNSTFSFR (TYRP2_HUMAN)
PRFQNSTFSFR

SEQ ID NO: 192534 - protein, 10 aa, Artificial Sequence
  Description of Artificial Sequence: Synthetic peptide
  Seed: FPRVCMTVDS (TYRP2_HUMAN)
FPRVCMTVDV

SEQ ID NO: 192535 - protein, 9 aa, Artificial Sequence
  Description of Artificial Sequence: Synthetic peptide
  Seed: VLHSFTDAI (TYRP2_HUMAN)
VMHSFTDAA

SEQ ID NO: 192536 - protein, 9 aa, Artificial Sequence
  Description of Artificial Sequence: Synthetic peptide
  Seed: SLDDYNHLV (TYRP2_HUMAN)
SCDDYNHLY

SEQ ID NO: 192537 - protein, 9 aa, Artificial Sequence
  Description of Artificial Sequence: Synthetic peptide
  Seed: DSLDDYNHL (TYRP2_HUMAN)
DSLDDYNHV

SEQ ID NO: 192538 - protein, 8 aa, Artificial Sequence
  Description of Artificial Sequence: Synthetic peptide
  Seed: RPDDPTLI (TYRP2_HUMAN)
RVDDPTLF

SEQ ID NO: 192539 - protein, 9 aa, Artificial Sequence
  Description of Artificial Sequence: Synthetic peptide
  Seed: HQGPAFVTW (TYRP2_HUMAN)
HTGPAFVTV

SEQ ID NO: 192540 - protein, 10 aa, Artificial Sequence
  Description of Artificial Sequence: Synthetic peptide
  Seed: LHYYSVRDTL (TYRP2_HUMAN)
LAYYSVRDTY

SEQ ID NO: 192541 - protein, 9 aa, Artificial Sequence
  Description of Artificial Sequence: Synthetic peptide
  Seed: SLHNLVHSF (TYRP2_HUMAN)
SLHNLVHSA

SEQ ID NO: 192542 - protein, 9 aa, Artificial Sequence
  Description of Artificial Sequence: Synthetic peptide
  Seed: PAFVTWHRY (TYRP2_HUMAN)
PFFVTWHRY

SEQ ID NO: 192543 - protein, 9 aa, Artificial Sequence
  Description of Artificial Sequence: Synthetic peptide
  Seed: VPFFPPVTN (TYRP2_HUMAN)
VGFFPPVTY

SEQ ID NO: 192544 - protein, 9 aa, Artificial Sequence
  Description of Artificial Sequence: Synthetic peptide
  Seed: LQKFDNPPF (TYRP2_HUMAN)
LQKFDNPPM

SEQ ID NO: 192545 - protein, 9 aa, Artificial Sequence
  Description of Artificial Sequence: Synthetic peptide
  Seed: RNQMGRNSM (TYRP2_HUMAN)
RVQMGRNSY

SEQ ID NO: 192546 - protein, 10 aa, Artificial Sequence
  Description of Artificial Sequence: Synthetic peptide
  Seed: RRLRKGYTPL (TYRP2_HUMAN)
RNLRKGYTPK

SEQ ID NO: 192547 - protein, 10 aa, Artificial Sequence
  Description of Artificial Sequence: Synthetic peptide
  Seed: RNSRFSSWET (TYRP2_HUMAN)
RPSRFSSWEL

SEQ ID NO: 192548 - protein, 10 aa, Artificial Sequence
  Description of Artificial Sequence: Synthetic peptide
  Seed: ADTRPWSGPY (TYRP2_HUMAN)
AYTRPWSGPY

SEQ ID NO: 192549 - protein, 9 aa, Artificial Sequence
  Description of Artificial Sequence: Synthetic peptide
  Seed: RQNIHSLSP (TYRP2_HUMAN)
RVNIHSLSM

SEQ ID NO: 192550 - protein, 9 aa, Artificial Sequence
  Description of Artificial Sequence: Synthetic peptide
  Seed: VALVGLFVL (TYRP2_HUMAN)
VTLVGLFVL

SEQ ID NO: 192551 - protein, 10 aa, Artificial Sequence
  Description of Artificial Sequence: Synthetic peptide
  Seed: RRLRKGYTPL (TYRP2_HUMAN)
RQLRKGYTPF

SEQ ID NO: 192552 - protein, 9 aa, Artificial Sequence
  Description of Artificial Sequence: Synthetic peptide
  Seed: SQVMSLHNL (TYRP2_HUMAN)
SHVMSLHNF

SEQ ID NO: 192553 - protein, 9 aa, Artificial Sequence
  Description of Artificial Sequence: Synthetic peptide
  Seed: TLDSQVMSL (TYRP2_HUMAN)
TWDSQVMSM

SEQ ID NO: 192554 - protein, 9 aa, Artificial Sequence
  Description of Artificial Sequence: Synthetic peptide
  Seed: CPRLGAESA (TYRP2_HUMAN)
CPRLGAESI

SEQ ID NO: 192555 - protein, 10 aa, Artificial Sequence
  Description of Artificial Sequence: Synthetic peptide
  Seed: AARPDDPTLI (TYRP2_HUMAN)
ATRPDDPTLY

SEQ ID NO: 192556 - protein, 10 aa, Artificial Sequence
  Description of Artificial Sequence: Synthetic peptide
  Seed: SPLWWGFLLS (TYRP2_HUMAN)
SGLWWGFLLI

SEQ ID NO: 192557 - protein, 9 aa, Artificial Sequence
  Description of Artificial Sequence: Synthetic peptide
  Seed: MSPLWWGFL (TYRP2_HUMAN)
MSPLWWGFW

SEQ ID NO: 192558 - protein, 9 aa, Artificial Sequence
  Description of Artificial Sequence: Synthetic peptide
  Seed: GTNALPHSA (TYRP2_HUMAN)
GMNALPHSA

SEQ ID NO: 192559 - protein, 10 aa, Artificial Sequence
  Description of Artificial Sequence: Synthetic peptide
  Seed: FVWLHYYSVR (TYRP2_HUMAN)
FLWLHYYSVY

SEQ ID NO: 192560 - protein, 9 aa, Artificial Sequence
  Description of Artificial Sequence: Synthetic peptide
  Seed: PADAWPQEL (TYRP2_HUMAN)
PVDAWPQEM

SEQ ID NO: 192561 - protein, 10 aa, Artificial Sequence
  Description of Artificial Sequence: Synthetic peptide
  Seed: YDFFVWLHYY (TYRP2_HUMAN)
YTFFVWLHYM

SEQ ID NO: 192562 - protein, 10 aa, Artificial Sequence
  Description of Artificial Sequence: Synthetic peptide
  Seed: SLQKFDNPPF (TYRP2_HUMAN)
SIQKFDNPPF

SEQ ID NO: 192563 - protein, 10 aa, Artificial Sequence
  Description of Artificial Sequence: Synthetic peptide
  Seed: YNMVPFFPPV (TYRP2_HUMAN)
YRMVPFFPPT

SEQ ID NO: 192564 - protein, 10 aa, Artificial Sequence
  Description of Artificial Sequence: Synthetic peptide
  Seed: FSFRNALEGF (TYRP2_HUMAN)
FQFRNALEGL

SEQ ID NO: 192565 - protein, 11 aa, Artificial Sequence
  Description of Artificial Sequence: Synthetic peptide
  Seed: LLVVMGTLVAL (TYRP2_HUMAN)
LPVVMGTLVAV

SEQ ID NO: 192566 - protein, 9 aa, Artificial Sequence
  Description of Artificial Sequence: Synthetic peptide
  Seed: FLLSCLGCK (TYRP2_HUMAN)
FTLSCLGCK

SEQ ID NO: 192567 - protein, 10 aa, Artificial Sequence
  Description of Artificial Sequence: Synthetic peptide
  Seed: SDQLGYSYAI (TYRP2_HUMAN)
SMQLGYSYAV

SEQ ID NO: 192568 - protein, 9 aa, Artificial Sequence
  Description of Artificial Sequence: Synthetic peptide
  Seed: VHPDYVITT (TYRP2_HUMAN)
VMPDYVITM

SEQ ID NO: 192569 - protein, 11 aa, Artificial Sequence
  Description of Artificial Sequence: Synthetic peptide
  Seed: LPVSVEETPGW (TYRP2_HUMAN)
LKVSVEETPGW

SEQ ID NO: 192570 - protein, 10 aa, Artificial Sequence
  Description of Artificial Sequence: Synthetic peptide
  Seed: MSPLWWGFLL (TYRP2_HUMAN)
MTPLWWGFLA

SEQ ID NO: 192571 - protein, 9 aa, Artificial Sequence
  Description of Artificial Sequence: Synthetic peptide
  Seed: ALVGLFVLL (TYRP2_HUMAN)
ASVGLFVLI

SEQ ID NO: 192572 - protein, 9 aa, Artificial Sequence
  Description of Artificial Sequence: Synthetic peptide
  Seed: PQFANCSVY (TYRP2_HUMAN)
PMFANCSVF

SEQ ID NO: 192573 - protein, 9 aa, Artificial Sequence
  Description of Artificial Sequence: Synthetic peptide
  Seed: RTCKCTGNF (TYRP2_HUMAN)
RKCKCTGNF

SEQ ID NO: 192574 - protein, 10 aa, Artificial Sequence
  Description of Artificial Sequence: Synthetic peptide
  Seed: ESANVCGSQQ (TYRP2_HUMAN)
EVANVCGSQM

SEQ ID NO: 192575 - protein, 10 aa, Artificial Sequence
  Description of Artificial Sequence: Synthetic peptide
  Seed: HSFLNGTNAL (TYRP2_HUMAN)
HQFLNGTNAM

SEQ ID NO: 192576 - protein, 11 aa, Artificial Sequence
  Description of Artificial Sequence: Synthetic peptide
  Seed: FVVLHSFTDAI (TYRP2_HUMAN)
FTVLHSFTDAI

SEQ ID NO: 192577 - protein, 10 aa, Artificial Sequence
  Description of Artificial Sequence: Synthetic peptide
  Seed: FLNGTNALPH (TYRP2_HUMAN)
FANGTNALPM

SEQ ID NO: 192578 - protein, 9 aa, Artificial Sequence
  Description of Artificial Sequence: Synthetic peptide
  Seed: TLDSQVMSL (TYRP2_HUMAN)
TMDSQVMSA

SEQ ID NO: 192579 - protein, 9 aa, Artificial Sequence
  Description of Artificial Sequence: Synthetic peptide
  Seed: RKFFHRTCK (TYRP2_HUMAN)
RMFFHRTCH

SEQ ID NO: 192580 - protein, 9 aa, Artificial Sequence
  Description of Artificial Sequence: Synthetic peptide
  Seed: ITTQHWLGL (TYRP2_HUMAN)
IQTQHWLGV

SEQ ID NO: 192581 - protein, 9 aa, Artificial Sequence
  Description of Artificial Sequence: Synthetic peptide
  Seed: YSYAIDLPV (TYRP2_HUMAN)
YVYAIDLPL

SEQ ID NO: 192582 - protein, 9 aa, Artificial Sequence
  Description of Artificial Sequence: Synthetic peptide
  Seed: GFDKADGTL (TYRP2_HUMAN)
GADKADGTV

SEQ ID NO: 192583 - protein, 9 aa, Artificial Sequence
  Description of Artificial Sequence: Synthetic peptide
  Seed: DAIFDEWMK (TYRP2_HUMAN)
DTIFDEWMK

SEQ ID NO: 192584 - protein, 10 aa, Artificial Sequence
  Description of Artificial Sequence: Synthetic peptide
  Seed: NSRFSSWETV (TYRP2_HUMAN)
NRRFSSWETM

SEQ ID NO: 192585 - protein, 9 aa, Artificial Sequence
  Description of Artificial Sequence: Synthetic peptide
  Seed: FFPPVTNEE (TYRP2_HUMAN)
FFPPVTNEL

SEQ ID NO: 192586 - protein, 9 aa, Artificial Sequence
  Description of Artificial Sequence: Synthetic peptide
  Seed: RFNPPADAW (TYRP2_HUMAN)
RSNPPADAF

SEQ ID NO: 192587 - protein, 9 aa, Artificial Sequence
  Description of Artificial Sequence: Synthetic peptide
  Seed: TLDSQVMSL (TYRP2_HUMAN)
TWDSQVMSC

SEQ ID NO: 192588 - protein, 10 aa, Artificial Sequence
  Description of Artificial Sequence: Synthetic peptide
  Seed: RMYNMVPFFP (TYRP2_HUMAN)
RSYNMVPFFK

SEQ ID NO: 192589 - protein, 10 aa, Artificial Sequence
  Description of Artificial Sequence: Synthetic peptide
  Seed: ELAPIGHNRM (TYRP2_HUMAN)
EVAPIGHNRC

SEQ ID NO: 192590 - protein, 9 aa, Artificial Sequence
  Description of Artificial Sequence: Synthetic peptide
  Seed: YSYAIDLPV (TYRP2_HUMAN)
YFYAIDLPM

SEQ ID NO: 192591 - protein, 9 aa, Artificial Sequence
  Description of Artificial Sequence: Synthetic peptide
  Seed: YDFFVWLHY (TYRP2_HUMAN)
YQFFVWLHY

SEQ ID NO: 192592 - protein, 9 aa, Artificial Sequence
  Description of Artificial Sequence: Synthetic peptide
  Seed: FFPPVTNEE (TYRP2_HUMAN)
FWPPVTNEF

SEQ ID NO: 192593 - protein, 9 aa, Artificial Sequence
  Description of Artificial Sequence: Synthetic peptide
  Seed: VGLFVLLAF (TYRP2_HUMAN)
VALFVLLAY

SEQ ID NO: 192594 - protein, 10 aa, Artificial Sequence
  Description of Artificial Sequence: Synthetic peptide
  Seed: YNMVPFFPPV (TYRP2_HUMAN)
YPMVPFFPPI

SEQ ID NO: 192595 - protein, 11 aa, Artificial Sequence
  Description of Artificial Sequence: Synthetic peptide
  Seed: YNMVPFFPPVT (TYRP2_HUMAN)
YTMVPFFPPVW

SEQ ID NO: 192596 - protein, 10 aa, Artificial Sequence
  Description of Artificial Sequence: Synthetic peptide
  Seed: GTLDSQVMSL (TYRP2_HUMAN)
GALDSQVMSY

SEQ ID NO: 192597 - protein, 10 aa, Artificial Sequence
  Description of Artificial Sequence: Synthetic peptide
  Seed: RNQMGRNSMK (TYRP2_HUMAN)
RRQMGRNSMY

SEQ ID NO: 192598 - protein, 9 aa, Artificial Sequence
  Description of Artificial Sequence: Synthetic peptide
  Seed: HYYSVRDTL (TYRP2_HUMAN)
HTYSVRDTF

SEQ ID NO: 192599 - protein, 9 aa, Artificial Sequence
  Description of Artificial Sequence: Synthetic peptide
  Seed: VVMGTLVAL (TYRP2_HUMAN)
VTMGTLVAK

SEQ ID NO: 192600 - protein, 11 aa, Artificial Sequence
  Description of Artificial Sequence: Synthetic peptide
  Seed: CDSLDDYNHLV (TYRP2_HUMAN)
CKSLDDYNHLV

SEQ ID NO: 192601 - protein, 10 aa, Artificial Sequence
  Description of Artificial Sequence: Synthetic peptide
  Seed: SPLWWGFLLS (TYRP2_HUMAN)
SGLWWGFLLV

SEQ ID NO: 192602 - protein, 11 aa, Artificial Sequence
  Description of Artificial Sequence: Synthetic peptide
  Seed: VYDFFVWLHYY (TYRP2_HUMAN)
VMDFFVWLHYY

SEQ ID NO: 192603 - protein, 10 aa, Artificial Sequence
  Description of Artificial Sequence: Synthetic peptide
  Seed: RNQMGRNSMK (TYRP2_HUMAN)
RKQMGRNSMR

SEQ ID NO: 192604 - protein, 10 aa, Artificial Sequence
  Description of Artificial Sequence: Synthetic peptide
  Seed: SPLWWGFLLS (TYRP2_HUMAN)
SWLWWGFLLL

SEQ ID NO: 192605 - protein, 9 aa, Artificial Sequence
  Description of Artificial Sequence: Synthetic peptide
  Seed: ILPGAQGQF (TYRP2_HUMAN)
IYPGAQGQW

SEQ ID NO: 192606 - protein, 10 aa, Artificial Sequence
  Description of Artificial Sequence: Synthetic peptide
  Seed: RRNQMGRNSM (TYRP2_HUMAN)
RQNQMGRNSY

SEQ ID NO: 192607 - protein, 11 aa, Artificial Sequence
  Description of Artificial Sequence: Synthetic peptide
  Seed: ELAPIGHNRMY (TYRP2_HUMAN)
EVAPIGHNRMR

SEQ ID NO: 192608 - protein, 9 aa, Artificial Sequence
  Description of Artificial Sequence: Synthetic peptide
  Seed: METHLSSKR (TYRP2_HUMAN)
MATHLSSKR

SEQ ID NO: 192609 - protein, 10 aa, Artificial Sequence
  Description of Artificial Sequence: Synthetic peptide
  Seed: YSYAIDLPVS (TYRP2_HUMAN)
YSYAIDLPVV

SEQ ID NO: 192610 - protein, 11 aa, Artificial Sequence
  Description of Artificial Sequence: Synthetic peptide
  Seed: FSSWETVCDSL (TYRP2_HUMAN)
FTSWETVCDSW

SEQ ID NO: 192611 - protein, 10 aa, Artificial Sequence
  Description of Artificial Sequence: Synthetic peptide
  Seed: RPDDPTLISR (TYRP2_HUMAN)
RTDDPTLISY

SEQ ID NO: 192612 - protein, 9 aa, Artificial Sequence
  Description of Artificial Sequence: Synthetic peptide
  Seed: GPGRPYRAI (TYRP2_HUMAN)
GPGRPYRAL

SEQ ID NO: 192613 - protein, 11 aa, Artificial Sequence
  Description of Artificial Sequence: Synthetic peptide
  Seed: LVVMGTLVALV (TYRP2_HUMAN)
LMVMGTLVALV

SEQ ID NO: 192614 - protein, 9 aa, Artificial Sequence
  Description of Artificial Sequence: Synthetic peptide
  Seed: FVLLAFLQY (TYRP2_HUMAN)
FKLLAFLQL

SEQ ID NO: 192615 - protein, 10 aa, Artificial Sequence
  Description of Artificial Sequence: Synthetic peptide
  Seed: NPPFFQNSTF (TYRP2_HUMAN)
NGPFFQNSTY

SEQ ID NO: 192616 - protein, 10 aa, Artificial Sequence
  Description of Artificial Sequence: Synthetic peptide
  Seed: LVVMGTLVAL (TYRP2_HUMAN)
LPVMGTLVAY

SEQ ID NO: 192617 - protein, 10 aa, Artificial Sequence
  Description of Artificial Sequence: Synthetic peptide
  Seed: RNSRFSSWET (TYRP2_HUMAN)
RWSRFSSWEI

SEQ ID NO: 192618 - protein, 10 aa, Artificial Sequence
  Description of Artificial Sequence: Synthetic peptide
  Seed: NCSVYDFFVW (TYRP2_HUMAN)
NVSVYDFFVW

SEQ ID NO: 192619 - protein, 9 aa, Artificial Sequence
  Description of Artificial Sequence: Synthetic peptide
  Seed: STFSFRNAL (TYRP2_HUMAN)
SMFSFRNAW

SEQ ID NO: 192620 - protein, 8 aa, Artificial Sequence
  Description of Artificial Sequence: Synthetic peptide
  Seed: AIDLPVSV (TYRP2_HUMAN)
AYDLPVSF

SEQ ID NO: 192621 - protein, 10 aa, Artificial Sequence
  Description of Artificial Sequence: Synthetic peptide
  Seed: RNSRFSSWET (TYRP2_HUMAN)
RCSRFSSWEA

SEQ ID NO: 192622 - protein, 9 aa, Artificial Sequence
  Description of Artificial Sequence: Synthetic peptide
  Seed: RVCMTVDSL (TYRP2_HUMAN)
RMCMTVDSY

SEQ ID NO: 192623 - protein, 9 aa, Artificial Sequence
  Description of Artificial Sequence: Synthetic peptide
  Seed: VHPDYVITT (TYRP2_HUMAN)
VFPDYVITL

SEQ ID NO: 192624 - protein, 9 aa, Artificial Sequence
  Description of Artificial Sequence: Synthetic peptide
  Seed: RLRKGYTPL (TYRP2_HUMAN)
RSRKGYTPM

SEQ ID NO: 192625 - protein, 10 aa, Artificial Sequence
  Description of Artificial Sequence: Synthetic peptide
  Seed: IGNESFALPY (TYRP2_HUMAN)
ISNESFALPY

SEQ ID NO: 192626 - protein, 9 aa, Artificial Sequence
  Description of Artificial Sequence: Synthetic peptide
  Seed: VLHSFTDAI (TYRP2_HUMAN)
VVHSFTDAL

SEQ ID NO: 192627 - protein, 9 aa, Artificial Sequence
  Description of Artificial Sequence: Synthetic peptide
  Seed: HQGPAFVTW (TYRP2_HUMAN)
HGGPAFVTW

SEQ ID NO: 192628 - protein, 9 aa, Artificial Sequence
  Description of Artificial Sequence: Synthetic peptide
  Seed: LVHSFLNGT (TYRP2_HUMAN)
LQHSFLNGL

SEQ ID NO: 192629 - protein, 10 aa, Artificial Sequence
  Description of Artificial Sequence: Synthetic peptide
  Seed: SPLWWGFLLS (TYRP2_HUMAN)
SDLWWGFLLI

SEQ ID NO: 192630 - protein, 10 aa, Artificial Sequence
  Description of Artificial Sequence: Synthetic peptide
  Seed: KRFNPPADAW (TYRP2_HUMAN)
KQFNPPADAM

SEQ ID NO: 192631 - protein, 9 aa, Artificial Sequence
  Description of Artificial Sequence: Synthetic peptide
  Seed: RNSMKLPTL (TYRP2_HUMAN)
RRSMKLPTV

SEQ ID NO: 192632 - protein, 10 aa, Artificial Sequence
  Description of Artificial Sequence: Synthetic peptide
  Seed: RNQMGRNSMK (TYRP2_HUMAN)
RAQMGRNSMK

SEQ ID NO: 192633 - protein, 10 aa, Artificial Sequence
  Description of Artificial Sequence: Synthetic peptide
  Seed: SPLWWGFLLS (TYRP2_HUMAN)
SFLWWGFLLA

SEQ ID NO: 192634 - protein, 9 aa, Artificial Sequence
  Description of Artificial Sequence: Synthetic peptide
  Seed: FVLLAFLQY (TYRP2_HUMAN)
FKLLAFLQF

SEQ ID NO: 192635 - protein, 9 aa, Artificial Sequence
  Description of Artificial Sequence: Synthetic peptide
  Seed: QKFDNPPFF (TYRP2_HUMAN)
QAFDNPPFF

SEQ ID NO: 192636 - protein, 8 aa, Artificial Sequence
  Description of Artificial Sequence: Synthetic peptide
  Seed: RPDDPTLI (TYRP2_HUMAN)
RLDDPTLI

SEQ ID NO: 192637 - protein, 9 aa, Artificial Sequence
  Description of Artificial Sequence: Synthetic peptide
  Seed: ANDPIFVVL (TYRP2_HUMAN)
ASDPIFVVF

SEQ ID NO: 192638 - protein, 11 aa, Artificial Sequence
  Description of Artificial Sequence: Synthetic peptide
  Seed: YTPLMETHLSS (TYRP2_HUMAN)
YVPLMETHLSV

SEQ ID NO: 192639 - protein, 8 aa, Artificial Sequence
  Description of Artificial Sequence: Synthetic peptide
  Seed: FQNSTFSF (TYRP2_HUMAN)
FQNSTFSM

SEQ ID NO: 192640 - protein, 10 aa, Artificial Sequence
  Description of Artificial Sequence: Synthetic peptide
  Seed: MSLHNLVHSF (TYRP2_HUMAN)
MTLHNLVHSM

SEQ ID NO: 192641 - protein, 10 aa, Artificial Sequence
  Description of Artificial Sequence: Synthetic peptide
  Seed: MSPLWWGFLL (TYRP2_HUMAN)
MQPLWWGFLV

SEQ ID NO: 192642 - protein, 10 aa, Artificial Sequence
  Description of Artificial Sequence: Synthetic peptide
  Seed: LHYYSVRDTL (TYRP2_HUMAN)
LPYYSVRDTF

SEQ ID NO: 192643 - protein, 9 aa, Artificial Sequence
  Description of Artificial Sequence: Synthetic peptide
  Seed: NQMGRNSMK (TYRP2_HUMAN)
NSMGRNSMK

SEQ ID NO: 192644 - protein, 11 aa, Artificial Sequence
  Description of Artificial Sequence: Synthetic peptide
  Seed: FFPPVTNEELF (TYRP2_HUMAN)
FYPPVTNEELM

SEQ ID NO: 192645 - protein, 11 aa, Artificial Sequence
  Description of Artificial Sequence: Synthetic peptide
  Seed: FVVLHSFTDAI (TYRP2_HUMAN)
FQVLHSFTDAI

SEQ ID NO: 192646 - protein, 8 aa, Artificial Sequence
  Description of Artificial Sequence: Synthetic peptide
  Seed: FQNSTFSF (TYRP2_HUMAN)
FTNSTFSM

SEQ ID NO: 192647 - protein, 9 aa, Artificial Sequence
  Description of Artificial Sequence: Synthetic peptide
  Seed: KDIRDCLSL (TYRP2_HUMAN)
KEIRDCLSM

SEQ ID NO: 192648 - protein, 10 aa, Artificial Sequence
  Description of Artificial Sequence: Synthetic peptide
  Seed: DAIFDEWMKR (TYRP2_HUMAN)
DSIFDEWMKK

SEQ ID NO: 192649 - protein, 9 aa, Artificial Sequence
  Description of Artificial Sequence: Synthetic peptide
  Seed: RLIGNESFA (TYRP2_HUMAN)
RMIGNESFM

SEQ ID NO: 192650 - protein, 11 aa, Artificial Sequence
  Description of Artificial Sequence: Synthetic peptide
  Seed: VMSLHNLVHSF (TYRP2_HUMAN)
VSSLHNLVHSF

SEQ ID NO: 192651 - protein, 9 aa, Artificial Sequence
  Description of Artificial Sequence: Synthetic peptide
  Seed: ANCSVYDFF (TYRP2_HUMAN)
ASCSVYDFF

SEQ ID NO: 192652 - protein, 10 aa, Artificial Sequence
  Description of Artificial Sequence: Synthetic peptide
  Seed: RLRKGYTPLM (TYRP2_HUMAN)
RPRKGYTPLF

SEQ ID NO: 192653 - protein, 10 aa, Artificial Sequence
  Description of Artificial Sequence: Synthetic peptide
  Seed: LVVMGTLVAL (TYRP2_HUMAN)
LCVMGTLVAL

SEQ ID NO: 192654 - protein, 10 aa, Artificial Sequence
  Description of Artificial Sequence: Synthetic peptide
  Seed: SVYDFFVWLH (TYRP2_HUMAN)
SHYDFFVWLR

SEQ ID NO: 192655 - protein, 10 aa, Artificial Sequence
  Description of Artificial Sequence: Synthetic peptide
  Seed: RNSRFSSWET (TYRP2_HUMAN)
RFSRFSSWEK

SEQ ID NO: 192656 - protein, 10 aa, Artificial Sequence
  Description of Artificial Sequence: Synthetic peptide
  Seed: FTDAIFDEWM (TYRP2_HUMAN)
FTDAIFDEWV

SEQ ID NO: 192657 - protein, 10 aa, Artificial Sequence
  Description of Artificial Sequence: Synthetic peptide
  Seed: LTSDQLGYSY (TYRP2_HUMAN)
LSSDQLGYSW

SEQ ID NO: 192658 - protein, 10 aa, Artificial Sequence
  Description of Artificial Sequence: Synthetic peptide
  Seed: FSFRNALEGF (TYRP2_HUMAN)
FAFRNALEGF

SEQ ID NO: 192659 - protein, 10 aa, Artificial Sequence
  Description of Artificial Sequence: Synthetic peptide
  Seed: VVMGTLVALV (TYRP2_HUMAN)
VTMGTLVALL

SEQ ID NO: 192660 - protein, 9 aa, Artificial Sequence
  Description of Artificial Sequence: Synthetic peptide
  Seed: FFPPVTNEE (TYRP2_HUMAN)
FHPPVTNEM

SEQ ID NO: 192661 - protein, 9 aa, Artificial Sequence
  Description of Artificial Sequence: Synthetic peptide
  Seed: RKFFHRTCK (TYRP2_HUMAN)
RLFFHRTCR

SEQ ID NO: 192662 - protein, 9 aa, Artificial Sequence
  Description of Artificial Sequence: Synthetic peptide
  Seed: SAANDPIFV (TYRP2_HUMAN)
STANDPIFV

SEQ ID NO: 192663 - protein, 9 aa, Artificial Sequence
  Description of Artificial Sequence: Synthetic peptide
  Seed: YTPLMETHL (TYRP2_HUMAN)
YFPLMETHM

SEQ ID NO: 192664 - protein, 10 aa, Artificial Sequence
  Description of Artificial Sequence: Synthetic peptide
  Seed: TLLGPGRPYR (TYRP2_HUMAN)
TMLGPGRPYK

SEQ ID NO: 192665 - protein, 9 aa, Artificial Sequence
  Description of Artificial Sequence: Synthetic peptide
  Seed: LSPQEREQF (TYRP2_HUMAN)
LYPQEREQM

SEQ ID NO: 192666 - protein, 9 aa, Artificial Sequence
  Description of Artificial Sequence: Synthetic peptide
  Seed: TDQLFGAAR (TYRP2_HUMAN)
TAQLFGAAR

SEQ ID NO: 192667 - protein, 9 aa, Artificial Sequence
  Description of Artificial Sequence: Synthetic peptide
  Seed: ETPGWPTTL (TYRP2_HUMAN)
EVPGWPTTW

SEQ ID NO: 192668 - protein, 10 aa, Artificial Sequence
  Description of Artificial Sequence: Synthetic peptide
  Seed: MSPLWWGFLL (TYRP2_HUMAN)
MLPLWWGFLY

SEQ ID NO: 192669 - protein, 9 aa, Artificial Sequence
  Description of Artificial Sequence: Synthetic peptide
  Seed: SAANDPIFV (TYRP2_HUMAN)
SIANDPIFI

SEQ ID NO: 192670 - protein, 9 aa, Artificial Sequence
  Description of Artificial Sequence: Synthetic peptide
  Seed: ETPGWPTTL (TYRP2_HUMAN)
ERPGWPTTY

SEQ ID NO: 192671 - protein, 11 aa, Artificial Sequence
  Description of Artificial Sequence: Synthetic peptide
  Seed: LSLQKFDNPPF (TYRP2_HUMAN)
LQLQKFDNPPF

SEQ ID NO: 192672 - protein, 10 aa, Artificial Sequence
  Description of Artificial Sequence: Synthetic peptide
  Seed: ADTRPWSGPY (TYRP2_HUMAN)
AMTRPWSGPK

SEQ ID NO: 192673 - protein, 10 aa, Artificial Sequence
  Description of Artificial Sequence: Synthetic peptide
  Seed: MSPLWWGFLL (TYRP2_HUMAN)
MEPLWWGFLF

SEQ ID NO: 192674 - protein, 9 aa, Artificial Sequence
  Description of Artificial Sequence: Synthetic peptide
  Seed: ANDPIFVVL (TYRP2_HUMAN)
AVDPIFVVI

SEQ ID NO: 192675 - protein, 9 aa, Artificial Sequence
  Description of Artificial Sequence: Synthetic peptide
  Seed: GTLVALVGL (TYRP2_HUMAN)
GQLVALVGM

SEQ ID NO: 192676 - protein, 9 aa, Artificial Sequence
  Description of Artificial Sequence: Synthetic peptide
  Seed: SRNSRFSSW (TYRP2_HUMAN)
SYNSRFSSL

SEQ ID NO: 192677 - protein, 10 aa, Artificial Sequence
  Description of Artificial Sequence: Synthetic peptide
  Seed: SDQLGYSYAI (TYRP2_HUMAN)
SHQLGYSYAL

SEQ ID NO: 192678 - protein, 10 aa, Artificial Sequence
  Description of Artificial Sequence: Synthetic peptide
  Seed: LVVMGTLVAL (TYRP2_HUMAN)
LRVMGTLVAA

SEQ ID NO: 192679 - protein, 9 aa, Artificial Sequence
  Description of Artificial Sequence: Synthetic peptide
  Seed: HQGPAFVTW (TYRP2_HUMAN)
HYGPAFVTV

SEQ ID NO: 192680 - protein, 9 aa, Artificial Sequence
  Description of Artificial Sequence: Synthetic peptide
  Seed: ETPGWPTTL (TYRP2_HUMAN)
EQPGWPTTY

SEQ ID NO: 192681 - protein, 9 aa, Artificial Sequence
  Description of Artificial Sequence: Synthetic peptide
  Seed: LLVVMGTLV (TYRP2_HUMAN)
LMVVMGTLL

SEQ ID NO: 192682 - protein, 10 aa, Artificial Sequence
  Description of Artificial Sequence: Synthetic peptide
  Seed: DTLLGPGRPY (TYRP2_HUMAN)
DALLGPGRPK

SEQ ID NO: 192683 - protein, 10 aa, Artificial Sequence
  Description of Artificial Sequence: Synthetic peptide
  Seed: FQNSTFSFRN (TYRP2_HUMAN)
FFNSTFSFRK

SEQ ID NO: 192684 - protein, 10 aa, Artificial Sequence
  Description of Artificial Sequence: Synthetic peptide
  Seed: KRFNPPADAW (TYRP2_HUMAN)
KMFNPPADAF

SEQ ID NO: 192685 - protein, 9 aa, Artificial Sequence
  Description of Artificial Sequence: Synthetic peptide
  Seed: QFPRVCMTV (TYRP2_HUMAN)
QYPRVCMTY

SEQ ID NO: 192686 - protein, 10 aa, Artificial Sequence
  Description of Artificial Sequence: Synthetic peptide
  Seed: DSLDDYNHLV (TYRP2_HUMAN)
DWLDDYNHLL

SEQ ID NO: 192687 - protein, 9 aa, Artificial Sequence
  Description of Artificial Sequence: Synthetic peptide
  Seed: TLLGPGRPY (TYRP2_HUMAN)
TSLGPGRPL

SEQ ID NO: 192688 - protein, 8 aa, Artificial Sequence
  Description of Artificial Sequence: Synthetic peptide
  Seed: NSMKLPTL (TYRP2_HUMAN)
NAMKLPTV

SEQ ID NO: 192689 - protein, 11 aa, Artificial Sequence
  Description of Artificial Sequence: Synthetic peptide
  Seed: YNMVPFFPPVT (TYRP2_HUMAN)
YQMVPFFPPVM

SEQ ID NO: 192690 - protein, 11 aa, Artificial Sequence
  Description of Artificial Sequence: Synthetic peptide
  Seed: YNMVPFFPPVT (TYRP2_HUMAN)
YQMVPFFPPVP

SEQ ID NO: 192691 - protein, 9 aa, Artificial Sequence
  Description of Artificial Sequence: Synthetic peptide
  Seed: RMYNMVPFF (TYRP2_HUMAN)
RTYNMVPFQ

SEQ ID NO: 192692 - protein, 11 aa, Artificial Sequence
  Description of Artificial Sequence: Synthetic peptide
  Seed: FVVLHSFTDAI (TYRP2_HUMAN)
FYVLHSFTDAL

SEQ ID NO: 192693 - protein, 9 aa, Artificial Sequence
  Description of Artificial Sequence: Synthetic peptide
  Seed: ALVGLFVLL (TYRP2_HUMAN)
ALVGLFVLT

SEQ ID NO: 192694 - protein, 9 aa, Artificial Sequence
  Description of Artificial Sequence: Synthetic peptide
  Seed: TLDSQVMSL (TYRP2_HUMAN)
TCDSQVMSL

SEQ ID NO: 192695 - protein, 10 aa, Artificial Sequence
  Description of Artificial Sequence: Synthetic peptide
  Seed: YDFFVWLHYY (TYRP2_HUMAN)
YFFFVWLHYG

SEQ ID NO: 192696 - protein, 11 aa, Artificial Sequence
  Description of Artificial Sequence: Synthetic peptide
  Seed: RNSRFSSWETV (TYRP2_HUMAN)
RFSRFSSWETI

SEQ ID NO: 192697 - protein, 10 aa, Artificial Sequence
  Description of Artificial Sequence: Synthetic peptide
  Seed: SLVNKECCPR (TYRP2_HUMAN)
STVNKECCPK

SEQ ID NO: 192698 - protein, 11 aa, Artificial Sequence
  Description of Artificial Sequence: Synthetic peptide
  Seed: FFPPVTNEELF (TYRP2_HUMAN)
FMPPVTNEELW

SEQ ID NO: 192699 - protein, 11 aa, Artificial Sequence
  Description of Artificial Sequence: Synthetic peptide
  Seed: RNSRFSSWETV (TYRP2_HUMAN)
RHSRFSSWETI

SEQ ID NO: 192700 - protein, 9 aa, Artificial Sequence
  Description of Artificial Sequence: Synthetic peptide
  Seed: DDYNHLVTL (TYRP2_HUMAN)
DTYNHLVTF

SEQ ID NO: 192701 - protein, 10 aa, Artificial Sequence
  Description of Artificial Sequence: Synthetic peptide
  Seed: LISRNSRFSS (TYRP2_HUMAN)
LSSRNSRFSK

SEQ ID NO: 192702 - protein, 9 aa, Artificial Sequence
  Description of Artificial Sequence: Synthetic peptide
  Seed: ALPYWNFAT (TYRP2_HUMAN)
AVPYWNFAV

SEQ ID NO: 192703 - protein, 11 aa, Artificial Sequence
  Description of Artificial Sequence: Synthetic peptide
  Seed: TQPQFANCSVY (TYRP2_HUMAN)
TEPQFANCSVM

SEQ ID NO: 192704 - protein, 8 aa, Artificial Sequence
  Description of Artificial Sequence: Synthetic peptide
  Seed: MVPFFPPV (TYRP2_HUMAN)
MIPFFPPV

SEQ ID NO: 192705 - protein, 9 aa, Artificial Sequence
  Description of Artificial Sequence: Synthetic peptide
  Seed: TLLGPGRPY (TYRP2_HUMAN)
TYLGPGRPY

SEQ ID NO: 192706 - protein, 8 aa, Artificial Sequence
  Description of Artificial Sequence: Synthetic peptide
  Seed: FLNGTNAL (TYRP2_HUMAN)
FYNGTNAM

SEQ ID NO: 192707 - protein, 9 aa, Artificial Sequence
  Description of Artificial Sequence: Synthetic peptide
  Seed: TSDQLGYSY (TYRP2_HUMAN)
TCDQLGYSL

SEQ ID NO: 192708 - protein, 9 aa, Artificial Sequence
  Description of Artificial Sequence: Synthetic peptide
  Seed: VIRQNIHSL (TYRP2_HUMAN)
VPRQNIHSV

SEQ ID NO: 192709 - protein, 10 aa, Artificial Sequence
  Description of Artificial Sequence: Synthetic peptide
  Seed: FLTSDQLGYS (TYRP2_HUMAN)
FHTSDQLGYV

SEQ ID NO: 192710 - protein, 9 aa, Artificial Sequence
  Description of Artificial Sequence: Synthetic peptide
  Seed: AKKRVHPDY (TYRP2_HUMAN)
AQKRVHPDY

SEQ ID NO: 192711 - protein, 9 aa, Artificial Sequence
  Description of Artificial Sequence: Synthetic peptide
  Seed: HQGPAFVTW (TYRP2_HUMAN)
HYGPAFVTY

SEQ ID NO: 192712 - protein, 9 aa, Artificial Sequence
  Description of Artificial Sequence: Synthetic peptide
  Seed: LHNLVHSFL (TYRP2_HUMAN)
LKNLVHSFY

SEQ ID NO: 192713 - protein, 9 aa, Artificial Sequence
  Description of Artificial Sequence: Synthetic peptide
  Seed: HQGPAFVTW (TYRP2_HUMAN)
HHGPAFVTL

SEQ ID NO: 192714 - protein, 9 aa, Artificial Sequence
  Description of Artificial Sequence: Synthetic peptide
  Seed: TLDSQVMSL (TYRP2_HUMAN)
TLDSQVMSI

SEQ ID NO: 192715 - protein, 10 aa, Artificial Sequence
  Description of Artificial Sequence: Synthetic peptide
  Seed: VYDFFVWLHY (TYRP2_HUMAN)
VSDFFVWLHY

SEQ ID NO: 192716 - protein, 10 aa, Artificial Sequence
  Description of Artificial Sequence: Synthetic peptide
  Seed: QELAPIGHNR (TYRP2_HUMAN)
QELAPIGHNF

SEQ ID NO: 192717 - protein, 10 aa, Artificial Sequence
  Description of Artificial Sequence: Synthetic peptide
  Seed: DSLDDYNHLV (TYRP2_HUMAN)
DYLDDYNHLL

SEQ ID NO: 192718 - protein, 9 aa, Artificial Sequence
  Description of Artificial Sequence: Synthetic peptide
  Seed: LHSFTDAIF (TYRP2_HUMAN)
LRSFTDAIF

SEQ ID NO: 192719 - protein, 9 aa, Artificial Sequence
  Description of Artificial Sequence: Synthetic peptide
  Seed: ETPGWPTTL (TYRP2_HUMAN)
ELPGWPTTI

SEQ ID NO: 192720 - protein, 9 aa, Artificial Sequence
  Description of Artificial Sequence: Synthetic peptide
  Seed: STFSFRNAL (TYRP2_HUMAN)
SMFSFRNAM

SEQ ID NO: 192721 - protein, 9 aa, Artificial Sequence
  Description of Artificial Sequence: Synthetic peptide
  Seed: SVRDTLLGP (TYRP2_HUMAN)
STRDTLLGA

SEQ ID NO: 192722 - protein, 10 aa, Artificial Sequence
  Description of Artificial Sequence: Synthetic peptide
  Seed: HSFLNGTNAL (TYRP2_HUMAN)
HWFLNGTNAF

SEQ ID NO: 192723 - protein, 10 aa, Artificial Sequence
  Description of Artificial Sequence: Synthetic peptide
  Seed: FTDAIFDEWM (TYRP2_HUMAN)
FMDAIFDEWA

SEQ ID NO: 192724 - protein, 10 aa, Artificial Sequence
  Description of Artificial Sequence: Synthetic peptide
  Seed: FFVWLHYYSV (TYRP2_HUMAN)
FIVWLHYYSA

SEQ ID NO: 192725 - protein, 10 aa, Artificial Sequence
  Description of Artificial Sequence: Synthetic peptide
  Seed: NPPFFQNSTF (TYRP2_HUMAN)
NNPFFQNSTY

SEQ ID NO: 192726 - protein, 10 aa, Artificial Sequence
  Description of Artificial Sequence: Synthetic peptide
  Seed: FFPPVTNEEL (TYRP2_HUMAN)
FTPPVTNEEY

SEQ ID NO: 192727 - protein, 10 aa, Artificial Sequence
  Description of Artificial Sequence: Synthetic peptide
  Seed: MSPLWWGFLL (TYRP2_HUMAN)
MTPLWWGFLV

SEQ ID NO: 192728 - protein, 10 aa, Artificial Sequence
  Description of Artificial Sequence: Synthetic peptide
  Seed: SVYDFFVWLH (TYRP2_HUMAN)
SMYDFFVWLR

SEQ ID NO: 192729 - protein, 9 aa, Artificial Sequence
  Description of Artificial Sequence: Synthetic peptide
  Seed: ILPGAQGQF (TYRP2_HUMAN)
IMPGAQGQM

SEQ ID NO: 192730 - protein, 9 aa, Artificial Sequence
  Description of Artificial Sequence: Synthetic peptide
  Seed: TLLVVMGTL (TYRP2_HUMAN)
TQLVVMGTI

SEQ ID NO: 192731 - protein, 10 aa, Artificial Sequence
  Description of Artificial Sequence: Synthetic peptide
  Seed: PFFQNSTFSF (TYRP2_HUMAN)
PYFQNSTFSW

SEQ ID NO: 192732 - protein, 10 aa, Artificial Sequence
  Description of Artificial Sequence: Synthetic peptide
  Seed: LVVMGTLVAL (TYRP2_HUMAN)
LGVMGTLVAY

SEQ ID NO: 192733 - protein, 9 aa, Artificial Sequence
  Description of Artificial Sequence: Synthetic peptide
  Seed: TLDSQVMSL (TYRP2_HUMAN)
TFDSQVMSA

SEQ ID NO: 192734 - protein, 9 aa, Artificial Sequence
  Description of Artificial Sequence: Synthetic peptide
  Seed: NMVPFFPPV (TYRP2_HUMAN)
NMVPFFPPL

SEQ ID NO: 192735 - protein, 8 aa, Artificial Sequence
  Description of Artificial Sequence: Synthetic peptide
  Seed: MVPFFPPV (TYRP2_HUMAN)
MMPFFPPV

SEQ ID NO: 192736 - protein, 9 aa, Artificial Sequence
  Description of Artificial Sequence: Synthetic peptide
  Seed: FLTSDQLGY (TYRP2_HUMAN)
FVTSDQLGY

SEQ ID NO: 192737 - protein, 10 aa, Artificial Sequence
  Description of Artificial Sequence: Synthetic peptide
  Seed: VVMGTLVALV (TYRP2_HUMAN)
VIMGTLVALA

SEQ ID NO: 192738 - protein, 9 aa, Artificial Sequence
  Description of Artificial Sequence: Synthetic peptide
  Seed: AANDPIFVV (TYRP2_HUMAN)
AGNDPIFVW

SEQ ID NO: 192739 - protein, 9 aa, Artificial Sequence
  Description of Artificial Sequence: Synthetic peptide
  Seed: RELWPRKFF (TYRP2_HUMAN)
RQLWPRKFY

SEQ ID NO: 192740 - protein, 9 aa, Artificial Sequence
  Description of Artificial Sequence: Synthetic peptide
  Seed: TSDQLGYSY (TYRP2_HUMAN)
TGDQLGYSM

SEQ ID NO: 192741 - protein, 9 aa, Artificial Sequence
  Description of Artificial Sequence: Synthetic peptide
  Seed: AARPDDPTL (TYRP2_HUMAN)
AARPDDPTY

SEQ ID NO: 192742 - protein, 9 aa, Artificial Sequence
  Description of Artificial Sequence: Synthetic peptide
  Seed: KDIRDCLSL (TYRP2_HUMAN)
KQIRDCLSV

SEQ ID NO: 192743 - protein, 10 aa, Artificial Sequence
  Description of Artificial Sequence: Synthetic peptide
  Seed: SLQKFDNPPF (TYRP2_HUMAN)
SAQKFDNPPF

SEQ ID NO: 192744 - protein, 9 aa, Artificial Sequence
  Description of Artificial Sequence: Synthetic peptide
  Seed: ETPGWPTTL (TYRP2_HUMAN)
EVPGWPTTV

SEQ ID NO: 192745 - protein, 9 aa, Artificial Sequence
  Description of Artificial Sequence: Synthetic peptide
  Seed: TLDSQVMSL (TYRP2_HUMAN)
TRDSQVMSM

SEQ ID NO: 192746 - protein, 11 aa, Artificial Sequence
  Description of Artificial Sequence: Synthetic peptide
  Seed: KADGTLDSQVM (TYRP2_HUMAN)
KTDGTLDSQVF

SEQ ID NO: 192747 - protein, 9 aa, Artificial Sequence
  Description of Artificial Sequence: Synthetic peptide
  Seed: HSFLNGTNA (TYRP2_HUMAN)
HAFLNGTNF

SEQ ID NO: 192748 - protein, 9 aa, Artificial Sequence
  Description of Artificial Sequence: Synthetic peptide
  Seed: VIRQNIHSL (TYRP2_HUMAN)
VLRQNIHSL

SEQ ID NO: 192749 - protein, 10 aa, Artificial Sequence
  Description of Artificial Sequence: Synthetic peptide
  Seed: LHYYSVRDTL (TYRP2_HUMAN)
LDYYSVRDTW

SEQ ID NO: 192750 - protein, 9 aa, Artificial Sequence
  Description of Artificial Sequence: Synthetic peptide
  Seed: SAANDPIFV (TYRP2_HUMAN)
SLANDPIFV

SEQ ID NO: 192751 - protein, 10 aa, Artificial Sequence
  Description of Artificial Sequence: Synthetic peptide
  Seed: NSTFSFRNAL (TYRP2_HUMAN)
NVTFSFRNAV

SEQ ID NO: 192752 - protein, 9 aa, Artificial Sequence
  Description of Artificial Sequence: Synthetic peptide
  Seed: FVWLHYYSV (TYRP2_HUMAN)
FLWLHYYSR

SEQ ID NO: 192753 - protein, 9 aa, Artificial Sequence
  Description of Artificial Sequence: Synthetic peptide
  Seed: VVMGTLVAL (TYRP2_HUMAN)
VMMGTLVAL

SEQ ID NO: 192754 - protein, 10 aa, Artificial Sequence
  Description of Artificial Sequence: Synthetic peptide
  Seed: VGLFVLLAFL (TYRP2_HUMAN)
VKLFVLLAFV

SEQ ID NO: 192755 - protein, 9 aa, Artificial Sequence
  Description of Artificial Sequence: Synthetic peptide
  Seed: DQLGYSYAI (TYRP2_HUMAN)
DTLGYSYAI

SEQ ID NO: 192756 - protein, 10 aa, Artificial Sequence
  Description of Artificial Sequence: Synthetic peptide
  Seed: VLLAFLQYRR (TYRP2_HUMAN)
VHLAFLQYRR

SEQ ID NO: 192757 - protein, 9 aa, Artificial Sequence
  Description of Artificial Sequence: Synthetic peptide
  Seed: HQGPAFVTW (TYRP2_HUMAN)
HIGPAFVTM

SEQ ID NO: 192758 - protein, 9 aa, Artificial Sequence
  Description of Artificial Sequence: Synthetic peptide
  Seed: ANDPIFVVL (TYRP2_HUMAN)
AYDPIFVVY

SEQ ID NO: 192759 - protein, 10 aa, Artificial Sequence
  Description of Artificial Sequence: Synthetic peptide
  Seed: HSAANDPIFV (TYRP2_HUMAN)
HIAANDPIFV

SEQ ID NO: 192760 - protein, 10 aa, Artificial Sequence
  Description of Artificial Sequence: Synthetic peptide
  Seed: YNMVPFFPPV (TYRP2_HUMAN)
YMMVPFFPPI

SEQ ID NO: 192761 - protein, 9 aa, Artificial Sequence
  Description of Artificial Sequence: Synthetic peptide
  Seed: AARPDDPTL (TYRP2_HUMAN)
AFRPDDPTM

SEQ ID NO: 192762 - protein, 11 aa, Artificial Sequence
  Description of Artificial Sequence: Synthetic peptide
  Seed: RADTRPWSGPY (TYRP2_HUMAN)
RFDTRPWSGPY

SEQ ID NO: 192763 - protein, 9 aa, Artificial Sequence
  Description of Artificial Sequence: Synthetic peptide
  Seed: NMVPFFPPV (TYRP2_HUMAN)
NVVPFFPPK

SEQ ID NO: 192764 - protein, 10 aa, Artificial Sequence
  Description of Artificial Sequence: Synthetic peptide
  Seed: RNSRFSSWET (TYRP2_HUMAN)
RPSRFSSWEV

SEQ ID NO: 192765 - protein, 10 aa, Artificial Sequence
  Description of Artificial Sequence: Synthetic peptide
  Seed: KILPGAQGQF (TYRP2_HUMAN)
KMLPGAQGQF

SEQ ID NO: 192766 - protein, 11 aa, Artificial Sequence
  Description of Artificial Sequence: Synthetic peptide
  Seed: TQPQFANCSVY (TYRP2_HUMAN)
TQPQFANCSVF

SEQ ID NO: 192767 - protein, 9 aa, Artificial Sequence
  Description of Artificial Sequence: Synthetic peptide
  Seed: YSYAIDLPV (TYRP2_HUMAN)
YQYAIDLPL

SEQ ID NO: 192768 - protein, 9 aa, Artificial Sequence
  Description of Artificial Sequence: Synthetic peptide
  Seed: ALDLAKKRV (TYRP2_HUMAN)
AIDLAKKRM

SEQ ID NO: 192769 - protein, 9 aa, Artificial Sequence
  Description of Artificial Sequence: Synthetic peptide
  Seed: VLHSFTDAI (TYRP2_HUMAN)
VIHSFTDAL

SEQ ID NO: 192770 - protein, 10 aa, Artificial Sequence
  Description of Artificial Sequence: Synthetic peptide
  Seed: RRLRKGYTPL (TYRP2_HUMAN)
RQLRKGYTPK

SEQ ID NO: 192771 - protein, 9 aa, Artificial Sequence
  Description of Artificial Sequence: Synthetic peptide
  Seed: VSVEETPGW (TYRP2_HUMAN)
VPVEETPGW

SEQ ID NO: 192772 - protein, 9 aa, Artificial Sequence
  Description of Artificial Sequence: Synthetic peptide
  Seed: ARPDDPTLI (TYRP2_HUMAN)
ARPDDPTLM

SEQ ID NO: 192773 - protein, 9 aa, Artificial Sequence
  Description of Artificial Sequence: Synthetic peptide
  Seed: GLFVLLAFL (TYRP2_HUMAN)
GQFVLLAFI

SEQ ID NO: 192774 - protein, 10 aa, Artificial Sequence
  Description of Artificial Sequence: Synthetic peptide
  Seed: LKDIRDCLSL (TYRP2_HUMAN)
LQDIRDCLSY

SEQ ID NO: 192775 - protein, 10 aa, Artificial Sequence
  Description of Artificial Sequence: Synthetic peptide
  Seed: VYDFFVWLHY (TYRP2_HUMAN)
VIDFFVWLHY

SEQ ID NO: 192776 - protein, 11 aa, Artificial Sequence
  Description of Artificial Sequence: Synthetic peptide
  Seed: YTPLMETHLSS (TYRP2_HUMAN)
YEPLMETHLSL

SEQ ID NO: 192777 - protein, 9 aa, Artificial Sequence
  Description of Artificial Sequence: Synthetic peptide
  Seed: STFSFRNAL (TYRP2_HUMAN)
SKFSFRNAM

SEQ ID NO: 192778 - protein, 9 aa, Artificial Sequence
  Description of Artificial Sequence: Synthetic peptide
  Seed: VIRQNIHSL (TYRP2_HUMAN)
VWRQNIHSY

SEQ ID NO: 192779 - protein, 9 aa, Artificial Sequence
  Description of Artificial Sequence: Synthetic peptide
  Seed: TLDSQVMSL (TYRP2_HUMAN)
TSDSQVMSM

SEQ ID NO: 192780 - protein, 9 aa, Artificial Sequence
  Description of Artificial Sequence: Synthetic peptide
  Seed: DDYNHLVTL (TYRP2_HUMAN)
DQYNHLVTI

SEQ ID NO: 192781 - protein, 10 aa, Artificial Sequence
  Description of Artificial Sequence: Synthetic peptide
  Seed: KRFNPPADAW (TYRP2_HUMAN)
KTFNPPADAF

SEQ ID NO: 192782 - protein, 9 aa, Artificial Sequence
  Description of Artificial Sequence: Synthetic peptide
  Seed: QKFDNPPFF (TYRP2_HUMAN)
QYFDNPPFL

SEQ ID NO: 192783 - protein, 9 aa, Artificial Sequence
  Description of Artificial Sequence: Synthetic peptide
  Seed: GQFPRVCMT (TYRP2_HUMAN)
GIFPRVCMI

SEQ ID NO: 192784 - protein, 10 aa, Artificial Sequence
  Description of Artificial Sequence: Synthetic peptide
  Seed: CCPRLGAESA (TYRP2_HUMAN)
CRPRLGAESV

SEQ ID NO: 192785 - protein, 9 aa, Artificial Sequence
  Description of Artificial Sequence: Synthetic peptide
  Seed: DDRELWPRK (TYRP2_HUMAN)
DTRELWPRK

SEQ ID NO: 192786 - protein, 10 aa, Artificial Sequence
  Description of Artificial Sequence: Synthetic peptide
  Seed: IGNESFALPY (TYRP2_HUMAN)
IHNESFALPY

SEQ ID NO: 192787 - protein, 10 aa, Artificial Sequence
  Description of Artificial Sequence: Synthetic peptide
  Seed: PFFQNSTFSF (TYRP2_HUMAN)
PMFQNSTFSF

SEQ ID NO: 192788 - protein, 9 aa, Artificial Sequence
  Description of Artificial Sequence: Synthetic peptide
  Seed: DFFVWLHYY (TYRP2_HUMAN)
DIFVWLHYY

SEQ ID NO: 192789 - protein, 10 aa, Artificial Sequence
  Description of Artificial Sequence: Synthetic peptide
  Seed: GQFPRVCMTV (TYRP2_HUMAN)
GAFPRVCMTY

SEQ ID NO: 192790 - protein, 9 aa, Artificial Sequence
  Description of Artificial Sequence: Synthetic peptide
  Seed: FTDAIFDEW (TYRP2_HUMAN)
FNDAIFDEL

SEQ ID NO: 192791 - protein, 10 aa, Artificial Sequence
  Description of Artificial Sequence: Synthetic peptide
  Seed: LHYYSVRDTL (TYRP2_HUMAN)
LYYYSVRDTM

SEQ ID NO: 192792 - protein, 10 aa, Artificial Sequence
  Description of Artificial Sequence: Synthetic peptide
  Seed: RRLRKGYTPL (TYRP2_HUMAN)
RSLRKGYTPA

SEQ ID NO: 192793 - protein, 10 aa, Artificial Sequence
  Description of Artificial Sequence: Synthetic peptide
  Seed: RNSRFSSWET (TYRP2_HUMAN)
RSSRFSSWEV

SEQ ID NO: 192794 - protein, 10 aa, Artificial Sequence
  Description of Artificial Sequence: Synthetic peptide
  Seed: TRPWSGPYIL (TYRP2_HUMAN)
TMPWSGPYIL

SEQ ID NO: 192795 - protein, 9 aa, Artificial Sequence
  Description of Artificial Sequence: Synthetic peptide
  Seed: ILPGAQGQF (TYRP2_HUMAN)
IAPGAQGQV

SEQ ID NO: 192796 - protein, 9 aa, Artificial Sequence
  Description of Artificial Sequence: Synthetic peptide
  Seed: WMKRFNPPA (TYRP2_HUMAN)
WMKRFNPPK

SEQ ID NO: 192797 - protein, 9 aa, Artificial Sequence
  Description of Artificial Sequence: Synthetic peptide
  Seed: SVYDFFVWL (TYRP2_HUMAN)
SSYDFFVWM

SEQ ID NO: 192798 - protein, 10 aa, Artificial Sequence
  Description of Artificial Sequence: Synthetic peptide
  Seed: VVMGTLVALV (TYRP2_HUMAN)
VLMGTLVALI

SEQ ID NO: 192799 - protein, 11 aa, Artificial Sequence
  Description of Artificial Sequence: Synthetic peptide
  Seed: RNSRFSSWETV (TYRP2_HUMAN)
RISRFSSWETI

SEQ ID NO: 192800 - protein, 9 aa, Artificial Sequence
  Description of Artificial Sequence: Synthetic peptide
  Seed: VMSLHNLVH (TYRP2_HUMAN)
VMSLHNLVF

SEQ ID NO: 192801 - protein, 9 aa, Artificial Sequence
  Description of Artificial Sequence: Synthetic peptide
  Seed: RFNPPADAW (TYRP2_HUMAN)
RRNPPADAY

SEQ ID NO: 192802 - protein, 9 aa, Artificial Sequence
  Description of Artificial Sequence: Synthetic peptide
  Seed: SRFSSWETV (TYRP2_HUMAN)
SQFSSWETM

SEQ ID NO: 192803 - protein, 8 aa, Artificial Sequence
  Description of Artificial Sequence: Synthetic peptide
  Seed: QVMSLHNL (TYRP2_HUMAN)
QQMSLHNI

SEQ ID NO: 192804 - protein, 9 aa, Artificial Sequence
  Description of Artificial Sequence: Synthetic peptide
  Seed: ISRNSRFSS (TYRP2_HUMAN)
IQRNSRFSA

SEQ ID NO: 192805 - protein, 8 aa, Artificial Sequence
  Description of Artificial Sequence: Synthetic peptide
  Seed: SDQLGYSY (TYRP2_HUMAN)
SEQLGYSW

SEQ ID NO: 192806 - protein, 11 aa, Artificial Sequence
  Description of Artificial Sequence: Synthetic peptide
  Seed: WLHYYSVRDTL (TYRP2_HUMAN)
WIHYYSVRDTF

SEQ ID NO: 192807 - protein, 9 aa, Artificial Sequence
  Description of Artificial Sequence: Synthetic peptide
  Seed: LSPQEREQF (TYRP2_HUMAN)
LTPQEREQL

SEQ ID NO: 192808 - protein, 9 aa, Artificial Sequence
  Description of Artificial Sequence: Synthetic peptide
  Seed: GAQGQFPRV (TYRP2_HUMAN)
GQQGQFPRI

SEQ ID NO: 192809 - protein, 10 aa, Artificial Sequence
  Description of Artificial Sequence: Synthetic peptide
  Seed: SPLWWGFLLS (TYRP2_HUMAN)
SILWWGFLLA

SEQ ID NO: 192810 - protein, 9 aa, Artificial Sequence
  Description of Artificial Sequence: Synthetic peptide
  Seed: ETPGWPTTL (TYRP2_HUMAN)
EVPGWPTTK

SEQ ID NO: 192811 - protein, 9 aa, Artificial Sequence
  Description of Artificial Sequence: Synthetic peptide
  Seed: NSMKLPTLK (TYRP2_HUMAN)
NMMKLPTLR

SEQ ID NO: 192812 - protein, 8 aa, Artificial Sequence
  Description of Artificial Sequence: Synthetic peptide
  Seed: SLDDYNHL (TYRP2_HUMAN)
SGDDYNHL

SEQ ID NO: 192813 - protein, 9 aa, Artificial Sequence
  Description of Artificial Sequence: Synthetic peptide
  Seed: ARPDDPTLI (TYRP2_HUMAN)
AFPDDPTLM

SEQ ID NO: 192814 - protein, 9 aa, Artificial Sequence
  Description of Artificial Sequence: Synthetic peptide
  Seed: SFLNGTNAL (TYRP2_HUMAN)
SRLNGTNAM

SEQ ID NO: 192815 - protein, 10 aa, Artificial Sequence
  Description of Artificial Sequence: Synthetic peptide
  Seed: VLLAFLQYRR (TYRP2_HUMAN)
VYLAFLQYRR

SEQ ID NO: 192816 - protein, 10 aa, Artificial Sequence
  Description of Artificial Sequence: Synthetic peptide
  Seed: FLTSDQLGYS (TYRP2_HUMAN)
FGTSDQLGYV

SEQ ID NO: 192817 - protein, 10 aa, Artificial Sequence
  Description of Artificial Sequence: Synthetic peptide
  Seed: NGTYEGLLRR (TYRP2_HUMAN)
NRTYEGLLRK

SEQ ID NO: 192818 - protein, 11 aa, Artificial Sequence
  Description of Artificial Sequence: Synthetic peptide
  Seed: KADGTLDSQVM (TYRP2_HUMAN)
KQDGTLDSQVL

SEQ ID NO: 192819 - protein, 9 aa, Artificial Sequence
  Description of Artificial Sequence: Synthetic peptide
  Seed: VMGTLVALV (TYRP2_HUMAN)
VTGTLVALV

SEQ ID NO: 192820 - protein, 9 aa, Artificial Sequence
  Description of Artificial Sequence: Synthetic peptide
  Seed: DDYNHLVTL (TYRP2_HUMAN)
DQYNHLVTY

SEQ ID NO: 192821 - protein, 10 aa, Artificial Sequence
  Description of Artificial Sequence: Synthetic peptide
  Seed: REQFLGALDL (TYRP2_HUMAN)
REQFLGALDV

SEQ ID NO: 192822 - protein, 9 aa, Artificial Sequence
  Description of Artificial Sequence: Synthetic peptide
  Seed: FTDAIFDEW (TYRP2_HUMAN)
FIDAIFDEY

SEQ ID NO: 192823 - protein, 9 aa, Artificial Sequence
  Description of Artificial Sequence: Synthetic peptide
  Seed: TSDQLGYSY (TYRP2_HUMAN)
TFDQLGYSY

SEQ ID NO: 192824 - protein, 9 aa, Artificial Sequence
  Description of Artificial Sequence: Synthetic peptide
  Seed: NRMYNMVPF (TYRP2_HUMAN)
NYMYNMVPM

SEQ ID NO: 192825 - protein, 9 aa, Artificial Sequence
  Description of Artificial Sequence: Synthetic peptide
  Seed: LIGNESFAL (TYRP2_HUMAN)
LQGNESFAV

SEQ ID NO: 192826 - protein, 10 aa, Artificial Sequence
  Description of Artificial Sequence: Synthetic peptide
  Seed: SPLWWGFLLS (TYRP2_HUMAN)
SILWWGFLLI

SEQ ID NO: 192827 - protein, 10 aa, Artificial Sequence
  Description of Artificial Sequence: Synthetic peptide
  Seed: SDQLGYSYAI (TYRP2_HUMAN)
SWQLGYSYAF

SEQ ID NO: 192828 - protein, 10 aa, Artificial Sequence
  Description of Artificial Sequence: Synthetic peptide
  Seed: AFLQYRRLRK (TYRP2_HUMAN)
AVLQYRRLRR

SEQ ID NO: 192829 - protein, 8 aa, Artificial Sequence
  Description of Artificial Sequence: Synthetic peptide
  Seed: SLDDYNHL (TYRP2_HUMAN)
SYDDYNHI

SEQ ID NO: 192830 - protein, 11 aa, Artificial Sequence
  Description of Artificial Sequence: Synthetic peptide
  Seed: YNMVPFFPPVT (TYRP2_HUMAN)
YVMVPFFPPVM

SEQ ID NO: 192831 - protein, 10 aa, Artificial Sequence
  Description of Artificial Sequence: Synthetic peptide
  Seed: REQFLGALDL (TYRP2_HUMAN)
RNQFLGALDM

SEQ ID NO: 192832 - protein, 9 aa, Artificial Sequence
  Description of Artificial Sequence: Synthetic peptide
  Seed: FVLLAFLQY (TYRP2_HUMAN)
FHLLAFLQF

SEQ ID NO: 192833 - protein, 10 aa, Artificial Sequence
  Description of Artificial Sequence: Synthetic peptide
  Seed: FSFRNALEGF (TYRP2_HUMAN)
FTFRNALEGM

SEQ ID NO: 192834 - protein, 9 aa, Artificial Sequence
  Description of Artificial Sequence: Synthetic peptide
  Seed: EQFLGALDL (TYRP2_HUMAN)
EHFLGALDY

SEQ ID NO: 192835 - protein, 9 aa, Artificial Sequence
  Description of Artificial Sequence: Synthetic peptide
  Seed: STFSFRNAL (TYRP2_HUMAN)
SAFSFRNAR

SEQ ID NO: 192836 - protein, 10 aa, Artificial Sequence
  Description of Artificial Sequence: Synthetic peptide
  Seed: FFQNSTFSFR (TYRP2_HUMAN)
FIQNSTFSFK

SEQ ID NO: 192837 - protein, 11 aa, Artificial Sequence
  Description of Artificial Sequence: Synthetic peptide
  Seed: TQPQFANCSVY (TYRP2_HUMAN)
TYPQFANCSVF

SEQ ID NO: 192838 - protein, 9 aa, Artificial Sequence
  Description of Artificial Sequence: Synthetic peptide
  Seed: LHSFTDAIF (TYRP2_HUMAN)
LMSFTDAIY

SEQ ID NO: 192839 - protein, 10 aa, Artificial Sequence
  Description of Artificial Sequence: Synthetic peptide
  Seed: SLDDYNHLVT (TYRP2_HUMAN)
SSDDYNHLVF

SEQ ID NO: 192840 - protein, 9 aa, Artificial Sequence
  Description of Artificial Sequence: Synthetic peptide
  Seed: HPDYVITTQ (TYRP2_HUMAN)
HADYVITTF

SEQ ID NO: 192841 - protein, 10 aa, Artificial Sequence
  Description of Artificial Sequence: Synthetic peptide
  Seed: RLRKGYTPLM (TYRP2_HUMAN)
RPRKGYTPLH

SEQ ID NO: 192842 - protein, 10 aa, Artificial Sequence
  Description of Artificial Sequence: Synthetic peptide
  Seed: SVYDFFVWLH (TYRP2_HUMAN)
SWYDFFVWLF

SEQ ID NO: 192843 - protein, 9 aa, Artificial Sequence
  Description of Artificial Sequence: Synthetic peptide
  Seed: VALVGLFVL (TYRP2_HUMAN)
VQLVGLFVA

SEQ ID NO: 192844 - protein, 9 aa, Artificial Sequence
  Description of Artificial Sequence: Synthetic peptide
  Seed: ANDPIFVVL (TYRP2_HUMAN)
ACDPIFVVI

SEQ ID NO: 192845 - protein, 9 aa, Artificial Sequence
  Description of Artificial Sequence: Synthetic peptide
  Seed: NGTYEGLLR (TYRP2_HUMAN)
NTTYEGLLK

SEQ ID NO: 192846 - protein, 10 aa, Artificial Sequence
  Description of Artificial Sequence: Synthetic peptide
  Seed: SHQGPAFVTW (TYRP2_HUMAN)
SHQGPAFVTV

SEQ ID NO: 192847 - protein, 11 aa, Artificial Sequence
  Description of Artificial Sequence: Synthetic peptide
  Seed: FFPPVTNEELF (TYRP2_HUMAN)
FIPPVTNEELY

SEQ ID NO: 192848 - protein, 10 aa, Artificial Sequence
  Description of Artificial Sequence: Synthetic peptide
  Seed: SQVMSLHNLV (TYRP2_HUMAN)
SMVMSLHNLV

SEQ ID NO: 192849 - protein, 9 aa, Artificial Sequence
  Description of Artificial Sequence: Synthetic peptide
  Seed: RVCMTVDSL (TYRP2_HUMAN)
RLCMTVDSF

SEQ ID NO: 192850 - protein, 10 aa, Artificial Sequence
  Description of Artificial Sequence: Synthetic peptide
  Seed: MSLHNLVHSF (TYRP2_HUMAN)
MGLHNLVHSW

SEQ ID NO: 192851 - protein, 9 aa, Artificial Sequence
  Description of Artificial Sequence: Synthetic peptide
  Seed: ARPDDPTLI (TYRP2_HUMAN)
AWPDDPTLL

SEQ ID NO: 192852 - protein, 10 aa, Artificial Sequence
  Description of Artificial Sequence: Synthetic peptide
  Seed: RRLRKGYTPL (TYRP2_HUMAN)
RVLRKGYTPM

SEQ ID NO: 192853 - protein, 9 aa, Artificial Sequence
  Description of Artificial Sequence: Synthetic peptide
  Seed: RLIGNESFA (TYRP2_HUMAN)
RMIGNESFI

SEQ ID NO: 192854 - protein, 9 aa, Artificial Sequence
  Description of Artificial Sequence: Synthetic peptide
  Seed: FTDAIFDEW (TYRP2_HUMAN)
FIDAIFDEL

SEQ ID NO: 192855 - protein, 9 aa, Artificial Sequence
  Description of Artificial Sequence: Synthetic peptide
  Seed: YVITTQHWL (TYRP2_HUMAN)
YLITTQHWC

SEQ ID NO: 192856 - protein, 10 aa, Artificial Sequence
  Description of Artificial Sequence: Synthetic peptide
  Seed: MSLHNLVHSF (TYRP2_HUMAN)
MRLHNLVHSF

SEQ ID NO: 192857 - protein, 10 aa, Artificial Sequence
  Description of Artificial Sequence: Synthetic peptide
  Seed: RLRKGYTPLM (TYRP2_HUMAN)
RFRKGYTPLV

SEQ ID NO: 192858 - protein, 9 aa, Artificial Sequence
  Description of Artificial Sequence: Synthetic peptide
  Seed: RKFFHRTCK (TYRP2_HUMAN)
RNFFHRTCK

SEQ ID NO: 192859 - protein, 10 aa, Artificial Sequence
  Description of Artificial Sequence: Synthetic peptide
  Seed: TSDQLGYSYA (TYRP2_HUMAN)
TVDQLGYSYY

SEQ ID NO: 192860 - protein, 9 aa, Artificial Sequence
  Description of Artificial Sequence: Synthetic peptide
  Seed: RLRKGYTPL (TYRP2_HUMAN)
RHRKGYTPY

SEQ ID NO: 192861 - protein, 9 aa, Artificial Sequence
  Description of Artificial Sequence: Synthetic peptide
  Seed: VIRQNIHSL (TYRP2_HUMAN)
VVRQNIHSL

SEQ ID NO: 192862 - protein, 9 aa, Artificial Sequence
  Description of Artificial Sequence: Synthetic peptide
  Seed: RQNIHSLSP (TYRP2_HUMAN)
RRNIHSLSF

SEQ ID NO: 192863 - protein, 10 aa, Artificial Sequence
  Description of Artificial Sequence: Synthetic peptide
  Seed: HSFLNGTNAL (TYRP2_HUMAN)
HVFLNGTNAV

SEQ ID NO: 192864 - protein, 9 aa, Artificial Sequence
  Description of Artificial Sequence: Synthetic peptide
  Seed: SLDDYNHLV (TYRP2_HUMAN)
SNDDYNHLM

SEQ ID NO: 192865 - protein, 9 aa, Artificial Sequence
  Description of Artificial Sequence: Synthetic peptide
  Seed: ALVGLFVLL (TYRP2_HUMAN)
AAVGLFVLV

SEQ ID NO: 192866 - protein, 9 aa, Artificial Sequence
  Description of Artificial Sequence: Synthetic peptide
  Seed: GTLVALVGL (TYRP2_HUMAN)
GILVALVGI

SEQ ID NO: 192867 - protein, 9 aa, Artificial Sequence
  Description of Artificial Sequence: Synthetic peptide
  Seed: NRMYNMVPF (TYRP2_HUMAN)
NWMYNMVPM

SEQ ID NO: 192868 - protein, 9 aa, Artificial Sequence
  Description of Artificial Sequence: Synthetic peptide
  Seed: KCTGNFAGY (TYRP2_HUMAN)
KVTGNFAGY

SEQ ID NO: 192869 - protein, 10 aa, Artificial Sequence
  Description of Artificial Sequence: Synthetic peptide
  Seed: RRLRKGYTPL (TYRP2_HUMAN)
RGLRKGYTPY

SEQ ID NO: 192870 - protein, 9 aa, Artificial Sequence
  Description of Artificial Sequence: Synthetic peptide
  Seed: LHSFTDAIF (TYRP2_HUMAN)
LKSFTDAIF

SEQ ID NO: 192871 - protein, 11 aa, Artificial Sequence
  Description of Artificial Sequence: Synthetic peptide
  Seed: RADTRPWSGPY (TYRP2_HUMAN)
RADTRPWSGPF

SEQ ID NO: 192872 - protein, 10 aa, Artificial Sequence
  Description of Artificial Sequence: Synthetic peptide
  Seed: AFLQYRRLRK (TYRP2_HUMAN)
AMLQYRRLRK

SEQ ID NO: 192873 - protein, 9 aa, Artificial Sequence
  Description of Artificial Sequence: Synthetic peptide
  Seed: SVYDFFVWL (TYRP2_HUMAN)
SMYDFFVWL

SEQ ID NO: 192874 - protein, 10 aa, Artificial Sequence
  Description of Artificial Sequence: Synthetic peptide
  Seed: YSYAIDLPVS (TYRP2_HUMAN)
YQYAIDLPVA

SEQ ID NO: 192875 - protein, 10 aa, Artificial Sequence
  Description of Artificial Sequence: Synthetic peptide
  Seed: FLLSCLGCKI (TYRP2_HUMAN)
FELSCLGCKV

SEQ ID NO: 192876 - protein, 11 aa, Artificial Sequence
  Description of Artificial Sequence: Synthetic peptide
  Seed: LLVVMGTLVAL (TYRP2_HUMAN)
LDVVMGTLVAV

SEQ ID NO: 192877 - protein, 10 aa, Artificial Sequence
  Description of Artificial Sequence: Synthetic peptide
  Seed: VALVGLFVLL (TYRP2_HUMAN)
VLLVGLFVLL

SEQ ID NO: 192878 - protein, 10 aa, Artificial Sequence
  Description of Artificial Sequence: Synthetic peptide
  Seed: LGPNGTQPQF (TYRP2_HUMAN)
LCPNGTQPQW

SEQ ID NO: 192879 - protein, 9 aa, Artificial Sequence
  Description of Artificial Sequence: Synthetic peptide
  Seed: DRELWPRKF (TYRP2_HUMAN)
DHELWPRKL

SEQ ID NO: 192880 - protein, 9 aa, Artificial Sequence
  Description of Artificial Sequence: Synthetic peptide
  Seed: VDSLVNKEC (TYRP2_HUMAN)
VESLVNKEF

SEQ ID NO: 192881 - protein, 11 aa, Artificial Sequence
  Description of Artificial Sequence: Synthetic peptide
  Seed: SLQKFDNPPFF (TYRP2_HUMAN)
SQQKFDNPPFF

SEQ ID NO: 192882 - protein, 9 aa, Artificial Sequence
  Description of Artificial Sequence: Synthetic peptide
  Seed: CERKKPPVI (TYRP2_HUMAN)
CIRKKPPVL

SEQ ID NO: 192883 - protein, 10 aa, Artificial Sequence
  Description of Artificial Sequence: Synthetic peptide
  Seed: DAIFDEWMKR (TYRP2_HUMAN)
DTIFDEWMKR

SEQ ID NO: 192884 - protein, 10 aa, Artificial Sequence
  Description of Artificial Sequence: Synthetic peptide
  Seed: LVVMGTLVAL (TYRP2_HUMAN)
LPVMGTLVAA

SEQ ID NO: 192885 - protein, 10 aa, Artificial Sequence
  Description of Artificial Sequence: Synthetic peptide
  Seed: LTSDQLGYSY (TYRP2_HUMAN)
LSSDQLGYSF

SEQ ID NO: 192886 - protein, 9 aa, Artificial Sequence
  Description of Artificial Sequence: Synthetic peptide
  Seed: LVHSFLNGT (TYRP2_HUMAN)
LMHSFLNGV

SEQ ID NO: 192887 - protein, 10 aa, Artificial Sequence
  Description of Artificial Sequence: Synthetic peptide
  Seed: KILPGAQGQF (TYRP2_HUMAN)
KTLPGAQGQK

SEQ ID NO: 192888 - protein, 10 aa, Artificial Sequence
  Description of Artificial Sequence: Synthetic peptide
  Seed: LGPGRPYRAI (TYRP2_HUMAN)
LWPGRPYRAL

SEQ ID NO: 192889 - protein, 10 aa, Artificial Sequence
  Description of Artificial Sequence: Synthetic peptide
  Seed: HRYHLLCLER (TYRP2_HUMAN)
HYYHLLCLER

SEQ ID NO: 192890 - protein, 10 aa, Artificial Sequence
  Description of Artificial Sequence: Synthetic peptide
  Seed: FLTSDQLGYS (TYRP2_HUMAN)
FITSDQLGYV

SEQ ID NO: 192891 - protein, 10 aa, Artificial Sequence
  Description of Artificial Sequence: Synthetic peptide
  Seed: LGPGRPYRAI (TYRP2_HUMAN)
LGPGRPYRAL

SEQ ID NO: 192892 - protein, 9 aa, Artificial Sequence
  Description of Artificial Sequence: Synthetic peptide
  Seed: HQGPAFVTW (TYRP2_HUMAN)
HSGPAFVTM

SEQ ID NO: 192893 - protein, 9 aa, Artificial Sequence
  Description of Artificial Sequence: Synthetic peptide
  Seed: LHSFTDAIF (TYRP2_HUMAN)
LASFTDAIY

SEQ ID NO: 192894 - protein, 10 aa, Artificial Sequence
  Description of Artificial Sequence: Synthetic peptide
  Seed: REQFLGALDL (TYRP2_HUMAN)
RDQFLGALDM

SEQ ID NO: 192895 - protein, 9 aa, Artificial Sequence
  Description of Artificial Sequence: Synthetic peptide
  Seed: ETPGWPTTL (TYRP2_HUMAN)
EWPGWPTTM

SEQ ID NO: 192896 - protein, 9 aa, Artificial Sequence
  Description of Artificial Sequence: Synthetic peptide
  Seed: METHLSSKR (TYRP2_HUMAN)
MSTHLSSKR

SEQ ID NO: 192897 - protein, 9 aa, Artificial Sequence
  Description of Artificial Sequence: Synthetic peptide
  Seed: QEREQFLGA (TYRP2_HUMAN)
QEREQFLGF

SEQ ID NO: 192898 - protein, 10 aa, Artificial Sequence
  Description of Artificial Sequence: Synthetic peptide
  Seed: EETPGWPTTL (TYRP2_HUMAN)
EETPGWPTTF

SEQ ID NO: 192899 - protein, 10 aa, Artificial Sequence
  Description of Artificial Sequence: Synthetic peptide
  Seed: NPPFFQNSTF (TYRP2_HUMAN)
NTPFFQNSTY

SEQ ID NO: 192900 - protein, 8 aa, Artificial Sequence
  Description of Artificial Sequence: Synthetic peptide
  Seed: AIDLPVSV (TYRP2_HUMAN)
AFDLPVSV

SEQ ID NO: 192901 - protein, 9 aa, Artificial Sequence
  Description of Artificial Sequence: Synthetic peptide
  Seed: YAIDLPVSV (TYRP2_HUMAN)
YSIDLPVSF

SEQ ID NO: 192902 - protein, 9 aa, Artificial Sequence
  Description of Artificial Sequence: Synthetic peptide
  Seed: LRKGYTPLM (TYRP2_HUMAN)
LKKGYTPLM

SEQ ID NO: 192903 - protein, 9 aa, Artificial Sequence
  Description of Artificial Sequence: Synthetic peptide
  Seed: YSYAIDLPV (TYRP2_HUMAN)
YYYAIDLPY

SEQ ID NO: 192904 - protein, 10 aa, Artificial Sequence
  Description of Artificial Sequence: Synthetic peptide
  Seed: MSPLWWGFLL (TYRP2_HUMAN)
MFPLWWGFLA

SEQ ID NO: 192905 - protein, 10 aa, Artificial Sequence
  Description of Artificial Sequence: Synthetic peptide
  Seed: CMTVDSLVNK (TYRP2_HUMAN)
CVTVDSLVNR

SEQ ID NO: 192906 - protein, 9 aa, Artificial Sequence
  Description of Artificial Sequence: Synthetic peptide
  Seed: HQGPAFVTW (TYRP2_HUMAN)
HAGPAFVTI

SEQ ID NO: 192907 - protein, 10 aa, Artificial Sequence
  Description of Artificial Sequence: Synthetic peptide
  Seed: MGRNSMKLPT (TYRP2_HUMAN)
MTRNSMKLPV

SEQ ID NO: 192908 - protein, 9 aa, Artificial Sequence
  Description of Artificial Sequence: Synthetic peptide
  Seed: YDFFVWLHY (TYRP2_HUMAN)
YWFFVWLHF

SEQ ID NO: 192909 - protein, 10 aa, Artificial Sequence
  Description of Artificial Sequence: Synthetic peptide
  Seed: LGPGRPYRAI (TYRP2_HUMAN)
LSPGRPYRAL

SEQ ID NO: 192910 - protein, 10 aa, Artificial Sequence
  Description of Artificial Sequence: Synthetic peptide
  Seed: RELWPRKFFH (TYRP2_HUMAN)
RSLWPRKFFK

SEQ ID NO: 192911 - protein, 9 aa, Artificial Sequence
  Description of Artificial Sequence: Synthetic peptide
  Seed: VMGTLVALV (TYRP2_HUMAN)
VIGTLVALI

SEQ ID NO: 192912 - protein, 10 aa, Artificial Sequence
  Description of Artificial Sequence: Synthetic peptide
  Seed: DTLLGPGRPY (TYRP2_HUMAN)
DTLLGPGRPK

SEQ ID NO: 192913 - protein, 10 aa, Artificial Sequence
  Description of Artificial Sequence: Synthetic peptide
  Seed: ITTQHWLGLL (TYRP2_HUMAN)
ISTQHWLGLY

SEQ ID NO: 192914 - protein, 10 aa, Artificial Sequence
  Description of Artificial Sequence: Synthetic peptide
  Seed: ADTRPWSGPY (TYRP2_HUMAN)
AETRPWSGPK

SEQ ID NO: 192915 - protein, 9 aa, Artificial Sequence
  Description of Artificial Sequence: Synthetic peptide
  Seed: FANCSVYDF (TYRP2_HUMAN)
FTNCSVYDY

SEQ ID NO: 192916 - protein, 9 aa, Artificial Sequence
  Description of Artificial Sequence: Synthetic peptide
  Seed: RQNIHSLSP (TYRP2_HUMAN)
RANIHSLSL

SEQ ID NO: 192917 - protein, 10 aa, Artificial Sequence
  Description of Artificial Sequence: Synthetic peptide
  Seed: RLRKGYTPLM (TYRP2_HUMAN)
RVRKGYTPLN

SEQ ID NO: 192918 - protein, 10 aa, Artificial Sequence
  Description of Artificial Sequence: Synthetic peptide
  Seed: ELAPIGHNRM (TYRP2_HUMAN)
ELAPIGHNRK

SEQ ID NO: 192919 - protein, 11 aa, Artificial Sequence
  Description of Artificial Sequence: Synthetic peptide
  Seed: RNSRFSSWETV (TYRP2_HUMAN)
RQSRFSSWETL

SEQ ID NO: 192920 - protein, 9 aa, Artificial Sequence
  Description of Artificial Sequence: Synthetic peptide
  Seed: RMYNMVPFF (TYRP2_HUMAN)
RSYNMVPFR

SEQ ID NO: 192921 - protein, 9 aa, Artificial Sequence
  Description of Artificial Sequence: Synthetic peptide
  Seed: SFLNGTNAL (TYRP2_HUMAN)
SRLNGTNAL

SEQ ID NO: 192922 - protein, 10 aa, Artificial Sequence
  Description of Artificial Sequence: Synthetic peptide
  Seed: RMYNMVPFFP (TYRP2_HUMAN)
RIYNMVPFFL

SEQ ID NO: 192923 - protein, 11 aa, Artificial Sequence
  Description of Artificial Sequence: Synthetic peptide
  Seed: RNSRFSSWETV (TYRP2_HUMAN)
RYSRFSSWETV

SEQ ID NO: 192924 - protein, 11 aa, Artificial Sequence
  Description of Artificial Sequence: Synthetic peptide
  Seed: RADTRPWSGPY (TYRP2_HUMAN)
RCDTRPWSGPK

SEQ ID NO: 192925 - protein, 9 aa, Artificial Sequence
  Description of Artificial Sequence: Synthetic peptide
  Seed: SRFSSWETV (TYRP2_HUMAN)
SNFSSWETY

SEQ ID NO: 192926 - protein, 10 aa, Artificial Sequence
  Description of Artificial Sequence: Synthetic peptide
  Seed: LVVMGTLVAL (TYRP2_HUMAN)
LVVMGTLVAY

SEQ ID NO: 192927 - protein, 10 aa, Artificial Sequence
  Description of Artificial Sequence: Synthetic peptide
  Seed: LTSDQLGYSY (TYRP2_HUMAN)
LMSDQLGYSF

SEQ ID NO: 192928 - protein, 9 aa, Artificial Sequence
  Description of Artificial Sequence: Synthetic peptide
  Seed: NALEGFDKA (TYRP2_HUMAN)
NLLEGFDKV

SEQ ID NO: 192929 - protein, 10 aa, Artificial Sequence
  Description of Artificial Sequence: Synthetic peptide
  Seed: HRYHLLCLER (TYRP2_HUMAN)
HQYHLLCLER

SEQ ID NO: 192930 - protein, 11 aa, Artificial Sequence
  Description of Artificial Sequence: Synthetic peptide
  Seed: QFANCSVYDFF (TYRP2_HUMAN)
QYANCSVYDFW

SEQ ID NO: 192931 - protein, 9 aa, Artificial Sequence
  Description of Artificial Sequence: Synthetic peptide
  Seed: YDFFVWLHY (TYRP2_HUMAN)
YYFFVWLHY

SEQ ID NO: 192932 - protein, 9 aa, Artificial Sequence
  Description of Artificial Sequence: Synthetic peptide
  Seed: YYSVRDTLL (TYRP2_HUMAN)
YSSVRDTLL

SEQ ID NO: 192933 - protein, 9 aa, Artificial Sequence
  Description of Artificial Sequence: Synthetic peptide
  Seed: FSHQGPAFV (TYRP2_HUMAN)
FTHQGPAFA

SEQ ID NO: 192934 - protein, 9 aa, Artificial Sequence
  Description of Artificial Sequence: Synthetic peptide
  Seed: WPRKFFHRT (TYRP2_HUMAN)
WPRKFFHRF

SEQ ID NO: 192935 - protein, 11 aa, Artificial Sequence
  Description of Artificial Sequence: Synthetic peptide
  Seed: YNMVPFFPPVT (TYRP2_HUMAN)
YQMVPFFPPVE

SEQ ID NO: 192936 - protein, 8 aa, Artificial Sequence
  Description of Artificial Sequence: Synthetic peptide
  Seed: VMGTLVAL (TYRP2_HUMAN)
VAGTLVAM

SEQ ID NO: 192937 - protein, 10 aa, Artificial Sequence
  Description of Artificial Sequence: Synthetic peptide
  Seed: RRLRKGYTPL (TYRP2_HUMAN)
RYLRKGYTPV

SEQ ID NO: 192938 - protein, 11 aa, Artificial Sequence
  Description of Artificial Sequence: Synthetic peptide
  Seed: YSYAIDLPVSV (TYRP2_HUMAN)
YQYAIDLPVSV

SEQ ID NO: 192939 - protein, 9 aa, Artificial Sequence
  Description of Artificial Sequence: Synthetic peptide
  Seed: HQGPAFVTW (TYRP2_HUMAN)
HEGPAFVTY

SEQ ID NO: 192940 - protein, 9 aa, Artificial Sequence
  Description of Artificial Sequence: Synthetic peptide
  Seed: ETPGWPTTL (TYRP2_HUMAN)
EIPGWPTTF

SEQ ID NO: 192941 - protein, 9 aa, Artificial Sequence
  Description of Artificial Sequence: Synthetic peptide
  Seed: FANCSVYDF (TYRP2_HUMAN)
FFNCSVYDY

SEQ ID NO: 192942 - protein, 9 aa, Artificial Sequence
  Description of Artificial Sequence: Synthetic peptide
  Seed: RTCKCTGNF (TYRP2_HUMAN)
RMCKCTGNW

SEQ ID NO: 192943 - protein, 10 aa, Artificial Sequence
  Description of Artificial Sequence: Synthetic peptide
  Seed: RLRKGYTPLM (TYRP2_HUMAN)
RLRKGYTPLK

SEQ ID NO: 192944 - protein, 11 aa, Artificial Sequence
  Description of Artificial Sequence: Synthetic peptide
  Seed: KADGTLDSQVM (TYRP2_HUMAN)
KADGTLDSQVL

SEQ ID NO: 192945 - protein, 8 aa, Artificial Sequence
  Description of Artificial Sequence: Synthetic peptide
  Seed: AIDLPVSV (TYRP2_HUMAN)
AWDLPVSM

SEQ ID NO: 192946 - protein, 11 aa, Artificial Sequence
  Description of Artificial Sequence: Synthetic peptide
  Seed: FVVLHSFTDAI (TYRP2_HUMAN)
FPVLHSFTDAI

SEQ ID NO: 192947 - protein, 9 aa, Artificial Sequence
  Description of Artificial Sequence: Synthetic peptide
  Seed: FLNGTNALP (TYRP2_HUMAN)
FLNGTNALV

SEQ ID NO: 192948 - protein, 9 aa, Artificial Sequence
  Description of Artificial Sequence: Synthetic peptide
  Seed: YSYAIDLPV (TYRP2_HUMAN)
YTYAIDLPL

SEQ ID NO: 192949 - protein, 10 aa, Artificial Sequence
  Description of Artificial Sequence: Synthetic peptide
  Seed: MTVDSLVNKE (TYRP2_HUMAN)
MVVDSLVNKK

SEQ ID NO: 192950 - protein, 10 aa, Artificial Sequence
  Description of Artificial Sequence: Synthetic peptide
  Seed: GTLDSQVMSL (TYRP2_HUMAN)
GMLDSQVMSI

SEQ ID NO: 192951 - protein, 10 aa, Artificial Sequence
  Description of Artificial Sequence: Synthetic peptide
  Seed: LVVMGTLVAL (TYRP2_HUMAN)
LVVMGTLVAI

SEQ ID NO: 192952 - protein, 11 aa, Artificial Sequence
  Description of Artificial Sequence: Synthetic peptide
  Seed: LLVVMGTLVAL (TYRP2_HUMAN)
LMVVMGTLVAV

SEQ ID NO: 192953 - protein, 9 aa, Artificial Sequence
  Description of Artificial Sequence: Synthetic peptide
  Seed: SFLNGTNAL (TYRP2_HUMAN)
SYLNGTNAW

SEQ ID NO: 192954 - protein, 9 aa, Artificial Sequence
  Description of Artificial Sequence: Synthetic peptide
  Seed: VTNEELFLT (TYRP2_HUMAN)
VINEELFLL

SEQ ID NO: 192955 - protein, 8 aa, Artificial Sequence
  Description of Artificial Sequence: Synthetic peptide
  Seed: SLDDYNHL (TYRP2_HUMAN)
SADDYNHV

SEQ ID NO: 192956 - protein, 9 aa, Artificial Sequence
  Description of Artificial Sequence: Synthetic peptide
  Seed: IFDEWMKRF (TYRP2_HUMAN)
ISDEWMKRY

SEQ ID NO: 192957 - protein, 10 aa, Artificial Sequence
  Description of Artificial Sequence: Synthetic peptide
  Seed: MSLHNLVHSF (TYRP2_HUMAN)
MSLHNLVHSW

SEQ ID NO: 192958 - protein, 10 aa, Artificial Sequence
  Description of Artificial Sequence: Synthetic peptide
  Seed: RNQMGRNSMK (TYRP2_HUMAN)
RFQMGRNSMR

SEQ ID NO: 192959 - protein, 10 aa, Artificial Sequence
  Description of Artificial Sequence: Synthetic peptide
  Seed: KADGTLDSQV (TYRP2_HUMAN)
KSDGTLDSQL

SEQ ID NO: 192960 - protein, 9 aa, Artificial Sequence
  Description of Artificial Sequence: Synthetic peptide
  Seed: SRFSSWETV (TYRP2_HUMAN)
SQFSSWETI

SEQ ID NO: 192961 - protein, 9 aa, Artificial Sequence
  Description of Artificial Sequence: Synthetic peptide
  Seed: TLDSQVMSL (TYRP2_HUMAN)
TRDSQVMSI

SEQ ID NO: 192962 - protein, 9 aa, Artificial Sequence
  Description of Artificial Sequence: Synthetic peptide
  Seed: GTYEGLLRR (TYRP2_HUMAN)
GIYEGLLRK

SEQ ID NO: 192963 - protein, 11 aa, Artificial Sequence
  Description of Artificial Sequence: Synthetic peptide
  Seed: YTPLMETHLSS (TYRP2_HUMAN)
YYPLMETHLSM

SEQ ID NO: 192964 - protein, 10 aa, Artificial Sequence
  Description of Artificial Sequence: Synthetic peptide
  Seed: SPLWWGFLLS (TYRP2_HUMAN)
SMLWWGFLLG

SEQ ID NO: 192965 - protein, 9 aa, Artificial Sequence
  Description of Artificial Sequence: Synthetic peptide
  Seed: VTWHRYHLL (TYRP2_HUMAN)
VQWHRYHLR

SEQ ID NO: 192966 - protein, 9 aa, Artificial Sequence
  Description of Artificial Sequence: Synthetic peptide
  Seed: HPDYVITTQ (TYRP2_HUMAN)
HSDYVITTY

SEQ ID NO: 192967 - protein, 11 aa, Artificial Sequence
  Description of Artificial Sequence: Synthetic peptide
  Seed: MYNMVPFFPPV (TYRP2_HUMAN)
MNNMVPFFPPI

SEQ ID NO: 192968 - protein, 9 aa, Artificial Sequence
  Description of Artificial Sequence: Synthetic peptide
  Seed: RTCKCTGNF (TYRP2_HUMAN)
RLCKCTGNF

SEQ ID NO: 192969 - protein, 9 aa, Artificial Sequence
  Description of Artificial Sequence: Synthetic peptide
  Seed: LERDLQRLI (TYRP2_HUMAN)
LQRDLQRLV

SEQ ID NO: 192970 - protein, 9 aa, Artificial Sequence
  Description of Artificial Sequence: Synthetic peptide
  Seed: TLDSQVMSL (TYRP2_HUMAN)
TMDSQVMSV

SEQ ID NO: 192971 - protein, 10 aa, Artificial Sequence
  Description of Artificial Sequence: Synthetic peptide
  Seed: NPPFFQNSTF (TYRP2_HUMAN)
NHPFFQNSTW

SEQ ID NO: 192972 - protein, 9 aa, Artificial Sequence
  Description of Artificial Sequence: Synthetic peptide
  Seed: AIFDEWMKR (TYRP2_HUMAN)
AVFDEWMKK

SEQ ID NO: 192973 - protein, 9 aa, Artificial Sequence
  Description of Artificial Sequence: Synthetic peptide
  Seed: RTCKCTGNF (TYRP2_HUMAN)
RMCKCTGNF

SEQ ID NO: 192974 - protein, 8 aa, Artificial Sequence
  Description of Artificial Sequence: Synthetic peptide
  Seed: RPDDPTLI (TYRP2_HUMAN)
RVDDPTLL

SEQ ID NO: 192975 - protein, 9 aa, Artificial Sequence
  Description of Artificial Sequence: Synthetic peptide
  Seed: GNESFALPY (TYRP2_HUMAN)
GTESFALPY

SEQ ID NO: 192976 - protein, 10 aa, Artificial Sequence
  Description of Artificial Sequence: Synthetic peptide
  Seed: LHYYSVRDTL (TYRP2_HUMAN)
LQYYSVRDTY

SEQ ID NO: 192977 - protein, 11 aa, Artificial Sequence
  Description of Artificial Sequence: Synthetic peptide
  Seed: RNSRFSSWETV (TYRP2_HUMAN)
RKSRFSSWETF

SEQ ID NO: 192978 - protein, 9 aa, Artificial Sequence
  Description of Artificial Sequence: Synthetic peptide
  Seed: HYYSVRDTL (TYRP2_HUMAN)
HIYSVRDTY

SEQ ID NO: 192979 - protein, 9 aa, Artificial Sequence
  Description of Artificial Sequence: Synthetic peptide
  Seed: VVMGTLVAL (TYRP2_HUMAN)
VQMGTLVAF

SEQ ID NO: 192980 - protein, 9 aa, Artificial Sequence
  Description of Artificial Sequence: Synthetic peptide
  Seed: ANDPIFVVL (TYRP2_HUMAN)
AMDPIFVVA

SEQ ID NO: 192981 - protein, 9 aa, Artificial Sequence
  Description of Artificial Sequence: Synthetic peptide
  Seed: MTVDSLVNK (TYRP2_HUMAN)
MGVDSLVNY

SEQ ID NO: 192982 - protein, 10 aa, Artificial Sequence
  Description of Artificial Sequence: Synthetic peptide
  Seed: RNSRFSSWET (TYRP2_HUMAN)
RNSRFSSWEK

SEQ ID NO: 192983 - protein, 11 aa, Artificial Sequence
  Description of Artificial Sequence: Synthetic peptide
  Seed: RADTRPWSGPY (TYRP2_HUMAN)
RQDTRPWSGPK

SEQ ID NO: 192984 - protein, 9 aa, Artificial Sequence
  Description of Artificial Sequence: Synthetic peptide
  Seed: NSMKLPTLK (TYRP2_HUMAN)
NIMKLPTLR

SEQ ID NO: 192985 - protein, 11 aa, Artificial Sequence
  Description of Artificial Sequence: Synthetic peptide
  Seed: YNMVPFFPPVT (TYRP2_HUMAN)
YMMVPFFPPVT

SEQ ID NO: 192986 - protein, 10 aa, Artificial Sequence
  Description of Artificial Sequence: Synthetic peptide
  Seed: RNSRFSSWET (TYRP2_HUMAN)
RPSRFSSWEM

SEQ ID NO: 192987 - protein, 9 aa, Artificial Sequence
  Description of Artificial Sequence: Synthetic peptide
  Seed: RLRKGYTPL (TYRP2_HUMAN)
RQRKGYTPM

SEQ ID NO: 192988 - protein, 9 aa, Artificial Sequence
  Description of Artificial Sequence: Synthetic peptide
  Seed: RLRKGYTPL (TYRP2_HUMAN)
RTRKGYTPI

SEQ ID NO: 192989 - protein, 10 aa, Artificial Sequence
  Description of Artificial Sequence: Synthetic peptide
  Seed: QPQFANCSVY (TYRP2_HUMAN)
QFQFANCSVF

SEQ ID NO: 192990 - protein, 11 aa, Artificial Sequence
  Description of Artificial Sequence: Synthetic peptide
  Seed: FSHQGPAFVTW (TYRP2_HUMAN)
FSHQGPAFVTF

SEQ ID NO: 192991 - protein, 9 aa, Artificial Sequence
  Description of Artificial Sequence: Synthetic peptide
  Seed: ALPYWNFAT (TYRP2_HUMAN)
AVPYWNFAL

SEQ ID NO: 192992 - protein, 10 aa, Artificial Sequence
  Description of Artificial Sequence: Synthetic peptide
  Seed: METHLSSKRY (TYRP2_HUMAN)
MTTHLSSKRW

SEQ ID NO: 192993 - protein, 9 aa, Artificial Sequence
  Description of Artificial Sequence: Synthetic peptide
  Seed: WMKRFNPPA (TYRP2_HUMAN)
WLKRFNPPV

SEQ ID NO: 192994 - protein, 9 aa, Artificial Sequence
  Description of Artificial Sequence: Synthetic peptide
  Seed: DQLGYSYAI (TYRP2_HUMAN)
DALGYSYAI

SEQ ID NO: 192995 - protein, 9 aa, Artificial Sequence
  Description of Artificial Sequence: Synthetic peptide
  Seed: FVWLHYYSV (TYRP2_HUMAN)
FMWLHYYSG

SEQ ID NO: 192996 - protein, 9 aa, Artificial Sequence
  Description of Artificial Sequence: Synthetic peptide
  Seed: SLHNLVHSF (TYRP2_HUMAN)
SIHNLVHSA

SEQ ID NO: 192997 - protein, 9 aa, Artificial Sequence
  Description of Artificial Sequence: Synthetic peptide
  Seed: AIFDEWMKR (TYRP2_HUMAN)
AGFDEWMKY

SEQ ID NO: 192998 - protein, 9 aa, Artificial Sequence
  Description of Artificial Sequence: Synthetic peptide
  Seed: MSPLWWGFL (TYRP2_HUMAN)
MYPLWWGFM

SEQ ID NO: 192999 - protein, 11 aa, Artificial Sequence
  Description of Artificial Sequence: Synthetic peptide
  Seed: VVMGTLVALVG (TYRP2_HUMAN)
VTMGTLVALVV

SEQ ID NO: 193000 - protein, 9 aa, Artificial Sequence
  Description of Artificial Sequence: Synthetic peptide
  Seed: ISRNSRFSS (TYRP2_HUMAN)
ITRNSRFSP

SEQ ID NO: 193001 - protein, 10 aa, Artificial Sequence
  Description of Artificial Sequence: Synthetic peptide
  Seed: FFPPVTNEEL (TYRP2_HUMAN)
FRPPVTNEEL

SEQ ID NO: 193002 - protein, 10 aa, Artificial Sequence
  Description of Artificial Sequence: Synthetic peptide
  Seed: METHLSSKRY (TYRP2_HUMAN)
MMTHLSSKRF

SEQ ID NO: 193003 - protein, 11 aa, Artificial Sequence
  Description of Artificial Sequence: Synthetic peptide
  Seed: FFPPVTNEELF (TYRP2_HUMAN)
FDPPVTNEELY

SEQ ID NO: 193004 - protein, 9 aa, Artificial Sequence
  Description of Artificial Sequence: Synthetic peptide
  Seed: VIRQNIHSL (TYRP2_HUMAN)
VSRQNIHSF

SEQ ID NO: 193005 - protein, 10 aa, Artificial Sequence
  Description of Artificial Sequence: Synthetic peptide
  Seed: FVLLAFLQYR (TYRP2_HUMAN)
FLLLAFLQYR

SEQ ID NO: 193006 - protein, 10 aa, Artificial Sequence
  Description of Artificial Sequence: Synthetic peptide
  Seed: SDQLGYSYAI (TYRP2_HUMAN)
SPQLGYSYAL

SEQ ID NO: 193007 - protein, 9 aa, Artificial Sequence
  Description of Artificial Sequence: Synthetic peptide
  Seed: AIFDEWMKR (TYRP2_HUMAN)
AAFDEWMKV

SEQ ID NO: 193008 - protein, 8 aa, Artificial Sequence
  Description of Artificial Sequence: Synthetic peptide
  Seed: FSHQGPAF (TYRP2_HUMAN)
FQHQGPAF

SEQ ID NO: 193009 - protein, 10 aa, Artificial Sequence
  Description of Artificial Sequence: Synthetic peptide
  Seed: RLRKGYTPLM (TYRP2_HUMAN)
RQRKGYTPLM

SEQ ID NO: 193010 - protein, 10 aa, Artificial Sequence
  Description of Artificial Sequence: Synthetic peptide
  Seed: SLQKFDNPPF (TYRP2_HUMAN)
SDQKFDNPPY

SEQ ID NO: 193011 - protein, 9 aa, Artificial Sequence
  Description of Artificial Sequence: Synthetic peptide
  Seed: FLTSDQLGY (TYRP2_HUMAN)
FPTSDQLGM

SEQ ID NO: 193012 - protein, 9 aa, Artificial Sequence
  Description of Artificial Sequence: Synthetic peptide
  Seed: HSAANDPIF (TYRP2_HUMAN)
HVAANDPIF

SEQ ID NO: 193013 - protein, 9 aa, Artificial Sequence
  Description of Artificial Sequence: Synthetic peptide
  Seed: NALEGFDKA (TYRP2_HUMAN)
NLLEGFDKM

SEQ ID NO: 193014 - protein, 10 aa, Artificial Sequence
  Description of Artificial Sequence: Synthetic peptide
  Seed: FFVWLHYYSV (TYRP2_HUMAN)
FIVWLHYYSL

SEQ ID NO: 193015 - protein, 9 aa, Artificial Sequence
  Description of Artificial Sequence: Synthetic peptide
  Seed: RTCKCTGNF (TYRP2_HUMAN)
RMCKCTGNK

SEQ ID NO: 193016 - protein, 9 aa, Artificial Sequence
  Description of Artificial Sequence: Synthetic peptide
  Seed: SVYDFFVWL (TYRP2_HUMAN)
SIYDFFVWV

SEQ ID NO: 193017 - protein, 8 aa, Artificial Sequence
  Description of Artificial Sequence: Synthetic peptide
  Seed: ANDPIFVV (TYRP2_HUMAN)
AADPIFVI

SEQ ID NO: 193018 - protein, 9 aa, Artificial Sequence
  Description of Artificial Sequence: Synthetic peptide
  Seed: YAIDLPVSV (TYRP2_HUMAN)
YLIDLPVSR

SEQ ID NO: 193019 - protein, 9 aa, Artificial Sequence
  Description of Artificial Sequence: Synthetic peptide
  Seed: HQGPAFVTW (TYRP2_HUMAN)
HVGPAFVTF

SEQ ID NO: 193020 - protein, 8 aa, Artificial Sequence
  Description of Artificial Sequence: Synthetic peptide
  Seed: VMGTLVAL (TYRP2_HUMAN)
VQGTLVAI

SEQ ID NO: 193021 - protein, 9 aa, Artificial Sequence
  Description of Artificial Sequence: Synthetic peptide
  Seed: YSYAIDLPV (TYRP2_HUMAN)
YIYAIDLPT

SEQ ID NO: 193022 - protein, 9 aa, Artificial Sequence
  Description of Artificial Sequence: Synthetic peptide
  Seed: ANDPIFVVL (TYRP2_HUMAN)
AGDPIFVVI

SEQ ID NO: 193023 - protein, 9 aa, Artificial Sequence
  Description of Artificial Sequence: Synthetic peptide
  Seed: LLAFLQYRR (TYRP2_HUMAN)
LTAFLQYRR

SEQ ID NO: 193024 - protein, 9 aa, Artificial Sequence
  Description of Artificial Sequence: Synthetic peptide
  Seed: RNQDDRELW (TYRP2_HUMAN)
REQDDRELY

SEQ ID NO: 193025 - protein, 9 aa, Artificial Sequence
  Description of Artificial Sequence: Synthetic peptide
  Seed: RPWSGPYIL (TYRP2_HUMAN)
RQWSGPYIL

SEQ ID NO: 193026 - protein, 9 aa, Artificial Sequence
  Description of Artificial Sequence: Synthetic peptide
  Seed: YAIDLPVSV (TYRP2_HUMAN)
YLIDLPVSF

SEQ ID NO: 193027 - protein, 9 aa, Artificial Sequence
  Description of Artificial Sequence: Synthetic peptide
  Seed: FFPPVTNEE (TYRP2_HUMAN)
FYPPVTNEF

SEQ ID NO: 193028 - protein, 8 aa, Artificial Sequence
  Description of Artificial Sequence: Synthetic peptide
  Seed: LLAFLQYR (TYRP2_HUMAN)
LMAFLQYR

SEQ ID NO: 193029 - protein, 10 aa, Artificial Sequence
  Description of Artificial Sequence: Synthetic peptide
  Seed: SLDDYNHLVT (TYRP2_HUMAN)
SMDDYNHLVM

SEQ ID NO: 193030 - protein, 9 aa, Artificial Sequence
  Description of Artificial Sequence: Synthetic peptide
  Seed: VHPDYVITT (TYRP2_HUMAN)
VSPDYVITM

SEQ ID NO: 193031 - protein, 9 aa, Artificial Sequence
  Description of Artificial Sequence: Synthetic peptide
  Seed: TLDSQVMSL (TYRP2_HUMAN)
TSDSQVMSL

SEQ ID NO: 193032 - protein, 10 aa, Artificial Sequence
  Description of Artificial Sequence: Synthetic peptide
  Seed: MSPLWWGFLL (TYRP2_HUMAN)
MCPLWWGFLM

SEQ ID NO: 193033 - protein, 10 aa, Artificial Sequence
  Description of Artificial Sequence: Synthetic peptide
  Seed: GQFPRVCMTV (TYRP2_HUMAN)
GMFPRVCMTY

SEQ ID NO: 193034 - protein, 11 aa, Artificial Sequence
  Description of Artificial Sequence: Synthetic peptide
  Seed: YNMVPFFPPVT (TYRP2_HUMAN)
YLMVPFFPPVG

SEQ ID NO: 193035 - protein, 9 aa, Artificial Sequence
  Description of Artificial Sequence: Synthetic peptide
  Seed: IFDEWMKRF (TYRP2_HUMAN)
IFDEWMKRI

SEQ ID NO: 193036 - protein, 10 aa, Artificial Sequence
  Description of Artificial Sequence: Synthetic peptide
  Seed: SLQKFDNPPF (TYRP2_HUMAN)
STQKFDNPPY

SEQ ID NO: 193037 - protein, 11 aa, Artificial Sequence
  Description of Artificial Sequence: Synthetic peptide
  Seed: YTPLMETHLSS (TYRP2_HUMAN)
YHPLMETHLST

SEQ ID NO: 193038 - protein, 9 aa, Artificial Sequence
  Description of Artificial Sequence: Synthetic peptide
  Seed: STFSFRNAL (TYRP2_HUMAN)
STFSFRNAW

SEQ ID NO: 193039 - protein, 10 aa, Artificial Sequence
  Description of Artificial Sequence: Synthetic peptide
  Seed: ELAPIGHNRM (TYRP2_HUMAN)
EVAPIGHNRS

SEQ ID NO: 193040 - protein, 11 aa, Artificial Sequence
  Description of Artificial Sequence: Synthetic peptide
  Seed: FFQNSTFSFRN (TYRP2_HUMAN)
FLQNSTFSFRR

SEQ ID NO: 193041 - protein, 9 aa, Artificial Sequence
  Description of Artificial Sequence: Synthetic peptide
  Seed: SRNSRFSSW (TYRP2_HUMAN)
SNNSRFSSF

SEQ ID NO: 193042 - protein, 9 aa, Artificial Sequence
  Description of Artificial Sequence: Synthetic peptide
  Seed: VVMGTLVAL (TYRP2_HUMAN)
VIMGTLVAM

SEQ ID NO: 193043 - protein, 9 aa, Artificial Sequence
  Description of Artificial Sequence: Synthetic peptide
  Seed: WPTTLLVVM (TYRP2_HUMAN)
WPTTLLVVY

SEQ ID NO: 193044 - protein, 9 aa, Artificial Sequence
  Description of Artificial Sequence: Synthetic peptide
  Seed: FFQNSTFSF (TYRP2_HUMAN)
FFQNSTFSI

SEQ ID NO: 193045 - protein, 10 aa, Artificial Sequence
  Description of Artificial Sequence: Synthetic peptide
  Seed: YNMVPFFPPV (TYRP2_HUMAN)
YSMVPFFPPL

SEQ ID NO: 193046 - protein, 9 aa, Artificial Sequence
  Description of Artificial Sequence: Synthetic peptide
  Seed: STFSFRNAL (TYRP2_HUMAN)
SWFSFRNAF

SEQ ID NO: 193047 - protein, 9 aa, Artificial Sequence
  Description of Artificial Sequence: Synthetic peptide
  Seed: QFPRVCMTV (TYRP2_HUMAN)
QFPRVCMTI

SEQ ID NO: 193048 - protein, 10 aa, Artificial Sequence
  Description of Artificial Sequence: Synthetic peptide
  Seed: FLLSCLGCKI (TYRP2_HUMAN)
FDLSCLGCKV

SEQ ID NO: 193049 - protein, 9 aa, Artificial Sequence
  Description of Artificial Sequence: Synthetic peptide
  Seed: AIFDEWMKR (TYRP2_HUMAN)
AYFDEWMKR

SEQ ID NO: 193050 - protein, 9 aa, Artificial Sequence
  Description of Artificial Sequence: Synthetic peptide
  Seed: LHSFTDAIF (TYRP2_HUMAN)
LRSFTDAIY

SEQ ID NO: 193051 - protein, 11 aa, Artificial Sequence
  Description of Artificial Sequence: Synthetic peptide
  Seed: MYNMVPFFPPV (TYRP2_HUMAN)
MLNMVPFFPPM

SEQ ID NO: 193052 - protein, 8 aa, Artificial Sequence
  Description of Artificial Sequence: Synthetic peptide
  Seed: FSHQGPAF (TYRP2_HUMAN)
FAHQGPAL

SEQ ID NO: 193053 - protein, 9 aa, Artificial Sequence
  Description of Artificial Sequence: Synthetic peptide
  Seed: FVWLHYYSV (TYRP2_HUMAN)
FAWLHYYSY

SEQ ID NO: 193054 - protein, 10 aa, Artificial Sequence
  Description of Artificial Sequence: Synthetic peptide
  Seed: NCSVYDFFVW (TYRP2_HUMAN)
NQSVYDFFVW

SEQ ID NO: 193055 - protein, 9 aa, Artificial Sequence
  Description of Artificial Sequence: Synthetic peptide
  Seed: RLRKGYTPL (TYRP2_HUMAN)
RSRKGYTPY

SEQ ID NO: 193056 - protein, 9 aa, Artificial Sequence
  Description of Artificial Sequence: Synthetic peptide
  Seed: NMVPFFPPV (TYRP2_HUMAN)
NAVPFFPPF

SEQ ID NO: 193057 - protein, 9 aa, Artificial Sequence
  Description of Artificial Sequence: Synthetic peptide
  Seed: VIRQNIHSL (TYRP2_HUMAN)
VLRQNIHSA

SEQ ID NO: 193058 - protein, 10 aa, Artificial Sequence
  Description of Artificial Sequence: Synthetic peptide
  Seed: RRLRKGYTPL (TYRP2_HUMAN)
RRLRKGYTPI

SEQ ID NO: 193059 - protein, 9 aa, Artificial Sequence
  Description of Artificial Sequence: Synthetic peptide
  Seed: TLLGPGRPY (TYRP2_HUMAN)
THLGPGRPY

SEQ ID NO: 193060 - protein, 9 aa, Artificial Sequence
  Description of Artificial Sequence: Synthetic peptide
  Seed: VLHSFTDAI (TYRP2_HUMAN)
VAHSFTDAV

SEQ ID NO: 193061 - protein, 9 aa, Artificial Sequence
  Description of Artificial Sequence: Synthetic peptide
  Seed: SLHNLVHSF (TYRP2_HUMAN)
SFHNLVHSM

SEQ ID NO: 193062 - protein, 9 aa, Artificial Sequence
  Description of Artificial Sequence: Synthetic peptide
  Seed: STFSFRNAL (TYRP2_HUMAN)
SLFSFRNAK

SEQ ID NO: 193063 - protein, 8 aa, Artificial Sequence
  Description of Artificial Sequence: Synthetic peptide
  Seed: FFVWLHYY (TYRP2_HUMAN)
FYVWLHYM

SEQ ID NO: 193064 - protein, 9 aa, Artificial Sequence
  Description of Artificial Sequence: Synthetic peptide
  Seed: GPAFVTWHR (TYRP2_HUMAN)
GTAFVTWHR

SEQ ID NO: 193065 - protein, 10 aa, Artificial Sequence
  Description of Artificial Sequence: Synthetic peptide
  Seed: KILPGAQGQF (TYRP2_HUMAN)
KSLPGAQGQY

SEQ ID NO: 193066 - protein, 10 aa, Artificial Sequence
  Description of Artificial Sequence: Synthetic peptide
  Seed: LGPGRPYRAI (TYRP2_HUMAN)
LTPGRPYRAL

SEQ ID NO: 193067 - protein, 9 aa, Artificial Sequence
  Description of Artificial Sequence: Synthetic peptide
  Seed: RFNPPADAW (TYRP2_HUMAN)
RWNPPADAM

SEQ ID NO: 193068 - protein, 9 aa, Artificial Sequence
  Description of Artificial Sequence: Synthetic peptide
  Seed: DFFVWLHYY (TYRP2_HUMAN)
DFFVWLHYR

SEQ ID NO: 193069 - protein, 9 aa, Artificial Sequence
  Description of Artificial Sequence: Synthetic peptide
  Seed: STFSFRNAL (TYRP2_HUMAN)
SQFSFRNAG

SEQ ID NO: 193070 - protein, 10 aa, Artificial Sequence
  Description of Artificial Sequence: Synthetic peptide
  Seed: ADTRPWSGPY (TYRP2_HUMAN)
AKTRPWSGPK

SEQ ID NO: 193071 - protein, 9 aa, Artificial Sequence
  Description of Artificial Sequence: Synthetic peptide
  Seed: VGLFVLLAF (TYRP2_HUMAN)
VLLFVLLAY

SEQ ID NO: 193072 - protein, 9 aa, Artificial Sequence
  Description of Artificial Sequence: Synthetic peptide
  Seed: VMSLHNLVH (TYRP2_HUMAN)
VKSLHNLVY

SEQ ID NO: 193073 - protein, 10 aa, Artificial Sequence
  Description of Artificial Sequence: Synthetic peptide
  Seed: MSLHNLVHSF (TYRP2_HUMAN)
MKLHNLVHSF

SEQ ID NO: 193074 - protein, 9 aa, Artificial Sequence
  Description of Artificial Sequence: Synthetic peptide
  Seed: VVMGTLVAL (TYRP2_HUMAN)
VTMGTLVAM

SEQ ID NO: 193075 - protein, 10 aa, Artificial Sequence
  Description of Artificial Sequence: Synthetic peptide
  Seed: SDQLGYSYAI (TYRP2_HUMAN)
SPQLGYSYAV

SEQ ID NO: 193076 - protein, 9 aa, Artificial Sequence
  Description of Artificial Sequence: Synthetic peptide
  Seed: YAIDLPVSV (TYRP2_HUMAN)
YGIDLPVSL

SEQ ID NO: 193077 - protein, 10 aa, Artificial Sequence
  Description of Artificial Sequence: Synthetic peptide
  Seed: FVVLHSFTDA (TYRP2_HUMAN)
FYVLHSFTDV

SEQ ID NO: 193078 - protein, 9 aa, Artificial Sequence
  Description of Artificial Sequence: Synthetic peptide
  Seed: NMVPFFPPV (TYRP2_HUMAN)
NQVPFFPPV

SEQ ID NO: 193079 - protein, 10 aa, Artificial Sequence
  Description of Artificial Sequence: Synthetic peptide
  Seed: SLDDYNHLVT (TYRP2_HUMAN)
SSDDYNHLVI

SEQ ID NO: 193080 - protein, 9 aa, Artificial Sequence
  Description of Artificial Sequence: Synthetic peptide
  Seed: TLDSQVMSL (TYRP2_HUMAN)
TYDSQVMSY

SEQ ID NO: 193081 - protein, 9 aa, Artificial Sequence
  Description of Artificial Sequence: Synthetic peptide
  Seed: TEVRADTRP (TYRP2_HUMAN)
TEVRADTRV

SEQ ID NO: 193082 - protein, 9 aa, Artificial Sequence
  Description of Artificial Sequence: Synthetic peptide
  Seed: ALPYWNFAT (TYRP2_HUMAN)
ALPYWNFAI

SEQ ID NO: 193083 - protein, 10 aa, Artificial Sequence
  Description of Artificial Sequence: Synthetic peptide
  Seed: FFPPVTNEEL (TYRP2_HUMAN)
FVPPVTNEEL

SEQ ID NO: 193084 - protein, 10 aa, Artificial Sequence
  Description of Artificial Sequence: Synthetic peptide
  Seed: LHYYSVRDTL (TYRP2_HUMAN)
LYYYSVRDTL

SEQ ID NO: 193085 - protein, 9 aa, Artificial Sequence
  Description of Artificial Sequence: Synthetic peptide
  Seed: FFQNSTFSF (TYRP2_HUMAN)
FWQNSTFSW

SEQ ID NO: 193086 - protein, 9 aa, Artificial Sequence
  Description of Artificial Sequence: Synthetic peptide
  Seed: LLAFLQYRR (TYRP2_HUMAN)
LVAFLQYRR

SEQ ID NO: 193087 - protein, 9 aa, Artificial Sequence
  Description of Artificial Sequence: Synthetic peptide
  Seed: AARPDDPTL (TYRP2_HUMAN)
AIRPDDPTK

SEQ ID NO: 193088 - protein, 9 aa, Artificial Sequence
  Description of Artificial Sequence: Synthetic peptide
  Seed: YSYAIDLPV (TYRP2_HUMAN)
YQYAIDLPS

SEQ ID NO: 193089 - protein, 11 aa, Artificial Sequence
  Description of Artificial Sequence: Synthetic peptide
  Seed: RADTRPWSGPY (TYRP2_HUMAN)
RPDTRPWSGPF

SEQ ID NO: 193090 - protein, 9 aa, Artificial Sequence
  Description of Artificial Sequence: Synthetic peptide
  Seed: GAQGQFPRV (TYRP2_HUMAN)
GLQGQFPRI

SEQ ID NO: 193091 - protein, 9 aa, Artificial Sequence
  Description of Artificial Sequence: Synthetic peptide
  Seed: MVPFFPPVT (TYRP2_HUMAN)
MTPFFPPVV

SEQ ID NO: 193092 - protein, 9 aa, Artificial Sequence
  Description of Artificial Sequence: Synthetic peptide
  Seed: RRLRKGYTP (TYRP2_HUMAN)
RRLRKGYTA

SEQ ID NO: 193093 - protein, 10 aa, Artificial Sequence
  Description of Artificial Sequence: Synthetic peptide
  Seed: SDQLGYSYAI (TYRP2_HUMAN)
STQLGYSYAY

SEQ ID NO: 193094 - protein, 11 aa, Artificial Sequence
  Description of Artificial Sequence: Synthetic peptide
  Seed: SLDDYNHLVTL (TYRP2_HUMAN)
SLDDYNHLVTV

SEQ ID NO: 193095 - protein, 9 aa, Artificial Sequence
  Description of Artificial Sequence: Synthetic peptide
  Seed: YSYAIDLPV (TYRP2_HUMAN)
YKYAIDLPF

SEQ ID NO: 193096 - protein, 8 aa, Artificial Sequence
  Description of Artificial Sequence: Synthetic peptide
  Seed: IFDEWMKR (TYRP2_HUMAN)
ISDEWMKY

SEQ ID NO: 193097 - protein, 9 aa, Artificial Sequence
  Description of Artificial Sequence: Synthetic peptide
  Seed: RPWSGPYIL (TYRP2_HUMAN)
RRWSGPYIM

SEQ ID NO: 193098 - protein, 9 aa, Artificial Sequence
  Description of Artificial Sequence: Synthetic peptide
  Seed: SFRNALEGF (TYRP2_HUMAN)
SYRNALEGW

SEQ ID NO: 193099 - protein, 10 aa, Artificial Sequence
  Description of Artificial Sequence: Synthetic peptide
  Seed: IGNESFALPY (TYRP2_HUMAN)
ITNESFALPF

SEQ ID NO: 193100 - protein, 11 aa, Artificial Sequence
  Description of Artificial Sequence: Synthetic peptide
  Seed: RDTLLGPGRPY (TYRP2_HUMAN)
RETLLGPGRPW

SEQ ID NO: 193101 - protein, 10 aa, Artificial Sequence
  Description of Artificial Sequence: Synthetic peptide
  Seed: MSPLWWGFLL (TYRP2_HUMAN)
MIPLWWGFLF

SEQ ID NO: 193102 - protein, 9 aa, Artificial Sequence
  Description of Artificial Sequence: Synthetic peptide
  Seed: RQNIHSLSP (TYRP2_HUMAN)
RENIHSLSM

SEQ ID NO: 193103 - protein, 9 aa, Artificial Sequence
  Description of Artificial Sequence: Synthetic peptide
  Seed: RLRKGYTPL (TYRP2_HUMAN)
RFRKGYTPM

SEQ ID NO: 193104 - protein, 10 aa, Artificial Sequence
  Description of Artificial Sequence: Synthetic peptide
  Seed: IGNESFALPY (TYRP2_HUMAN)
IKNESFALPY

SEQ ID NO: 193105 - protein, 9 aa, Artificial Sequence
  Description of Artificial Sequence: Synthetic peptide
  Seed: STFSFRNAL (TYRP2_HUMAN)
SIFSFRNAW

SEQ ID NO: 193106 - protein, 11 aa, Artificial Sequence
  Description of Artificial Sequence: Synthetic peptide
  Seed: YNMVPFFPPVT (TYRP2_HUMAN)
YTMVPFFPPVF

SEQ ID NO: 193107 - protein, 9 aa, Artificial Sequence
  Description of Artificial Sequence: Synthetic peptide
  Seed: ILPGAQGQF (TYRP2_HUMAN)
ILPGAQGQL

SEQ ID NO: 193108 - protein, 9 aa, Artificial Sequence
  Description of Artificial Sequence: Synthetic peptide
  Seed: TSDQLGYSY (TYRP2_HUMAN)
TSDQLGYSW

SEQ ID NO: 193109 - protein, 9 aa, Artificial Sequence
  Description of Artificial Sequence: Synthetic peptide
  Seed: GAQGQFPRV (TYRP2_HUMAN)
GMQGQFPRA

SEQ ID NO: 193110 - protein, 9 aa, Artificial Sequence
  Description of Artificial Sequence: Synthetic peptide
  Seed: SLHNLVHSF (TYRP2_HUMAN)
SLHNLVHSR

SEQ ID NO: 193111 - protein, 8 aa, Artificial Sequence
  Description of Artificial Sequence: Synthetic peptide
  Seed: FLGALDLA (TYRP2_HUMAN)
FLGALDLV

SEQ ID NO: 193112 - protein, 8 aa, Artificial Sequence
  Description of Artificial Sequence: Synthetic peptide
  Seed: SLDDYNHL (TYRP2_HUMAN)
SYDDYNHF

SEQ ID NO: 193113 - protein, 10 aa, Artificial Sequence
  Description of Artificial Sequence: Synthetic peptide
  Seed: YNMVPFFPPV (TYRP2_HUMAN)
YQMVPFFPPF

SEQ ID NO: 193114 - protein, 9 aa, Artificial Sequence
  Description of Artificial Sequence: Synthetic peptide
  Seed: RQNIHSLSP (TYRP2_HUMAN)
RMNIHSLSA

SEQ ID NO: 193115 - protein, 10 aa, Artificial Sequence
  Description of Artificial Sequence: Synthetic peptide
  Seed: RMYNMVPFFP (TYRP2_HUMAN)
RVYNMVPFFF

SEQ ID NO: 193116 - protein, 9 aa, Artificial Sequence
  Description of Artificial Sequence: Synthetic peptide
  Seed: STFSFRNAL (TYRP2_HUMAN)
SFFSFRNAK

SEQ ID NO: 193117 - protein, 9 aa, Artificial Sequence
  Description of Artificial Sequence: Synthetic peptide
  Seed: FQNSTFSFR (TYRP2_HUMAN)
FYNSTFSFR

SEQ ID NO: 193118 - protein, 9 aa, Artificial Sequence
  Description of Artificial Sequence: Synthetic peptide
  Seed: AARPDDPTL (TYRP2_HUMAN)
AERPDDPTF

SEQ ID NO: 193119 - protein, 10 aa, Artificial Sequence
  Description of Artificial Sequence: Synthetic peptide
  Seed: LGPNGTQPQF (TYRP2_HUMAN)
LSPNGTQPQW

SEQ ID NO: 193120 - protein, 10 aa, Artificial Sequence
  Description of Artificial Sequence: Synthetic peptide
  Seed: MGRNSMKLPT (TYRP2_HUMAN)
MVRNSMKLPV

SEQ ID NO: 193121 - protein, 8 aa, Artificial Sequence
  Description of Artificial Sequence: Synthetic peptide
  Seed: RPDDPTLI (TYRP2_HUMAN)
RTDDPTLV

SEQ ID NO: 193122 - protein, 10 aa, Artificial Sequence
  Description of Artificial Sequence: Synthetic peptide
  Seed: CCPRLGAESA (TYRP2_HUMAN)
CQPRLGAESM

SEQ ID NO: 193123 - protein, 9 aa, Artificial Sequence
  Description of Artificial Sequence: Synthetic peptide
  Seed: FPPVTNEEL (TYRP2_HUMAN)
FYPVTNEEM

SEQ ID NO: 193124 - protein, 11 aa, Artificial Sequence
  Description of Artificial Sequence: Synthetic peptide
  Seed: MSLHNLVHSFL (TYRP2_HUMAN)
MSLHNLVHSFF

SEQ ID NO: 193125 - protein, 10 aa, Artificial Sequence
  Description of Artificial Sequence: Synthetic peptide
  Seed: RLIGNESFAL (TYRP2_HUMAN)
RMIGNESFAV

SEQ ID NO: 193126 - protein, 9 aa, Artificial Sequence
  Description of Artificial Sequence: Synthetic peptide
  Seed: CERKKPPVI (TYRP2_HUMAN)
CPRKKPPVL

SEQ ID NO: 193127 - protein, 10 aa, Artificial Sequence
  Description of Artificial Sequence: Synthetic peptide
  Seed: TLCNGTYEGL (TYRP2_HUMAN)
TLCNGTYEGV

SEQ ID NO: 193128 - protein, 11 aa, Artificial Sequence
  Description of Artificial Sequence: Synthetic peptide
  Seed: YNMVPFFPPVT (TYRP2_HUMAN)
YTMVPFFPPVT

SEQ ID NO: 193129 - protein, 9 aa, Artificial Sequence
  Description of Artificial Sequence: Synthetic peptide
  Seed: AANDPIFVV (TYRP2_HUMAN)
APNDPIFVL

SEQ ID NO: 193130 - protein, 9 aa, Artificial Sequence
  Description of Artificial Sequence: Synthetic peptide
  Seed: LAFLQYRRL (TYRP2_HUMAN)
LAFLQYRRW

SEQ ID NO: 193131 - protein, 11 aa, Artificial Sequence
  Description of Artificial Sequence: Synthetic peptide
  Seed: TQPQFANCSVY (TYRP2_HUMAN)
TMPQFANCSVM

SEQ ID NO: 193132 - protein, 11 aa, Artificial Sequence
  Description of Artificial Sequence: Synthetic peptide
  Seed: QELAPIGHNRM (TYRP2_HUMAN)
QELAPIGHNRL

SEQ ID NO: 193133 - protein, 11 aa, Artificial Sequence
  Description of Artificial Sequence: Synthetic peptide
  Seed: YTPLMETHLSS (TYRP2_HUMAN)
YDPLMETHLSI

SEQ ID NO: 193134 - protein, 10 aa, Artificial Sequence
  Description of Artificial Sequence: Synthetic peptide
  Seed: KILPGAQGQF (TYRP2_HUMAN)
KTLPGAQGQF

SEQ ID NO: 193135 - protein, 9 aa, Artificial Sequence
  Description of Artificial Sequence: Synthetic peptide
  Seed: VGLFVLLAF (TYRP2_HUMAN)
VQLFVLLAF

SEQ ID NO: 193136 - protein, 9 aa, Artificial Sequence
  Description of Artificial Sequence: Synthetic peptide
  Seed: FVWLHYYSV (TYRP2_HUMAN)
FQWLHYYSL

SEQ ID NO: 193137 - protein, 10 aa, Artificial Sequence
  Description of Artificial Sequence: Synthetic peptide
  Seed: SVYDFFVWLH (TYRP2_HUMAN)
SSYDFFVWLR

SEQ ID NO: 193138 - protein, 9 aa, Artificial Sequence
  Description of Artificial Sequence: Synthetic peptide
  Seed: YAIDLPVSV (TYRP2_HUMAN)
YEIDLPVSY

SEQ ID NO: 193139 - protein, 9 aa, Artificial Sequence
  Description of Artificial Sequence: Synthetic peptide
  Seed: YAIDLPVSV (TYRP2_HUMAN)
YQIDLPVSA

SEQ ID NO: 193140 - protein, 9 aa, Artificial Sequence
  Description of Artificial Sequence: Synthetic peptide
  Seed: ADGTLDSQV (TYRP2_HUMAN)
AEGTLDSQA

SEQ ID NO: 193141 - protein, 10 aa, Artificial Sequence
  Description of Artificial Sequence: Synthetic peptide
  Seed: LVVMGTLVAL (TYRP2_HUMAN)
LLVMGTLVAL

SEQ ID NO: 193142 - protein, 11 aa, Artificial Sequence
  Description of Artificial Sequence: Synthetic peptide
  Seed: VCDSLDDYNHL (TYRP2_HUMAN)
VLDSLDDYNHM

SEQ ID NO: 193143 - protein, 10 aa, Artificial Sequence
  Description of Artificial Sequence: Synthetic peptide
  Seed: SLQKFDNPPF (TYRP2_HUMAN)
SWQKFDNPPY

SEQ ID NO: 193144 - protein, 10 aa, Artificial Sequence
  Description of Artificial Sequence: Synthetic peptide
  Seed: DIRDCLSLQK (TYRP2_HUMAN)
DTRDCLSLQK

SEQ ID NO: 193145 - protein, 9 aa, Artificial Sequence
  Description of Artificial Sequence: Synthetic peptide
  Seed: LVTLCNGTY (TYRP2_HUMAN)
LTTLCNGTW

SEQ ID NO: 193146 - protein, 10 aa, Artificial Sequence
  Description of Artificial Sequence: Synthetic peptide
  Seed: AARPDDPTLI (TYRP2_HUMAN)
AARPDDPTLF

SEQ ID NO: 193147 - protein, 10 aa, Artificial Sequence
  Description of Artificial Sequence: Synthetic peptide
  Seed: MSPLWWGFLL (TYRP2_HUMAN)
MQPLWWGFLI

SEQ ID NO: 193148 - protein, 9 aa, Artificial Sequence
  Description of Artificial Sequence: Synthetic peptide
  Seed: SFLNGTNAL (TYRP2_HUMAN)
SGLNGTNAF

SEQ ID NO: 193149 - protein, 10 aa, Artificial Sequence
  Description of Artificial Sequence: Synthetic peptide
  Seed: YDFFVWLHYY (TYRP2_HUMAN)
YRFFVWLHYF

SEQ ID NO: 193150 - protein, 10 aa, Artificial Sequence
  Description of Artificial Sequence: Synthetic peptide
  Seed: YAIDLPVSVE (TYRP2_HUMAN)
YVIDLPVSVA

SEQ ID NO: 193151 - protein, 10 aa, Artificial Sequence
  Description of Artificial Sequence: Synthetic peptide
  Seed: FVWLHYYSVR (TYRP2_HUMAN)
FMWLHYYSVW

SEQ ID NO: 193152 - protein, 10 aa, Artificial Sequence
  Description of Artificial Sequence: Synthetic peptide
  Seed: MSPLWWGFLL (TYRP2_HUMAN)
MEPLWWGFLY

SEQ ID NO: 193153 - protein, 11 aa, Artificial Sequence
  Description of Artificial Sequence: Synthetic peptide
  Seed: MYNMVPFFPPV (TYRP2_HUMAN)
MINMVPFFPPI

SEQ ID NO: 193154 - protein, 9 aa, Artificial Sequence
  Description of Artificial Sequence: Synthetic peptide
  Seed: YSYAIDLPV (TYRP2_HUMAN)
YPYAIDLPY

SEQ ID NO: 193155 - protein, 9 aa, Artificial Sequence
  Description of Artificial Sequence: Synthetic peptide
  Seed: AANDPIFVV (TYRP2_HUMAN)
AINDPIFVV

SEQ ID NO: 193156 - protein, 10 aa, Artificial Sequence
  Description of Artificial Sequence: Synthetic peptide
  Seed: YDFFVWLHYY (TYRP2_HUMAN)
YYFFVWLHYH

SEQ ID NO: 193157 - protein, 11 aa, Artificial Sequence
  Description of Artificial Sequence: Synthetic peptide
  Seed: SLDDYNHLVTL (TYRP2_HUMAN)
STDDYNHLVTI

SEQ ID NO: 193158 - protein, 9 aa, Artificial Sequence
  Description of Artificial Sequence: Synthetic peptide
  Seed: FVWLHYYSV (TYRP2_HUMAN)
FSWLHYYSI

SEQ ID NO: 193159 - protein, 10 aa, Artificial Sequence
  Description of Artificial Sequence: Synthetic peptide
  Seed: RNSRFSSWET (TYRP2_HUMAN)
RCSRFSSWEL

SEQ ID NO: 193160 - protein, 11 aa, Artificial Sequence
  Description of Artificial Sequence: Synthetic peptide
  Seed: FLTSDQLGYSY (TYRP2_HUMAN)
FHTSDQLGYSY

SEQ ID NO: 193161 - protein, 9 aa, Artificial Sequence
  Description of Artificial Sequence: Synthetic peptide
  Seed: MTVDSLVNK (TYRP2_HUMAN)
MMVDSLVNY

SEQ ID NO: 193162 - protein, 11 aa, Artificial Sequence
  Description of Artificial Sequence: Synthetic peptide
  Seed: FVVLHSFTDAI (TYRP2_HUMAN)
FTVLHSFTDAV

SEQ ID NO: 193163 - protein, 11 aa, Artificial Sequence
  Description of Artificial Sequence: Synthetic peptide
  Seed: FVVLHSFTDAI (TYRP2_HUMAN)
FMVLHSFTDAV

SEQ ID NO: 193164 - protein, 10 aa, Artificial Sequence
  Description of Artificial Sequence: Synthetic peptide
  Seed: ELAPIGHNRM (TYRP2_HUMAN)
EAAPIGHNRK

SEQ ID NO: 193165 - protein, 11 aa, Artificial Sequence
  Description of Artificial Sequence: Synthetic peptide
  Seed: YNMVPFFPPVT (TYRP2_HUMAN)
YTMVPFFPPVQ

SEQ ID NO: 193166 - protein, 9 aa, Artificial Sequence
  Description of Artificial Sequence: Synthetic peptide
  Seed: ANDPIFVVL (TYRP2_HUMAN)
AIDPIFVVM

SEQ ID NO: 193167 - protein, 9 aa, Artificial Sequence
  Description of Artificial Sequence: Synthetic peptide
  Seed: WHRYHLLCL (TYRP2_HUMAN)
WARYHLLCL

SEQ ID NO: 193168 - protein, 9 aa, Artificial Sequence
  Description of Artificial Sequence: Synthetic peptide
  Seed: LQKFDNPPF (TYRP2_HUMAN)
LRKFDNPPF

SEQ ID NO: 193169 - protein, 8 aa, Artificial Sequence
  Description of Artificial Sequence: Synthetic peptide
  Seed: QKFDNPPF (TYRP2_HUMAN)
QMFDNPPY

SEQ ID NO: 193170 - protein, 9 aa, Artificial Sequence
  Description of Artificial Sequence: Synthetic peptide
  Seed: VYDFFVWLH (TYRP2_HUMAN)
VMDFFVWLY

SEQ ID NO: 193171 - protein, 10 aa, Artificial Sequence
  Description of Artificial Sequence: Synthetic peptide
  Seed: GTLDSQVMSL (TYRP2_HUMAN)
GQLDSQVMSF

SEQ ID NO: 193172 - protein, 10 aa, Artificial Sequence
  Description of Artificial Sequence: Synthetic peptide
  Seed: GPAFVTWHRY (TYRP2_HUMAN)
GTAFVTWHRY

SEQ ID NO: 193173 - protein, 9 aa, Artificial Sequence
  Description of Artificial Sequence: Synthetic peptide
  Seed: TLDSQVMSL (TYRP2_HUMAN)
TLDSQVMSF

SEQ ID NO: 193174 - protein, 10 aa, Artificial Sequence
  Description of Artificial Sequence: Synthetic peptide
  Seed: RLRKGYTPLM (TYRP2_HUMAN)
RSRKGYTPLL

SEQ ID NO: 193175 - protein, 10 aa, Artificial Sequence
  Description of Artificial Sequence: Synthetic peptide
  Seed: KILPGAQGQF (TYRP2_HUMAN)
KSLPGAQGQW

SEQ ID NO: 193176 - protein, 10 aa, Artificial Sequence
  Description of Artificial Sequence: Synthetic peptide
  Seed: RNSRFSSWET (TYRP2_HUMAN)
RCSRFSSWEI

SEQ ID NO: 193177 - protein, 9 aa, Artificial Sequence
  Description of Artificial Sequence: Synthetic peptide
  Seed: RMYNMVPFF (TYRP2_HUMAN)
RSYNMVPFT

SEQ ID NO: 193178 - protein, 10 aa, Artificial Sequence
  Description of Artificial Sequence: Synthetic peptide
  Seed: MGRNSMKLPT (TYRP2_HUMAN)
MTRNSMKLPL

SEQ ID NO: 193179 - protein, 9 aa, Artificial Sequence
  Description of Artificial Sequence: Synthetic peptide
  Seed: GQFPRVCMT (TYRP2_HUMAN)
GQFPRVCML

SEQ ID NO: 193180 - protein, 9 aa, Artificial Sequence
  Description of Artificial Sequence: Synthetic peptide
  Seed: VTWHRYHLL (TYRP2_HUMAN)
VWWHRYHLM

SEQ ID NO: 193181 - protein, 9 aa, Artificial Sequence
  Description of Artificial Sequence: Synthetic peptide
  Seed: QKFDNPPFF (TYRP2_HUMAN)
QQFDNPPFM

SEQ ID NO: 193182 - protein, 9 aa, Artificial Sequence
  Description of Artificial Sequence: Synthetic peptide
  Seed: SRFSSWETV (TYRP2_HUMAN)
SHFSSWETY

SEQ ID NO: 193183 - protein, 10 aa, Artificial Sequence
  Description of Artificial Sequence: Synthetic peptide
  Seed: RLRKGYTPLM (TYRP2_HUMAN)
RIRKGYTPLL

SEQ ID NO: 193184 - protein, 9 aa, Artificial Sequence
  Description of Artificial Sequence: Synthetic peptide
  Seed: TSDQLGYSY (TYRP2_HUMAN)
TGDQLGYSL

SEQ ID NO: 193185 - protein, 9 aa, Artificial Sequence
  Description of Artificial Sequence: Synthetic peptide
  Seed: RFNPPADAW (TYRP2_HUMAN)
RWNPPADAF

SEQ ID NO: 193186 - protein, 10 aa, Artificial Sequence
  Description of Artificial Sequence: Synthetic peptide
  Seed: RNSRFSSWET (TYRP2_HUMAN)
RGSRFSSWEA

SEQ ID NO: 193187 - protein, 10 aa, Artificial Sequence
  Description of Artificial Sequence: Synthetic peptide
  Seed: SAANDPIFVV (TYRP2_HUMAN)
SMANDPIFVM

SEQ ID NO: 193188 - protein, 10 aa, Artificial Sequence
  Description of Artificial Sequence: Synthetic peptide
  Seed: RMYNMVPFFP (TYRP2_HUMAN)
RQYNMVPFFQ

SEQ ID NO: 193189 - protein, 10 aa, Artificial Sequence
  Description of Artificial Sequence: Synthetic peptide
  Seed: SLDDYNHLVT (TYRP2_HUMAN)
SSDDYNHLVV

SEQ ID NO: 193190 - protein, 10 aa, Artificial Sequence
  Description of Artificial Sequence: Synthetic peptide
  Seed: HSFLNGTNAL (TYRP2_HUMAN)
HDFLNGTNAM

SEQ ID NO: 193191 - protein, 10 aa, Artificial Sequence
  Description of Artificial Sequence: Synthetic peptide
  Seed: KRFNPPADAW (TYRP2_HUMAN)
KSFNPPADAF

SEQ ID NO: 193192 - protein, 9 aa, Artificial Sequence
  Description of Artificial Sequence: Synthetic peptide
  Seed: SLDDYNHLV (TYRP2_HUMAN)
STDDYNHLM

SEQ ID NO: 193193 - protein, 9 aa, Artificial Sequence
  Description of Artificial Sequence: Synthetic peptide
  Seed: NALEGFDKA (TYRP2_HUMAN)
NMLEGFDKI

SEQ ID NO: 193194 - protein, 9 aa, Artificial Sequence
  Description of Artificial Sequence: Synthetic peptide
  Seed: SLDDYNHLV (TYRP2_HUMAN)
SIDDYNHLM

SEQ ID NO: 193195 - protein, 9 aa, Artificial Sequence
  Description of Artificial Sequence: Synthetic peptide
  Seed: RLRKGYTPL (TYRP2_HUMAN)
RLRKGYTPY

SEQ ID NO: 193196 - protein, 9 aa, Artificial Sequence
  Description of Artificial Sequence: Synthetic peptide
  Seed: FVWLHYYSV (TYRP2_HUMAN)
FAWLHYYSL

SEQ ID NO: 193197 - protein, 9 aa, Artificial Sequence
  Description of Artificial Sequence: Synthetic peptide
  Seed: TTQHWLGLL (TYRP2_HUMAN)
TLQHWLGLL

SEQ ID NO: 193198 - protein, 9 aa, Artificial Sequence
  Description of Artificial Sequence: Synthetic peptide
  Seed: ALPYWNFAT (TYRP2_HUMAN)
AAPYWNFAV

SEQ ID NO: 193199 - protein, 10 aa, Artificial Sequence
  Description of Artificial Sequence: Synthetic peptide
  Seed: RNSRFSSWET (TYRP2_HUMAN)
RKSRFSSWEL

SEQ ID NO: 193200 - protein, 9 aa, Artificial Sequence
  Description of Artificial Sequence: Synthetic peptide
  Seed: CERKKPPVI (TYRP2_HUMAN)
CMRKKPPVL

SEQ ID NO: 193201 - protein, 9 aa, Artificial Sequence
  Description of Artificial Sequence: Synthetic peptide
  Seed: RNQMGRNSM (TYRP2_HUMAN)
RMQMGRNSF

SEQ ID NO: 193202 - protein, 9 aa, Artificial Sequence
  Description of Artificial Sequence: Synthetic peptide
  Seed: LPVSVEETP (TYRP2_HUMAN)
LPVSVEETV

SEQ ID NO: 193203 - protein, 10 aa, Artificial Sequence
  Description of Artificial Sequence: Synthetic peptide
  Seed: NGTYEGLLRR (TYRP2_HUMAN)
NTTYEGLLRK

SEQ ID NO: 193204 - protein, 10 aa, Artificial Sequence
  Description of Artificial Sequence: Synthetic peptide
  Seed: YNMVPFFPPV (TYRP2_HUMAN)
YIMVPFFPPS

SEQ ID NO: 193205 - protein, 10 aa, Artificial Sequence
  Description of Artificial Sequence: Synthetic peptide
  Seed: FFVWLHYYSV (TYRP2_HUMAN)
FCVWLHYYSV

SEQ ID NO: 193206 - protein, 8 aa, Artificial Sequence
  Description of Artificial Sequence: Synthetic peptide
  Seed: KFDNPPFF (TYRP2_HUMAN)
KFDNPPFL

SEQ ID NO: 193207 - protein, 8 aa, Artificial Sequence
  Description of Artificial Sequence: Synthetic peptide
  Seed: YYSVRDTL (TYRP2_HUMAN)
YSSVRDTL

SEQ ID NO: 193208 - protein, 9 aa, Artificial Sequence
  Description of Artificial Sequence: Synthetic peptide
  Seed: STFSFRNAL (TYRP2_HUMAN)
SPFSFRNAI

SEQ ID NO: 193209 - protein, 10 aa, Artificial Sequence
  Description of Artificial Sequence: Synthetic peptide
  Seed: MSPLWWGFLL (TYRP2_HUMAN)
MEPLWWGFLL

SEQ ID NO: 193210 - protein, 10 aa, Artificial Sequence
  Description of Artificial Sequence: Synthetic peptide
  Seed: MSLHNLVHSF (TYRP2_HUMAN)
MQLHNLVHSL

SEQ ID NO: 193211 - protein, 9 aa, Artificial Sequence
  Description of Artificial Sequence: Synthetic peptide
  Seed: GTLVALVGL (TYRP2_HUMAN)
GVLVALVGI

SEQ ID NO: 193212 - protein, 10 aa, Artificial Sequence
  Description of Artificial Sequence: Synthetic peptide
  Seed: ALVGLFVLLA (TYRP2_HUMAN)
AIVGLFVLLV

SEQ ID NO: 193213 - protein, 9 aa, Artificial Sequence
  Description of Artificial Sequence: Synthetic peptide
  Seed: DQLGYSYAI (TYRP2_HUMAN)
DSLGYSYAL

SEQ ID NO: 193214 - protein, 11 aa, Artificial Sequence
  Description of Artificial Sequence: Synthetic peptide
  Seed: ALPYWNFATGR (TYRP2_HUMAN)
ATPYWNFATGR

SEQ ID NO: 193215 - protein, 9 aa, Artificial Sequence
  Description of Artificial Sequence: Synthetic peptide
  Seed: FVLLAFLQY (TYRP2_HUMAN)
FFLLAFLQY

SEQ ID NO: 193216 - protein, 9 aa, Artificial Sequence
  Description of Artificial Sequence: Synthetic peptide
  Seed: SLHNLVHSF (TYRP2_HUMAN)
SQHNLVHSA

SEQ ID NO: 193217 - protein, 9 aa, Artificial Sequence
  Description of Artificial Sequence: Synthetic peptide
  Seed: FTDAIFDEW (TYRP2_HUMAN)
FFDAIFDEI

SEQ ID NO: 193218 - protein, 9 aa, Artificial Sequence
  Description of Artificial Sequence: Synthetic peptide
  Seed: RLRKGYTPL (TYRP2_HUMAN)
RARKGYTPS

SEQ ID NO: 193219 - protein, 9 aa, Artificial Sequence
  Description of Artificial Sequence: Synthetic peptide
  Seed: FVLLAFLQY (TYRP2_HUMAN)
FVLLAFLQK

SEQ ID NO: 193220 - protein, 10 aa, Artificial Sequence
  Description of Artificial Sequence: Synthetic peptide
  Seed: KRFNPPADAW (TYRP2_HUMAN)
KIFNPPADAW

SEQ ID NO: 193221 - protein, 10 aa, Artificial Sequence
  Description of Artificial Sequence: Synthetic peptide
  Seed: SVYDFFVWLH (TYRP2_HUMAN)
SEYDFFVWLR

SEQ ID NO: 193222 - protein, 9 aa, Artificial Sequence
  Description of Artificial Sequence: Synthetic peptide
  Seed: TTQHWLGLL (TYRP2_HUMAN)
TLQHWLGLI

SEQ ID NO: 193223 - protein, 9 aa, Artificial Sequence
  Description of Artificial Sequence: Synthetic peptide
  Seed: FSHQGPAFV (TYRP2_HUMAN)
FLHQGPAFI

SEQ ID NO: 193224 - protein, 9 aa, Artificial Sequence
  Description of Artificial Sequence: Synthetic peptide
  Seed: SLDDYNHLV (TYRP2_HUMAN)
SVDDYNHLA

SEQ ID NO: 193225 - protein, 9 aa, Artificial Sequence
  Description of Artificial Sequence: Synthetic peptide
  Seed: TLLGPGRPY (TYRP2_HUMAN)
THLGPGRPF

SEQ ID NO: 193226 - protein, 9 aa, Artificial Sequence
  Description of Artificial Sequence: Synthetic peptide
  Seed: SLHNLVHSF (TYRP2_HUMAN)
SLHNLVHSW

SEQ ID NO: 193227 - protein, 10 aa, Artificial Sequence
  Description of Artificial Sequence: Synthetic peptide
  Seed: AANDPIFVVL (TYRP2_HUMAN)
AVNDPIFVVF

SEQ ID NO: 193228 - protein, 9 aa, Artificial Sequence
  Description of Artificial Sequence: Synthetic peptide
  Seed: ETPGWPTTL (TYRP2_HUMAN)
EYPGWPTTL

SEQ ID NO: 193229 - protein, 9 aa, Artificial Sequence
  Description of Artificial Sequence: Synthetic peptide
  Seed: RLRKGYTPL (TYRP2_HUMAN)
RPRKGYTPH

SEQ ID NO: 193230 - protein, 9 aa, Artificial Sequence
  Description of Artificial Sequence: Synthetic peptide
  Seed: MSPLWWGFL (TYRP2_HUMAN)
MTPLWWGFV

SEQ ID NO: 193231 - protein, 9 aa, Artificial Sequence
  Description of Artificial Sequence: Synthetic peptide
  Seed: ETPGWPTTL (TYRP2_HUMAN)
ETPGWPTTF

SEQ ID NO: 193232 - protein, 8 aa, Artificial Sequence
  Description of Artificial Sequence: Synthetic peptide
  Seed: ANDPIFVV (TYRP2_HUMAN)
AIDPIFVL

SEQ ID NO: 193233 - protein, 9 aa, Artificial Sequence
  Description of Artificial Sequence: Synthetic peptide
  Seed: FFQNSTFSF (TYRP2_HUMAN)
FLQNSTFSF

SEQ ID NO: 193234 - protein, 9 aa, Artificial Sequence
  Description of Artificial Sequence: Synthetic peptide
  Seed: VIRQNIHSL (TYRP2_HUMAN)
VARQNIHSK

SEQ ID NO: 193235 - protein, 10 aa, Artificial Sequence
  Description of Artificial Sequence: Synthetic peptide
  Seed: MSLHNLVHSF (TYRP2_HUMAN)
MDLHNLVHSY

SEQ ID NO: 193236 - protein, 9 aa, Artificial Sequence
  Description of Artificial Sequence: Synthetic peptide
  Seed: IFDEWMKRF (TYRP2_HUMAN)
ISDEWMKRF

SEQ ID NO: 193237 - protein, 10 aa, Artificial Sequence
  Description of Artificial Sequence: Synthetic peptide
  Seed: HSFLNGTNAL (TYRP2_HUMAN)
HFFLNGTNAM

SEQ ID NO: 193238 - protein, 9 aa, Artificial Sequence
  Description of Artificial Sequence: Synthetic peptide
  Seed: GPAFVTWHR (TYRP2_HUMAN)
GVAFVTWHR

SEQ ID NO: 193239 - protein, 9 aa, Artificial Sequence
  Description of Artificial Sequence: Synthetic peptide
  Seed: HQGPAFVTW (TYRP2_HUMAN)
HYGPAFVTI

SEQ ID NO: 193240 - protein, 11 aa, Artificial Sequence
  Description of Artificial Sequence: Synthetic peptide
  Seed: TQPQFANCSVY (TYRP2_HUMAN)
TSPQFANCSVY

SEQ ID NO: 193241 - protein, 10 aa, Artificial Sequence
  Description of Artificial Sequence: Synthetic peptide
  Seed: YSYAIDLPVS (TYRP2_HUMAN)
YTYAIDLPVA

SEQ ID NO: 193242 - protein, 10 aa, Artificial Sequence
  Description of Artificial Sequence: Synthetic peptide
  Seed: LTSDQLGYSY (TYRP2_HUMAN)
LTSDQLGYSW

SEQ ID NO: 193243 - protein, 10 aa, Artificial Sequence
  Description of Artificial Sequence: Synthetic peptide
  Seed: VYDFFVWLHY (TYRP2_HUMAN)
VTDFFVWLHY

SEQ ID NO: 193244 - protein, 10 aa, Artificial Sequence
  Description of Artificial Sequence: Synthetic peptide
  Seed: NPPFFQNSTF (TYRP2_HUMAN)
NIPFFQNSTW

SEQ ID NO: 193245 - protein, 9 aa, Artificial Sequence
  Description of Artificial Sequence: Synthetic peptide
  Seed: QRLIGNESF (TYRP2_HUMAN)
QQLIGNESY

SEQ ID NO: 193246 - protein, 10 aa, Artificial Sequence
  Description of Artificial Sequence: Synthetic peptide
  Seed: ADTRPWSGPY (TYRP2_HUMAN)
AQTRPWSGPF

SEQ ID NO: 193247 - protein, 9 aa, Artificial Sequence
  Description of Artificial Sequence: Synthetic peptide
  Seed: SLHNLVHSF (TYRP2_HUMAN)
SFHNLVHSF

SEQ ID NO: 193248 - protein, 10 aa, Artificial Sequence
  Description of Artificial Sequence: Synthetic peptide
  Seed: FFQNSTFSFR (TYRP2_HUMAN)
FTQNSTFSFR

SEQ ID NO: 193249 - protein, 10 aa, Artificial Sequence
  Description of Artificial Sequence: Synthetic peptide
  Seed: GYSYAIDLPV (TYRP2_HUMAN)
GMSYAIDLPI

SEQ ID NO: 193250 - protein, 10 aa, Artificial Sequence
  Description of Artificial Sequence: Synthetic peptide
  Seed: LVALVGLFVL (TYRP2_HUMAN)
LMALVGLFVV

SEQ ID NO: 193251 - protein, 10 aa, Artificial Sequence
  Description of Artificial Sequence: Synthetic peptide
  Seed: NSRFSSWETV (TYRP2_HUMAN)
NYRFSSWETL

SEQ ID NO: 193252 - protein, 10 aa, Artificial Sequence
  Description of Artificial Sequence: Synthetic peptide
  Seed: SQVMSLHNLV (TYRP2_HUMAN)
SMVMSLHNLA

SEQ ID NO: 193253 - protein, 9 aa, Artificial Sequence
  Description of Artificial Sequence: Synthetic peptide
  Seed: LSPQEREQF (TYRP2_HUMAN)
LLPQEREQL

SEQ ID NO: 193254 - protein, 10 aa, Artificial Sequence
  Description of Artificial Sequence: Synthetic peptide
  Seed: CCPRLGAESA (TYRP2_HUMAN)
CCPRLGAESL

SEQ ID NO: 193255 - protein, 9 aa, Artificial Sequence
  Description of Artificial Sequence: Synthetic peptide
  Seed: STFSFRNAL (TYRP2_HUMAN)
SWFSFRNAL

SEQ ID NO: 193256 - protein, 9 aa, Artificial Sequence
  Description of Artificial Sequence: Synthetic peptide
  Seed: WHRYHLLCL (TYRP2_HUMAN)
WERYHLLCY

SEQ ID NO: 193257 - protein, 9 aa, Artificial Sequence
  Description of Artificial Sequence: Synthetic peptide
  Seed: VVLHSFTDA (TYRP2_HUMAN)
VQLHSFTDV

SEQ ID NO: 193258 - protein, 9 aa, Artificial Sequence
  Description of Artificial Sequence: Synthetic peptide
  Seed: QKFDNPPFF (TYRP2_HUMAN)
QLFDNPPFF

SEQ ID NO: 193259 - protein, 10 aa, Artificial Sequence
  Description of Artificial Sequence: Synthetic peptide
  Seed: DSLDDYNHLV (TYRP2_HUMAN)
DMLDDYNHLI

SEQ ID NO: 193260 - protein, 9 aa, Artificial Sequence
  Description of Artificial Sequence: Synthetic peptide
  Seed: FANCSVYDF (TYRP2_HUMAN)
FSNCSVYDF

SEQ ID NO: 193261 - protein, 9 aa, Artificial Sequence
  Description of Artificial Sequence: Synthetic peptide
  Seed: SRFSSWETV (TYRP2_HUMAN)
SEFSSWETF

SEQ ID NO: 193262 - protein, 9 aa, Artificial Sequence
  Description of Artificial Sequence: Synthetic peptide
  Seed: RLRKGYTPL (TYRP2_HUMAN)
RGRKGYTPA

SEQ ID NO: 193263 - protein, 9 aa, Artificial Sequence
  Description of Artificial Sequence: Synthetic peptide
  Seed: GLFVLLAFL (TYRP2_HUMAN)
GMFVLLAFI

SEQ ID NO: 193264 - protein, 11 aa, Artificial Sequence
  Description of Artificial Sequence: Synthetic peptide
  Seed: HNRMYNMVPFF (TYRP2_HUMAN)
HQRMYNMVPFF

SEQ ID NO: 193265 - protein, 10 aa, Artificial Sequence
  Description of Artificial Sequence: Synthetic peptide
  Seed: MSLHNLVHSF (TYRP2_HUMAN)
MPLHNLVHSM

SEQ ID NO: 193266 - protein, 11 aa, Artificial Sequence
  Description of Artificial Sequence: Synthetic peptide
  Seed: LPHSAANDPIF (TYRP2_HUMAN)
LSHSAANDPIW

SEQ ID NO: 193267 - protein, 10 aa, Artificial Sequence
  Description of Artificial Sequence: Synthetic peptide
  Seed: KILPGAQGQF (TYRP2_HUMAN)
KELPGAQGQY

SEQ ID NO: 193268 - protein, 10 aa, Artificial Sequence
  Description of Artificial Sequence: Synthetic peptide
  Seed: LVVMGTLVAL (TYRP2_HUMAN)
LFVMGTLVAV

SEQ ID NO: 193269 - protein, 10 aa, Artificial Sequence
  Description of Artificial Sequence: Synthetic peptide
  Seed: RLRKGYTPLM (TYRP2_HUMAN)
RYRKGYTPLS

SEQ ID NO: 193270 - protein, 10 aa, Artificial Sequence
  Description of Artificial Sequence: Synthetic peptide
  Seed: YDFFVWLHYY (TYRP2_HUMAN)
YNFFVWLHYF

SEQ ID NO: 193271 - protein, 11 aa, Artificial Sequence
  Description of Artificial Sequence: Synthetic peptide
  Seed: VEETPGWPTTL (TYRP2_HUMAN)
VEETPGWPTTA

SEQ ID NO: 193272 - protein, 9 aa, Artificial Sequence
  Description of Artificial Sequence: Synthetic peptide
  Seed: VIRQNIHSL (TYRP2_HUMAN)
VRRQNIHSY

SEQ ID NO: 193273 - protein, 10 aa, Artificial Sequence
  Description of Artificial Sequence: Synthetic peptide
  Seed: SVYDFFVWLH (TYRP2_HUMAN)
SGYDFFVWLR

SEQ ID NO: 193274 - protein, 11 aa, Artificial Sequence
  Description of Artificial Sequence: Synthetic peptide
  Seed: YNMVPFFPPVT (TYRP2_HUMAN)
YIMVPFFPPVW

SEQ ID NO: 193275 - protein, 9 aa, Artificial Sequence
  Description of Artificial Sequence: Synthetic peptide
  Seed: LVNKECCPR (TYRP2_HUMAN)
LTNKECCPK

SEQ ID NO: 193276 - protein, 10 aa, Artificial Sequence
  Description of Artificial Sequence: Synthetic peptide
  Seed: SPLWWGFLLS (TYRP2_HUMAN)
SMLWWGFLLT

SEQ ID NO: 193277 - protein, 9 aa, Artificial Sequence
  Description of Artificial Sequence: Synthetic peptide
  Seed: NALEGFDKA (TYRP2_HUMAN)
NILEGFDKM

SEQ ID NO: 193278 - protein, 9 aa, Artificial Sequence
  Description of Artificial Sequence: Synthetic peptide
  Seed: RVCMTVDSL (TYRP2_HUMAN)
RQCMTVDSI

SEQ ID NO: 193279 - protein, 10 aa, Artificial Sequence
  Description of Artificial Sequence: Synthetic peptide
  Seed: TDAIFDEWMK (TYRP2_HUMAN)
TVAIFDEWMK

SEQ ID NO: 193280 - protein, 11 aa, Artificial Sequence
  Description of Artificial Sequence: Synthetic peptide
  Seed: YNMVPFFPPVT (TYRP2_HUMAN)
YLMVPFFPPVA

SEQ ID NO: 193281 - protein, 9 aa, Artificial Sequence
  Description of Artificial Sequence: Synthetic peptide
  Seed: TLDSQVMSL (TYRP2_HUMAN)
TRDSQVMSF

SEQ ID NO: 193282 - protein, 10 aa, Artificial Sequence
  Description of Artificial Sequence: Synthetic peptide
  Seed: REQFLGALDL (TYRP2_HUMAN)
RAQFLGALDF

SEQ ID NO: 193283 - protein, 8 aa, Artificial Sequence
  Description of Artificial Sequence: Synthetic peptide
  Seed: SLDDYNHL (TYRP2_HUMAN)
SVDDYNHI

SEQ ID NO: 193284 - protein, 10 aa, Artificial Sequence
  Description of Artificial Sequence: Synthetic peptide
  Seed: YDFFVWLHYY (TYRP2_HUMAN)
YFFFVWLHYA

SEQ ID NO: 193285 - protein, 9 aa, Artificial Sequence
  Description of Artificial Sequence: Synthetic peptide
  Seed: RVCMTVDSL (TYRP2_HUMAN)
RICMTVDSV

SEQ ID NO: 193286 - protein, 10 aa, Artificial Sequence
  Description of Artificial Sequence: Synthetic peptide
  Seed: CMTVDSLVNK (TYRP2_HUMAN)
CTTVDSLVNK

SEQ ID NO: 193287 - protein, 10 aa, Artificial Sequence
  Description of Artificial Sequence: Synthetic peptide
  Seed: RTCKCTGNFA (TYRP2_HUMAN)
RLCKCTGNFK

SEQ ID NO: 193288 - protein, 9 aa, Artificial Sequence
  Description of Artificial Sequence: Synthetic peptide
  Seed: SLDDYNHLV (TYRP2_HUMAN)
SLDDYNHLF

SEQ ID NO: 193289 - protein, 10 aa, Artificial Sequence
  Description of Artificial Sequence: Synthetic peptide
  Seed: AANDPIFVVL (TYRP2_HUMAN)
APNDPIFVVM

SEQ ID NO: 193290 - protein, 9 aa, Artificial Sequence
  Description of Artificial Sequence: Synthetic peptide
  Seed: HYYSVRDTL (TYRP2_HUMAN)
HWYSVRDTW

SEQ ID NO: 193291 - protein, 9 aa, Artificial Sequence
  Description of Artificial Sequence: Synthetic peptide
  Seed: FVLLAFLQY (TYRP2_HUMAN)
FTLLAFLQW

SEQ ID NO: 193292 - protein, 11 aa, Artificial Sequence
  Description of Artificial Sequence: Synthetic peptide
  Seed: MSLHNLVHSFL (TYRP2_HUMAN)
MLLHNLVHSFL

SEQ ID NO: 193293 - protein, 11 aa, Artificial Sequence
  Description of Artificial Sequence: Synthetic peptide
  Seed: QRLIGNESFAL (TYRP2_HUMAN)
QHLIGNESFAL

SEQ ID NO: 193294 - protein, 9 aa, Artificial Sequence
  Description of Artificial Sequence: Synthetic peptide
  Seed: DSLDDYNHL (TYRP2_HUMAN)
DILDDYNHR

SEQ ID NO: 193295 - protein, 10 aa, Artificial Sequence
  Description of Artificial Sequence: Synthetic peptide
  Seed: SLDDYNHLVT (TYRP2_HUMAN)
SGDDYNHLVM

SEQ ID NO: 193296 - protein, 11 aa, Artificial Sequence
  Description of Artificial Sequence: Synthetic peptide
  Seed: QRLIGNESFAL (TYRP2_HUMAN)
QRLIGNESFAV

SEQ ID NO: 193297 - protein, 10 aa, Artificial Sequence
  Description of Artificial Sequence: Synthetic peptide
  Seed: FFPPVTNEEL (TYRP2_HUMAN)
FNPPVTNEEL

SEQ ID NO: 193298 - protein, 10 aa, Artificial Sequence
  Description of Artificial Sequence: Synthetic peptide
  Seed: GWPTTLLVVM (TYRP2_HUMAN)
GYPTTLLVVY

SEQ ID NO: 193299 - protein, 9 aa, Artificial Sequence
  Description of Artificial Sequence: Synthetic peptide
  Seed: ITTQHWLGL (TYRP2_HUMAN)
ITTQHWLGY

SEQ ID NO: 193300 - protein, 10 aa, Artificial Sequence
  Description of Artificial Sequence: Synthetic peptide
  Seed: SLDDYNHLVT (TYRP2_HUMAN)
STDDYNHLVV

SEQ ID NO: 193301 - protein, 9 aa, Artificial Sequence
  Description of Artificial Sequence: Synthetic peptide
  Seed: NMVPFFPPV (TYRP2_HUMAN)
NFVPFFPPF

SEQ ID NO: 193302 - protein, 10 aa, Artificial Sequence
  Description of Artificial Sequence: Synthetic peptide
  Seed: RMYNMVPFFP (TYRP2_HUMAN)
REYNMVPFFF

SEQ ID NO: 193303 - protein, 10 aa, Artificial Sequence
  Description of Artificial Sequence: Synthetic peptide
  Seed: ADTRPWSGPY (TYRP2_HUMAN)
ARTRPWSGPK

SEQ ID NO: 193304 - protein, 9 aa, Artificial Sequence
  Description of Artificial Sequence: Synthetic peptide
  Seed: SLDDYNHLV (TYRP2_HUMAN)
SVDDYNHLL

SEQ ID NO: 193305 - protein, 9 aa, Artificial Sequence
  Description of Artificial Sequence: Synthetic peptide
  Seed: TLDSQVMSL (TYRP2_HUMAN)
TSDSQVMSC

SEQ ID NO: 193306 - protein, 9 aa, Artificial Sequence
  Description of Artificial Sequence: Synthetic peptide
  Seed: RLIGNESFA (TYRP2_HUMAN)
RMIGNESFA

SEQ ID NO: 193307 - protein, 9 aa, Artificial Sequence
  Description of Artificial Sequence: Synthetic peptide
  Seed: ESANVCGSQ (TYRP2_HUMAN)
ETANVCGSR

SEQ ID NO: 193308 - protein, 9 aa, Artificial Sequence
  Description of Artificial Sequence: Synthetic peptide
  Seed: TSDQLGYSY (TYRP2_HUMAN)
TMDQLGYSM

SEQ ID NO: 193309 - protein, 9 aa, Artificial Sequence
  Description of Artificial Sequence: Synthetic peptide
  Seed: YSYAIDLPV (TYRP2_HUMAN)
YWYAIDLPI

SEQ ID NO: 193310 - protein, 10 aa, Artificial Sequence
  Description of Artificial Sequence: Synthetic peptide
  Seed: REQFLGALDL (TYRP2_HUMAN)
RHQFLGALDM

SEQ ID NO: 193311 - protein, 9 aa, Artificial Sequence
  Description of Artificial Sequence: Synthetic peptide
  Seed: SVYDFFVWL (TYRP2_HUMAN)
SLYDFFVWM

SEQ ID NO: 193312 - protein, 9 aa, Artificial Sequence
  Description of Artificial Sequence: Synthetic peptide
  Seed: NRMYNMVPF (TYRP2_HUMAN)
NHMYNMVPL

SEQ ID NO: 193313 - protein, 9 aa, Artificial Sequence
  Description of Artificial Sequence: Synthetic peptide
  Seed: NMVPFFPPV (TYRP2_HUMAN)
NSVPFFPPM

SEQ ID NO: 193314 - protein, 9 aa, Artificial Sequence
  Description of Artificial Sequence: Synthetic peptide
  Seed: VLHSFTDAI (TYRP2_HUMAN)
VMHSFTDAR

SEQ ID NO: 193315 - protein, 10 aa, Artificial Sequence
  Description of Artificial Sequence: Synthetic peptide
  Seed: NSRFSSWETV (TYRP2_HUMAN)
NIRFSSWETL

SEQ ID NO: 193316 - protein, 9 aa, Artificial Sequence
  Description of Artificial Sequence: Synthetic peptide
  Seed: NMVPFFPPV (TYRP2_HUMAN)
NQVPFFPPI

SEQ ID NO: 193317 - protein, 9 aa, Artificial Sequence
  Description of Artificial Sequence: Synthetic peptide
  Seed: GTYEGLLRR (TYRP2_HUMAN)
GMYEGLLRM

SEQ ID NO: 193318 - protein, 8 aa, Artificial Sequence
  Description of Artificial Sequence: Synthetic peptide
  Seed: FSHQGPAF (TYRP2_HUMAN)
FYHQGPAV

SEQ ID NO: 193319 - protein, 11 aa, Artificial Sequence
  Description of Artificial Sequence: Synthetic peptide
  Seed: RADTRPWSGPY (TYRP2_HUMAN)
RMDTRPWSGPK

SEQ ID NO: 193320 - protein, 9 aa, Artificial Sequence
  Description of Artificial Sequence: Synthetic peptide
  Seed: SLDDYNHLV (TYRP2_HUMAN)
SYDDYNHLV

SEQ ID NO: 193321 - protein, 11 aa, Artificial Sequence
  Description of Artificial Sequence: Synthetic peptide
  Seed: MYNMVPFFPPV (TYRP2_HUMAN)
MCNMVPFFPPV

SEQ ID NO: 193322 - protein, 9 aa, Artificial Sequence
  Description of Artificial Sequence: Synthetic peptide
  Seed: NSMKLPTLK (TYRP2_HUMAN)
NVMKLPTLR

SEQ ID NO: 193323 - protein, 10 aa, Artificial Sequence
  Description of Artificial Sequence: Synthetic peptide
  Seed: SDQLGYSYAI (TYRP2_HUMAN)
SAQLGYSYAV

SEQ ID NO: 193324 - protein, 11 aa, Artificial Sequence
  Description of Artificial Sequence: Synthetic peptide
  Seed: RNSRFSSWETV (TYRP2_HUMAN)
RLSRFSSWETM

SEQ ID NO: 193325 - protein, 9 aa, Artificial Sequence
  Description of Artificial Sequence: Synthetic peptide
  Seed: RNQMGRNSM (TYRP2_HUMAN)
RQQMGRNSY

SEQ ID NO: 193326 - protein, 11 aa, Artificial Sequence
  Description of Artificial Sequence: Synthetic peptide
  Seed: RNSRFSSWETV (TYRP2_HUMAN)
RMSRFSSWETL

SEQ ID NO: 193327 - protein, 8 aa, Artificial Sequence
  Description of Artificial Sequence: Synthetic peptide
  Seed: LLGPGRPY (TYRP2_HUMAN)
LAGPGRPY

SEQ ID NO: 193328 - protein, 11 aa, Artificial Sequence
  Description of Artificial Sequence: Synthetic peptide
  Seed: LLGPNGTQPQF (TYRP2_HUMAN)
LSGPNGTQPQW

SEQ ID NO: 193329 - protein, 10 aa, Artificial Sequence
  Description of Artificial Sequence: Synthetic peptide
  Seed: ELAPIGHNRM (TYRP2_HUMAN)
EIAPIGHNRL

SEQ ID NO: 193330 - protein, 10 aa, Artificial Sequence
  Description of Artificial Sequence: Synthetic peptide
  Seed: TRPWSGPYIL (TYRP2_HUMAN)
TLPWSGPYIF

SEQ ID NO: 193331 - protein, 10 aa, Artificial Sequence
  Description of Artificial Sequence: Synthetic peptide
  Seed: LDDYNHLVTL (TYRP2_HUMAN)
LADYNHLVTL

SEQ ID NO: 193332 - protein, 9 aa, Artificial Sequence
  Description of Artificial Sequence: Synthetic peptide
  Seed: RLRKGYTPL (TYRP2_HUMAN)
RLRKGYTPM

SEQ ID NO: 193333 - protein, 8 aa, Artificial Sequence
  Description of Artificial Sequence: Synthetic peptide
  Seed: AIDLPVSV (TYRP2_HUMAN)
AADLPVSV

SEQ ID NO: 193334 - protein, 10 aa, Artificial Sequence
  Description of Artificial Sequence: Synthetic peptide
  Seed: FFQNSTFSFR (TYRP2_HUMAN)
FYQNSTFSFF

SEQ ID NO: 193335 - protein, 8 aa, Artificial Sequence
  Description of Artificial Sequence: Synthetic peptide
  Seed: SLDDYNHL (TYRP2_HUMAN)
SWDDYNHI

SEQ ID NO: 193336 - protein, 11 aa, Artificial Sequence
  Description of Artificial Sequence: Synthetic peptide
  Seed: CDSLDDYNHLV (TYRP2_HUMAN)
CVSLDDYNHLV

SEQ ID NO: 193337 - protein, 10 aa, Artificial Sequence
  Description of Artificial Sequence: Synthetic peptide
  Seed: FFQNSTFSFR (TYRP2_HUMAN)
FVQNSTFSFR

SEQ ID NO: 193338 - protein, 9 aa, Artificial Sequence
  Description of Artificial Sequence: Synthetic peptide
  Seed: MTVDSLVNK (TYRP2_HUMAN)
MMVDSLVNR

SEQ ID NO: 193339 - protein, 9 aa, Artificial Sequence
  Description of Artificial Sequence: Synthetic peptide
  Seed: ILPGAQGQF (TYRP2_HUMAN)
IFPGAQGQW

SEQ ID NO: 193340 - protein, 10 aa, Artificial Sequence
  Description of Artificial Sequence: Synthetic peptide
  Seed: QELAPIGHNR (TYRP2_HUMAN)
QALAPIGHNR

SEQ ID NO: 193341 - protein, 9 aa, Artificial Sequence
  Description of Artificial Sequence: Synthetic peptide
  Seed: VGLFVLLAF (TYRP2_HUMAN)
VTLFVLLAY

SEQ ID NO: 193342 - protein, 10 aa, Artificial Sequence
  Description of Artificial Sequence: Synthetic peptide
  Seed: RRNQMGRNSM (TYRP2_HUMAN)
RRNQMGRNSF

SEQ ID NO: 193343 - protein, 10 aa, Artificial Sequence
  Description of Artificial Sequence: Synthetic peptide
  Seed: AFLQYRRLRK (TYRP2_HUMAN)
ALLQYRRLRK

SEQ ID NO: 193344 - protein, 9 aa, Artificial Sequence
  Description of Artificial Sequence: Synthetic peptide
  Seed: METHLSSKR (TYRP2_HUMAN)
MWTHLSSKR

SEQ ID NO: 193345 - protein, 9 aa, Artificial Sequence
  Description of Artificial Sequence: Synthetic peptide
  Seed: FLNGTNALP (TYRP2_HUMAN)
FQNGTNALV

SEQ ID NO: 193346 - protein, 10 aa, Artificial Sequence
  Description of Artificial Sequence: Synthetic peptide
  Seed: HSFLNGTNAL (TYRP2_HUMAN)
HSFLNGTNAF

SEQ ID NO: 193347 - protein, 10 aa, Artificial Sequence
  Description of Artificial Sequence: Synthetic peptide
  Seed: NPPFFQNSTF (TYRP2_HUMAN)
NAPFFQNSTY

SEQ ID NO: 193348 - protein, 9 aa, Artificial Sequence
  Description of Artificial Sequence: Synthetic peptide
  Seed: PADAWPQEL (TYRP2_HUMAN)
PFDAWPQEI

SEQ ID NO: 193349 - protein, 9 aa, Artificial Sequence
  Description of Artificial Sequence: Synthetic peptide
  Seed: ISRNSRFSS (TYRP2_HUMAN)
IFRNSRFSK

SEQ ID NO: 193350 - protein, 10 aa, Artificial Sequence
  Description of Artificial Sequence: Synthetic peptide
  Seed: IDFSHQGPAF (TYRP2_HUMAN)
IQFSHQGPAY

SEQ ID NO: 193351 - protein, 10 aa, Artificial Sequence
  Description of Artificial Sequence: Synthetic peptide
  Seed: SHQGPAFVTW (TYRP2_HUMAN)
SYQGPAFVTI

SEQ ID NO: 193352 - protein, 10 aa, Artificial Sequence
  Description of Artificial Sequence: Synthetic peptide
  Seed: TDAIFDEWMK (TYRP2_HUMAN)
TVAIFDEWMR

SEQ ID NO: 193353 - protein, 9 aa, Artificial Sequence
  Description of Artificial Sequence: Synthetic peptide
  Seed: HQGPAFVTW (TYRP2_HUMAN)
HQGPAFVTY

SEQ ID NO: 193354 - protein, 9 aa, Artificial Sequence
  Description of Artificial Sequence: Synthetic peptide
  Seed: ETPGWPTTL (TYRP2_HUMAN)
ELPGWPTTK

SEQ ID NO: 193355 - protein, 10 aa, Artificial Sequence
  Description of Artificial Sequence: Synthetic peptide
  Seed: QPQFANCSVY (TYRP2_HUMAN)
QTQFANCSVF

SEQ ID NO: 193356 - protein, 10 aa, Artificial Sequence
  Description of Artificial Sequence: Synthetic peptide
  Seed: RLRKGYTPLM (TYRP2_HUMAN)
RIRKGYTPLM

SEQ ID NO: 193357 - protein, 10 aa, Artificial Sequence
  Description of Artificial Sequence: Synthetic peptide
  Seed: CCPRLGAESA (TYRP2_HUMAN)
CIPRLGAESL

SEQ ID NO: 193358 - protein, 11 aa, Artificial Sequence
  Description of Artificial Sequence: Synthetic peptide
  Seed: RADTRPWSGPY (TYRP2_HUMAN)
RQDTRPWSGPM

SEQ ID NO: 193359 - protein, 9 aa, Artificial Sequence
  Description of Artificial Sequence: Synthetic peptide
  Seed: YVITTQHWL (TYRP2_HUMAN)
YTITTQHWI

SEQ ID NO: 193360 - protein, 11 aa, Artificial Sequence
  Description of Artificial Sequence: Synthetic peptide
  Seed: RRNQMGRNSMK (TYRP2_HUMAN)
RSNQMGRNSMR

SEQ ID NO: 193361 - protein, 9 aa, Artificial Sequence
  Description of Artificial Sequence: Synthetic peptide
  Seed: SVYDFFVWL (TYRP2_HUMAN)
SIYDFFVWI

SEQ ID NO: 193362 - protein, 10 aa, Artificial Sequence
  Description of Artificial Sequence: Synthetic peptide
  Seed: ELAPIGHNRM (TYRP2_HUMAN)
EVAPIGHNRE

SEQ ID NO: 193363 - protein, 11 aa, Artificial Sequence
  Description of Artificial Sequence: Synthetic peptide
  Seed: RMYNMVPFFPP (TYRP2_HUMAN)
RIYNMVPFFPL

SEQ ID NO: 193364 - protein, 9 aa, Artificial Sequence
  Description of Artificial Sequence: Synthetic peptide
  Seed: FPPVTNEEL (TYRP2_HUMAN)
FGPVTNEEF

SEQ ID NO: 193365 - protein, 9 aa, Artificial Sequence
  Description of Artificial Sequence: Synthetic peptide
  Seed: TSDQLGYSY (TYRP2_HUMAN)
TFDQLGYSM

SEQ ID NO: 193366 - protein, 9 aa, Artificial Sequence
  Description of Artificial Sequence: Synthetic peptide
  Seed: CERKKPPVI (TYRP2_HUMAN)
CARKKPPVL

SEQ ID NO: 193367 - protein, 9 aa, Artificial Sequence
  Description of Artificial Sequence: Synthetic peptide
  Seed: VTNEELFLT (TYRP2_HUMAN)
VANEELFLA

SEQ ID NO: 193368 - protein, 11 aa, Artificial Sequence
  Description of Artificial Sequence: Synthetic peptide
  Seed: FLTSDQLGYSY (TYRP2_HUMAN)
FATSDQLGYSY

SEQ ID NO: 193369 - protein, 11 aa, Artificial Sequence
  Description of Artificial Sequence: Synthetic peptide
  Seed: RRNQMGRNSMK (TYRP2_HUMAN)
RFNQMGRNSMR

SEQ ID NO: 193370 - protein, 10 aa, Artificial Sequence
  Description of Artificial Sequence: Synthetic peptide
  Seed: GTLDSQVMSL (TYRP2_HUMAN)
GYLDSQVMSL

SEQ ID NO: 193371 - protein, 9 aa, Artificial Sequence
  Description of Artificial Sequence: Synthetic peptide
  Seed: VIRQNIHSL (TYRP2_HUMAN)
VMRQNIHSL

SEQ ID NO: 193372 - protein, 10 aa, Artificial Sequence
  Description of Artificial Sequence: Synthetic peptide
  Seed: VVLHSFTDAI (TYRP2_HUMAN)
VELHSFTDAV

SEQ ID NO: 193373 - protein, 9 aa, Artificial Sequence
  Description of Artificial Sequence: Synthetic peptide
  Seed: WPTTLLVVM (TYRP2_HUMAN)
WQTTLLVVL

SEQ ID NO: 193374 - protein, 10 aa, Artificial Sequence
  Description of Artificial Sequence: Synthetic peptide
  Seed: HNRMYNMVPF (TYRP2_HUMAN)
HTRMYNMVPF

SEQ ID NO: 193375 - protein, 9 aa, Artificial Sequence
  Description of Artificial Sequence: Synthetic peptide
  Seed: YAIDLPVSV (TYRP2_HUMAN)
YWIDLPVSY

SEQ ID NO: 193376 - protein, 10 aa, Artificial Sequence
  Description of Artificial Sequence: Synthetic peptide
  Seed: SLDDYNHLVT (TYRP2_HUMAN)
STDDYNHLVI

SEQ ID NO: 193377 - protein, 10 aa, Artificial Sequence
  Description of Artificial Sequence: Synthetic peptide
  Seed: LQRLIGNESF (TYRP2_HUMAN)
LQRLIGNESM

SEQ ID NO: 193378 - protein, 10 aa, Artificial Sequence
  Description of Artificial Sequence: Synthetic peptide
  Seed: RRLRKGYTPL (TYRP2_HUMAN)
RFLRKGYTPF

SEQ ID NO: 193379 - protein, 10 aa, Artificial Sequence
  Description of Artificial Sequence: Synthetic peptide
  Seed: ITTQHWLGLL (TYRP2_HUMAN)
ISTQHWLGLW

SEQ ID NO: 193380 - protein, 9 aa, Artificial Sequence
  Description of Artificial Sequence: Synthetic peptide
  Seed: VLHSFTDAI (TYRP2_HUMAN)
VIHSFTDAV

SEQ ID NO: 193381 - protein, 10 aa, Artificial Sequence
  Description of Artificial Sequence: Synthetic peptide
  Seed: MGRNSMKLPT (TYRP2_HUMAN)
MARNSMKLPK

SEQ ID NO: 193382 - protein, 9 aa, Artificial Sequence
  Description of Artificial Sequence: Synthetic peptide
  Seed: ALDLAKKRV (TYRP2_HUMAN)
ALDLAKKRL

SEQ ID NO: 193383 - protein, 9 aa, Artificial Sequence
  Description of Artificial Sequence: Synthetic peptide
  Seed: QHWLGLLGP (TYRP2_HUMAN)
QHWLGLLGA

SEQ ID NO: 193384 - protein, 9 aa, Artificial Sequence
  Description of Artificial Sequence: Synthetic peptide
  Seed: KCTGNFAGY (TYRP2_HUMAN)
KATGNFAGY

SEQ ID NO: 193385 - protein, 11 aa, Artificial Sequence
  Description of Artificial Sequence: Synthetic peptide
  Seed: CDSLDDYNHLV (TYRP2_HUMAN)
CFSLDDYNHLV

SEQ ID NO: 193386 - protein, 9 aa, Artificial Sequence
  Description of Artificial Sequence: Synthetic peptide
  Seed: WHRYHLLCL (TYRP2_HUMAN)
WLRYHLLCL

SEQ ID NO: 193387 - protein, 9 aa, Artificial Sequence
  Description of Artificial Sequence: Synthetic peptide
  Seed: YAIDLPVSV (TYRP2_HUMAN)
YWIDLPVSM

SEQ ID NO: 193388 - protein, 10 aa, Artificial Sequence
  Description of Artificial Sequence: Synthetic peptide
  Seed: LTSDQLGYSY (TYRP2_HUMAN)
LMSDQLGYSW

SEQ ID NO: 193389 - protein, 9 aa, Artificial Sequence
  Description of Artificial Sequence: Synthetic peptide
  Seed: RDCLSLQKF (TYRP2_HUMAN)
RQCLSLQKY

SEQ ID NO: 193390 - protein, 9 aa, Artificial Sequence
  Description of Artificial Sequence: Synthetic peptide
  Seed: RMYNMVPFF (TYRP2_HUMAN)
RAYNMVPFA

SEQ ID NO: 193391 - protein, 10 aa, Artificial Sequence
  Description of Artificial Sequence: Synthetic peptide
  Seed: HSFLNGTNAL (TYRP2_HUMAN)
HAFLNGTNAY

SEQ ID NO: 193392 - protein, 9 aa, Artificial Sequence
  Description of Artificial Sequence: Synthetic peptide
  Seed: PADAWPQEL (TYRP2_HUMAN)
PVDAWPQEL

SEQ ID NO: 193393 - protein, 9 aa, Artificial Sequence
  Description of Artificial Sequence: Synthetic peptide
  Seed: RAIDFSHQG (TYRP2_HUMAN)
RSIDFSHQL

SEQ ID NO: 193394 - protein, 11 aa, Artificial Sequence
  Description of Artificial Sequence: Synthetic peptide
  Seed: MYNMVPFFPPV (TYRP2_HUMAN)
MYNMVPFFPPF

SEQ ID NO: 193395 - protein, 10 aa, Artificial Sequence
  Description of Artificial Sequence: Synthetic peptide
  Seed: LGPNGTQPQF (TYRP2_HUMAN)
LAPNGTQPQW

SEQ ID NO: 193396 - protein, 10 aa, Artificial Sequence
  Description of Artificial Sequence: Synthetic peptide
  Seed: SVYDFFVWLH (TYRP2_HUMAN)
SWYDFFVWLR

SEQ ID NO: 193397 - protein, 9 aa, Artificial Sequence
  Description of Artificial Sequence: Synthetic peptide
  Seed: HQGPAFVTW (TYRP2_HUMAN)
HGGPAFVTF

SEQ ID NO: 193398 - protein, 10 aa, Artificial Sequence
  Description of Artificial Sequence: Synthetic peptide
  Seed: LGPGRPYRAI (TYRP2_HUMAN)
LAPGRPYRAL

SEQ ID NO: 193399 - protein, 9 aa, Artificial Sequence
  Description of Artificial Sequence: Synthetic peptide
  Seed: YAIDLPVSV (TYRP2_HUMAN)
YRIDLPVSV

SEQ ID NO: 193400 - protein, 10 aa, Artificial Sequence
  Description of Artificial Sequence: Synthetic peptide
  Seed: MSPLWWGFLL (TYRP2_HUMAN)
MRPLWWGFLM

SEQ ID NO: 193401 - protein, 9 aa, Artificial Sequence
  Description of Artificial Sequence: Synthetic peptide
  Seed: YVITTQHWL (TYRP2_HUMAN)
YTITTQHWF

SEQ ID NO: 193402 - protein, 9 aa, Artificial Sequence
  Description of Artificial Sequence: Synthetic peptide
  Seed: RFNPPADAW (TYRP2_HUMAN)
RFNPPADAY

SEQ ID NO: 193403 - protein, 10 aa, Artificial Sequence
  Description of Artificial Sequence: Synthetic peptide
  Seed: GTLDSQVMSL (TYRP2_HUMAN)
GILDSQVMSV

SEQ ID NO: 193404 - protein, 9 aa, Artificial Sequence
  Description of Artificial Sequence: Synthetic peptide
  Seed: RLRKGYTPL (TYRP2_HUMAN)
RGRKGYTPK

SEQ ID NO: 193405 - protein, 9 aa, Artificial Sequence
  Description of Artificial Sequence: Synthetic peptide
  Seed: LLAFLQYRR (TYRP2_HUMAN)
LAAFLQYRR

SEQ ID NO: 193406 - protein, 11 aa, Artificial Sequence
  Description of Artificial Sequence: Synthetic peptide
  Seed: RNSRFSSWETV (TYRP2_HUMAN)
RASRFSSWETM

SEQ ID NO: 193407 - protein, 10 aa, Artificial Sequence
  Description of Artificial Sequence: Synthetic peptide
  Seed: REQFLGALDL (TYRP2_HUMAN)
RKQFLGALDF

SEQ ID NO: 193408 - protein, 10 aa, Artificial Sequence
  Description of Artificial Sequence: Synthetic peptide
  Seed: VVLHSFTDAI (TYRP2_HUMAN)
VALHSFTDAV

SEQ ID NO: 193409 - protein, 10 aa, Artificial Sequence
  Description of Artificial Sequence: Synthetic peptide
  Seed: YDFFVWLHYY (TYRP2_HUMAN)
YFFFVWLHYQ

SEQ ID NO: 193410 - protein, 9 aa, Artificial Sequence
  Description of Artificial Sequence: Synthetic peptide
  Seed: PADAWPQEL (TYRP2_HUMAN)
PYDAWPQEL

SEQ ID NO: 193411 - protein, 10 aa, Artificial Sequence
  Description of Artificial Sequence: Synthetic peptide
  Seed: QPQFANCSVY (TYRP2_HUMAN)
QEQFANCSVM

SEQ ID NO: 193412 - protein, 9 aa, Artificial Sequence
  Description of Artificial Sequence: Synthetic peptide
  Seed: SFLNGTNAL (TYRP2_HUMAN)
SWLNGTNAI

SEQ ID NO: 193413 - protein, 9 aa, Artificial Sequence
  Description of Artificial Sequence: Synthetic peptide
  Seed: TLLGPGRPY (TYRP2_HUMAN)
TMLGPGRPY

SEQ ID NO: 193414 - protein, 9 aa, Artificial Sequence
  Description of Artificial Sequence: Synthetic peptide
  Seed: VTWHRYHLL (TYRP2_HUMAN)
VAWHRYHLW

SEQ ID NO: 193415 - protein, 10 aa, Artificial Sequence
  Description of Artificial Sequence: Synthetic peptide
  Seed: VVLHSFTDAI (TYRP2_HUMAN)
VQLHSFTDAV

SEQ ID NO: 193416 - protein, 9 aa, Artificial Sequence
  Description of Artificial Sequence: Synthetic peptide
  Seed: GLFVLLAFL (TYRP2_HUMAN)
GQFVLLAFL

SEQ ID NO: 193417 - protein, 10 aa, Artificial Sequence
  Description of Artificial Sequence: Synthetic peptide
  Seed: FVVLHSFTDA (TYRP2_HUMAN)
FVVLHSFTDV

SEQ ID NO: 193418 - protein, 10 aa, Artificial Sequence
  Description of Artificial Sequence: Synthetic peptide
  Seed: FFQNSTFSFR (TYRP2_HUMAN)
FFQNSTFSFM

SEQ ID NO: 193419 - protein, 9 aa, Artificial Sequence
  Description of Artificial Sequence: Synthetic peptide
  Seed: RVCMTVDSL (TYRP2_HUMAN)
RQCMTVDSL

SEQ ID NO: 193420 - protein, 10 aa, Artificial Sequence
  Description of Artificial Sequence: Synthetic peptide
  Seed: AARPDDPTLI (TYRP2_HUMAN)
ASRPDDPTLF

SEQ ID NO: 193421 - protein, 9 aa, Artificial Sequence
  Description of Artificial Sequence: Synthetic peptide
  Seed: FLNGTNALP (TYRP2_HUMAN)
FQNGTNALM

SEQ ID NO: 193422 - protein, 9 aa, Artificial Sequence
  Description of Artificial Sequence: Synthetic peptide
  Seed: GPNGTQPQF (TYRP2_HUMAN)
GPNGTQPQL

SEQ ID NO: 193423 - protein, 9 aa, Artificial Sequence
  Description of Artificial Sequence: Synthetic peptide
  Seed: RPWSGPYIL (TYRP2_HUMAN)
RPWSGPYIF

SEQ ID NO: 193424 - protein, 9 aa, Artificial Sequence
  Description of Artificial Sequence: Synthetic peptide
  Seed: RNQMGRNSM (TYRP2_HUMAN)
RVQMGRNSF

SEQ ID NO: 193425 - protein, 9 aa, Artificial Sequence
  Description of Artificial Sequence: Synthetic peptide
  Seed: RNSMKLPTL (TYRP2_HUMAN)
RASMKLPTL

SEQ ID NO: 193426 - protein, 10 aa, Artificial Sequence
  Description of Artificial Sequence: Synthetic peptide
  Seed: QELAPIGHNR (TYRP2_HUMAN)
QNLAPIGHNR

SEQ ID NO: 193427 - protein, 9 aa, Artificial Sequence
  Description of Artificial Sequence: Synthetic peptide
  Seed: SWETVCDSL (TYRP2_HUMAN)
SFETVCDSF

SEQ ID NO: 193428 - protein, 9 aa, Artificial Sequence
  Description of Artificial Sequence: Synthetic peptide
  Seed: TLDSQVMSL (TYRP2_HUMAN)
TNDSQVMSL

SEQ ID NO: 193429 - protein, 9 aa, Artificial Sequence
  Description of Artificial Sequence: Synthetic peptide
  Seed: YSVRDTLLG (TYRP2_HUMAN)
YTVRDTLLF

SEQ ID NO: 193430 - protein, 9 aa, Artificial Sequence
  Description of Artificial Sequence: Synthetic peptide
  Seed: VGLFVLLAF (TYRP2_HUMAN)
VMLFVLLAY

SEQ ID NO: 193431 - protein, 9 aa, Artificial Sequence
  Description of Artificial Sequence: Synthetic peptide
  Seed: VTNEELFLT (TYRP2_HUMAN)
VINEELFLV

SEQ ID NO: 193432 - protein, 10 aa, Artificial Sequence
  Description of Artificial Sequence: Synthetic peptide
  Seed: RELWPRKFFH (TYRP2_HUMAN)
RSLWPRKFFY

SEQ ID NO: 193433 - protein, 10 aa, Artificial Sequence
  Description of Artificial Sequence: Synthetic peptide
  Seed: LQKFDNPPFF (TYRP2_HUMAN)
LMKFDNPPFY

SEQ ID NO: 193434 - protein, 11 aa, Artificial Sequence
  Description of Artificial Sequence: Synthetic peptide
  Seed: YNMVPFFPPVT (TYRP2_HUMAN)
YAMVPFFPPVV

SEQ ID NO: 193435 - protein, 9 aa, Artificial Sequence
  Description of Artificial Sequence: Synthetic peptide
  Seed: RMYNMVPFF (TYRP2_HUMAN)
RFYNMVPFR

SEQ ID NO: 193436 - protein, 10 aa, Artificial Sequence
  Description of Artificial Sequence: Synthetic peptide
  Seed: PFFQNSTFSF (TYRP2_HUMAN)
PWFQNSTFSW

SEQ ID NO: 193437 - protein, 9 aa, Artificial Sequence
  Description of Artificial Sequence: Synthetic peptide
  Seed: DQLGYSYAI (TYRP2_HUMAN)
DVLGYSYAI

SEQ ID NO: 193438 - protein, 9 aa, Artificial Sequence
  Description of Artificial Sequence: Synthetic peptide
  Seed: FTDAIFDEW (TYRP2_HUMAN)
FFDAIFDEV

SEQ ID NO: 193439 - protein, 10 aa, Artificial Sequence
  Description of Artificial Sequence: Synthetic peptide
  Seed: TRPWSGPYIL (TYRP2_HUMAN)
TCPWSGPYIY

SEQ ID NO: 193440 - protein, 8 aa, Artificial Sequence
  Description of Artificial Sequence: Synthetic peptide
  Seed: FQNSTFSF (TYRP2_HUMAN)
FWNSTFSF

SEQ ID NO: 193441 - protein, 9 aa, Artificial Sequence
  Description of Artificial Sequence: Synthetic peptide
  Seed: FVLLAFLQY (TYRP2_HUMAN)
FHLLAFLQY

SEQ ID NO: 193442 - protein, 11 aa, Artificial Sequence
  Description of Artificial Sequence: Synthetic peptide
  Seed: YNMVPFFPPVT (TYRP2_HUMAN)
YLMVPFFPPVM

SEQ ID NO: 193443 - protein, 10 aa, Artificial Sequence
  Description of Artificial Sequence: Synthetic peptide
  Seed: RMYNMVPFFP (TYRP2_HUMAN)
RTYNMVPFFM

SEQ ID NO: 193444 - protein, 10 aa, Artificial Sequence
  Description of Artificial Sequence: Synthetic peptide
  Seed: CMTVDSLVNK (TYRP2_HUMAN)
CWTVDSLVNK

SEQ ID NO: 193445 - protein, 9 aa, Artificial Sequence
  Description of Artificial Sequence: Synthetic peptide
  Seed: AARPDDPTL (TYRP2_HUMAN)
ARRPDDPTY

SEQ ID NO: 193446 - protein, 9 aa, Artificial Sequence
  Description of Artificial Sequence: Synthetic peptide
  Seed: TLVALVGLF (TYRP2_HUMAN)
TYVALVGLF

SEQ ID NO: 193447 - protein, 10 aa, Artificial Sequence
  Description of Artificial Sequence: Synthetic peptide
  Seed: RNSMKLPTLK (TYRP2_HUMAN)
RHSMKLPTLR

SEQ ID NO: 193448 - protein, 9 aa, Artificial Sequence
  Description of Artificial Sequence: Synthetic peptide
  Seed: RELWPRKFF (TYRP2_HUMAN)
RELWPRKFA

SEQ ID NO: 193449 - protein, 9 aa, Artificial Sequence
  Description of Artificial Sequence: Synthetic peptide
  Seed: AARPDDPTL (TYRP2_HUMAN)
AIRPDDPTW

SEQ ID NO: 193450 - protein, 9 aa, Artificial Sequence
  Description of Artificial Sequence: Synthetic peptide
  Seed: VIRQNIHSL (TYRP2_HUMAN)
VRRQNIHSM

SEQ ID NO: 193451 - protein, 9 aa, Artificial Sequence
  Description of Artificial Sequence: Synthetic peptide
  Seed: QKFDNPPFF (TYRP2_HUMAN)
QRFDNPPFI

SEQ ID NO: 193452 - protein, 9 aa, Artificial Sequence
  Description of Artificial Sequence: Synthetic peptide
  Seed: VTWHRYHLL (TYRP2_HUMAN)
VYWHRYHLI

SEQ ID NO: 193453 - protein, 10 aa, Artificial Sequence
  Description of Artificial Sequence: Synthetic peptide
  Seed: FFQNSTFSFR (TYRP2_HUMAN)
FFQNSTFSFF

SEQ ID NO: 193454 - protein, 10 aa, Artificial Sequence
  Description of Artificial Sequence: Synthetic peptide
  Seed: MSLHNLVHSF (TYRP2_HUMAN)
MNLHNLVHSY

SEQ ID NO: 193455 - protein, 10 aa, Artificial Sequence
  Description of Artificial Sequence: Synthetic peptide
  Seed: FFPPVTNEEL (TYRP2_HUMAN)
FRPPVTNEEF

SEQ ID NO: 193456 - protein, 9 aa, Artificial Sequence
  Description of Artificial Sequence: Synthetic peptide
  Seed: SLDDYNHLV (TYRP2_HUMAN)
SDDDYNHLM

SEQ ID NO: 193457 - protein, 10 aa, Artificial Sequence
  Description of Artificial Sequence: Synthetic peptide
  Seed: YAIDLPVSVE (TYRP2_HUMAN)
YMIDLPVSVP

SEQ ID NO: 193458 - protein, 9 aa, Artificial Sequence
  Description of Artificial Sequence: Synthetic peptide
  Seed: YAIDLPVSV (TYRP2_HUMAN)
YQIDLPVST

SEQ ID NO: 193459 - protein, 9 aa, Artificial Sequence
  Description of Artificial Sequence: Synthetic peptide
  Seed: NMVPFFPPV (TYRP2_HUMAN)
NQVPFFPPA

SEQ ID NO: 193460 - protein, 9 aa, Artificial Sequence
  Description of Artificial Sequence: Synthetic peptide
  Seed: SLHNLVHSF (TYRP2_HUMAN)
SYHNLVHSM

SEQ ID NO: 193461 - protein, 10 aa, Artificial Sequence
  Description of Artificial Sequence: Synthetic peptide
  Seed: LGPNGTQPQF (TYRP2_HUMAN)
LRPNGTQPQW

SEQ ID NO: 193462 - protein, 8 aa, Artificial Sequence
  Description of Artificial Sequence: Synthetic peptide
  Seed: RPDDPTLI (TYRP2_HUMAN)
RSDDPTLI

SEQ ID NO: 193463 - protein, 10 aa, Artificial Sequence
  Description of Artificial Sequence: Synthetic peptide
  Seed: LVVMGTLVAL (TYRP2_HUMAN)
LGVMGTLVAA

SEQ ID NO: 193464 - protein, 10 aa, Artificial Sequence
  Description of Artificial Sequence: Synthetic peptide
  Seed: AIDFSHQGPA (TYRP2_HUMAN)
ALDFSHQGPV

SEQ ID NO: 193465 - protein, 9 aa, Artificial Sequence
  Description of Artificial Sequence: Synthetic peptide
  Seed: YSYAIDLPV (TYRP2_HUMAN)
YTYAIDLPV

SEQ ID NO: 193466 - protein, 10 aa, Artificial Sequence
  Description of Artificial Sequence: Synthetic peptide
  Seed: FLLSCLGCKI (TYRP2_HUMAN)
FFLSCLGCKV

SEQ ID NO: 193467 - protein, 9 aa, Artificial Sequence
  Description of Artificial Sequence: Synthetic peptide
  Seed: AARPDDPTL (TYRP2_HUMAN)
ANRPDDPTY

SEQ ID NO: 193468 - protein, 9 aa, Artificial Sequence
  Description of Artificial Sequence: Synthetic peptide
  Seed: RLIGNESFA (TYRP2_HUMAN)
RLIGNESFL

SEQ ID NO: 193469 - protein, 9 aa, Artificial Sequence
  Description of Artificial Sequence: Synthetic peptide
  Seed: NMVPFFPPV (TYRP2_HUMAN)
NYVPFFPPM

SEQ ID NO: 193470 - protein, 10 aa, Artificial Sequence
  Description of Artificial Sequence: Synthetic peptide
  Seed: MGTLVALVGL (TYRP2_HUMAN)
MKTLVALVGV

SEQ ID NO: 193471 - protein, 10 aa, Artificial Sequence
  Description of Artificial Sequence: Synthetic peptide
  Seed: RTCKCTGNFA (TYRP2_HUMAN)
RSCKCTGNFV

SEQ ID NO: 193472 - protein, 9 aa, Artificial Sequence
  Description of Artificial Sequence: Synthetic peptide
  Seed: YAIDLPVSV (TYRP2_HUMAN)
YKIDLPVSL

SEQ ID NO: 193473 - protein, 9 aa, Artificial Sequence
  Description of Artificial Sequence: Synthetic peptide
  Seed: LVTLCNGTY (TYRP2_HUMAN)
LPTLCNGTF

SEQ ID NO: 193474 - protein, 9 aa, Artificial Sequence
  Description of Artificial Sequence: Synthetic peptide
  Seed: ITTQHWLGL (TYRP2_HUMAN)
IVTQHWLGV

SEQ ID NO: 193475 - protein, 10 aa, Artificial Sequence
  Description of Artificial Sequence: Synthetic peptide
  Seed: LVVMGTLVAL (TYRP2_HUMAN)
LSVMGTLVAA

SEQ ID NO: 193476 - protein, 9 aa, Artificial Sequence
  Description of Artificial Sequence: Synthetic peptide
  Seed: RNQMGRNSM (TYRP2_HUMAN)
RAQMGRNSF

SEQ ID NO: 193477 - protein, 11 aa, Artificial Sequence
  Description of Artificial Sequence: Synthetic peptide
  Seed: RELWPRKFFHR (TYRP2_HUMAN)
RVLWPRKFFHK

SEQ ID NO: 193478 - protein, 9 aa, Artificial Sequence
  Description of Artificial Sequence: Synthetic peptide
  Seed: NRMYNMVPF (TYRP2_HUMAN)
NRMYNMVPV

SEQ ID NO: 193479 - protein, 9 aa, Artificial Sequence
  Description of Artificial Sequence: Synthetic peptide
  Seed: LLAFLQYRR (TYRP2_HUMAN)
LMAFLQYRK

SEQ ID NO: 193480 - protein, 10 aa, Artificial Sequence
  Description of Artificial Sequence: Synthetic peptide
  Seed: IGNESFALPY (TYRP2_HUMAN)
IANESFALPF

SEQ ID NO: 193481 - protein, 9 aa, Artificial Sequence
  Description of Artificial Sequence: Synthetic peptide
  Seed: RAIDFSHQG (TYRP2_HUMAN)
RTIDFSHQM

SEQ ID NO: 193482 - protein, 11 aa, Artificial Sequence
  Description of Artificial Sequence: Synthetic peptide
  Seed: YTPLMETHLSS (TYRP2_HUMAN)
YHPLMETHLSM

SEQ ID NO: 193483 - protein, 10 aa, Artificial Sequence
  Description of Artificial Sequence: Synthetic peptide
  Seed: QPQFANCSVY (TYRP2_HUMAN)
QGQFANCSVY

SEQ ID NO: 193484 - protein, 9 aa, Artificial Sequence
  Description of Artificial Sequence: Synthetic peptide
  Seed: FVWLHYYSV (TYRP2_HUMAN)
FVWLHYYSA

SEQ ID NO: 193485 - protein, 10 aa, Artificial Sequence
  Description of Artificial Sequence: Synthetic peptide
  Seed: RLRKGYTPLM (TYRP2_HUMAN)
RMRKGYTPLK

SEQ ID NO: 193486 - protein, 10 aa, Artificial Sequence
  Description of Artificial Sequence: Synthetic peptide
  Seed: RNSRFSSWET (TYRP2_HUMAN)
RKSRFSSWEA

SEQ ID NO: 193487 - protein, 11 aa, Artificial Sequence
  Description of Artificial Sequence: Synthetic peptide
  Seed: YTPLMETHLSS (TYRP2_HUMAN)
YRPLMETHLSL

SEQ ID NO: 193488 - protein, 10 aa, Artificial Sequence
  Description of Artificial Sequence: Synthetic peptide
  Seed: FVVLHSFTDA (TYRP2_HUMAN)
FMVLHSFTDV

SEQ ID NO: 193489 - protein, 9 aa, Artificial Sequence
  Description of Artificial Sequence: Synthetic peptide
  Seed: SRNSRFSSW (TYRP2_HUMAN)
SENSRFSSM

SEQ ID NO: 193490 - protein, 9 aa, Artificial Sequence
  Description of Artificial Sequence: Synthetic peptide
  Seed: QKFDNPPFF (TYRP2_HUMAN)
QHFDNPPFY

SEQ ID NO: 193491 - protein, 8 aa, Artificial Sequence
  Description of Artificial Sequence: Synthetic peptide
  Seed: RPDDPTLI (TYRP2_HUMAN)
RADDPTLM

SEQ ID NO: 193492 - protein, 9 aa, Artificial Sequence
  Description of Artificial Sequence: Synthetic peptide
  Seed: QKFDNPPFF (TYRP2_HUMAN)
QAFDNPPFL

SEQ ID NO: 193493 - protein, 10 aa, Artificial Sequence
  Description of Artificial Sequence: Synthetic peptide
  Seed: MSLHNLVHSF (TYRP2_HUMAN)
MTLHNLVHSL

SEQ ID NO: 193494 - protein, 10 aa, Artificial Sequence
  Description of Artificial Sequence: Synthetic peptide
  Seed: RRLRKGYTPL (TYRP2_HUMAN)
RMLRKGYTPK

SEQ ID NO: 193495 - protein, 9 aa, Artificial Sequence
  Description of Artificial Sequence: Synthetic peptide
  Seed: WHRYHLLCL (TYRP2_HUMAN)
WYRYHLLCL

SEQ ID NO: 193496 - protein, 10 aa, Artificial Sequence
  Description of Artificial Sequence: Synthetic peptide
  Seed: FQNSTFSFRN (TYRP2_HUMAN)
FMNSTFSFRK

SEQ ID NO: 193497 - protein, 9 aa, Artificial Sequence
  Description of Artificial Sequence: Synthetic peptide
  Seed: RLRKGYTPL (TYRP2_HUMAN)
RFRKGYTPL

SEQ ID NO: 193498 - protein, 9 aa, Artificial Sequence
  Description of Artificial Sequence: Synthetic peptide
  Seed: FANCSVYDF (TYRP2_HUMAN)
FQNCSVYDY

SEQ ID NO: 193499 - protein, 9 aa, Artificial Sequence
  Description of Artificial Sequence: Synthetic peptide
  Seed: RLIGNESFA (TYRP2_HUMAN)
RQIGNESFV

SEQ ID NO: 193500 - protein, 9 aa, Artificial Sequence
  Description of Artificial Sequence: Synthetic peptide
  Seed: SVRDTLLGP (TYRP2_HUMAN)
SSRDTLLGI

SEQ ID NO: 193501 - protein, 9 aa, Artificial Sequence
  Description of Artificial Sequence: Synthetic peptide
  Seed: EQFLGALDL (TYRP2_HUMAN)
EEFLGALDA

SEQ ID NO: 193502 - protein, 9 aa, Artificial Sequence
  Description of Artificial Sequence: Synthetic peptide
  Seed: RLRKGYTPL (TYRP2_HUMAN)
RHRKGYTPF

SEQ ID NO: 193503 - protein, 11 aa, Artificial Sequence
  Description of Artificial Sequence: Synthetic peptide
  Seed: TQPQFANCSVY (TYRP2_HUMAN)
TWPQFANCSVM

SEQ ID NO: 193504 - protein, 9 aa, Artificial Sequence
  Description of Artificial Sequence: Synthetic peptide
  Seed: ILPGAQGQF (TYRP2_HUMAN)
IMPGAQGQL

SEQ ID NO: 193505 - protein, 10 aa, Artificial Sequence
  Description of Artificial Sequence: Synthetic peptide
  Seed: LVALVGLFVL (TYRP2_HUMAN)
LMALVGLFVL

SEQ ID NO: 193506 - protein, 10 aa, Artificial Sequence
  Description of Artificial Sequence: Synthetic peptide
  Seed: FLTSDQLGYS (TYRP2_HUMAN)
FWTSDQLGYV

SEQ ID NO: 193507 - protein, 9 aa, Artificial Sequence
  Description of Artificial Sequence: Synthetic peptide
  Seed: GQFPRVCMT (TYRP2_HUMAN)
GQFPRVCMV

SEQ ID NO: 193508 - protein, 10 aa, Artificial Sequence
  Description of Artificial Sequence: Synthetic peptide
  Seed: LVVMGTLVAL (TYRP2_HUMAN)
LAVMGTLVAA

SEQ ID NO: 193509 - protein, 8 aa, Artificial Sequence
  Description of Artificial Sequence: Synthetic peptide
  Seed: RPDDPTLI (TYRP2_HUMAN)
RADDPTLL

SEQ ID NO: 193510 - protein, 10 aa, Artificial Sequence
  Description of Artificial Sequence: Synthetic peptide
  Seed: SLSPQEREQF (TYRP2_HUMAN)
STSPQEREQW

SEQ ID NO: 193511 - protein, 11 aa, Artificial Sequence
  Description of Artificial Sequence: Synthetic peptide
  Seed: RNQDDRELWPR (TYRP2_HUMAN)
RIQDDRELWPR

SEQ ID NO: 193512 - protein, 9 aa, Artificial Sequence
  Description of Artificial Sequence: Synthetic peptide
  Seed: NSMKLPTLK (TYRP2_HUMAN)
NQMKLPTLR

SEQ ID NO: 193513 - protein, 9 aa, Artificial Sequence
  Description of Artificial Sequence: Synthetic peptide
  Seed: CPRLGAESA (TYRP2_HUMAN)
CPRLGAESM

SEQ ID NO: 193514 - protein, 10 aa, Artificial Sequence
  Description of Artificial Sequence: Synthetic peptide
  Seed: SYAIDLPVSV (TYRP2_HUMAN)
SVAIDLPVSV

SEQ ID NO: 193515 - protein, 9 aa, Artificial Sequence
  Description of Artificial Sequence: Synthetic peptide
  Seed: YAIDLPVSV (TYRP2_HUMAN)
YTIDLPVSL

SEQ ID NO: 193516 - protein, 9 aa, Artificial Sequence
  Description of Artificial Sequence: Synthetic peptide
  Seed: TLDSQVMSL (TYRP2_HUMAN)
TQDSQVMSV

SEQ ID NO: 193517 - protein, 11 aa, Artificial Sequence
  Description of Artificial Sequence: Synthetic peptide
  Seed: SLDDYNHLVTL (TYRP2_HUMAN)
SVDDYNHLVTI

SEQ ID NO: 193518 - protein, 10 aa, Artificial Sequence
  Description of Artificial Sequence: Synthetic peptide
  Seed: SYAIDLPVSV (TYRP2_HUMAN)
SIAIDLPVSV

SEQ ID NO: 193519 - protein, 10 aa, Artificial Sequence
  Description of Artificial Sequence: Synthetic peptide
  Seed: MSPLWWGFLL (TYRP2_HUMAN)
MKPLWWGFLA

SEQ ID NO: 193520 - protein, 9 aa, Artificial Sequence
  Description of Artificial Sequence: Synthetic peptide
  Seed: YSYAIDLPV (TYRP2_HUMAN)
YTYAIDLPI

SEQ ID NO: 193521 - protein, 10 aa, Artificial Sequence
  Description of Artificial Sequence: Synthetic peptide
  Seed: RLRKGYTPLM (TYRP2_HUMAN)
RIRKGYTPLK

SEQ ID NO: 193522 - protein, 9 aa, Artificial Sequence
  Description of Artificial Sequence: Synthetic peptide
  Seed: GNESFALPY (TYRP2_HUMAN)
GQESFALPM

SEQ ID NO: 193523 - protein, 11 aa, Artificial Sequence
  Description of Artificial Sequence: Synthetic peptide
  Seed: VVMGTLVALVG (TYRP2_HUMAN)
VLMGTLVALVV

SEQ ID NO: 193524 - protein, 9 aa, Artificial Sequence
  Description of Artificial Sequence: Synthetic peptide
  Seed: TLISRNSRF (TYRP2_HUMAN)
TQISRNSRM

SEQ ID NO: 193525 - protein, 11 aa, Artificial Sequence
  Description of Artificial Sequence: Synthetic peptide
  Seed: RNSRFSSWETV (TYRP2_HUMAN)
RTSRFSSWETL

SEQ ID NO: 193526 - protein, 11 aa, Artificial Sequence
  Description of Artificial Sequence: Synthetic peptide
  Seed: FVVLHSFTDAI (TYRP2_HUMAN)
FSVLHSFTDAV

SEQ ID NO: 193527 - protein, 9 aa, Artificial Sequence
  Description of Artificial Sequence: Synthetic peptide
  Seed: LRKGYTPLM (TYRP2_HUMAN)
LMKGYTPLY

SEQ ID NO: 193528 - protein, 10 aa, Artificial Sequence
  Description of Artificial Sequence: Synthetic peptide
  Seed: LHYYSVRDTL (TYRP2_HUMAN)
LLYYSVRDTY

SEQ ID NO: 193529 - protein, 9 aa, Artificial Sequence
  Description of Artificial Sequence: Synthetic peptide
  Seed: VVMGTLVAL (TYRP2_HUMAN)
VSMGTLVAF

SEQ ID NO: 193530 - protein, 10 aa, Artificial Sequence
  Description of Artificial Sequence: Synthetic peptide
  Seed: IDFSHQGPAF (TYRP2_HUMAN)
IVFSHQGPAF

SEQ ID NO: 193531 - protein, 9 aa, Artificial Sequence
  Description of Artificial Sequence: Synthetic peptide
  Seed: RVCMTVDSL (TYRP2_HUMAN)
RQCMTVDSY

SEQ ID NO: 193532 - protein, 9 aa, Artificial Sequence
  Description of Artificial Sequence: Synthetic peptide
  Seed: AANDPIFVV (TYRP2_HUMAN)
AMNDPIFVM

SEQ ID NO: 193533 - protein, 10 aa, Artificial Sequence
  Description of Artificial Sequence: Synthetic peptide
  Seed: GPAFVTWHRY (TYRP2_HUMAN)
GFAFVTWHRY

SEQ ID NO: 193534 - protein, 10 aa, Artificial Sequence
  Description of Artificial Sequence: Synthetic peptide
  Seed: MGRNSMKLPT (TYRP2_HUMAN)
MSRNSMKLPY

SEQ ID NO: 193535 - protein, 9 aa, Artificial Sequence
  Description of Artificial Sequence: Synthetic peptide
  Seed: ALVGLFVLL (TYRP2_HUMAN)
AQVGLFVLW

SEQ ID NO: 193536 - protein, 10 aa, Artificial Sequence
  Description of Artificial Sequence: Synthetic peptide
  Seed: RLRKGYTPLM (TYRP2_HUMAN)
RTRKGYTPLT

SEQ ID NO: 193537 - protein, 11 aa, Artificial Sequence
  Description of Artificial Sequence: Synthetic peptide
  Seed: YTPLMETHLSS (TYRP2_HUMAN)
YRPLMETHLSI

SEQ ID NO: 193538 - protein, 10 aa, Artificial Sequence
  Description of Artificial Sequence: Synthetic peptide
  Seed: KILPGAQGQF (TYRP2_HUMAN)
KALPGAQGQR

SEQ ID NO: 193539 - protein, 11 aa, Artificial Sequence
  Description of Artificial Sequence: Synthetic peptide
  Seed: RNSRFSSWETV (TYRP2_HUMAN)
RYSRFSSWETI

SEQ ID NO: 193540 - protein, 9 aa, Artificial Sequence
  Description of Artificial Sequence: Synthetic peptide
  Seed: IGHNRMYNM (TYRP2_HUMAN)
IAHNRMYNI

SEQ ID NO: 193541 - protein, 10 aa, Artificial Sequence
  Description of Artificial Sequence: Synthetic peptide
  Seed: MSLHNLVHSF (TYRP2_HUMAN)
MILHNLVHSY

SEQ ID NO: 193542 - protein, 8 aa, Artificial Sequence
  Description of Artificial Sequence: Synthetic peptide
  Seed: FSHQGPAF (TYRP2_HUMAN)
FSHQGPAY

SEQ ID NO: 193543 - protein, 10 aa, Artificial Sequence
  Description of Artificial Sequence: Synthetic peptide
  Seed: SFTDAIFDEW (TYRP2_HUMAN)
SYTDAIFDEL

SEQ ID NO: 193544 - protein, 9 aa, Artificial Sequence
  Description of Artificial Sequence: Synthetic peptide
  Seed: SLDDYNHLV (TYRP2_HUMAN)
SCDDYNHLM

SEQ ID NO: 193545 - protein, 9 aa, Artificial Sequence
  Description of Artificial Sequence: Synthetic peptide
  Seed: NSMKLPTLK (TYRP2_HUMAN)
NNMKLPTLR

SEQ ID NO: 193546 - protein, 9 aa, Artificial Sequence
  Description of Artificial Sequence: Synthetic peptide
  Seed: FQNSTFSFR (TYRP2_HUMAN)
FLNSTFSFK

SEQ ID NO: 193547 - protein, 9 aa, Artificial Sequence
  Description of Artificial Sequence: Synthetic peptide
  Seed: APIGHNRMY (TYRP2_HUMAN)
AYIGHNRMY

SEQ ID NO: 193548 - protein, 9 aa, Artificial Sequence
  Description of Artificial Sequence: Synthetic peptide
  Seed: ADAWPQELA (TYRP2_HUMAN)
AEAWPQELT

SEQ ID NO: 193549 - protein, 11 aa, Artificial Sequence
  Description of Artificial Sequence: Synthetic peptide
  Seed: RADTRPWSGPY (TYRP2_HUMAN)
RKDTRPWSGPF

SEQ ID NO: 193550 - protein, 9 aa, Artificial Sequence
  Description of Artificial Sequence: Synthetic peptide
  Seed: SFLNGTNAL (TYRP2_HUMAN)
SWLNGTNAY

SEQ ID NO: 193551 - protein, 9 aa, Artificial Sequence
  Description of Artificial Sequence: Synthetic peptide
  Seed: YAIDLPVSV (TYRP2_HUMAN)
YQIDLPVSW

SEQ ID NO: 193552 - protein, 9 aa, Artificial Sequence
  Description of Artificial Sequence: Synthetic peptide
  Seed: KDIRDCLSL (TYRP2_HUMAN)
KQIRDCLSL

SEQ ID NO: 193553 - protein, 10 aa, Artificial Sequence
  Description of Artificial Sequence: Synthetic peptide
  Seed: MTVDSLVNKE (TYRP2_HUMAN)
MIVDSLVNKR

SEQ ID NO: 193554 - protein, 9 aa, Artificial Sequence
  Description of Artificial Sequence: Synthetic peptide
  Seed: YYSVRDTLL (TYRP2_HUMAN)
YASVRDTLY

SEQ ID NO: 193555 - protein, 10 aa, Artificial Sequence
  Description of Artificial Sequence: Synthetic peptide
  Seed: TLVALVGLFV (TYRP2_HUMAN)
TMVALVGLFI

SEQ ID NO: 193556 - protein, 10 aa, Artificial Sequence
  Description of Artificial Sequence: Synthetic peptide
  Seed: ELWPRKFFHR (TYRP2_HUMAN)
EAWPRKFFHK

SEQ ID NO: 193557 - protein, 9 aa, Artificial Sequence
  Description of Artificial Sequence: Synthetic peptide
  Seed: RLRKGYTPL (TYRP2_HUMAN)
RIRKGYTPW

SEQ ID NO: 193558 - protein, 10 aa, Artificial Sequence
  Description of Artificial Sequence: Synthetic peptide
  Seed: SDQLGYSYAI (TYRP2_HUMAN)
SFQLGYSYAL

SEQ ID NO: 193559 - protein, 9 aa, Artificial Sequence
  Description of Artificial Sequence: Synthetic peptide
  Seed: RELWPRKFF (TYRP2_HUMAN)
RQLWPRKFM

SEQ ID NO: 193560 - protein, 10 aa, Artificial Sequence
  Description of Artificial Sequence: Synthetic peptide
  Seed: TRPWSGPYIL (TYRP2_HUMAN)
TTPWSGPYIF

SEQ ID NO: 193561 - protein, 9 aa, Artificial Sequence
  Description of Artificial Sequence: Synthetic peptide
  Seed: ARPDDPTLI (TYRP2_HUMAN)
AHPDDPTLL

SEQ ID NO: 193562 - protein, 10 aa, Artificial Sequence
  Description of Artificial Sequence: Synthetic peptide
  Seed: KILPGAQGQF (TYRP2_HUMAN)
KVLPGAQGQF

SEQ ID NO: 193563 - protein, 9 aa, Artificial Sequence
  Description of Artificial Sequence: Synthetic peptide
  Seed: FFQNSTFSF (TYRP2_HUMAN)
FLQNSTFSL

SEQ ID NO: 193564 - protein, 10 aa, Artificial Sequence
  Description of Artificial Sequence: Synthetic peptide
  Seed: MSPLWWGFLL (TYRP2_HUMAN)
MYPLWWGFLI

SEQ ID NO: 193565 - protein, 10 aa, Artificial Sequence
  Description of Artificial Sequence: Synthetic peptide
  Seed: LVVMGTLVAL (TYRP2_HUMAN)
LVVMGTLVAV

SEQ ID NO: 193566 - protein, 9 aa, Artificial Sequence
  Description of Artificial Sequence: Synthetic peptide
  Seed: STFSFRNAL (TYRP2_HUMAN)
SNFSFRNAY

SEQ ID NO: 193567 - protein, 9 aa, Artificial Sequence
  Description of Artificial Sequence: Synthetic peptide
  Seed: ANDPIFVVL (TYRP2_HUMAN)
AEDPIFVVV

SEQ ID NO: 193568 - protein, 8 aa, Artificial Sequence
  Description of Artificial Sequence: Synthetic peptide
  Seed: AIDLPVSV (TYRP2_HUMAN)
AGDLPVSM

SEQ ID NO: 193569 - protein, 10 aa, Artificial Sequence
  Description of Artificial Sequence: Synthetic peptide
  Seed: TQPQFANCSV (TYRP2_HUMAN)
TRPQFANCSM

SEQ ID NO: 193570 - protein, 11 aa, Artificial Sequence
  Description of Artificial Sequence: Synthetic peptide
  Seed: HPDYVITTQHW (TYRP2_HUMAN)
HGDYVITTQHF

SEQ ID NO: 193571 - protein, 10 aa, Artificial Sequence
  Description of Artificial Sequence: Synthetic peptide
  Seed: FVWLHYYSVR (TYRP2_HUMAN)
FMWLHYYSVT

SEQ ID NO: 193572 - protein, 10 aa, Artificial Sequence
  Description of Artificial Sequence: Synthetic peptide
  Seed: MSPLWWGFLL (TYRP2_HUMAN)
MSPLWWGFLW

SEQ ID NO: 193573 - protein, 10 aa, Artificial Sequence
  Description of Artificial Sequence: Synthetic peptide
  Seed: MSPLWWGFLL (TYRP2_HUMAN)
MVPLWWGFLA

SEQ ID NO: 193574 - protein, 9 aa, Artificial Sequence
  Description of Artificial Sequence: Synthetic peptide
  Seed: RLRKGYTPL (TYRP2_HUMAN)
RLRKGYTPV

SEQ ID NO: 193575 - protein, 10 aa, Artificial Sequence
  Description of Artificial Sequence: Synthetic peptide
  Seed: VVMGTLVALV (TYRP2_HUMAN)
VMMGTLVALI

SEQ ID NO: 193576 - protein, 10 aa, Artificial Sequence
  Description of Artificial Sequence: Synthetic peptide
  Seed: RNSRFSSWET (TYRP2_HUMAN)
RISRFSSWEV

SEQ ID NO: 193577 - protein, 10 aa, Artificial Sequence
  Description of Artificial Sequence: Synthetic peptide
  Seed: SLVNKECCPR (TYRP2_HUMAN)
SMVNKECCPR

SEQ ID NO: 193578 - protein, 9 aa, Artificial Sequence
  Description of Artificial Sequence: Synthetic peptide
  Seed: NSMKLPTLK (TYRP2_HUMAN)
NTMKLPTLR

SEQ ID NO: 193579 - protein, 9 aa, Artificial Sequence
  Description of Artificial Sequence: Synthetic peptide
  Seed: VDSLVNKEC (TYRP2_HUMAN)
VESLVNKEV

SEQ ID NO: 193580 - protein, 10 aa, Artificial Sequence
  Description of Artificial Sequence: Synthetic peptide
  Seed: RNSRFSSWET (TYRP2_HUMAN)
RESRFSSWEI

SEQ ID NO: 193581 - protein, 8 aa, Artificial Sequence
  Description of Artificial Sequence: Synthetic peptide
  Seed: SLDDYNHL (TYRP2_HUMAN)
SVDDYNHL

SEQ ID NO: 193582 - protein, 10 aa, Artificial Sequence
  Description of Artificial Sequence: Synthetic peptide
  Seed: TLLGPGRPYR (TYRP2_HUMAN)
TMLGPGRPYR

SEQ ID NO: 193583 - protein, 9 aa, Artificial Sequence
  Description of Artificial Sequence: Synthetic peptide
  Seed: RLRKGYTPL (TYRP2_HUMAN)
RYRKGYTPN

SEQ ID NO: 193584 - protein, 9 aa, Artificial Sequence
  Description of Artificial Sequence: Synthetic peptide
  Seed: TLDSQVMSL (TYRP2_HUMAN)
TEDSQVMSF

SEQ ID NO: 193585 - protein, 10 aa, Artificial Sequence
  Description of Artificial Sequence: Synthetic peptide
  Seed: MSLHNLVHSF (TYRP2_HUMAN)
MHLHNLVHSY

SEQ ID NO: 193586 - protein, 9 aa, Artificial Sequence
  Description of Artificial Sequence: Synthetic peptide
  Seed: ISRNSRFSS (TYRP2_HUMAN)
IARNSRFSK

SEQ ID NO: 193587 - protein, 10 aa, Artificial Sequence
  Description of Artificial Sequence: Synthetic peptide
  Seed: YDFFVWLHYY (TYRP2_HUMAN)
YFFFVWLHYW

SEQ ID NO: 193588 - protein, 9 aa, Artificial Sequence
  Description of Artificial Sequence: Synthetic peptide
  Seed: LHSFTDAIF (TYRP2_HUMAN)
LHSFTDAIL

SEQ ID NO: 193589 - protein, 9 aa, Artificial Sequence
  Description of Artificial Sequence: Synthetic peptide
  Seed: IDFSHQGPA (TYRP2_HUMAN)
IEFSHQGPL

SEQ ID NO: 193590 - protein, 9 aa, Artificial Sequence
  Description of Artificial Sequence: Synthetic peptide
  Seed: HYYSVRDTL (TYRP2_HUMAN)
HFYSVRDTY

SEQ ID NO: 193591 - protein, 10 aa, Artificial Sequence
  Description of Artificial Sequence: Synthetic peptide
  Seed: ISRNSRFSSW (TYRP2_HUMAN)
ISRNSRFSSF

SEQ ID NO: 193592 - protein, 9 aa, Artificial Sequence
  Description of Artificial Sequence: Synthetic peptide
  Seed: TSDQLGYSY (TYRP2_HUMAN)
TIDQLGYSL

SEQ ID NO: 193593 - protein, 9 aa, Artificial Sequence
  Description of Artificial Sequence: Synthetic peptide
  Seed: QKFDNPPFF (TYRP2_HUMAN)
QRFDNPPFL

SEQ ID NO: 193594 - protein, 10 aa, Artificial Sequence
  Description of Artificial Sequence: Synthetic peptide
  Seed: LGPNGTQPQF (TYRP2_HUMAN)
LHPNGTQPQW

SEQ ID NO: 193595 - protein, 9 aa, Artificial Sequence
  Description of Artificial Sequence: Synthetic peptide
  Seed: FANCSVYDF (TYRP2_HUMAN)
FINCSVYDF

SEQ ID NO: 193596 - protein, 10 aa, Artificial Sequence
  Description of Artificial Sequence: Synthetic peptide
  Seed: QVMSLHNLVH (TYRP2_HUMAN)
QIMSLHNLVK

SEQ ID NO: 193597 - protein, 10 aa, Artificial Sequence
  Description of Artificial Sequence: Synthetic peptide
  Seed: YAIDLPVSVE (TYRP2_HUMAN)
YLIDLPVSVL

SEQ ID NO: 193598 - protein, 10 aa, Artificial Sequence
  Description of Artificial Sequence: Synthetic peptide
  Seed: MGRNSMKLPT (TYRP2_HUMAN)
MGRNSMKLPK

SEQ ID NO: 193599 - protein, 10 aa, Artificial Sequence
  Description of Artificial Sequence: Synthetic peptide
  Seed: SPLWWGFLLS (TYRP2_HUMAN)
SGLWWGFLLL

SEQ ID NO: 193600 - protein, 9 aa, Artificial Sequence
  Description of Artificial Sequence: Synthetic peptide
  Seed: TLDSQVMSL (TYRP2_HUMAN)
TGDSQVMSY

SEQ ID NO: 193601 - protein, 9 aa, Artificial Sequence
  Description of Artificial Sequence: Synthetic peptide
  Seed: TSDQLGYSY (TYRP2_HUMAN)
TCDQLGYSF

SEQ ID NO: 193602 - protein, 10 aa, Artificial Sequence
  Description of Artificial Sequence: Synthetic peptide
  Seed: LGPNGTQPQF (TYRP2_HUMAN)
LMPNGTQPQW

SEQ ID NO: 193603 - protein, 9 aa, Artificial Sequence
  Description of Artificial Sequence: Synthetic peptide
  Seed: WHRYHLLCL (TYRP2_HUMAN)
WQRYHLLCL

SEQ ID NO: 193604 - protein, 10 aa, Artificial Sequence
  Description of Artificial Sequence: Synthetic peptide
  Seed: RLRKGYTPLM (TYRP2_HUMAN)
RSRKGYTPLS

SEQ ID NO: 193605 - protein, 9 aa, Artificial Sequence
  Description of Artificial Sequence: Synthetic peptide
  Seed: TLDSQVMSL (TYRP2_HUMAN)
TTDSQVMSV

SEQ ID NO: 193606 - protein, 11 aa, Artificial Sequence
  Description of Artificial Sequence: Synthetic peptide
  Seed: MSLHNLVHSFL (TYRP2_HUMAN)
MSLHNLVHSFY

SEQ ID NO: 193607 - protein, 10 aa, Artificial Sequence
  Description of Artificial Sequence: Synthetic peptide
  Seed: FLTSDQLGYS (TYRP2_HUMAN)
FSTSDQLGYV

SEQ ID NO: 193608 - protein, 10 aa, Artificial Sequence
  Description of Artificial Sequence: Synthetic peptide
  Seed: SDQLGYSYAI (TYRP2_HUMAN)
SAQLGYSYAF

SEQ ID NO: 193609 - protein, 9 aa, Artificial Sequence
  Description of Artificial Sequence: Synthetic peptide
  Seed: YAIDLPVSV (TYRP2_HUMAN)
YSIDLPVSH

SEQ ID NO: 193610 - protein, 10 aa, Artificial Sequence
  Description of Artificial Sequence: Synthetic peptide
  Seed: AANDPIFVVL (TYRP2_HUMAN)
AYNDPIFVVY

SEQ ID NO: 193611 - protein, 10 aa, Artificial Sequence
  Description of Artificial Sequence: Synthetic peptide
  Seed: VYDFFVWLHY (TYRP2_HUMAN)
VVDFFVWLHY

SEQ ID NO: 193612 - protein, 10 aa, Artificial Sequence
  Description of Artificial Sequence: Synthetic peptide
  Seed: TSDQLGYSYA (TYRP2_HUMAN)
TADQLGYSYY

SEQ ID NO: 193613 - protein, 10 aa, Artificial Sequence
  Description of Artificial Sequence: Synthetic peptide
  Seed: RNSRFSSWET (TYRP2_HUMAN)
RNSRFSSWEL

SEQ ID NO: 193614 - protein, 10 aa, Artificial Sequence
  Description of Artificial Sequence: Synthetic peptide
  Seed: LVVMGTLVAL (TYRP2_HUMAN)
LRVMGTLVAI

SEQ ID NO: 193615 - protein, 10 aa, Artificial Sequence
  Description of Artificial Sequence: Synthetic peptide
  Seed: MSPLWWGFLL (TYRP2_HUMAN)
MAPLWWGFLL

SEQ ID NO: 193616 - protein, 8 aa, Artificial Sequence
  Description of Artificial Sequence: Synthetic peptide
  Seed: RPDDPTLI (TYRP2_HUMAN)
RCDDPTLL

SEQ ID NO: 193617 - protein, 10 aa, Artificial Sequence
  Description of Artificial Sequence: Synthetic peptide
  Seed: AANDPIFVVL (TYRP2_HUMAN)
ATNDPIFVVL

SEQ ID NO: 193618 - protein, 9 aa, Artificial Sequence
  Description of Artificial Sequence: Synthetic peptide
  Seed: FFQNSTFSF (TYRP2_HUMAN)
FPQNSTFSW

SEQ ID NO: 193619 - protein, 9 aa, Artificial Sequence
  Description of Artificial Sequence: Synthetic peptide
  Seed: SLDDYNHLV (TYRP2_HUMAN)
SLDDYNHLR

SEQ ID NO: 193620 - protein, 10 aa, Artificial Sequence
  Description of Artificial Sequence: Synthetic peptide
  Seed: YNMVPFFPPV (TYRP2_HUMAN)
YEMVPFFPPT

SEQ ID NO: 193621 - protein, 9 aa, Artificial Sequence
  Description of Artificial Sequence: Synthetic peptide
  Seed: YSYAIDLPV (TYRP2_HUMAN)
YHYAIDLPL

SEQ ID NO: 193622 - protein, 9 aa, Artificial Sequence
  Description of Artificial Sequence: Synthetic peptide
  Seed: YYSVRDTLL (TYRP2_HUMAN)
YASVRDTLV

SEQ ID NO: 193623 - protein, 9 aa, Artificial Sequence
  Description of Artificial Sequence: Synthetic peptide
  Seed: ALVGLFVLL (TYRP2_HUMAN)
ALVGLFVLI

SEQ ID NO: 193624 - protein, 9 aa, Artificial Sequence
  Description of Artificial Sequence: Synthetic peptide
  Seed: AANDPIFVV (TYRP2_HUMAN)
ALNDPIFVF

SEQ ID NO: 193625 - protein, 11 aa, Artificial Sequence
  Description of Artificial Sequence: Synthetic peptide
  Seed: YTPLMETHLSS (TYRP2_HUMAN)
YEPLMETHLSM

SEQ ID NO: 193626 - protein, 10 aa, Artificial Sequence
  Description of Artificial Sequence: Synthetic peptide
  Seed: SVRDTLLGPG (TYRP2_HUMAN)
SARDTLLGPK

SEQ ID NO: 193627 - protein, 10 aa, Artificial Sequence
  Description of Artificial Sequence: Synthetic peptide
  Seed: AANDPIFVVL (TYRP2_HUMAN)
ATNDPIFVVM

SEQ ID NO: 193628 - protein, 11 aa, Artificial Sequence
  Description of Artificial Sequence: Synthetic peptide
  Seed: LISRNSRFSSW (TYRP2_HUMAN)
LTSRNSRFSSW

SEQ ID NO: 193629 - protein, 9 aa, Artificial Sequence
  Description of Artificial Sequence: Synthetic peptide
  Seed: AWPQELAPI (TYRP2_HUMAN)
AYPQELAPM

SEQ ID NO: 193630 - protein, 10 aa, Artificial Sequence
  Description of Artificial Sequence: Synthetic peptide
  Seed: FFPPVTNEEL (TYRP2_HUMAN)
FLPPVTNEEV

SEQ ID NO: 193631 - protein, 10 aa, Artificial Sequence
  Description of Artificial Sequence: Synthetic peptide
  Seed: RLRKGYTPLM (TYRP2_HUMAN)
RHRKGYTPLK

SEQ ID NO: 193632 - protein, 10 aa, Artificial Sequence
  Description of Artificial Sequence: Synthetic peptide
  Seed: RMYNMVPFFP (TYRP2_HUMAN)
RQYNMVPFFL

SEQ ID NO: 193633 - protein, 11 aa, Artificial Sequence
  Description of Artificial Sequence: Synthetic peptide
  Seed: CDSLDDYNHLV (TYRP2_HUMAN)
CQSLDDYNHLV

SEQ ID NO: 193634 - protein, 10 aa, Artificial Sequence
  Description of Artificial Sequence: Synthetic peptide
  Seed: PFFQNSTFSF (TYRP2_HUMAN)
PYFQNSTFSF

SEQ ID NO: 193635 - protein, 9 aa, Artificial Sequence
  Description of Artificial Sequence: Synthetic peptide
  Seed: LVTLCNGTY (TYRP2_HUMAN)
LMTLCNGTM

SEQ ID NO: 193636 - protein, 9 aa, Artificial Sequence
  Description of Artificial Sequence: Synthetic peptide
  Seed: NRMYNMVPF (TYRP2_HUMAN)
NFMYNMVPM

SEQ ID NO: 193637 - protein, 10 aa, Artificial Sequence
  Description of Artificial Sequence: Synthetic peptide
  Seed: RNQMGRNSMK (TYRP2_HUMAN)
RMQMGRNSMK

SEQ ID NO: 193638 - protein, 10 aa, Artificial Sequence
  Description of Artificial Sequence: Synthetic peptide
  Seed: CSVYDFFVWL (TYRP2_HUMAN)
CLVYDFFVWV

SEQ ID NO: 193639 - protein, 10 aa, Artificial Sequence
  Description of Artificial Sequence: Synthetic peptide
  Seed: MSPLWWGFLL (TYRP2_HUMAN)
MLPLWWGFLM

SEQ ID NO: 193640 - protein, 9 aa, Artificial Sequence
  Description of Artificial Sequence: Synthetic peptide
  Seed: SRFSSWETV (TYRP2_HUMAN)
SHFSSWETA

SEQ ID NO: 193641 - protein, 10 aa, Artificial Sequence
  Description of Artificial Sequence: Synthetic peptide
  Seed: QPQFANCSVY (TYRP2_HUMAN)
QHQFANCSVY

SEQ ID NO: 193642 - protein, 10 aa, Artificial Sequence
  Description of Artificial Sequence: Synthetic peptide
  Seed: SPLWWGFLLS (TYRP2_HUMAN)
SLLWWGFLLL

SEQ ID NO: 193643 - protein, 9 aa, Artificial Sequence
  Description of Artificial Sequence: Synthetic peptide
  Seed: QKFDNPPFF (TYRP2_HUMAN)
QRFDNPPFM

SEQ ID NO: 193644 - protein, 8 aa, Artificial Sequence
  Description of Artificial Sequence: Synthetic peptide
  Seed: KFDNPPFF (TYRP2_HUMAN)
KWDNPPFL

SEQ ID NO: 193645 - protein, 8 aa, Artificial Sequence
  Description of Artificial Sequence: Synthetic peptide
  Seed: FLGALDLA (TYRP2_HUMAN)
FMGALDLL

SEQ ID NO: 193646 - protein, 10 aa, Artificial Sequence
  Description of Artificial Sequence: Synthetic peptide
  Seed: SHQGPAFVTW (TYRP2_HUMAN)
SYQGPAFVTW

SEQ ID NO: 193647 - protein, 9 aa, Artificial Sequence
  Description of Artificial Sequence: Synthetic peptide
  Seed: AANDPIFVV (TYRP2_HUMAN)
ASNDPIFVV

SEQ ID NO: 193648 - protein, 11 aa, Artificial Sequence
  Description of Artificial Sequence: Synthetic peptide
  Seed: YSYAIDLPVSV (TYRP2_HUMAN)
YTYAIDLPVSV

SEQ ID NO: 193649 - protein, 10 aa, Artificial Sequence
  Description of Artificial Sequence: Synthetic peptide
  Seed: SLDDYNHLVT (TYRP2_HUMAN)
SIDDYNHLVI

SEQ ID NO: 193650 - protein, 9 aa, Artificial Sequence
  Description of Artificial Sequence: Synthetic peptide
  Seed: STFSFRNAL (TYRP2_HUMAN)
SQFSFRNAF

SEQ ID NO: 193651 - protein, 9 aa, Artificial Sequence
  Description of Artificial Sequence: Synthetic peptide
  Seed: YSYAIDLPV (TYRP2_HUMAN)
YMYAIDLPG

SEQ ID NO: 193652 - protein, 9 aa, Artificial Sequence
  Description of Artificial Sequence: Synthetic peptide
  Seed: HSFLNGTNA (TYRP2_HUMAN)
HHFLNGTNA

SEQ ID NO: 193653 - protein, 10 aa, Artificial Sequence
  Description of Artificial Sequence: Synthetic peptide
  Seed: RPWSGPYILR (TYRP2_HUMAN)
RPWSGPYILF

SEQ ID NO: 193654 - protein, 10 aa, Artificial Sequence
  Description of Artificial Sequence: Synthetic peptide
  Seed: FQNSTFSFRN (TYRP2_HUMAN)
FVNSTFSFRR

SEQ ID NO: 193655 - protein, 9 aa, Artificial Sequence
  Description of Artificial Sequence: Synthetic peptide
  Seed: FLTSDQLGY (TYRP2_HUMAN)
FSTSDQLGF

SEQ ID NO: 193656 - protein, 9 aa, Artificial Sequence
  Description of Artificial Sequence: Synthetic peptide
  Seed: NSMKLPTLK (TYRP2_HUMAN)
NYMKLPTLK

SEQ ID NO: 193657 - protein, 10 aa, Artificial Sequence
  Description of Artificial Sequence: Synthetic peptide
  Seed: IGNESFALPY (TYRP2_HUMAN)
IENESFALPF

SEQ ID NO: 193658 - protein, 9 aa, Artificial Sequence
  Description of Artificial Sequence: Synthetic peptide
  Seed: KCTGNFAGY (TYRP2_HUMAN)
KWTGNFAGY

SEQ ID NO: 193659 - protein, 9 aa, Artificial Sequence
  Description of Artificial Sequence: Synthetic peptide
  Seed: NRMYNMVPF (TYRP2_HUMAN)
NRMYNMVPA

SEQ ID NO: 193660 - protein, 10 aa, Artificial Sequence
  Description of Artificial Sequence: Synthetic peptide
  Seed: CMTVDSLVNK (TYRP2_HUMAN)
CNTVDSLVNR

SEQ ID NO: 193661 - protein, 10 aa, Artificial Sequence
  Description of Artificial Sequence: Synthetic peptide
  Seed: ELAPIGHNRM (TYRP2_HUMAN)
ETAPIGHNRH

SEQ ID NO: 193662 - protein, 11 aa, Artificial Sequence
  Description of Artificial Sequence: Synthetic peptide
  Seed: GTLDSQVMSLH (TYRP2_HUMAN)
GTLDSQVMSLK

SEQ ID NO: 193663 - protein, 8 aa, Artificial Sequence
  Description of Artificial Sequence: Synthetic peptide
  Seed: IFDEWMKR (TYRP2_HUMAN)
ITDEWMKY

SEQ ID NO: 193664 - protein, 9 aa, Artificial Sequence
  Description of Artificial Sequence: Synthetic peptide
  Seed: YSYAIDLPV (TYRP2_HUMAN)
YWYAIDLPL

SEQ ID NO: 193665 - protein, 9 aa, Artificial Sequence
  Description of Artificial Sequence: Synthetic peptide
  Seed: RFNPPADAW (TYRP2_HUMAN)
RQNPPADAW

SEQ ID NO: 193666 - protein, 9 aa, Artificial Sequence
  Description of Artificial Sequence: Synthetic peptide
  Seed: VIRQNIHSL (TYRP2_HUMAN)
VPRQNIHST

SEQ ID NO: 193667 - protein, 9 aa, Artificial Sequence
  Description of Artificial Sequence: Synthetic peptide
  Seed: STFSFRNAL (TYRP2_HUMAN)
SAFSFRNAK

SEQ ID NO: 193668 - protein, 10 aa, Artificial Sequence
  Description of Artificial Sequence: Synthetic peptide
  Seed: FQNSTFSFRN (TYRP2_HUMAN)
FLNSTFSFRR

SEQ ID NO: 193669 - protein, 9 aa, Artificial Sequence
  Description of Artificial Sequence: Synthetic peptide
  Seed: SRFSSWETV (TYRP2_HUMAN)
SQFSSWETY

SEQ ID NO: 193670 - protein, 8 aa, Artificial Sequence
  Description of Artificial Sequence: Synthetic peptide
  Seed: FQNSTFSF (TYRP2_HUMAN)
FSNSTFSM

SEQ ID NO: 193671 - protein, 9 aa, Artificial Sequence
  Description of Artificial Sequence: Synthetic peptide
  Seed: RFNPPADAW (TYRP2_HUMAN)
RRNPPADAF

SEQ ID NO: 193672 - protein, 9 aa, Artificial Sequence
  Description of Artificial Sequence: Synthetic peptide
  Seed: STFSFRNAL (TYRP2_HUMAN)
SSFSFRNAA

SEQ ID NO: 193673 - protein, 9 aa, Artificial Sequence
  Description of Artificial Sequence: Synthetic peptide
  Seed: HYYSVRDTL (TYRP2_HUMAN)
HFYSVRDTM

SEQ ID NO: 193674 - protein, 10 aa, Artificial Sequence
  Description of Artificial Sequence: Synthetic peptide
  Seed: RRLRKGYTPL (TYRP2_HUMAN)
RNLRKGYTPY

SEQ ID NO: 193675 - protein, 10 aa, Artificial Sequence
  Description of Artificial Sequence: Synthetic peptide
  Seed: ELAPIGHNRM (TYRP2_HUMAN)
EVAPIGHNRI

SEQ ID NO: 193676 - protein, 10 aa, Artificial Sequence
  Description of Artificial Sequence: Synthetic peptide
  Seed: VVMGTLVALV (TYRP2_HUMAN)
VLMGTLVALT

SEQ ID NO: 193677 - protein, 9 aa, Artificial Sequence
  Description of Artificial Sequence: Synthetic peptide
  Seed: QEREQFLGA (TYRP2_HUMAN)
QEREQFLGP

SEQ ID NO: 193678 - protein, 10 aa, Artificial Sequence
  Description of Artificial Sequence: Synthetic peptide
  Seed: LHYYSVRDTL (TYRP2_HUMAN)
LWYYSVRDTF

SEQ ID NO: 193679 - protein, 10 aa, Artificial Sequence
  Description of Artificial Sequence: Synthetic peptide
  Seed: VVMGTLVALV (TYRP2_HUMAN)
VQMGTLVALM

SEQ ID NO: 193680 - protein, 8 aa, Artificial Sequence
  Description of Artificial Sequence: Synthetic peptide
  Seed: FSHQGPAF (TYRP2_HUMAN)
FYHQGPAY

SEQ ID NO: 193681 - protein, 10 aa, Artificial Sequence
  Description of Artificial Sequence: Synthetic peptide
  Seed: METHLSSKRY (TYRP2_HUMAN)
MSTHLSSKRY

SEQ ID NO: 193682 - protein, 10 aa, Artificial Sequence
  Description of Artificial Sequence: Synthetic peptide
  Seed: LQKFDNPPFF (TYRP2_HUMAN)
LEKFDNPPFF

SEQ ID NO: 193683 - protein, 9 aa, Artificial Sequence
  Description of Artificial Sequence: Synthetic peptide
  Seed: VTWHRYHLL (TYRP2_HUMAN)
VYWHRYHLM

SEQ ID NO: 193684 - protein, 9 aa, Artificial Sequence
  Description of Artificial Sequence: Synthetic peptide
  Seed: RNSMKLPTL (TYRP2_HUMAN)
RSSMKLPTL

SEQ ID NO: 193685 - protein, 9 aa, Artificial Sequence
  Description of Artificial Sequence: Synthetic peptide
  Seed: TLDSQVMSL (TYRP2_HUMAN)
TGDSQVMSI

SEQ ID NO: 193686 - protein, 10 aa, Artificial Sequence
  Description of Artificial Sequence: Synthetic peptide
  Seed: RRNQMGRNSM (TYRP2_HUMAN)
RHNQMGRNSY

SEQ ID NO: 193687 - protein, 9 aa, Artificial Sequence
  Description of Artificial Sequence: Synthetic peptide
  Seed: ALDLAKKRV (TYRP2_HUMAN)
AADLAKKRL

SEQ ID NO: 193688 - protein, 9 aa, Artificial Sequence
  Description of Artificial Sequence: Synthetic peptide
  Seed: NMVPFFPPV (TYRP2_HUMAN)
NVVPFFPPR

SEQ ID NO: 193689 - protein, 10 aa, Artificial Sequence
  Description of Artificial Sequence: Synthetic peptide
  Seed: DTLLGPGRPY (TYRP2_HUMAN)
DALLGPGRPR

SEQ ID NO: 193690 - protein, 11 aa, Artificial Sequence
  Description of Artificial Sequence: Synthetic peptide
  Seed: YTPLMETHLSS (TYRP2_HUMAN)
YSPLMETHLSM

SEQ ID NO: 193691 - protein, 11 aa, Artificial Sequence
  Description of Artificial Sequence: Synthetic peptide
  Seed: RELWPRKFFHR (TYRP2_HUMAN)
RTLWPRKFFHK

SEQ ID NO: 193692 - protein, 11 aa, Artificial Sequence
  Description of Artificial Sequence: Synthetic peptide
  Seed: FFQNSTFSFRN (TYRP2_HUMAN)
FRQNSTFSFRR

SEQ ID NO: 193693 - protein, 10 aa, Artificial Sequence
  Description of Artificial Sequence: Synthetic peptide
  Seed: FLLSCLGCKI (TYRP2_HUMAN)
FILSCLGCKI

SEQ ID NO: 193694 - protein, 11 aa, Artificial Sequence
  Description of Artificial Sequence: Synthetic peptide
  Seed: ILRNQDDRELW (TYRP2_HUMAN)
ITRNQDDRELW

SEQ ID NO: 193695 - protein, 9 aa, Artificial Sequence
  Description of Artificial Sequence: Synthetic peptide
  Seed: LQKFDNPPF (TYRP2_HUMAN)
LAKFDNPPF

SEQ ID NO: 193696 - protein, 9 aa, Artificial Sequence
  Description of Artificial Sequence: Synthetic peptide
  Seed: RMYNMVPFF (TYRP2_HUMAN)
RTYNMVPFH

SEQ ID NO: 193697 - protein, 9 aa, Artificial Sequence
  Description of Artificial Sequence: Synthetic peptide
  Seed: TQHWLGLLG (TYRP2_HUMAN)
TQHWLGLLM

SEQ ID NO: 193698 - protein, 11 aa, Artificial Sequence
  Description of Artificial Sequence: Synthetic peptide
  Seed: TQPQFANCSVY (TYRP2_HUMAN)
TVPQFANCSVM

SEQ ID NO: 193699 - protein, 11 aa, Artificial Sequence
  Description of Artificial Sequence: Synthetic peptide
  Seed: LPVSVEETPGW (TYRP2_HUMAN)
LVVSVEETPGW

SEQ ID NO: 193700 - protein, 9 aa, Artificial Sequence
  Description of Artificial Sequence: Synthetic peptide
  Seed: SLDDYNHLV (TYRP2_HUMAN)
SWDDYNHLM

SEQ ID NO: 193701 - protein, 9 aa, Artificial Sequence
  Description of Artificial Sequence: Synthetic peptide
  Seed: QFPRVCMTV (TYRP2_HUMAN)
QFPRVCMTW

SEQ ID NO: 193702 - protein, 9 aa, Artificial Sequence
  Description of Artificial Sequence: Synthetic peptide
  Seed: VHPDYVITT (TYRP2_HUMAN)
VRPDYVITM

SEQ ID NO: 193703 - protein, 9 aa, Artificial Sequence
  Description of Artificial Sequence: Synthetic peptide
  Seed: FVWLHYYSV (TYRP2_HUMAN)
FQWLHYYST

SEQ ID NO: 193704 - protein, 10 aa, Artificial Sequence
  Description of Artificial Sequence: Synthetic peptide
  Seed: NECDVCTDQL (TYRP2_HUMAN)
NHCDVCTDQF

SEQ ID NO: 193705 - protein, 10 aa, Artificial Sequence
  Description of Artificial Sequence: Synthetic peptide
  Seed: GTLDSQVMSL (TYRP2_HUMAN)
GYLDSQVMSV

SEQ ID NO: 193706 - protein, 9 aa, Artificial Sequence
  Description of Artificial Sequence: Synthetic peptide
  Seed: HPDYVITTQ (TYRP2_HUMAN)
HMDYVITTY

SEQ ID NO: 193707 - protein, 11 aa, Artificial Sequence
  Description of Artificial Sequence: Synthetic peptide
  Seed: RMYNMVPFFPP (TYRP2_HUMAN)
RLYNMVPFFPT

SEQ ID NO: 193708 - protein, 10 aa, Artificial Sequence
  Description of Artificial Sequence: Synthetic peptide
  Seed: FFVWLHYYSV (TYRP2_HUMAN)
FHVWLHYYSV

SEQ ID NO: 193709 - protein, 9 aa, Artificial Sequence
  Description of Artificial Sequence: Synthetic peptide
  Seed: HQGPAFVTW (TYRP2_HUMAN)
HHGPAFVTY

SEQ ID NO: 193710 - protein, 10 aa, Artificial Sequence
  Description of Artificial Sequence: Synthetic peptide
  Seed: LPGAQGQFPR (TYRP2_HUMAN)
LMGAQGQFPR

SEQ ID NO: 193711 - protein, 10 aa, Artificial Sequence
  Description of Artificial Sequence: Synthetic peptide
  Seed: HNRMYNMVPF (TYRP2_HUMAN)
HRRMYNMVPY

SEQ ID NO: 193712 - protein, 9 aa, Artificial Sequence
  Description of Artificial Sequence: Synthetic peptide
  Seed: ILPGAQGQF (TYRP2_HUMAN)
IYPGAQGQL

SEQ ID NO: 193713 - protein, 11 aa, Artificial Sequence
  Description of Artificial Sequence: Synthetic peptide
  Seed: FVVLHSFTDAI (TYRP2_HUMAN)
FYVLHSFTDAV

SEQ ID NO: 193714 - protein, 9 aa, Artificial Sequence
  Description of Artificial Sequence: Synthetic peptide
  Seed: SVYDFFVWL (TYRP2_HUMAN)
SLYDFFVWC

SEQ ID NO: 193715 - protein, 9 aa, Artificial Sequence
  Description of Artificial Sequence: Synthetic peptide
  Seed: VLLAFLQYR (TYRP2_HUMAN)
VTLAFLQYY

SEQ ID NO: 193716 - protein, 10 aa, Artificial Sequence
  Description of Artificial Sequence: Synthetic peptide
  Seed: YNMVPFFPPV (TYRP2_HUMAN)
YYMVPFFPPM

SEQ ID NO: 193717 - protein, 10 aa, Artificial Sequence
  Description of Artificial Sequence: Synthetic peptide
  Seed: RLRKGYTPLM (TYRP2_HUMAN)
RFRKGYTPLL

SEQ ID NO: 193718 - protein, 11 aa, Artificial Sequence
  Description of Artificial Sequence: Synthetic peptide
  Seed: QRLIGNESFAL (TYRP2_HUMAN)
QFLIGNESFAI

SEQ ID NO: 193719 - protein, 11 aa, Artificial Sequence
  Description of Artificial Sequence: Synthetic peptide
  Seed: FANCSVYDFFV (TYRP2_HUMAN)
FTNCSVYDFFV

SEQ ID NO: 193720 - protein, 10 aa, Artificial Sequence
  Description of Artificial Sequence: Synthetic peptide
  Seed: FSFRNALEGF (TYRP2_HUMAN)
FMFRNALEGW

SEQ ID NO: 193721 - protein, 11 aa, Artificial Sequence
  Description of Artificial Sequence: Synthetic peptide
  Seed: RADTRPWSGPY (TYRP2_HUMAN)
RRDTRPWSGPW

SEQ ID NO: 193722 - protein, 10 aa, Artificial Sequence
  Description of Artificial Sequence: Synthetic peptide
  Seed: YSYAIDLPVS (TYRP2_HUMAN)
YIYAIDLPVL

SEQ ID NO: 193723 - protein, 9 aa, Artificial Sequence
  Description of Artificial Sequence: Synthetic peptide
  Seed: ARPDDPTLI (TYRP2_HUMAN)
AAPDDPTLM

SEQ ID NO: 193724 - protein, 10 aa, Artificial Sequence
  Description of Artificial Sequence: Synthetic peptide
  Seed: MSPLWWGFLL (TYRP2_HUMAN)
MVPLWWGFLM

SEQ ID NO: 193725 - protein, 11 aa, Artificial Sequence
  Description of Artificial Sequence: Synthetic peptide
  Seed: MYNMVPFFPPV (TYRP2_HUMAN)
MSNMVPFFPPL

SEQ ID NO: 193726 - protein, 10 aa, Artificial Sequence
  Description of Artificial Sequence: Synthetic peptide
  Seed: YAIDLPVSVE (TYRP2_HUMAN)
YLIDLPVSVH

SEQ ID NO: 193727 - protein, 10 aa, Artificial Sequence
  Description of Artificial Sequence: Synthetic peptide
  Seed: TRPWSGPYIL (TYRP2_HUMAN)
TRPWSGPYIY

SEQ ID NO: 193728 - protein, 10 aa, Artificial Sequence
  Description of Artificial Sequence: Synthetic peptide
  Seed: VLLAFLQYRR (TYRP2_HUMAN)
VWLAFLQYRK

SEQ ID NO: 193729 - protein, 11 aa, Artificial Sequence
  Description of Artificial Sequence: Synthetic peptide
  Seed: WLHYYSVRDTL (TYRP2_HUMAN)
WSHYYSVRDTF

SEQ ID NO: 193730 - protein, 9 aa, Artificial Sequence
  Description of Artificial Sequence: Synthetic peptide
  Seed: WMKRFNPPA (TYRP2_HUMAN)
WKKRFNPPF

SEQ ID NO: 193731 - protein, 9 aa, Artificial Sequence
  Description of Artificial Sequence: Synthetic peptide
  Seed: YAIDLPVSV (TYRP2_HUMAN)
YVIDLPVSV

SEQ ID NO: 193732 - protein, 10 aa, Artificial Sequence
  Description of Artificial Sequence: Synthetic peptide
  Seed: FLLSCLGCKI (TYRP2_HUMAN)
FALSCLGCKV

SEQ ID NO: 193733 - protein, 9 aa, Artificial Sequence
  Description of Artificial Sequence: Synthetic peptide
  Seed: RLRKGYTPL (TYRP2_HUMAN)
RKRKGYTPL

SEQ ID NO: 193734 - protein, 11 aa, Artificial Sequence
  Description of Artificial Sequence: Synthetic peptide
  Seed: ARPDDPTLISR (TYRP2_HUMAN)
AYPDDPTLISF

SEQ ID NO: 193735 - protein, 9 aa, Artificial Sequence
  Description of Artificial Sequence: Synthetic peptide
  Seed: NGTYEGLLR (TYRP2_HUMAN)
NSTYEGLLR

SEQ ID NO: 193736 - protein, 9 aa, Artificial Sequence
  Description of Artificial Sequence: Synthetic peptide
  Seed: FPPVTNEEL (TYRP2_HUMAN)
FVPVTNEEM

SEQ ID NO: 193737 - protein, 10 aa, Artificial Sequence
  Description of Artificial Sequence: Synthetic peptide
  Seed: GTLDSQVMSL (TYRP2_HUMAN)
GLLDSQVMSI

SEQ ID NO: 193738 - protein, 10 aa, Artificial Sequence
  Description of Artificial Sequence: Synthetic peptide
  Seed: LDDYNHLVTL (TYRP2_HUMAN)
LSDYNHLVTL

SEQ ID NO: 193739 - protein, 10 aa, Artificial Sequence
  Description of Artificial Sequence: Synthetic peptide
  Seed: RRLRKGYTPL (TYRP2_HUMAN)
RRLRKGYTPV

SEQ ID NO: 193740 - protein, 9 aa, Artificial Sequence
  Description of Artificial Sequence: Synthetic peptide
  Seed: RLRKGYTPL (TYRP2_HUMAN)
RARKGYTPF

SEQ ID NO: 193741 - protein, 9 aa, Artificial Sequence
  Description of Artificial Sequence: Synthetic peptide
  Seed: SLHNLVHSF (TYRP2_HUMAN)
SSHNLVHSF

SEQ ID NO: 193742 - protein, 9 aa, Artificial Sequence
  Description of Artificial Sequence: Synthetic peptide
  Seed: LVGLFVLLA (TYRP2_HUMAN)
LLGLFVLLL

SEQ ID NO: 193743 - protein, 10 aa, Artificial Sequence
  Description of Artificial Sequence: Synthetic peptide
  Seed: RRLRKGYTPL (TYRP2_HUMAN)
RYLRKGYTPA

SEQ ID NO: 193744 - protein, 9 aa, Artificial Sequence
  Description of Artificial Sequence: Synthetic peptide
  Seed: DQLGYSYAI (TYRP2_HUMAN)
DELGYSYAV

SEQ ID NO: 193745 - protein, 10 aa, Artificial Sequence
  Description of Artificial Sequence: Synthetic peptide
  Seed: GTLVALVGLF (TYRP2_HUMAN)
GSLVALVGLW

SEQ ID NO: 193746 - protein, 9 aa, Artificial Sequence
  Description of Artificial Sequence: Synthetic peptide
  Seed: TSDQLGYSY (TYRP2_HUMAN)
TLDQLGYSV

SEQ ID NO: 193747 - protein, 9 aa, Artificial Sequence
  Description of Artificial Sequence: Synthetic peptide
  Seed: VSVEETPGW (TYRP2_HUMAN)
VSVEETPGY

SEQ ID NO: 193748 - protein, 10 aa, Artificial Sequence
  Description of Artificial Sequence: Synthetic peptide
  Seed: YNMVPFFPPV (TYRP2_HUMAN)
YFMVPFFPPM

SEQ ID NO: 193749 - protein, 11 aa, Artificial Sequence
  Description of Artificial Sequence: Synthetic peptide
  Seed: YNMVPFFPPVT (TYRP2_HUMAN)
YLMVPFFPPVE

SEQ ID NO: 193750 - protein, 11 aa, Artificial Sequence
  Description of Artificial Sequence: Synthetic peptide
  Seed: ANCSVYDFFVW (TYRP2_HUMAN)
AMCSVYDFFVW

SEQ ID NO: 193751 - protein, 9 aa, Artificial Sequence
  Description of Artificial Sequence: Synthetic peptide
  Seed: FPPVTNEEL (TYRP2_HUMAN)
FNPVTNEEL

SEQ ID NO: 193752 - protein, 10 aa, Artificial Sequence
  Description of Artificial Sequence: Synthetic peptide
  Seed: RNSRFSSWET (TYRP2_HUMAN)
RQSRFSSWEI

SEQ ID NO: 193753 - protein, 10 aa, Artificial Sequence
  Description of Artificial Sequence: Synthetic peptide
  Seed: TLLGPGRPYR (TYRP2_HUMAN)
TSLGPGRPYR

SEQ ID NO: 193754 - protein, 10 aa, Artificial Sequence
  Description of Artificial Sequence: Synthetic peptide
  Seed: YAIDLPVSVE (TYRP2_HUMAN)
YIIDLPVSVL

SEQ ID NO: 193755 - protein, 10 aa, Artificial Sequence
  Description of Artificial Sequence: Synthetic peptide
  Seed: DTLLGPGRPY (TYRP2_HUMAN)
DSLLGPGRPR

SEQ ID NO: 193756 - protein, 9 aa, Artificial Sequence
  Description of Artificial Sequence: Synthetic peptide
  Seed: YSYAIDLPV (TYRP2_HUMAN)
YYYAIDLPI

SEQ ID NO: 193757 - protein, 10 aa, Artificial Sequence
  Description of Artificial Sequence: Synthetic peptide
  Seed: IDFSHQGPAF (TYRP2_HUMAN)
IGFSHQGPAY

SEQ ID NO: 193758 - protein, 11 aa, Artificial Sequence
  Description of Artificial Sequence: Synthetic peptide
  Seed: WLHYYSVRDTL (TYRP2_HUMAN)
WQHYYSVRDTW

SEQ ID NO: 193759 - protein, 9 aa, Artificial Sequence
  Description of Artificial Sequence: Synthetic peptide
  Seed: DQLGYSYAI (TYRP2_HUMAN)
DMLGYSYAI

SEQ ID NO: 193760 - protein, 9 aa, Artificial Sequence
  Description of Artificial Sequence: Synthetic peptide
  Seed: VGLFVLLAF (TYRP2_HUMAN)
VHLFVLLAF

SEQ ID NO: 193761 - protein, 10 aa, Artificial Sequence
  Description of Artificial Sequence: Synthetic peptide
  Seed: ADTRPWSGPY (TYRP2_HUMAN)
AATRPWSGPK

SEQ ID NO: 193762 - protein, 10 aa, Artificial Sequence
  Description of Artificial Sequence: Synthetic peptide
  Seed: YSYAIDLPVS (TYRP2_HUMAN)
YLYAIDLPVL

SEQ ID NO: 193763 - protein, 10 aa, Artificial Sequence
  Description of Artificial Sequence: Synthetic peptide
  Seed: TDAIFDEWMK (TYRP2_HUMAN)
TMAIFDEWMK

SEQ ID NO: 193764 - protein, 9 aa, Artificial Sequence
  Description of Artificial Sequence: Synthetic peptide
  Seed: ISRNSRFSS (TYRP2_HUMAN)
ITRNSRFSK

SEQ ID NO: 193765 - protein, 9 aa, Artificial Sequence
  Description of Artificial Sequence: Synthetic peptide
  Seed: LHNLVHSFL (TYRP2_HUMAN)
LANLVHSFF

SEQ ID NO: 193766 - protein, 11 aa, Artificial Sequence
  Description of Artificial Sequence: Synthetic peptide
  Seed: RADTRPWSGPY (TYRP2_HUMAN)
RTDTRPWSGPY

SEQ ID NO: 193767 - protein, 10 aa, Artificial Sequence
  Description of Artificial Sequence: Synthetic peptide
  Seed: FVWLHYYSVR (TYRP2_HUMAN)
FFWLHYYSVR

SEQ ID NO: 193768 - protein, 9 aa, Artificial Sequence
  Description of Artificial Sequence: Synthetic peptide
  Seed: VTNEELFLT (TYRP2_HUMAN)
VLNEELFLI

SEQ ID NO: 193769 - protein, 10 aa, Artificial Sequence
  Description of Artificial Sequence: Synthetic peptide
  Seed: RLRKGYTPLM (TYRP2_HUMAN)
RRRKGYTPLF

SEQ ID NO: 193770 - protein, 9 aa, Artificial Sequence
  Description of Artificial Sequence: Synthetic peptide
  Seed: ANDPIFVVL (TYRP2_HUMAN)
AMDPIFVVL

SEQ ID NO: 193771 - protein, 10 aa, Artificial Sequence
  Description of Artificial Sequence: Synthetic peptide
  Seed: LHYYSVRDTL (TYRP2_HUMAN)
LGYYSVRDTF

SEQ ID NO: 193772 - protein, 9 aa, Artificial Sequence
  Description of Artificial Sequence: Synthetic peptide
  Seed: ISRNSRFSS (TYRP2_HUMAN)
IARNSRFSV

SEQ ID NO: 193773 - protein, 10 aa, Artificial Sequence
  Description of Artificial Sequence: Synthetic peptide
  Seed: RLRKGYTPLM (TYRP2_HUMAN)
RKRKGYTPLY

SEQ ID NO: 193774 - protein, 10 aa, Artificial Sequence
  Description of Artificial Sequence: Synthetic peptide
  Seed: AIFDEWMKRF (TYRP2_HUMAN)
AMFDEWMKRF

SEQ ID NO: 193775 - protein, 11 aa, Artificial Sequence
  Description of Artificial Sequence: Synthetic peptide
  Seed: WLHYYSVRDTL (TYRP2_HUMAN)
WAHYYSVRDTW

SEQ ID NO: 193776 - protein, 9 aa, Artificial Sequence
  Description of Artificial Sequence: Synthetic peptide
  Seed: VTWHRYHLL (TYRP2_HUMAN)
VRWHRYHLL

SEQ ID NO: 193777 - protein, 9 aa, Artificial Sequence
  Description of Artificial Sequence: Synthetic peptide
  Seed: VTWHRYHLL (TYRP2_HUMAN)
VMWHRYHLF

SEQ ID NO: 193778 - protein, 10 aa, Artificial Sequence
  Description of Artificial Sequence: Synthetic peptide
  Seed: HRYHLLCLER (TYRP2_HUMAN)
HWYHLLCLER

SEQ ID NO: 193779 - protein, 10 aa, Artificial Sequence
  Description of Artificial Sequence: Synthetic peptide
  Seed: TRPWSGPYIL (TYRP2_HUMAN)
TKPWSGPYIY

SEQ ID NO: 193780 - protein, 9 aa, Artificial Sequence
  Description of Artificial Sequence: Synthetic peptide
  Seed: DQLGYSYAI (TYRP2_HUMAN)
DELGYSYAL

SEQ ID NO: 193781 - protein, 9 aa, Artificial Sequence
  Description of Artificial Sequence: Synthetic peptide
  Seed: SQVMSLHNL (TYRP2_HUMAN)
SHVMSLHNV

SEQ ID NO: 193782 - protein, 9 aa, Artificial Sequence
  Description of Artificial Sequence: Synthetic peptide
  Seed: GQFPRVCMT (TYRP2_HUMAN)
GMFPRVCMV

SEQ ID NO: 193783 - protein, 9 aa, Artificial Sequence
  Description of Artificial Sequence: Synthetic peptide
  Seed: RFNPPADAW (TYRP2_HUMAN)
RVNPPADAL

SEQ ID NO: 193784 - protein, 9 aa, Artificial Sequence
  Description of Artificial Sequence: Synthetic peptide
  Seed: EQFLGALDL (TYRP2_HUMAN)
EMFLGALDF

SEQ ID NO: 193785 - protein, 10 aa, Artificial Sequence
  Description of Artificial Sequence: Synthetic peptide
  Seed: LTSDQLGYSY (TYRP2_HUMAN)
LQSDQLGYSY

SEQ ID NO: 193786 - protein, 10 aa, Artificial Sequence
  Description of Artificial Sequence: Synthetic peptide
  Seed: AIFDEWMKRF (TYRP2_HUMAN)
ATFDEWMKRY

SEQ ID NO: 193787 - protein, 10 aa, Artificial Sequence
  Description of Artificial Sequence: Synthetic peptide
  Seed: LPGAQGQFPR (TYRP2_HUMAN)
LTGAQGQFPR

SEQ ID NO: 193788 - protein, 9 aa, Artificial Sequence
  Description of Artificial Sequence: Synthetic peptide
  Seed: SQVMSLHNL (TYRP2_HUMAN)
SMVMSLHNF

SEQ ID NO: 193789 - protein, 10 aa, Artificial Sequence
  Description of Artificial Sequence: Synthetic peptide
  Seed: FFPPVTNEEL (TYRP2_HUMAN)
FAPPVTNEEY

SEQ ID NO: 193790 - protein, 10 aa, Artificial Sequence
  Description of Artificial Sequence: Synthetic peptide
  Seed: FFQNSTFSFR (TYRP2_HUMAN)
FLQNSTFSFR

SEQ ID NO: 193791 - protein, 8 aa, Artificial Sequence
  Description of Artificial Sequence: Synthetic peptide
  Seed: LDDYNHLV (TYRP2_HUMAN)
LADYNHLV

SEQ ID NO: 193792 - protein, 8 aa, Artificial Sequence
  Description of Artificial Sequence: Synthetic peptide
  Seed: FQNSTFSF (TYRP2_HUMAN)
FSNSTFSY

SEQ ID NO: 193793 - protein, 11 aa, Artificial Sequence
  Description of Artificial Sequence: Synthetic peptide
  Seed: ANCSVYDFFVW (TYRP2_HUMAN)
ADCSVYDFFVW

SEQ ID NO: 193794 - protein, 10 aa, Artificial Sequence
  Description of Artificial Sequence: Synthetic peptide
  Seed: LVVMGTLVAL (TYRP2_HUMAN)
LIVMGTLVAV

SEQ ID NO: 193795 - protein, 10 aa, Artificial Sequence
  Description of Artificial Sequence: Synthetic peptide
  Seed: ETPGWPTTLL (TYRP2_HUMAN)
EVPGWPTTLF

SEQ ID NO: 193796 - protein, 9 aa, Artificial Sequence
  Description of Artificial Sequence: Synthetic peptide
  Seed: DDYNHLVTL (TYRP2_HUMAN)
DMYNHLVTL

SEQ ID NO: 193797 - protein, 10 aa, Artificial Sequence
  Description of Artificial Sequence: Synthetic peptide
  Seed: GQFPRVCMTV (TYRP2_HUMAN)
GIFPRVCMTV

SEQ ID NO: 193798 - protein, 9 aa, Artificial Sequence
  Description of Artificial Sequence: Synthetic peptide
  Seed: GPGRPYRAI (TYRP2_HUMAN)
GPGRPYRAA

SEQ ID NO: 193799 - protein, 8 aa, Artificial Sequence
  Description of Artificial Sequence: Synthetic peptide
  Seed: LAPIGHNR (TYRP2_HUMAN)
LAPIGHNF

SEQ ID NO: 193800 - protein, 9 aa, Artificial Sequence
  Description of Artificial Sequence: Synthetic peptide
  Seed: ETPGWPTTL (TYRP2_HUMAN)
EIPGWPTTR

SEQ ID NO: 193801 - protein, 10 aa, Artificial Sequence
  Description of Artificial Sequence: Synthetic peptide
  Seed: LDDYNHLVTL (TYRP2_HUMAN)
LEDYNHLVTA

SEQ ID NO: 193802 - protein, 9 aa, Artificial Sequence
  Description of Artificial Sequence: Synthetic peptide
  Seed: YYSVRDTLL (TYRP2_HUMAN)
YFSVRDTLW

SEQ ID NO: 193803 - protein, 9 aa, Artificial Sequence
  Description of Artificial Sequence: Synthetic peptide
  Seed: STFSFRNAL (TYRP2_HUMAN)
SVFSFRNAK

SEQ ID NO: 193804 - protein, 9 aa, Artificial Sequence
  Description of Artificial Sequence: Synthetic peptide
  Seed: FLNGTNALP (TYRP2_HUMAN)
FLNGTNALA

SEQ ID NO: 193805 - protein, 10 aa, Artificial Sequence
  Description of Artificial Sequence: Synthetic peptide
  Seed: FVVLHSFTDA (TYRP2_HUMAN)
FMVLHSFTDL

SEQ ID NO: 193806 - protein, 10 aa, Artificial Sequence
  Description of Artificial Sequence: Synthetic peptide
  Seed: LVVMGTLVAL (TYRP2_HUMAN)
LSVMGTLVAM

SEQ ID NO: 193807 - protein, 9 aa, Artificial Sequence
  Description of Artificial Sequence: Synthetic peptide
  Seed: RYHLLCLER (TYRP2_HUMAN)
RVHLLCLER

SEQ ID NO: 193808 - protein, 11 aa, Artificial Sequence
  Description of Artificial Sequence: Synthetic peptide
  Seed: YNMVPFFPPVT (TYRP2_HUMAN)
YLMVPFFPPVV

SEQ ID NO: 193809 - protein, 10 aa, Artificial Sequence
  Description of Artificial Sequence: Synthetic peptide
  Seed: RLRKGYTPLM (TYRP2_HUMAN)
RPRKGYTPLG

SEQ ID NO: 193810 - protein, 9 aa, Artificial Sequence
  Description of Artificial Sequence: Synthetic peptide
  Seed: YAIDLPVSV (TYRP2_HUMAN)
YAIDLPVSI

SEQ ID NO: 193811 - protein, 11 aa, Artificial Sequence
  Description of Artificial Sequence: Synthetic peptide
  Seed: RNSRFSSWETV (TYRP2_HUMAN)
RPSRFSSWETI

SEQ ID NO: 193812 - protein, 10 aa, Artificial Sequence
  Description of Artificial Sequence: Synthetic peptide
  Seed: SLDDYNHLVT (TYRP2_HUMAN)
SMDDYNHLVY

SEQ ID NO: 193813 - protein, 11 aa, Artificial Sequence
  Description of Artificial Sequence: Synthetic peptide
  Seed: HPDYVITTQHW (TYRP2_HUMAN)
HVDYVITTQHF

SEQ ID NO: 193814 - protein, 10 aa, Artificial Sequence
  Description of Artificial Sequence: Synthetic peptide
  Seed: DAIFDEWMKR (TYRP2_HUMAN)
DGIFDEWMKR

SEQ ID NO: 193815 - protein, 9 aa, Artificial Sequence
  Description of Artificial Sequence: Synthetic peptide
  Seed: HSAANDPIF (TYRP2_HUMAN)
HAAANDPIY

SEQ ID NO: 193816 - protein, 10 aa, Artificial Sequence
  Description of Artificial Sequence: Synthetic peptide
  Seed: DAIFDEWMKR (TYRP2_HUMAN)
DIIFDEWMKR

SEQ ID NO: 193817 - protein, 10 aa, Artificial Sequence
  Description of Artificial Sequence: Synthetic peptide
  Seed: TDAIFDEWMK (TYRP2_HUMAN)
TTAIFDEWMR

SEQ ID NO: 193818 - protein, 8 aa, Artificial Sequence
  Description of Artificial Sequence: Synthetic peptide
  Seed: QFANCSVY (TYRP2_HUMAN)
QFANCSVF

SEQ ID NO: 193819 - protein, 10 aa, Artificial Sequence
  Description of Artificial Sequence: Synthetic peptide
  Seed: GQFPRVCMTV (TYRP2_HUMAN)
GVFPRVCMTY

SEQ ID NO: 193820 - protein, 11 aa, Artificial Sequence
  Description of Artificial Sequence: Synthetic peptide
  Seed: LLVVMGTLVAL (TYRP2_HUMAN)
LLVVMGTLVAI

SEQ ID NO: 193821 - protein, 9 aa, Artificial Sequence
  Description of Artificial Sequence: Synthetic peptide
  Seed: ALPYWNFAT (TYRP2_HUMAN)
AMPYWNFAI

SEQ ID NO: 193822 - protein, 9 aa, Artificial Sequence
  Description of Artificial Sequence: Synthetic peptide
  Seed: FTDAIFDEW (TYRP2_HUMAN)
FTDAIFDEI

SEQ ID NO: 193823 - protein, 9 aa, Artificial Sequence
  Description of Artificial Sequence: Synthetic peptide
  Seed: AANDPIFVV (TYRP2_HUMAN)
AANDPIFVI

SEQ ID NO: 193824 - protein, 10 aa, Artificial Sequence
  Description of Artificial Sequence: Synthetic peptide
  Seed: LHYYSVRDTL (TYRP2_HUMAN)
LSYYSVRDTW

SEQ ID NO: 193825 - protein, 9 aa, Artificial Sequence
  Description of Artificial Sequence: Synthetic peptide
  Seed: GLFVLLAFL (TYRP2_HUMAN)
GVFVLLAFI

SEQ ID NO: 193826 - protein, 10 aa, Artificial Sequence
  Description of Artificial Sequence: Synthetic peptide
  Seed: HSAANDPIFV (TYRP2_HUMAN)
HMAANDPIFL

SEQ ID NO: 193827 - protein, 9 aa, Artificial Sequence
  Description of Artificial Sequence: Synthetic peptide
  Seed: VTWHRYHLL (TYRP2_HUMAN)
VIWHRYHLR

SEQ ID NO: 193828 - protein, 9 aa, Artificial Sequence
  Description of Artificial Sequence: Synthetic peptide
  Seed: RNQDDRELW (TYRP2_HUMAN)
RSQDDRELW

SEQ ID NO: 193829 - protein, 9 aa, Artificial Sequence
  Description of Artificial Sequence: Synthetic peptide
  Seed: AFLQYRRLR (TYRP2_HUMAN)
AMLQYRRLR

SEQ ID NO: 193830 - protein, 8 aa, Artificial Sequence
  Description of Artificial Sequence: Synthetic peptide
  Seed: IRQNIHSL (TYRP2_HUMAN)
IHQNIHSA

SEQ ID NO: 193831 - protein, 11 aa, Artificial Sequence
  Description of Artificial Sequence: Synthetic peptide
  Seed: RNSRFSSWETV (TYRP2_HUMAN)
RESRFSSWETM

SEQ ID NO: 193832 - protein, 9 aa, Artificial Sequence
  Description of Artificial Sequence: Synthetic peptide
  Seed: DDYNHLVTL (TYRP2_HUMAN)
DPYNHLVTF

SEQ ID NO: 193833 - protein, 10 aa, Artificial Sequence
  Description of Artificial Sequence: Synthetic peptide
  Seed: FPPVTNEELF (TYRP2_HUMAN)
FQPVTNEELF

SEQ ID NO: 193834 - protein, 10 aa, Artificial Sequence
  Description of Artificial Sequence: Synthetic peptide
  Seed: MGRNSMKLPT (TYRP2_HUMAN)
MTRNSMKLPY

SEQ ID NO: 193835 - protein, 11 aa, Artificial Sequence
  Description of Artificial Sequence: Synthetic peptide
  Seed: RNSRFSSWETV (TYRP2_HUMAN)
RRSRFSSWETK

SEQ ID NO: 193836 - protein, 9 aa, Artificial Sequence
  Description of Artificial Sequence: Synthetic peptide
  Seed: TSDQLGYSY (TYRP2_HUMAN)
TGDQLGYSF

SEQ ID NO: 193837 - protein, 9 aa, Artificial Sequence
  Description of Artificial Sequence: Synthetic peptide
  Seed: LGYSYAIDL (TYRP2_HUMAN)
LAYSYAIDY

SEQ ID NO: 193838 - protein, 9 aa, Artificial Sequence
  Description of Artificial Sequence: Synthetic peptide
  Seed: LVALVGLFV (TYRP2_HUMAN)
LMALVGLFA

SEQ ID NO: 193839 - protein, 11 aa, Artificial Sequence
  Description of Artificial Sequence: Synthetic peptide
  Seed: RNSRFSSWETV (TYRP2_HUMAN)
RVSRFSSWETM

SEQ ID NO: 193840 - protein, 11 aa, Artificial Sequence
  Description of Artificial Sequence: Synthetic peptide
  Seed: HSAANDPIFVV (TYRP2_HUMAN)
HTAANDPIFVV

SEQ ID NO: 193841 - protein, 11 aa, Artificial Sequence
  Description of Artificial Sequence: Synthetic peptide
  Seed: HQGPAFVTWHR (TYRP2_HUMAN)
HIGPAFVTWHK

SEQ ID NO: 193842 - protein, 11 aa, Artificial Sequence
  Description of Artificial Sequence: Synthetic peptide
  Seed: SLDDYNHLVTL (TYRP2_HUMAN)
SFDDYNHLVTL

SEQ ID NO: 193843 - protein, 10 aa, Artificial Sequence
  Description of Artificial Sequence: Synthetic peptide
  Seed: KILPGAQGQF (TYRP2_HUMAN)
KLLPGAQGQY

SEQ ID NO: 193844 - protein, 9 aa, Artificial Sequence
  Description of Artificial Sequence: Synthetic peptide
  Seed: RQNIHSLSP (TYRP2_HUMAN)
RHNIHSLSF

SEQ ID NO: 193845 - protein, 10 aa, Artificial Sequence
  Description of Artificial Sequence: Synthetic peptide
  Seed: AARPDDPTLI (TYRP2_HUMAN)
AVRPDDPTLW

SEQ ID NO: 193846 - protein, 10 aa, Artificial Sequence
  Description of Artificial Sequence: Synthetic peptide
  Seed: TLDSQVMSLH (TYRP2_HUMAN)
TVDSQVMSLY

SEQ ID NO: 193847 - protein, 9 aa, Artificial Sequence
  Description of Artificial Sequence: Synthetic peptide
  Seed: HQGPAFVTW (TYRP2_HUMAN)
HMGPAFVTV

SEQ ID NO: 193848 - protein, 9 aa, Artificial Sequence
  Description of Artificial Sequence: Synthetic peptide
  Seed: TLLVVMGTL (TYRP2_HUMAN)
TILVVMGTV

SEQ ID NO: 193849 - protein, 10 aa, Artificial Sequence
  Description of Artificial Sequence: Synthetic peptide
  Seed: RNSRFSSWET (TYRP2_HUMAN)
RSSRFSSWEL

SEQ ID NO: 193850 - protein, 11 aa, Artificial Sequence
  Description of Artificial Sequence: Synthetic peptide
  Seed: YNMVPFFPPVT (TYRP2_HUMAN)
YVMVPFFPPVQ

SEQ ID NO: 193851 - protein, 10 aa, Artificial Sequence
  Description of Artificial Sequence: Synthetic peptide
  Seed: YNMVPFFPPV (TYRP2_HUMAN)
YGMVPFFPPT

SEQ ID NO: 193852 - protein, 9 aa, Artificial Sequence
  Description of Artificial Sequence: Synthetic peptide
  Seed: ALVGLFVLL (TYRP2_HUMAN)
ATVGLFVLA

SEQ ID NO: 193853 - protein, 9 aa, Artificial Sequence
  Description of Artificial Sequence: Synthetic peptide
  Seed: LHNLVHSFL (TYRP2_HUMAN)
LMNLVHSFM

SEQ ID NO: 193854 - protein, 9 aa, Artificial Sequence
  Description of Artificial Sequence: Synthetic peptide
  Seed: YAIDLPVSV (TYRP2_HUMAN)
YAIDLPVSY

SEQ ID NO: 193855 - protein, 11 aa, Artificial Sequence
  Description of Artificial Sequence: Synthetic peptide
  Seed: YTPLMETHLSS (TYRP2_HUMAN)
YGPLMETHLSV

SEQ ID NO: 193856 - protein, 10 aa, Artificial Sequence
  Description of Artificial Sequence: Synthetic peptide
  Seed: FPPVTNEELF (TYRP2_HUMAN)
FMPVTNEELW

SEQ ID NO: 193857 - protein, 10 aa, Artificial Sequence
  Description of Artificial Sequence: Synthetic peptide
  Seed: QPQFANCSVY (TYRP2_HUMAN)
QRQFANCSVM

SEQ ID NO: 193858 - protein, 10 aa, Artificial Sequence
  Description of Artificial Sequence: Synthetic peptide
  Seed: TRPWSGPYIL (TYRP2_HUMAN)
TSPWSGPYIY

SEQ ID NO: 193859 - protein, 10 aa, Artificial Sequence
  Description of Artificial Sequence: Synthetic peptide
  Seed: VYDFFVWLHY (TYRP2_HUMAN)
VMDFFVWLHY

SEQ ID NO: 193860 - protein, 9 aa, Artificial Sequence
  Description of Artificial Sequence: Synthetic peptide
  Seed: VIRQNIHSL (TYRP2_HUMAN)
VVRQNIHSK

SEQ ID NO: 193861 - protein, 9 aa, Artificial Sequence
  Description of Artificial Sequence: Synthetic peptide
  Seed: QFPRVCMTV (TYRP2_HUMAN)
QYPRVCMTL

SEQ ID NO: 193862 - protein, 10 aa, Artificial Sequence
  Description of Artificial Sequence: Synthetic peptide
  Seed: MSPLWWGFLL (TYRP2_HUMAN)
MAPLWWGFLW

SEQ ID NO: 193863 - protein, 10 aa, Artificial Sequence
  Description of Artificial Sequence: Synthetic peptide
  Seed: RNSRFSSWET (TYRP2_HUMAN)
RMSRFSSWEV

SEQ ID NO: 193864 - protein, 9 aa, Artificial Sequence
  Description of Artificial Sequence: Synthetic peptide
  Seed: LVALVGLFV (TYRP2_HUMAN)
LMALVGLFI

SEQ ID NO: 193865 - protein, 10 aa, Artificial Sequence
  Description of Artificial Sequence: Synthetic peptide
  Seed: DPTLISRNSR (TYRP2_HUMAN)
DATLISRNSR

SEQ ID NO: 193866 - protein, 9 aa, Artificial Sequence
  Description of Artificial Sequence: Synthetic peptide
  Seed: ANDPIFVVL (TYRP2_HUMAN)
AFDPIFVVL

SEQ ID NO: 193867 - protein, 9 aa, Artificial Sequence
  Description of Artificial Sequence: Synthetic peptide
  Seed: VIRQNIHSL (TYRP2_HUMAN)
VGRQNIHSY

SEQ ID NO: 193868 - protein, 9 aa, Artificial Sequence
  Description of Artificial Sequence: Synthetic peptide
  Seed: VMSLHNLVH (TYRP2_HUMAN)
VVSLHNLVY

SEQ ID NO: 193869 - protein, 11 aa, Artificial Sequence
  Description of Artificial Sequence: Synthetic peptide
  Seed: RNSRFSSWETV (TYRP2_HUMAN)
RDSRFSSWETF

SEQ ID NO: 193870 - protein, 9 aa, Artificial Sequence
  Description of Artificial Sequence: Synthetic peptide
  Seed: RPWSGPYIL (TYRP2_HUMAN)
RAWSGPYIF

SEQ ID NO: 193871 - protein, 11 aa, Artificial Sequence
  Description of Artificial Sequence: Synthetic peptide
  Seed: YTPLMETHLSS (TYRP2_HUMAN)
YSPLMETHLSV

SEQ ID NO: 193872 - protein, 9 aa, Artificial Sequence
  Description of Artificial Sequence: Synthetic peptide
  Seed: FVLLAFLQY (TYRP2_HUMAN)
FLLLAFLQY

SEQ ID NO: 193873 - protein, 10 aa, Artificial Sequence
  Description of Artificial Sequence: Synthetic peptide
  Seed: NPPFFQNSTF (TYRP2_HUMAN)
NMPFFQNSTL

SEQ ID NO: 193874 - protein, 9 aa, Artificial Sequence
  Description of Artificial Sequence: Synthetic peptide
  Seed: TPGWPTTLL (TYRP2_HUMAN)
TPGWPTTLF

SEQ ID NO: 193875 - protein, 9 aa, Artificial Sequence
  Description of Artificial Sequence: Synthetic peptide
  Seed: SLDDYNHLV (TYRP2_HUMAN)
SMDDYNHLT

SEQ ID NO: 193876 - protein, 11 aa, Artificial Sequence
  Description of Artificial Sequence: Synthetic peptide
  Seed: SVYDFFVWLHY (TYRP2_HUMAN)
SQYDFFVWLHY

SEQ ID NO: 193877 - protein, 9 aa, Artificial Sequence
  Description of Artificial Sequence: Synthetic peptide
  Seed: HQGPAFVTW (TYRP2_HUMAN)
HLGPAFVTW

SEQ ID NO: 193878 - protein, 11 aa, Artificial Sequence
  Description of Artificial Sequence: Synthetic peptide
  Seed: FFPPVTNEELF (TYRP2_HUMAN)
FAPPVTNEELW

SEQ ID NO: 193879 - protein, 8 aa, Artificial Sequence
  Description of Artificial Sequence: Synthetic peptide
  Seed: SLDDYNHL (TYRP2_HUMAN)
SWDDYNHF

SEQ ID NO: 193880 - protein, 10 aa, Artificial Sequence
  Description of Artificial Sequence: Synthetic peptide
  Seed: LHYYSVRDTL (TYRP2_HUMAN)
LFYYSVRDTI

SEQ ID NO: 193881 - protein, 9 aa, Artificial Sequence
  Description of Artificial Sequence: Synthetic peptide
  Seed: RFNPPADAW (TYRP2_HUMAN)
RVNPPADAF

SEQ ID NO: 193882 - protein, 9 aa, Artificial Sequence
  Description of Artificial Sequence: Synthetic peptide
  Seed: RLRKGYTPL (TYRP2_HUMAN)
RARKGYTPE

SEQ ID NO: 193883 - protein, 11 aa, Artificial Sequence
  Description of Artificial Sequence: Synthetic peptide
  Seed: YTPLMETHLSS (TYRP2_HUMAN)
YIPLMETHLSL

SEQ ID NO: 193884 - protein, 10 aa, Artificial Sequence
  Description of Artificial Sequence: Synthetic peptide
  Seed: RLRKGYTPLM (TYRP2_HUMAN)
RVRKGYTPLK

SEQ ID NO: 193885 - protein, 9 aa, Artificial Sequence
  Description of Artificial Sequence: Synthetic peptide
  Seed: CSVYDFFVW (TYRP2_HUMAN)
CVVYDFFVW

SEQ ID NO: 193886 - protein, 9 aa, Artificial Sequence
  Description of Artificial Sequence: Synthetic peptide
  Seed: AARPDDPTL (TYRP2_HUMAN)
AERPDDPTL

SEQ ID NO: 193887 - protein, 9 aa, Artificial Sequence
  Description of Artificial Sequence: Synthetic peptide
  Seed: LHNLVHSFL (TYRP2_HUMAN)
LMNLVHSFY

SEQ ID NO: 193888 - protein, 9 aa, Artificial Sequence
  Description of Artificial Sequence: Synthetic peptide
  Seed: HYYSVRDTL (TYRP2_HUMAN)
HYYSVRDTV

SEQ ID NO: 193889 - protein, 9 aa, Artificial Sequence
  Description of Artificial Sequence: Synthetic peptide
  Seed: LQKFDNPPF (TYRP2_HUMAN)
LMKFDNPPF

SEQ ID NO: 193890 - protein, 9 aa, Artificial Sequence
  Description of Artificial Sequence: Synthetic peptide
  Seed: NRMYNMVPF (TYRP2_HUMAN)
NHMYNMVPM

SEQ ID NO: 193891 - protein, 10 aa, Artificial Sequence
  Description of Artificial Sequence: Synthetic peptide
  Seed: YAIDLPVSVE (TYRP2_HUMAN)
YIIDLPVSVV

SEQ ID NO: 193892 - protein, 9 aa, Artificial Sequence
  Description of Artificial Sequence: Synthetic peptide
  Seed: NALEGFDKA (TYRP2_HUMAN)
NTLEGFDKV

SEQ ID NO: 193893 - protein, 8 aa, Artificial Sequence
  Description of Artificial Sequence: Synthetic peptide
  Seed: SLDDYNHL (TYRP2_HUMAN)
SSDDYNHL

SEQ ID NO: 193894 - protein, 10 aa, Artificial Sequence
  Description of Artificial Sequence: Synthetic peptide
  Seed: GQFPRVCMTV (TYRP2_HUMAN)
GRFPRVCMTV

SEQ ID NO: 193895 - protein, 10 aa, Artificial Sequence
  Description of Artificial Sequence: Synthetic peptide
  Seed: LFLTSDQLGY (TYRP2_HUMAN)
LYLTSDQLGY

SEQ ID NO: 193896 - protein, 10 aa, Artificial Sequence
  Description of Artificial Sequence: Synthetic peptide
  Seed: VGLFVLLAFL (TYRP2_HUMAN)
VHLFVLLAFV

SEQ ID NO: 193897 - protein, 10 aa, Artificial Sequence
  Description of Artificial Sequence: Synthetic peptide
  Seed: HSFLNGTNAL (TYRP2_HUMAN)
HTFLNGTNAY

SEQ ID NO: 193898 - protein, 9 aa, Artificial Sequence
  Description of Artificial Sequence: Synthetic peptide
  Seed: HSAANDPIF (TYRP2_HUMAN)
HLAANDPIY

SEQ ID NO: 193899 - protein, 9 aa, Artificial Sequence
  Description of Artificial Sequence: Synthetic peptide
  Seed: SRFSSWETV (TYRP2_HUMAN)
SQFSSWETV

SEQ ID NO: 193900 - protein, 9 aa, Artificial Sequence
  Description of Artificial Sequence: Synthetic peptide
  Seed: DDYNHLVTL (TYRP2_HUMAN)
DRYNHLVTL

SEQ ID NO: 193901 - protein, 10 aa, Artificial Sequence
  Description of Artificial Sequence: Synthetic peptide
  Seed: IGNESFALPY (TYRP2_HUMAN)
IYNESFALPY

SEQ ID NO: 193902 - protein, 9 aa, Artificial Sequence
  Description of Artificial Sequence: Synthetic peptide
  Seed: TNALPHSAA (TYRP2_HUMAN)
THALPHSAV

SEQ ID NO: 193903 - protein, 9 aa, Artificial Sequence
  Description of Artificial Sequence: Synthetic peptide
  Seed: VIRQNIHSL (TYRP2_HUMAN)
VTRQNIHSR

SEQ ID NO: 193904 - protein, 9 aa, Artificial Sequence
  Description of Artificial Sequence: Synthetic peptide
  Seed: GPAFVTWHR (TYRP2_HUMAN)
GNAFVTWHR

SEQ ID NO: 193905 - protein, 9 aa, Artificial Sequence
  Description of Artificial Sequence: Synthetic peptide
  Seed: VVMGTLVAL (TYRP2_HUMAN)
VLMGTLVAM

SEQ ID NO: 193906 - protein, 9 aa, Artificial Sequence
  Description of Artificial Sequence: Synthetic peptide
  Seed: DTRPWSGPY (TYRP2_HUMAN)
DMRPWSGPF

SEQ ID NO: 193907 - protein, 8 aa, Artificial Sequence
  Description of Artificial Sequence: Synthetic peptide
  Seed: RMYNMVPF (TYRP2_HUMAN)
RFYNMVPL

SEQ ID NO: 193908 - protein, 9 aa, Artificial Sequence
  Description of Artificial Sequence: Synthetic peptide
  Seed: YAIDLPVSV (TYRP2_HUMAN)
YLIDLPVSV

SEQ ID NO: 193909 - protein, 9 aa, Artificial Sequence
  Description of Artificial Sequence: Synthetic peptide
  Seed: SVYDFFVWL (TYRP2_HUMAN)
SLYDFFVWA

SEQ ID NO: 193910 - protein, 9 aa, Artificial Sequence
  Description of Artificial Sequence: Synthetic peptide
  Seed: YVITTQHWL (TYRP2_HUMAN)
YAITTQHWM

SEQ ID NO: 193911 - protein, 9 aa, Artificial Sequence
  Description of Artificial Sequence: Synthetic peptide
  Seed: SVYDFFVWL (TYRP2_HUMAN)
STYDFFVWR

SEQ ID NO: 193912 - protein, 9 aa, Artificial Sequence
  Description of Artificial Sequence: Synthetic peptide
  Seed: VIRQNIHSL (TYRP2_HUMAN)
VQRQNIHSY

SEQ ID NO: 193913 - protein, 9 aa, Artificial Sequence
  Description of Artificial Sequence: Synthetic peptide
  Seed: RKFFHRTCK (TYRP2_HUMAN)
RSFFHRTCV

SEQ ID NO: 193914 - protein, 9 aa, Artificial Sequence
  Description of Artificial Sequence: Synthetic peptide
  Seed: VVMGTLVAL (TYRP2_HUMAN)
VQMGTLVAL

SEQ ID NO: 193915 - protein, 10 aa, Artificial Sequence
  Description of Artificial Sequence: Synthetic peptide
  Seed: SAANDPIFVV (TYRP2_HUMAN)
SLANDPIFVL

SEQ ID NO: 193916 - protein, 10 aa, Artificial Sequence
  Description of Artificial Sequence: Synthetic peptide
  Seed: FQNSTFSFRN (TYRP2_HUMAN)
FQNSTFSFRR

SEQ ID NO: 193917 - protein, 9 aa, Artificial Sequence
  Description of Artificial Sequence: Synthetic peptide
  Seed: TSDQLGYSY (TYRP2_HUMAN)
TSDQLGYSL

SEQ ID NO: 193918 - protein, 9 aa, Artificial Sequence
  Description of Artificial Sequence: Synthetic peptide
  Seed: YSYAIDLPV (TYRP2_HUMAN)
YCYAIDLPW

SEQ ID NO: 193919 - protein, 9 aa, Artificial Sequence
  Description of Artificial Sequence: Synthetic peptide
  Seed: KCTGNFAGY (TYRP2_HUMAN)
KYTGNFAGY

SEQ ID NO: 193920 - protein, 10 aa, Artificial Sequence
  Description of Artificial Sequence: Synthetic peptide
  Seed: MTVDSLVNKE (TYRP2_HUMAN)
MAVDSLVNKK

SEQ ID NO: 193921 - protein, 10 aa, Artificial Sequence
  Description of Artificial Sequence: Synthetic peptide
  Seed: RLRKGYTPLM (TYRP2_HUMAN)
RPRKGYTPLQ

SEQ ID NO: 193922 - protein, 11 aa, Artificial Sequence
  Description of Artificial Sequence: Synthetic peptide
  Seed: LLAFLQYRRLR (TYRP2_HUMAN)
LMAFLQYRRLR

SEQ ID NO: 193923 - protein, 9 aa, Artificial Sequence
  Description of Artificial Sequence: Synthetic peptide
  Seed: ITTQHWLGL (TYRP2_HUMAN)
IITQHWLGV

SEQ ID NO: 193924 - protein, 10 aa, Artificial Sequence
  Description of Artificial Sequence: Synthetic peptide
  Seed: RNSRFSSWET (TYRP2_HUMAN)
RKSRFSSWEI

SEQ ID NO: 193925 - protein, 9 aa, Artificial Sequence
  Description of Artificial Sequence: Synthetic peptide
  Seed: QEREQFLGA (TYRP2_HUMAN)
QEREQFLGV

SEQ ID NO: 193926 - protein, 10 aa, Artificial Sequence
  Description of Artificial Sequence: Synthetic peptide
  Seed: FFVWLHYYSV (TYRP2_HUMAN)
FMVWLHYYSL

SEQ ID NO: 193927 - protein, 9 aa, Artificial Sequence
  Description of Artificial Sequence: Synthetic peptide
  Seed: ANDPIFVVL (TYRP2_HUMAN)
ALDPIFVVV

SEQ ID NO: 193928 - protein, 8 aa, Artificial Sequence
  Description of Artificial Sequence: Synthetic peptide
  Seed: LLGPGRPY (TYRP2_HUMAN)
LAGPGRPF

SEQ ID NO: 193929 - protein, 10 aa, Artificial Sequence
  Description of Artificial Sequence: Synthetic peptide
  Seed: RRNQMGRNSM (TYRP2_HUMAN)
RKNQMGRNSY

SEQ ID NO: 193930 - protein, 10 aa, Artificial Sequence
  Description of Artificial Sequence: Synthetic peptide
  Seed: HNRMYNMVPF (TYRP2_HUMAN)
HRRMYNMVPL

SEQ ID NO: 193931 - protein, 10 aa, Artificial Sequence
  Description of Artificial Sequence: Synthetic peptide
  Seed: MTVDSLVNKE (TYRP2_HUMAN)
MIVDSLVNKK

SEQ ID NO: 193932 - protein, 9 aa, Artificial Sequence
  Description of Artificial Sequence: Synthetic peptide
  Seed: GWPTTLLVV (TYRP2_HUMAN)
GWPTTLLVF

SEQ ID NO: 193933 - protein, 9 aa, Artificial Sequence
  Description of Artificial Sequence: Synthetic peptide
  Seed: ISRNSRFSS (TYRP2_HUMAN)
IGRNSRFSK

SEQ ID NO: 193934 - protein, 9 aa, Artificial Sequence
  Description of Artificial Sequence: Synthetic peptide
  Seed: QKFDNPPFF (TYRP2_HUMAN)
QLFDNPPFY

SEQ ID NO: 193935 - protein, 9 aa, Artificial Sequence
  Description of Artificial Sequence: Synthetic peptide
  Seed: RRLRKGYTP (TYRP2_HUMAN)
RRLRKGYTC

SEQ ID NO: 193936 - protein, 9 aa, Artificial Sequence
  Description of Artificial Sequence: Synthetic peptide
  Seed: DFFVWLHYY (TYRP2_HUMAN)
DLFVWLHYK

SEQ ID NO: 193937 - protein, 9 aa, Artificial Sequence
  Description of Artificial Sequence: Synthetic peptide
  Seed: NESFALPYW (TYRP2_HUMAN)
NTSFALPYW

SEQ ID NO: 193938 - protein, 9 aa, Artificial Sequence
  Description of Artificial Sequence: Synthetic peptide
  Seed: RVCMTVDSL (TYRP2_HUMAN)
RLCMTVDSI

SEQ ID NO: 193939 - protein, 9 aa, Artificial Sequence
  Description of Artificial Sequence: Synthetic peptide
  Seed: LLRRNQMGR (TYRP2_HUMAN)
LMRRNQMGR

SEQ ID NO: 193940 - protein, 11 aa, Artificial Sequence
  Description of Artificial Sequence: Synthetic peptide
  Seed: ALPYWNFATGR (TYRP2_HUMAN)
AWPYWNFATGR

SEQ ID NO: 193941 - protein, 9 aa, Artificial Sequence
  Description of Artificial Sequence: Synthetic peptide
  Seed: ILPGAQGQF (TYRP2_HUMAN)
ITPGAQGQL

SEQ ID NO: 193942 - protein, 10 aa, Artificial Sequence
  Description of Artificial Sequence: Synthetic peptide
  Seed: YAIDLPVSVE (TYRP2_HUMAN)
YLIDLPVSVT

SEQ ID NO: 193943 - protein, 10 aa, Artificial Sequence
  Description of Artificial Sequence: Synthetic peptide
  Seed: YNMVPFFPPV (TYRP2_HUMAN)
YPMVPFFPPV

SEQ ID NO: 193944 - protein, 11 aa, Artificial Sequence
  Description of Artificial Sequence: Synthetic peptide
  Seed: LLVVMGTLVAL (TYRP2_HUMAN)
LYVVMGTLVAV

SEQ ID NO: 193945 - protein, 11 aa, Artificial Sequence
  Description of Artificial Sequence: Synthetic peptide
  Seed: MYNMVPFFPPV (TYRP2_HUMAN)
MLNMVPFFPPA

SEQ ID NO: 193946 - protein, 10 aa, Artificial Sequence
  Description of Artificial Sequence: Synthetic peptide
  Seed: KRFNPPADAW (TYRP2_HUMAN)
KLFNPPADAW

SEQ ID NO: 193947 - protein, 9 aa, Artificial Sequence
  Description of Artificial Sequence: Synthetic peptide
  Seed: ALVGLFVLL (TYRP2_HUMAN)
AAVGLFVLF

SEQ ID NO: 193948 - protein, 9 aa, Artificial Sequence
  Description of Artificial Sequence: Synthetic peptide
  Seed: METHLSSKR (TYRP2_HUMAN)
MTTHLSSKR

SEQ ID NO: 193949 - protein, 11 aa, Artificial Sequence
  Description of Artificial Sequence: Synthetic peptide
  Seed: FQNSTFSFRNA (TYRP2_HUMAN)
FLNSTFSFRNA

SEQ ID NO: 193950 - protein, 10 aa, Artificial Sequence
  Description of Artificial Sequence: Synthetic peptide
  Seed: RELWPRKFFH (TYRP2_HUMAN)
RMLWPRKFFK

SEQ ID NO: 193951 - protein, 10 aa, Artificial Sequence
  Description of Artificial Sequence: Synthetic peptide
  Seed: AANDPIFVVL (TYRP2_HUMAN)
ATNDPIFVVW

SEQ ID NO: 193952 - protein, 10 aa, Artificial Sequence
  Description of Artificial Sequence: Synthetic peptide
  Seed: SLQKFDNPPF (TYRP2_HUMAN)
SFQKFDNPPF

SEQ ID NO: 193953 - protein, 10 aa, Artificial Sequence
  Description of Artificial Sequence: Synthetic peptide
  Seed: ADTRPWSGPY (TYRP2_HUMAN)
ANTRPWSGPY

SEQ ID NO: 193954 - protein, 9 aa, Artificial Sequence
  Description of Artificial Sequence: Synthetic peptide
  Seed: FVLLAFLQY (TYRP2_HUMAN)
FSLLAFLQF

SEQ ID NO: 193955 - protein, 11 aa, Artificial Sequence
  Description of Artificial Sequence: Synthetic peptide
  Seed: RNSRFSSWETV (TYRP2_HUMAN)
RLSRFSSWETV

SEQ ID NO: 193956 - protein, 11 aa, Artificial Sequence
  Description of Artificial Sequence: Synthetic peptide
  Seed: YNMVPFFPPVT (TYRP2_HUMAN)
YTMVPFFPPVE

SEQ ID NO: 193957 - protein, 9 aa, Artificial Sequence
  Description of Artificial Sequence: Synthetic peptide
  Seed: TDQLFGAAR (TYRP2_HUMAN)
TAQLFGAAM

SEQ ID NO: 193958 - protein, 9 aa, Artificial Sequence
  Description of Artificial Sequence: Synthetic peptide
  Seed: FVLLAFLQY (TYRP2_HUMAN)
FTLLAFLQY

SEQ ID NO: 193959 - protein, 10 aa, Artificial Sequence
  Description of Artificial Sequence: Synthetic peptide
  Seed: YDFFVWLHYY (TYRP2_HUMAN)
YFFFVWLHYH

SEQ ID NO: 193960 - protein, 9 aa, Artificial Sequence
  Description of Artificial Sequence: Synthetic peptide
  Seed: RQNIHSLSP (TYRP2_HUMAN)
RMNIHSLSL

SEQ ID NO: 193961 - protein, 9 aa, Artificial Sequence
  Description of Artificial Sequence: Synthetic peptide
  Seed: FFPPVTNEE (TYRP2_HUMAN)
FIPPVTNEY

SEQ ID NO: 193962 - protein, 8 aa, Artificial Sequence
  Description of Artificial Sequence: Synthetic peptide
  Seed: FSHQGPAF (TYRP2_HUMAN)
FTHQGPAF

SEQ ID NO: 193963 - protein, 9 aa, Artificial Sequence
  Description of Artificial Sequence: Synthetic peptide
  Seed: DDYNHLVTL (TYRP2_HUMAN)
DMYNHLVTI

SEQ ID NO: 193964 - protein, 10 aa, Artificial Sequence
  Description of Artificial Sequence: Synthetic peptide
  Seed: TQPQFANCSV (TYRP2_HUMAN)
THPQFANCSL

SEQ ID NO: 193965 - protein, 10 aa, Artificial Sequence
  Description of Artificial Sequence: Synthetic peptide
  Seed: IGNESFALPY (TYRP2_HUMAN)
IWNESFALPY

SEQ ID NO: 193966 - protein, 11 aa, Artificial Sequence
  Description of Artificial Sequence: Synthetic peptide
  Seed: TQPQFANCSVY (TYRP2_HUMAN)
TAPQFANCSVM

SEQ ID NO: 193967 - protein, 10 aa, Artificial Sequence
  Description of Artificial Sequence: Synthetic peptide
  Seed: TLDSQVMSLH (TYRP2_HUMAN)
TIDSQVMSLY

SEQ ID NO: 193968 - protein, 9 aa, Artificial Sequence
  Description of Artificial Sequence: Synthetic peptide
  Seed: FPPVTNEEL (TYRP2_HUMAN)
FCPVTNEEL

SEQ ID NO: 193969 - protein, 9 aa, Artificial Sequence
  Description of Artificial Sequence: Synthetic peptide
  Seed: SVRDTLLGP (TYRP2_HUMAN)
SSRDTLLGA

SEQ ID NO: 193970 - protein, 9 aa, Artificial Sequence
  Description of Artificial Sequence: Synthetic peptide
  Seed: TLDSQVMSL (TYRP2_HUMAN)
TDDSQVMSL

SEQ ID NO: 193971 - protein, 9 aa, Artificial Sequence
  Description of Artificial Sequence: Synthetic peptide
  Seed: YVITTQHWL (TYRP2_HUMAN)
YLITTQHWR

SEQ ID NO: 193972 - protein, 9 aa, Artificial Sequence
  Description of Artificial Sequence: Synthetic peptide
  Seed: CERKKPPVI (TYRP2_HUMAN)
CLRKKPPVL

SEQ ID NO: 193973 - protein, 9 aa, Artificial Sequence
  Description of Artificial Sequence: Synthetic peptide
  Seed: YSYAIDLPV (TYRP2_HUMAN)
YLYAIDLPM

SEQ ID NO: 193974 - protein, 10 aa, Artificial Sequence
  Description of Artificial Sequence: Synthetic peptide
  Seed: NIHSLSPQER (TYRP2_HUMAN)
NTHSLSPQEK

SEQ ID NO: 193975 - protein, 10 aa, Artificial Sequence
  Description of Artificial Sequence: Synthetic peptide
  Seed: LISRNSRFSS (TYRP2_HUMAN)
LVSRNSRFSA

SEQ ID NO: 193976 - protein, 10 aa, Artificial Sequence
  Description of Artificial Sequence: Synthetic peptide
  Seed: ESANVCGSQQ (TYRP2_HUMAN)
EVANVCGSQY

SEQ ID NO: 193977 - protein, 10 aa, Artificial Sequence
  Description of Artificial Sequence: Synthetic peptide
  Seed: SRFSSWETVC (TYRP2_HUMAN)
SRFSSWETVF

SEQ ID NO: 193978 - protein, 9 aa, Artificial Sequence
  Description of Artificial Sequence: Synthetic peptide
  Seed: RAIDFSHQG (TYRP2_HUMAN)
RVIDFSHQM

SEQ ID NO: 193979 - protein, 9 aa, Artificial Sequence
  Description of Artificial Sequence: Synthetic peptide
  Seed: HYYSVRDTL (TYRP2_HUMAN)
HFYSVRDTV

SEQ ID NO: 193980 - protein, 9 aa, Artificial Sequence
  Description of Artificial Sequence: Synthetic peptide
  Seed: LQKFDNPPF (TYRP2_HUMAN)
LSKFDNPPF

SEQ ID NO: 193981 - protein, 10 aa, Artificial Sequence
  Description of Artificial Sequence: Synthetic peptide
  Seed: MSPLWWGFLL (TYRP2_HUMAN)
MWPLWWGFLI

SEQ ID NO: 193982 - protein, 11 aa, Artificial Sequence
  Description of Artificial Sequence: Synthetic peptide
  Seed: QPQFANCSVYD (TYRP2_HUMAN)
QRQFANCSVYM

SEQ ID NO: 193983 - protein, 9 aa, Artificial Sequence
  Description of Artificial Sequence: Synthetic peptide
  Seed: TLLGPGRPY (TYRP2_HUMAN)
TTLGPGRPM

SEQ ID NO: 193984 - protein, 10 aa, Artificial Sequence
  Description of Artificial Sequence: Synthetic peptide
  Seed: QPQFANCSVY (TYRP2_HUMAN)
QQQFANCSVW

SEQ ID NO: 193985 - protein, 9 aa, Artificial Sequence
  Description of Artificial Sequence: Synthetic peptide
  Seed: YAIDLPVSV (TYRP2_HUMAN)
YMIDLPVSS

SEQ ID NO: 193986 - protein, 10 aa, Artificial Sequence
  Description of Artificial Sequence: Synthetic peptide
  Seed: YAIDLPVSVE (TYRP2_HUMAN)
YMIDLPVSVF

SEQ ID NO: 193987 - protein, 11 aa, Artificial Sequence
  Description of Artificial Sequence: Synthetic peptide
  Seed: FANCSVYDFFV (TYRP2_HUMAN)
FMNCSVYDFFA

SEQ ID NO: 193988 - protein, 10 aa, Artificial Sequence
  Description of Artificial Sequence: Synthetic peptide
  Seed: NIHSLSPQER (TYRP2_HUMAN)
NVHSLSPQER

SEQ ID NO: 193989 - protein, 10 aa, Artificial Sequence
  Description of Artificial Sequence: Synthetic peptide
  Seed: HNRMYNMVPF (TYRP2_HUMAN)
HRRMYNMVPI

SEQ ID NO: 193990 - protein, 9 aa, Artificial Sequence
  Description of Artificial Sequence: Synthetic peptide
  Seed: ETPGWPTTL (TYRP2_HUMAN)
EIPGWPTTV

SEQ ID NO: 193991 - protein, 9 aa, Artificial Sequence
  Description of Artificial Sequence: Synthetic peptide
  Seed: ANDPIFVVL (TYRP2_HUMAN)
ALDPIFVVI

SEQ ID NO: 193992 - protein, 9 aa, Artificial Sequence
  Description of Artificial Sequence: Synthetic peptide
  Seed: VDSLVNKEC (TYRP2_HUMAN)
VESLVNKEL

SEQ ID NO: 193993 - protein, 9 aa, Artificial Sequence
  Description of Artificial Sequence: Synthetic peptide
  Seed: TLKDIRDCL (TYRP2_HUMAN)
TLKDIRDCY

SEQ ID NO: 193994 - protein, 10 aa, Artificial Sequence
  Description of Artificial Sequence: Synthetic peptide
  Seed: TVDSLVNKEC (TYRP2_HUMAN)
TMDSLVNKEL

SEQ ID NO: 193995 - protein, 9 aa, Artificial Sequence
  Description of Artificial Sequence: Synthetic peptide
  Seed: STFSFRNAL (TYRP2_HUMAN)
SNFSFRNAF

SEQ ID NO: 193996 - protein, 9 aa, Artificial Sequence
  Description of Artificial Sequence: Synthetic peptide
  Seed: FSHQGPAFV (TYRP2_HUMAN)
FLHQGPAFY

SEQ ID NO: 193997 - protein, 10 aa, Artificial Sequence
  Description of Artificial Sequence: Synthetic peptide
  Seed: MSPLWWGFLL (TYRP2_HUMAN)
MDPLWWGFLA

SEQ ID NO: 193998 - protein, 10 aa, Artificial Sequence
  Description of Artificial Sequence: Synthetic peptide
  Seed: FFQNSTFSFR (TYRP2_HUMAN)
FYQNSTFSFT

SEQ ID NO: 193999 - protein, 9 aa, Artificial Sequence
  Description of Artificial Sequence: Synthetic peptide
  Seed: NALEGFDKA (TYRP2_HUMAN)
NILEGFDKL

SEQ ID NO: 194000 - protein, 10 aa, Artificial Sequence
  Description of Artificial Sequence: Synthetic peptide
  Seed: RTCKCTGNFA (TYRP2_HUMAN)
RVCKCTGNFA

SEQ ID NO: 194001 - protein, 9 aa, Artificial Sequence
  Description of Artificial Sequence: Synthetic peptide
  Seed: TLLGPGRPY (TYRP2_HUMAN)
TFLGPGRPF

SEQ ID NO: 194002 - protein, 10 aa, Artificial Sequence
  Description of Artificial Sequence: Synthetic peptide
  Seed: MGTLVALVGL (TYRP2_HUMAN)
MQTLVALVGI

SEQ ID NO: 194003 - protein, 10 aa, Artificial Sequence
  Description of Artificial Sequence: Synthetic peptide
  Seed: TDAIFDEWMK (TYRP2_HUMAN)
TRAIFDEWMR

SEQ ID NO: 194004 - protein, 10 aa, Artificial Sequence
  Description of Artificial Sequence: Synthetic peptide
  Seed: RELWPRKFFH (TYRP2_HUMAN)
RPLWPRKFFK

SEQ ID NO: 194005 - protein, 9 aa, Artificial Sequence
  Description of Artificial Sequence: Synthetic peptide
  Seed: VLLAFLQYR (TYRP2_HUMAN)
VSLAFLQYR

SEQ ID NO: 194006 - protein, 9 aa, Artificial Sequence
  Description of Artificial Sequence: Synthetic peptide
  Seed: FTDAIFDEW (TYRP2_HUMAN)
FFDAIFDEF

SEQ ID NO: 194007 - protein, 9 aa, Artificial Sequence
  Description of Artificial Sequence: Synthetic peptide
  Seed: FLLSCLGCK (TYRP2_HUMAN)
FFLSCLGCR

SEQ ID NO: 194008 - protein, 9 aa, Artificial Sequence
  Description of Artificial Sequence: Synthetic peptide
  Seed: LVTLCNGTY (TYRP2_HUMAN)
LLTLCNGTY

SEQ ID NO: 194009 - protein, 9 aa, Artificial Sequence
  Description of Artificial Sequence: Synthetic peptide
  Seed: RLRKGYTPL (TYRP2_HUMAN)
RKRKGYTPY

SEQ ID NO: 194010 - protein, 10 aa, Artificial Sequence
  Description of Artificial Sequence: Synthetic peptide
  Seed: FFQNSTFSFR (TYRP2_HUMAN)
FMQNSTFSFR

SEQ ID NO: 194011 - protein, 10 aa, Artificial Sequence
  Description of Artificial Sequence: Synthetic peptide
  Seed: SPLWWGFLLS (TYRP2_HUMAN)
SALWWGFLLI

SEQ ID NO: 194012 - protein, 8 aa, Artificial Sequence
  Description of Artificial Sequence: Synthetic peptide
  Seed: FSHQGPAF (TYRP2_HUMAN)
FTHQGPAV

SEQ ID NO: 194013 - protein, 9 aa, Artificial Sequence
  Description of Artificial Sequence: Synthetic peptide
  Seed: ALVGLFVLL (TYRP2_HUMAN)
ATVGLFVLF

SEQ ID NO: 194014 - protein, 11 aa, Artificial Sequence
  Description of Artificial Sequence: Synthetic peptide
  Seed: LPHSAANDPIF (TYRP2_HUMAN)
LPHSAANDPIY

SEQ ID NO: 194015 - protein, 9 aa, Artificial Sequence
  Description of Artificial Sequence: Synthetic peptide
  Seed: AQGQFPRVC (TYRP2_HUMAN)
AEGQFPRVM

SEQ ID NO: 194016 - protein, 10 aa, Artificial Sequence
  Description of Artificial Sequence: Synthetic peptide
  Seed: YAIDLPVSVE (TYRP2_HUMAN)
YLIDLPVSVA

SEQ ID NO: 194017 - protein, 11 aa, Artificial Sequence
  Description of Artificial Sequence: Synthetic peptide
  Seed: RMYNMVPFFPP (TYRP2_HUMAN)
RLYNMVPFFPL

SEQ ID NO: 194018 - protein, 8 aa, Artificial Sequence
  Description of Artificial Sequence: Synthetic peptide
  Seed: AIDLPVSV (TYRP2_HUMAN)
AIDLPVSI

SEQ ID NO: 194019 - protein, 11 aa, Artificial Sequence
  Description of Artificial Sequence: Synthetic peptide
  Seed: RADTRPWSGPY (TYRP2_HUMAN)
RMDTRPWSGPY

SEQ ID NO: 194020 - protein, 10 aa, Artificial Sequence
  Description of Artificial Sequence: Synthetic peptide
  Seed: SVYDFFVWLH (TYRP2_HUMAN)
SAYDFFVWLR

SEQ ID NO: 194021 - protein, 10 aa, Artificial Sequence
  Description of Artificial Sequence: Synthetic peptide
  Seed: RLIGNESFAL (TYRP2_HUMAN)
RLIGNESFAV

SEQ ID NO: 194022 - protein, 9 aa, Artificial Sequence
  Description of Artificial Sequence: Synthetic peptide
  Seed: RNQMGRNSM (TYRP2_HUMAN)
RQQMGRNSW

SEQ ID NO: 194023 - protein, 8 aa, Artificial Sequence
  Description of Artificial Sequence: Synthetic peptide
  Seed: VPFFPPVT (TYRP2_HUMAN)
VPFFPPVA

SEQ ID NO: 194024 - protein, 9 aa, Artificial Sequence
  Description of Artificial Sequence: Synthetic peptide
  Seed: VLHSFTDAI (TYRP2_HUMAN)
VMHSFTDAI

SEQ ID NO: 194025 - protein, 10 aa, Artificial Sequence
  Description of Artificial Sequence: Synthetic peptide
  Seed: GTLDSQVMSL (TYRP2_HUMAN)
GKLDSQVMSV

SEQ ID NO: 194026 - protein, 9 aa, Artificial Sequence
  Description of Artificial Sequence: Synthetic peptide
  Seed: QVMSLHNLV (TYRP2_HUMAN)
QQMSLHNLI

SEQ ID NO: 194027 - protein, 9 aa, Artificial Sequence
  Description of Artificial Sequence: Synthetic peptide
  Seed: RFNPPADAW (TYRP2_HUMAN)
RYNPPADAF

SEQ ID NO: 194028 - protein, 10 aa, Artificial Sequence
  Description of Artificial Sequence: Synthetic peptide
  Seed: RELWPRKFFH (TYRP2_HUMAN)
RKLWPRKFFK

SEQ ID NO: 194029 - protein, 10 aa, Artificial Sequence
  Description of Artificial Sequence: Synthetic peptide
  Seed: HSFLNGTNAL (TYRP2_HUMAN)
HLFLNGTNAM

SEQ ID NO: 194030 - protein, 9 aa, Artificial Sequence
  Description of Artificial Sequence: Synthetic peptide
  Seed: TSDQLGYSY (TYRP2_HUMAN)
TYDQLGYSY

SEQ ID NO: 194031 - protein, 11 aa, Artificial Sequence
  Description of Artificial Sequence: Synthetic peptide
  Seed: VCDSLDDYNHL (TYRP2_HUMAN)
VMDSLDDYNHL

SEQ ID NO: 194032 - protein, 10 aa, Artificial Sequence
  Description of Artificial Sequence: Synthetic peptide
  Seed: ETPGWPTTLL (TYRP2_HUMAN)
EVPGWPTTLW

SEQ ID NO: 194033 - protein, 9 aa, Artificial Sequence
  Description of Artificial Sequence: Synthetic peptide
  Seed: RFNPPADAW (TYRP2_HUMAN)
RTNPPADAW

SEQ ID NO: 194034 - protein, 9 aa, Artificial Sequence
  Description of Artificial Sequence: Synthetic peptide
  Seed: LIGNESFAL (TYRP2_HUMAN)
LMGNESFAL

SEQ ID NO: 194035 - protein, 9 aa, Artificial Sequence
  Description of Artificial Sequence: Synthetic peptide
  Seed: VIRQNIHSL (TYRP2_HUMAN)
VWRQNIHSL

SEQ ID NO: 194036 - protein, 9 aa, Artificial Sequence
  Description of Artificial Sequence: Synthetic peptide
  Seed: FANCSVYDF (TYRP2_HUMAN)
FYNCSVYDL

SEQ ID NO: 194037 - protein, 11 aa, Artificial Sequence
  Description of Artificial Sequence: Synthetic peptide
  Seed: RNSRFSSWETV (TYRP2_HUMAN)
RWSRFSSWETV

SEQ ID NO: 194038 - protein, 10 aa, Artificial Sequence
  Description of Artificial Sequence: Synthetic peptide
  Seed: MSLHNLVHSF (TYRP2_HUMAN)
MALHNLVHSW

SEQ ID NO: 194039 - protein, 9 aa, Artificial Sequence
  Description of Artificial Sequence: Synthetic peptide
  Seed: YSYAIDLPV (TYRP2_HUMAN)
YPYAIDLPG

SEQ ID NO: 194040 - protein, 8 aa, Artificial Sequence
  Description of Artificial Sequence: Synthetic peptide
  Seed: LDDYNHLV (TYRP2_HUMAN)
LSDYNHLL

SEQ ID NO: 194041 - protein, 9 aa, Artificial Sequence
  Description of Artificial Sequence: Synthetic peptide
  Seed: RLRKGYTPL (TYRP2_HUMAN)
RYRKGYTPP

SEQ ID NO: 194042 - protein, 10 aa, Artificial Sequence
  Description of Artificial Sequence: Synthetic peptide
  Seed: TLCNGTYEGL (TYRP2_HUMAN)
TQCNGTYEGW

SEQ ID NO: 194043 - protein, 10 aa, Artificial Sequence
  Description of Artificial Sequence: Synthetic peptide
  Seed: KILPGAQGQF (TYRP2_HUMAN)
KMLPGAQGQR

SEQ ID NO: 194044 - protein, 9 aa, Artificial Sequence
  Description of Artificial Sequence: Synthetic peptide
  Seed: FPPVTNEEL (TYRP2_HUMAN)
FGPVTNEEL

SEQ ID NO: 194045 - protein, 9 aa, Artificial Sequence
  Description of Artificial Sequence: Synthetic peptide
  Seed: ILPGAQGQF (TYRP2_HUMAN)
IWPGAQGQW

SEQ ID NO: 194046 - protein, 9 aa, Artificial Sequence
  Description of Artificial Sequence: Synthetic peptide
  Seed: NRMYNMVPF (TYRP2_HUMAN)
NKMYNMVPY

SEQ ID NO: 194047 - protein, 11 aa, Artificial Sequence
  Description of Artificial Sequence: Synthetic peptide
  Seed: MYNMVPFFPPV (TYRP2_HUMAN)
MWNMVPFFPPL

SEQ ID NO: 194048 - protein, 9 aa, Artificial Sequence
  Description of Artificial Sequence: Synthetic peptide
  Seed: TSDQLGYSY (TYRP2_HUMAN)
TCDQLGYSM

SEQ ID NO: 194049 - protein, 9 aa, Artificial Sequence
  Description of Artificial Sequence: Synthetic peptide
  Seed: GWPTTLLVV (TYRP2_HUMAN)
GYPTTLLVL

SEQ ID NO: 194050 - protein, 9 aa, Artificial Sequence
  Description of Artificial Sequence: Synthetic peptide
  Seed: LHSFTDAIF (TYRP2_HUMAN)
LKSFTDAIY

SEQ ID NO: 194051 - protein, 10 aa, Artificial Sequence
  Description of Artificial Sequence: Synthetic peptide
  Seed: MSPLWWGFLL (TYRP2_HUMAN)
MWPLWWGFLY

SEQ ID NO: 194052 - protein, 11 aa, Artificial Sequence
  Description of Artificial Sequence: Synthetic peptide
  Seed: TQPQFANCSVY (TYRP2_HUMAN)
TCPQFANCSVF

SEQ ID NO: 194053 - protein, 9 aa, Artificial Sequence
  Description of Artificial Sequence: Synthetic peptide
  Seed: RLRKGYTPL (TYRP2_HUMAN)
RSRKGYTPI

SEQ ID NO: 194054 - protein, 9 aa, Artificial Sequence
  Description of Artificial Sequence: Synthetic peptide
  Seed: DQLGYSYAI (TYRP2_HUMAN)
DLLGYSYAV

SEQ ID NO: 194055 - protein, 8 aa, Artificial Sequence
  Description of Artificial Sequence: Synthetic peptide
  Seed: RMYNMVPF (TYRP2_HUMAN)
RFYNMVPF

SEQ ID NO: 194056 - protein, 9 aa, Artificial Sequence
  Description of Artificial Sequence: Synthetic peptide
  Seed: AANDPIFVV (TYRP2_HUMAN)
ATNDPIFVY

SEQ ID NO: 194057 - protein, 10 aa, Artificial Sequence
  Description of Artificial Sequence: Synthetic peptide
  Seed: RNQMGRNSMK (TYRP2_HUMAN)
RFQMGRNSMK

SEQ ID NO: 194058 - protein, 10 aa, Artificial Sequence
  Description of Artificial Sequence: Synthetic peptide
  Seed: LVVMGTLVAL (TYRP2_HUMAN)
LPVMGTLVAL

SEQ ID NO: 194059 - protein, 10 aa, Artificial Sequence
  Description of Artificial Sequence: Synthetic peptide
  Seed: RRLRKGYTPL (TYRP2_HUMAN)
RILRKGYTPY

SEQ ID NO: 194060 - protein, 9 aa, Artificial Sequence
  Description of Artificial Sequence: Synthetic peptide
  Seed: SVYDFFVWL (TYRP2_HUMAN)
STYDFFVWI

SEQ ID NO: 194061 - protein, 9 aa, Artificial Sequence
  Description of Artificial Sequence: Synthetic peptide
  Seed: IFDEWMKRF (TYRP2_HUMAN)
ILDEWMKRI

SEQ ID NO: 194062 - protein, 10 aa, Artificial Sequence
  Description of Artificial Sequence: Synthetic peptide
  Seed: LTSDQLGYSY (TYRP2_HUMAN)
LYSDQLGYSY

SEQ ID NO: 194063 - protein, 9 aa, Artificial Sequence
  Description of Artificial Sequence: Synthetic peptide
  Seed: STFSFRNAL (TYRP2_HUMAN)
SYFSFRNAW

SEQ ID NO: 194064 - protein, 9 aa, Artificial Sequence
  Description of Artificial Sequence: Synthetic peptide
  Seed: AFLQYRRLR (TYRP2_HUMAN)
ALLQYRRLR

SEQ ID NO: 194065 - protein, 10 aa, Artificial Sequence
  Description of Artificial Sequence: Synthetic peptide
  Seed: ELAPIGHNRM (TYRP2_HUMAN)
ETAPIGHNRS

SEQ ID NO: 194066 - protein, 9 aa, Artificial Sequence
  Description of Artificial Sequence: Synthetic peptide
  Seed: FLNGTNALP (TYRP2_HUMAN)
FLNGTNALM

SEQ ID NO: 194067 - protein, 10 aa, Artificial Sequence
  Description of Artificial Sequence: Synthetic peptide
  Seed: FTDAIFDEWM (TYRP2_HUMAN)
FVDAIFDEWL

SEQ ID NO: 194068 - protein, 8 aa, Artificial Sequence
  Description of Artificial Sequence: Synthetic peptide
  Seed: RPDDPTLI (TYRP2_HUMAN)
RFDDPTLF

SEQ ID NO: 194069 - protein, 9 aa, Artificial Sequence
  Description of Artificial Sequence: Synthetic peptide
  Seed: VMSLHNLVH (TYRP2_HUMAN)
VISLHNLVY

SEQ ID NO: 194070 - protein, 10 aa, Artificial Sequence
  Description of Artificial Sequence: Synthetic peptide
  Seed: MTVDSLVNKE (TYRP2_HUMAN)
MMVDSLVNKR

SEQ ID NO: 194071 - protein, 10 aa, Artificial Sequence
  Description of Artificial Sequence: Synthetic peptide
  Seed: HNRMYNMVPF (TYRP2_HUMAN)
HLRMYNMVPF

SEQ ID NO: 194072 - protein, 10 aa, Artificial Sequence
  Description of Artificial Sequence: Synthetic peptide
  Seed: FLLSCLGCKI (TYRP2_HUMAN)
FCLSCLGCKL

SEQ ID NO: 194073 - protein, 10 aa, Artificial Sequence
  Description of Artificial Sequence: Synthetic peptide
  Seed: RPWSGPYILR (TYRP2_HUMAN)
RGWSGPYILR

SEQ ID NO: 194074 - protein, 9 aa, Artificial Sequence
  Description of Artificial Sequence: Synthetic peptide
  Seed: RNQMGRNSM (TYRP2_HUMAN)
RIQMGRNSF

SEQ ID NO: 194075 - protein, 10 aa, Artificial Sequence
  Description of Artificial Sequence: Synthetic peptide
  Seed: TDAIFDEWMK (TYRP2_HUMAN)
TAAIFDEWMK

SEQ ID NO: 194076 - protein, 9 aa, Artificial Sequence
  Description of Artificial Sequence: Synthetic peptide
  Seed: TLVALVGLF (TYRP2_HUMAN)
TTVALVGLY

SEQ ID NO: 194077 - protein, 9 aa, Artificial Sequence
  Description of Artificial Sequence: Synthetic peptide
  Seed: ANCSVYDFF (TYRP2_HUMAN)
AACSVYDFF

SEQ ID NO: 194078 - protein, 9 aa, Artificial Sequence
  Description of Artificial Sequence: Synthetic peptide
  Seed: FPPVTNEEL (TYRP2_HUMAN)
FQPVTNEEY

SEQ ID NO: 194079 - protein, 10 aa, Artificial Sequence
  Description of Artificial Sequence: Synthetic peptide
  Seed: FPPVTNEELF (TYRP2_HUMAN)
FEPVTNEELY

SEQ ID NO: 194080 - protein, 10 aa, Artificial Sequence
  Description of Artificial Sequence: Synthetic peptide
  Seed: TLDSQVMSLH (TYRP2_HUMAN)
TADSQVMSLY

SEQ ID NO: 194081 - protein, 9 aa, Artificial Sequence
  Description of Artificial Sequence: Synthetic peptide
  Seed: SLHNLVHSF (TYRP2_HUMAN)
SVHNLVHSV

SEQ ID NO: 194082 - protein, 10 aa, Artificial Sequence
  Description of Artificial Sequence: Synthetic peptide
  Seed: RRLRKGYTPL (TYRP2_HUMAN)
RYLRKGYTPY

SEQ ID NO: 194083 - protein, 10 aa, Artificial Sequence
  Description of Artificial Sequence: Synthetic peptide
  Seed: RELWPRKFFH (TYRP2_HUMAN)
RYLWPRKFFR

SEQ ID NO: 194084 - protein, 10 aa, Artificial Sequence
  Description of Artificial Sequence: Synthetic peptide
  Seed: YHLLCLERDL (TYRP2_HUMAN)
YLLLCLERDI

SEQ ID NO: 194085 - protein, 10 aa, Artificial Sequence
  Description of Artificial Sequence: Synthetic peptide
  Seed: GQFPRVCMTV (TYRP2_HUMAN)
GVFPRVCMTI

SEQ ID NO: 194086 - protein, 9 aa, Artificial Sequence
  Description of Artificial Sequence: Synthetic peptide
  Seed: GTLVALVGL (TYRP2_HUMAN)
GSLVALVGW

SEQ ID NO: 194087 - protein, 10 aa, Artificial Sequence
  Description of Artificial Sequence: Synthetic peptide
  Seed: YNMVPFFPPV (TYRP2_HUMAN)
YDMVPFFPPM

SEQ ID NO: 194088 - protein, 9 aa, Artificial Sequence
  Description of Artificial Sequence: Synthetic peptide
  Seed: NMVPFFPPV (TYRP2_HUMAN)
NLVPFFPPI

SEQ ID NO: 194089 - protein, 10 aa, Artificial Sequence
  Description of Artificial Sequence: Synthetic peptide
  Seed: REQFLGALDL (TYRP2_HUMAN)
RFQFLGALDY

SEQ ID NO: 194090 - protein, 9 aa, Artificial Sequence
  Description of Artificial Sequence: Synthetic peptide
  Seed: MTVDSLVNK (TYRP2_HUMAN)
MSVDSLVNF

SEQ ID NO: 194091 - protein, 9 aa, Artificial Sequence
  Description of Artificial Sequence: Synthetic peptide
  Seed: STFSFRNAL (TYRP2_HUMAN)
SMFSFRNAK

SEQ ID NO: 194092 - protein, 10 aa, Artificial Sequence
  Description of Artificial Sequence: Synthetic peptide
  Seed: NGTYEGLLRR (TYRP2_HUMAN)
NTTYEGLLRR

SEQ ID NO: 194093 - protein, 10 aa, Artificial Sequence
  Description of Artificial Sequence: Synthetic peptide
  Seed: YDFFVWLHYY (TYRP2_HUMAN)
YPFFVWLHYF

SEQ ID NO: 194094 - protein, 9 aa, Artificial Sequence
  Description of Artificial Sequence: Synthetic peptide
  Seed: ALVGLFVLL (TYRP2_HUMAN)
AVVGLFVLF

SEQ ID NO: 194095 - protein, 10 aa, Artificial Sequence
  Description of Artificial Sequence: Synthetic peptide
  Seed: AIFDEWMKRF (TYRP2_HUMAN)
AMFDEWMKRR

SEQ ID NO: 194096 - protein, 9 aa, Artificial Sequence
  Description of Artificial Sequence: Synthetic peptide
  Seed: VVMGTLVAL (TYRP2_HUMAN)
VHMGTLVAY

SEQ ID NO: 194097 - protein, 9 aa, Artificial Sequence
  Description of Artificial Sequence: Synthetic peptide
  Seed: TSDQLGYSY (TYRP2_HUMAN)
TSDQLGYSM

SEQ ID NO: 194098 - protein, 9 aa, Artificial Sequence
  Description of Artificial Sequence: Synthetic peptide
  Seed: FQNSTFSFR (TYRP2_HUMAN)
FFNSTFSFY

SEQ ID NO: 194099 - protein, 9 aa, Artificial Sequence
  Description of Artificial Sequence: Synthetic peptide
  Seed: ANDPIFVVL (TYRP2_HUMAN)
ADDPIFVVL

SEQ ID NO: 194100 - protein, 10 aa, Artificial Sequence
  Description of Artificial Sequence: Synthetic peptide
  Seed: GTLDSQVMSL (TYRP2_HUMAN)
GQLDSQVMSV

SEQ ID NO: 194101 - protein, 9 aa, Artificial Sequence
  Description of Artificial Sequence: Synthetic peptide
  Seed: APIGHNRMY (TYRP2_HUMAN)
APIGHNRML

SEQ ID NO: 194102 - protein, 11 aa, Artificial Sequence
  Description of Artificial Sequence: Synthetic peptide
  Seed: RNSRFSSWETV (TYRP2_HUMAN)
RCSRFSSWETV

SEQ ID NO: 194103 - protein, 9 aa, Artificial Sequence
  Description of Artificial Sequence: Synthetic peptide
  Seed: FFQNSTFSF (TYRP2_HUMAN)
FAQNSTFSF

SEQ ID NO: 194104 - protein, 11 aa, Artificial Sequence
  Description of Artificial Sequence: Synthetic peptide
  Seed: FFPPVTNEELF (TYRP2_HUMAN)
FNPPVTNEELW

SEQ ID NO: 194105 - protein, 9 aa, Artificial Sequence
  Description of Artificial Sequence: Synthetic peptide
  Seed: RLRKGYTPL (TYRP2_HUMAN)
RGRKGYTPV

SEQ ID NO: 194106 - protein, 10 aa, Artificial Sequence
  Description of Artificial Sequence: Synthetic peptide
  Seed: CCPRLGAESA (TYRP2_HUMAN)
CGPRLGAESM

SEQ ID NO: 194107 - protein, 10 aa, Artificial Sequence
  Description of Artificial Sequence: Synthetic peptide
  Seed: FPPVTNEELF (TYRP2_HUMAN)
FWPVTNEELY

SEQ ID NO: 194108 - protein, 10 aa, Artificial Sequence
  Description of Artificial Sequence: Synthetic peptide
  Seed: VVMGTLVALV (TYRP2_HUMAN)
VLMGTLVALN

SEQ ID NO: 194109 - protein, 10 aa, Artificial Sequence
  Description of Artificial Sequence: Synthetic peptide
  Seed: HNRMYNMVPF (TYRP2_HUMAN)
HMRMYNMVPM

SEQ ID NO: 194110 - protein, 9 aa, Artificial Sequence
  Description of Artificial Sequence: Synthetic peptide
  Seed: YSYAIDLPV (TYRP2_HUMAN)
YKYAIDLPA

SEQ ID NO: 194111 - protein, 9 aa, Artificial Sequence
  Description of Artificial Sequence: Synthetic peptide
  Seed: YAIDLPVSV (TYRP2_HUMAN)
YGIDLPVSM

SEQ ID NO: 194112 - protein, 9 aa, Artificial Sequence
  Description of Artificial Sequence: Synthetic peptide
  Seed: FPPVTNEEL (TYRP2_HUMAN)
FMPVTNEEM

SEQ ID NO: 194113 - protein, 9 aa, Artificial Sequence
  Description of Artificial Sequence: Synthetic peptide
  Seed: FPPVTNEEL (TYRP2_HUMAN)
FWPVTNEEY

SEQ ID NO: 194114 - protein, 10 aa, Artificial Sequence
  Description of Artificial Sequence: Synthetic peptide
  Seed: LHYYSVRDTL (TYRP2_HUMAN)
LRYYSVRDTL

SEQ ID NO: 194115 - protein, 9 aa, Artificial Sequence
  Description of Artificial Sequence: Synthetic peptide
  Seed: YAIDLPVSV (TYRP2_HUMAN)
YLIDLPVSM

SEQ ID NO: 194116 - protein, 9 aa, Artificial Sequence
  Description of Artificial Sequence: Synthetic peptide
  Seed: FQNSTFSFR (TYRP2_HUMAN)
FWNSTFSFY

SEQ ID NO: 194117 - protein, 9 aa, Artificial Sequence
  Description of Artificial Sequence: Synthetic peptide
  Seed: MSPLWWGFL (TYRP2_HUMAN)
MFPLWWGFF

SEQ ID NO: 194118 - protein, 10 aa, Artificial Sequence
  Description of Artificial Sequence: Synthetic peptide
  Seed: RELWPRKFFH (TYRP2_HUMAN)
RPLWPRKFFR

SEQ ID NO: 194119 - protein, 11 aa, Artificial Sequence
  Description of Artificial Sequence: Synthetic peptide
  Seed: YNMVPFFPPVT (TYRP2_HUMAN)
YQMVPFFPPVI

SEQ ID NO: 194120 - protein, 9 aa, Artificial Sequence
  Description of Artificial Sequence: Synthetic peptide
  Seed: YSVRDTLLG (TYRP2_HUMAN)
YSVRDTLLM

SEQ ID NO: 194121 - protein, 9 aa, Artificial Sequence
  Description of Artificial Sequence: Synthetic peptide
  Seed: GNESFALPY (TYRP2_HUMAN)
GVESFALPY

SEQ ID NO: 194122 - protein, 10 aa, Artificial Sequence
  Description of Artificial Sequence: Synthetic peptide
  Seed: SVYDFFVWLH (TYRP2_HUMAN)
SGYDFFVWLY

SEQ ID NO: 194123 - protein, 9 aa, Artificial Sequence
  Description of Artificial Sequence: Synthetic peptide
  Seed: ERKKPPVIR (TYRP2_HUMAN)
EMKKPPVIR

SEQ ID NO: 194124 - protein, 9 aa, Artificial Sequence
  Description of Artificial Sequence: Synthetic peptide
  Seed: GTYEGLLRR (TYRP2_HUMAN)
GGYEGLLRK

SEQ ID NO: 194125 - protein, 9 aa, Artificial Sequence
  Description of Artificial Sequence: Synthetic peptide
  Seed: YDFFVWLHY (TYRP2_HUMAN)
YMFFVWLHM

SEQ ID NO: 194126 - protein, 9 aa, Artificial Sequence
  Description of Artificial Sequence: Synthetic peptide
  Seed: FTDAIFDEW (TYRP2_HUMAN)
FLDAIFDEY

SEQ ID NO: 194127 - protein, 9 aa, Artificial Sequence
  Description of Artificial Sequence: Synthetic peptide
  Seed: QFPRVCMTV (TYRP2_HUMAN)
QQPRVCMTF

SEQ ID NO: 194128 - protein, 9 aa, Artificial Sequence
  Description of Artificial Sequence: Synthetic peptide
  Seed: RTCKCTGNF (TYRP2_HUMAN)
RTCKCTGNK

SEQ ID NO: 194129 - protein, 9 aa, Artificial Sequence
  Description of Artificial Sequence: Synthetic peptide
  Seed: RKFFHRTCK (TYRP2_HUMAN)
RWFFHRTCK

SEQ ID NO: 194130 - protein, 10 aa, Artificial Sequence
  Description of Artificial Sequence: Synthetic peptide
  Seed: LVVMGTLVAL (TYRP2_HUMAN)
LMVMGTLVAF

SEQ ID NO: 194131 - protein, 9 aa, Artificial Sequence
  Description of Artificial Sequence: Synthetic peptide
  Seed: DFFVWLHYY (TYRP2_HUMAN)
DLFVWLHYY

SEQ ID NO: 194132 - protein, 9 aa, Artificial Sequence
  Description of Artificial Sequence: Synthetic peptide
  Seed: VGLFVLLAF (TYRP2_HUMAN)
VMLFVLLAF

SEQ ID NO: 194133 - protein, 9 aa, Artificial Sequence
  Description of Artificial Sequence: Synthetic peptide
  Seed: GTNALPHSA (TYRP2_HUMAN)
GVNALPHSL

SEQ ID NO: 194134 - protein, 11 aa, Artificial Sequence
  Description of Artificial Sequence: Synthetic peptide
  Seed: RNSRFSSWETV (TYRP2_HUMAN)
RHSRFSSWETL

SEQ ID NO: 194135 - protein, 10 aa, Artificial Sequence
  Description of Artificial Sequence: Synthetic peptide
  Seed: YAIDLPVSVE (TYRP2_HUMAN)
YVIDLPVSVV

SEQ ID NO: 194136 - protein, 9 aa, Artificial Sequence
  Description of Artificial Sequence: Synthetic peptide
  Seed: LVTLCNGTY (TYRP2_HUMAN)
LTTLCNGTF

SEQ ID NO: 194137 - protein, 10 aa, Artificial Sequence
  Description of Artificial Sequence: Synthetic peptide
  Seed: HRYHLLCLER (TYRP2_HUMAN)
HYYHLLCLEK

SEQ ID NO: 194138 - protein, 10 aa, Artificial Sequence
  Description of Artificial Sequence: Synthetic peptide
  Seed: TQPQFANCSV (TYRP2_HUMAN)
TAPQFANCSL

SEQ ID NO: 194139 - protein, 10 aa, Artificial Sequence
  Description of Artificial Sequence: Synthetic peptide
  Seed: TLCNGTYEGL (TYRP2_HUMAN)
TQCNGTYEGF

SEQ ID NO: 194140 - protein, 9 aa, Artificial Sequence
  Description of Artificial Sequence: Synthetic peptide
  Seed: VLHSFTDAI (TYRP2_HUMAN)
VEHSFTDAM

SEQ ID NO: 194141 - protein, 9 aa, Artificial Sequence
  Description of Artificial Sequence: Synthetic peptide
  Seed: RTCKCTGNF (TYRP2_HUMAN)
RSCKCTGNF

SEQ ID NO: 194142 - protein, 10 aa, Artificial Sequence
  Description of Artificial Sequence: Synthetic peptide
  Seed: SDQLGYSYAI (TYRP2_HUMAN)
SVQLGYSYAM

SEQ ID NO: 194143 - protein, 10 aa, Artificial Sequence
  Description of Artificial Sequence: Synthetic peptide
  Seed: LVVMGTLVAL (TYRP2_HUMAN)
LNVMGTLVAY

SEQ ID NO: 194144 - protein, 10 aa, Artificial Sequence
  Description of Artificial Sequence: Synthetic peptide
  Seed: MSPLWWGFLL (TYRP2_HUMAN)
MPPLWWGFLA

SEQ ID NO: 194145 - protein, 10 aa, Artificial Sequence
  Description of Artificial Sequence: Synthetic peptide
  Seed: FVWLHYYSVR (TYRP2_HUMAN)
FMWLHYYSVH

SEQ ID NO: 194146 - protein, 9 aa, Artificial Sequence
  Description of Artificial Sequence: Synthetic peptide
  Seed: RLRKGYTPL (TYRP2_HUMAN)
RVRKGYTPF

SEQ ID NO: 194147 - protein, 10 aa, Artificial Sequence
  Description of Artificial Sequence: Synthetic peptide
  Seed: NGTYEGLLRR (TYRP2_HUMAN)
NATYEGLLRK

SEQ ID NO: 194148 - protein, 10 aa, Artificial Sequence
  Description of Artificial Sequence: Synthetic peptide
  Seed: VGLFVLLAFL (TYRP2_HUMAN)
VPLFVLLAFV

SEQ ID NO: 194149 - protein, 9 aa, Artificial Sequence
  Description of Artificial Sequence: Synthetic peptide
  Seed: RRLRKGYTP (TYRP2_HUMAN)
RQLRKGYTI

SEQ ID NO: 194150 - protein, 9 aa, Artificial Sequence
  Description of Artificial Sequence: Synthetic peptide
  Seed: VIRQNIHSL (TYRP2_HUMAN)
VYRQNIHSI

SEQ ID NO: 194151 - protein, 9 aa, Artificial Sequence
  Description of Artificial Sequence: Synthetic peptide
  Seed: PADAWPQEL (TYRP2_HUMAN)
PIDAWPQEM

SEQ ID NO: 194152 - protein, 9 aa, Artificial Sequence
  Description of Artificial Sequence: Synthetic peptide
  Seed: NMVPFFPPV (TYRP2_HUMAN)
NVVPFFPPF

SEQ ID NO: 194153 - protein, 10 aa, Artificial Sequence
  Description of Artificial Sequence: Synthetic peptide
  Seed: FANCSVYDFF (TYRP2_HUMAN)
FGNCSVYDFW

SEQ ID NO: 194154 - protein, 9 aa, Artificial Sequence
  Description of Artificial Sequence: Synthetic peptide
  Seed: AANDPIFVV (TYRP2_HUMAN)
AINDPIFVL

SEQ ID NO: 194155 - protein, 10 aa, Artificial Sequence
  Description of Artificial Sequence: Synthetic peptide
  Seed: RELWPRKFFH (TYRP2_HUMAN)
RTLWPRKFFH

SEQ ID NO: 194156 - protein, 9 aa, Artificial Sequence
  Description of Artificial Sequence: Synthetic peptide
  Seed: STFSFRNAL (TYRP2_HUMAN)
SIFSFRNAK

SEQ ID NO: 194157 - protein, 11 aa, Artificial Sequence
  Description of Artificial Sequence: Synthetic peptide
  Seed: ALPYWNFATGR (TYRP2_HUMAN)
AYPYWNFATGR

SEQ ID NO: 194158 - protein, 9 aa, Artificial Sequence
  Description of Artificial Sequence: Synthetic peptide
  Seed: RNSMKLPTL (TYRP2_HUMAN)
RRSMKLPTY

SEQ ID NO: 194159 - protein, 9 aa, Artificial Sequence
  Description of Artificial Sequence: Synthetic peptide
  Seed: LVHSFLNGT (TYRP2_HUMAN)
LIHSFLNGV

SEQ ID NO: 194160 - protein, 10 aa, Artificial Sequence
  Description of Artificial Sequence: Synthetic peptide
  Seed: RRLRKGYTPL (TYRP2_HUMAN)
RKLRKGYTPK

SEQ ID NO: 194161 - protein, 9 aa, Artificial Sequence
  Description of Artificial Sequence: Synthetic peptide
  Seed: MTVDSLVNK (TYRP2_HUMAN)
MMVDSLVNV

SEQ ID NO: 194162 - protein, 9 aa, Artificial Sequence
  Description of Artificial Sequence: Synthetic peptide
  Seed: TLLGPGRPY (TYRP2_HUMAN)
TFLGPGRPI

SEQ ID NO: 194163 - protein, 9 aa, Artificial Sequence
  Description of Artificial Sequence: Synthetic peptide
  Seed: DFFVWLHYY (TYRP2_HUMAN)
DYFVWLHYK

SEQ ID NO: 194164 - protein, 9 aa, Artificial Sequence
  Description of Artificial Sequence: Synthetic peptide
  Seed: ISRNSRFSS (TYRP2_HUMAN)
ISRNSRFSA

SEQ ID NO: 194165 - protein, 11 aa, Artificial Sequence
  Description of Artificial Sequence: Synthetic peptide
  Seed: LLAFLQYRRLR (TYRP2_HUMAN)
LVAFLQYRRLR

SEQ ID NO: 194166 - protein, 10 aa, Artificial Sequence
  Description of Artificial Sequence: Synthetic peptide
  Seed: VMGTLVALVG (TYRP2_HUMAN)
VLGTLVALVV

SEQ ID NO: 194167 - protein, 10 aa, Artificial Sequence
  Description of Artificial Sequence: Synthetic peptide
  Seed: YNMVPFFPPV (TYRP2_HUMAN)
YPMVPFFPPT

SEQ ID NO: 194168 - protein, 9 aa, Artificial Sequence
  Description of Artificial Sequence: Synthetic peptide
  Seed: ISRNSRFSS (TYRP2_HUMAN)
IVRNSRFSL

SEQ ID NO: 194169 - protein, 9 aa, Artificial Sequence
  Description of Artificial Sequence: Synthetic peptide
  Seed: RRLRKGYTP (TYRP2_HUMAN)
RQLRKGYTV

SEQ ID NO: 194170 - protein, 11 aa, Artificial Sequence
  Description of Artificial Sequence: Synthetic peptide
  Seed: RADTRPWSGPY (TYRP2_HUMAN)
RDDTRPWSGPK

SEQ ID NO: 194171 - protein, 9 aa, Artificial Sequence
  Description of Artificial Sequence: Synthetic peptide
  Seed: FTDAIFDEW (TYRP2_HUMAN)
FSDAIFDEW

SEQ ID NO: 194172 - protein, 9 aa, Artificial Sequence
  Description of Artificial Sequence: Synthetic peptide
  Seed: YSYAIDLPV (TYRP2_HUMAN)
YEYAIDLPY

SEQ ID NO: 194173 - protein, 10 aa, Artificial Sequence
  Description of Artificial Sequence: Synthetic peptide
  Seed: RLIGNESFAL (TYRP2_HUMAN)
RIIGNESFAY

SEQ ID NO: 194174 - protein, 10 aa, Artificial Sequence
  Description of Artificial Sequence: Synthetic peptide
  Seed: MGRNSMKLPT (TYRP2_HUMAN)
MTRNSMKLPI

SEQ ID NO: 194175 - protein, 10 aa, Artificial Sequence
  Description of Artificial Sequence: Synthetic peptide
  Seed: CSVYDFFVWL (TYRP2_HUMAN)
CTVYDFFVWW

SEQ ID NO: 194176 - protein, 9 aa, Artificial Sequence
  Description of Artificial Sequence: Synthetic peptide
  Seed: HSAANDPIF (TYRP2_HUMAN)
HMAANDPIF

SEQ ID NO: 194177 - protein, 10 aa, Artificial Sequence
  Description of Artificial Sequence: Synthetic peptide
  Seed: VLLAFLQYRR (TYRP2_HUMAN)
VVLAFLQYRR

SEQ ID NO: 194178 - protein, 10 aa, Artificial Sequence
  Description of Artificial Sequence: Synthetic peptide
  Seed: VVMGTLVALV (TYRP2_HUMAN)
VMMGTLVALM

SEQ ID NO: 194179 - protein, 9 aa, Artificial Sequence
  Description of Artificial Sequence: Synthetic peptide
  Seed: WHRYHLLCL (TYRP2_HUMAN)
WMRYHLLCY

SEQ ID NO: 194180 - protein, 10 aa, Artificial Sequence
  Description of Artificial Sequence: Synthetic peptide
  Seed: LISRNSRFSS (TYRP2_HUMAN)
LMSRNSRFSK

SEQ ID NO: 194181 - protein, 10 aa, Artificial Sequence
  Description of Artificial Sequence: Synthetic peptide
  Seed: YNMVPFFPPV (TYRP2_HUMAN)
YDMVPFFPPL

SEQ ID NO: 194182 - protein, 9 aa, Artificial Sequence
  Description of Artificial Sequence: Synthetic peptide
  Seed: AANDPIFVV (TYRP2_HUMAN)
ATNDPIFVI

SEQ ID NO: 194183 - protein, 9 aa, Artificial Sequence
  Description of Artificial Sequence: Synthetic peptide
  Seed: FPPVTNEEL (TYRP2_HUMAN)
FLPVTNEEL

SEQ ID NO: 194184 - protein, 10 aa, Artificial Sequence
  Description of Artificial Sequence: Synthetic peptide
  Seed: QGPAFVTWHR (TYRP2_HUMAN)
QMPAFVTWHK

SEQ ID NO: 194185 - protein, 9 aa, Artificial Sequence
  Description of Artificial Sequence: Synthetic peptide
  Seed: MSPLWWGFL (TYRP2_HUMAN)
MYPLWWGFV

SEQ ID NO: 194186 - protein, 9 aa, Artificial Sequence
  Description of Artificial Sequence: Synthetic peptide
  Seed: GTNALPHSA (TYRP2_HUMAN)
GMNALPHSV

SEQ ID NO: 194187 - protein, 10 aa, Artificial Sequence
  Description of Artificial Sequence: Synthetic peptide
  Seed: SVYDFFVWLH (TYRP2_HUMAN)
SAYDFFVWLK

SEQ ID NO: 194188 - protein, 9 aa, Artificial Sequence
  Description of Artificial Sequence: Synthetic peptide
  Seed: YSYAIDLPV (TYRP2_HUMAN)
YTYAIDLPW

SEQ ID NO: 194189 - protein, 9 aa, Artificial Sequence
  Description of Artificial Sequence: Synthetic peptide
  Seed: SLDDYNHLV (TYRP2_HUMAN)
SFDDYNHLC

SEQ ID NO: 194190 - protein, 10 aa, Artificial Sequence
  Description of Artificial Sequence: Synthetic peptide
  Seed: FPPVTNEELF (TYRP2_HUMAN)
FSPVTNEELF

SEQ ID NO: 194191 - protein, 10 aa, Artificial Sequence
  Description of Artificial Sequence: Synthetic peptide
  Seed: YDFFVWLHYY (TYRP2_HUMAN)
YWFFVWLHYY

SEQ ID NO: 194192 - protein, 10 aa, Artificial Sequence
  Description of Artificial Sequence: Synthetic peptide
  Seed: IDFSHQGPAF (TYRP2_HUMAN)
IPFSHQGPAY

SEQ ID NO: 194193 - protein, 9 aa, Artificial Sequence
  Description of Artificial Sequence: Synthetic peptide
  Seed: NALEGFDKA (TYRP2_HUMAN)
NQLEGFDKL

SEQ ID NO: 194194 - protein, 11 aa, Artificial Sequence
  Description of Artificial Sequence: Synthetic peptide
  Seed: FQNSTFSFRNA (TYRP2_HUMAN)
FLNSTFSFRNI

SEQ ID NO: 194195 - protein, 9 aa, Artificial Sequence
  Description of Artificial Sequence: Synthetic peptide
  Seed: RDCLSLQKF (TYRP2_HUMAN)
RQCLSLQKL

SEQ ID NO: 194196 - protein, 9 aa, Artificial Sequence
  Description of Artificial Sequence: Synthetic peptide
  Seed: SDQLGYSYA (TYRP2_HUMAN)
SEQLGYSYP

SEQ ID NO: 194197 - protein, 9 aa, Artificial Sequence
  Description of Artificial Sequence: Synthetic peptide
  Seed: SHQGPAFVT (TYRP2_HUMAN)
SHQGPAFVV

SEQ ID NO: 194198 - protein, 10 aa, Artificial Sequence
  Description of Artificial Sequence: Synthetic peptide
  Seed: NSTFSFRNAL (TYRP2_HUMAN)
NWTFSFRNAI

SEQ ID NO: 194199 - protein, 10 aa, Artificial Sequence
  Description of Artificial Sequence: Synthetic peptide
  Seed: FSFRNALEGF (TYRP2_HUMAN)
FTFRNALEGL

SEQ ID NO: 194200 - protein, 11 aa, Artificial Sequence
  Description of Artificial Sequence: Synthetic peptide
  Seed: RADTRPWSGPY (TYRP2_HUMAN)
REDTRPWSGPW

SEQ ID NO: 194201 - protein, 11 aa, Artificial Sequence
  Description of Artificial Sequence: Synthetic peptide
  Seed: YTPLMETHLSS (TYRP2_HUMAN)
YYPLMETHLSV

SEQ ID NO: 194202 - protein, 11 aa, Artificial Sequence
  Description of Artificial Sequence: Synthetic peptide
  Seed: FVVLHSFTDAI (TYRP2_HUMAN)
FDVLHSFTDAL

SEQ ID NO: 194203 - protein, 9 aa, Artificial Sequence
  Description of Artificial Sequence: Synthetic peptide
  Seed: SRNSRFSSW (TYRP2_HUMAN)
SRNSRFSSL

SEQ ID NO: 194204 - protein, 8 aa, Artificial Sequence
  Description of Artificial Sequence: Synthetic peptide
  Seed: ADAWPQEL (TYRP2_HUMAN)
AEAWPQEI

SEQ ID NO: 194205 - protein, 9 aa, Artificial Sequence
  Description of Artificial Sequence: Synthetic peptide
  Seed: YSYAIDLPV (TYRP2_HUMAN)
YAYAIDLPW

SEQ ID NO: 194206 - protein, 10 aa, Artificial Sequence
  Description of Artificial Sequence: Synthetic peptide
  Seed: IDFSHQGPAF (TYRP2_HUMAN)
IAFSHQGPAF

SEQ ID NO: 194207 - protein, 9 aa, Artificial Sequence
  Description of Artificial Sequence: Synthetic peptide
  Seed: FFQNSTFSF (TYRP2_HUMAN)
FWQNSTFSL

SEQ ID NO: 194208 - protein, 10 aa, Artificial Sequence
  Description of Artificial Sequence: Synthetic peptide
  Seed: RMYNMVPFFP (TYRP2_HUMAN)
RIYNMVPFFI

SEQ ID NO: 194209 - protein, 10 aa, Artificial Sequence
  Description of Artificial Sequence: Synthetic peptide
  Seed: RRLRKGYTPL (TYRP2_HUMAN)
RMLRKGYTPY

SEQ ID NO: 194210 - protein, 9 aa, Artificial Sequence
  Description of Artificial Sequence: Synthetic peptide
  Seed: LSPQEREQF (TYRP2_HUMAN)
LSPQEREQL

SEQ ID NO: 194211 - protein, 9 aa, Artificial Sequence
  Description of Artificial Sequence: Synthetic peptide
  Seed: NSMKLPTLK (TYRP2_HUMAN)
NFMKLPTLR

SEQ ID NO: 194212 - protein, 9 aa, Artificial Sequence
  Description of Artificial Sequence: Synthetic peptide
  Seed: RMYNMVPFF (TYRP2_HUMAN)
RGYNMVPFR

SEQ ID NO: 194213 - protein, 9 aa, Artificial Sequence
  Description of Artificial Sequence: Synthetic peptide
  Seed: VVLHSFTDA (TYRP2_HUMAN)
VLLHSFTDI

SEQ ID NO: 194214 - protein, 10 aa, Artificial Sequence
  Description of Artificial Sequence: Synthetic peptide
  Seed: NGTYEGLLRR (TYRP2_HUMAN)
NYTYEGLLRK

SEQ ID NO: 194215 - protein, 10 aa, Artificial Sequence
  Description of Artificial Sequence: Synthetic peptide
  Seed: RLRKGYTPLM (TYRP2_HUMAN)
RPRKGYTPLA

SEQ ID NO: 194216 - protein, 9 aa, Artificial Sequence
  Description of Artificial Sequence: Synthetic peptide
  Seed: FLTSDQLGY (TYRP2_HUMAN)
FKTSDQLGY

SEQ ID NO: 194217 - protein, 10 aa, Artificial Sequence
  Description of Artificial Sequence: Synthetic peptide
  Seed: ITTQHWLGLL (TYRP2_HUMAN)
ITTQHWLGLY

SEQ ID NO: 194218 - protein, 9 aa, Artificial Sequence
  Description of Artificial Sequence: Synthetic peptide
  Seed: DQLGYSYAI (TYRP2_HUMAN)
DHLGYSYAM

SEQ ID NO: 194219 - protein, 9 aa, Artificial Sequence
  Description of Artificial Sequence: Synthetic peptide
  Seed: RLRKGYTPL (TYRP2_HUMAN)
RMRKGYTPI

SEQ ID NO: 194220 - protein, 8 aa, Artificial Sequence
  Description of Artificial Sequence: Synthetic peptide
  Seed: AIDLPVSV (TYRP2_HUMAN)
ASDLPVSM

SEQ ID NO: 194221 - protein, 9 aa, Artificial Sequence
  Description of Artificial Sequence: Synthetic peptide
  Seed: FLLSCLGCK (TYRP2_HUMAN)
FLLSCLGCR

SEQ ID NO: 194222 - protein, 10 aa, Artificial Sequence
  Description of Artificial Sequence: Synthetic peptide
  Seed: GYSYAIDLPV (TYRP2_HUMAN)
GMSYAIDLPL

SEQ ID NO: 194223 - protein, 10 aa, Artificial Sequence
  Description of Artificial Sequence: Synthetic peptide
  Seed: RRLRKGYTPL (TYRP2_HUMAN)
RKLRKGYTPF

SEQ ID NO: 194224 - protein, 9 aa, Artificial Sequence
  Description of Artificial Sequence: Synthetic peptide
  Seed: LVHSFLNGT (TYRP2_HUMAN)
LVHSFLNGA

SEQ ID NO: 194225 - protein, 8 aa, Artificial Sequence
  Description of Artificial Sequence: Synthetic peptide
  Seed: AIDLPVSV (TYRP2_HUMAN)
ALDLPVSI

SEQ ID NO: 194226 - protein, 9 aa, Artificial Sequence
  Description of Artificial Sequence: Synthetic peptide
  Seed: VTNEELFLT (TYRP2_HUMAN)
VLNEELFLL

SEQ ID NO: 194227 - protein, 10 aa, Artificial Sequence
  Description of Artificial Sequence: Synthetic peptide
  Seed: LTSDQLGYSY (TYRP2_HUMAN)
LVSDQLGYSY

SEQ ID NO: 194228 - protein, 11 aa, Artificial Sequence
  Description of Artificial Sequence: Synthetic peptide
  Seed: MYNMVPFFPPV (TYRP2_HUMAN)
MENMVPFFPPV

SEQ ID NO: 194229 - protein, 10 aa, Artificial Sequence
  Description of Artificial Sequence: Synthetic peptide
  Seed: SPLWWGFLLS (TYRP2_HUMAN)
SVLWWGFLLL

SEQ ID NO: 194230 - protein, 9 aa, Artificial Sequence
  Description of Artificial Sequence: Synthetic peptide
  Seed: DFFVWLHYY (TYRP2_HUMAN)
DFFVWLHYK

SEQ ID NO: 194231 - protein, 9 aa, Artificial Sequence
  Description of Artificial Sequence: Synthetic peptide
  Seed: HSAANDPIF (TYRP2_HUMAN)
HSAANDPIW

SEQ ID NO: 194232 - protein, 10 aa, Artificial Sequence
  Description of Artificial Sequence: Synthetic peptide
  Seed: FTDAIFDEWM (TYRP2_HUMAN)
FMDAIFDEWV

SEQ ID NO: 194233 - protein, 10 aa, Artificial Sequence
  Description of Artificial Sequence: Synthetic peptide
  Seed: VVLHSFTDAI (TYRP2_HUMAN)
VILHSFTDAL

SEQ ID NO: 194234 - protein, 9 aa, Artificial Sequence
  Description of Artificial Sequence: Synthetic peptide
  Seed: ANDPIFVVL (TYRP2_HUMAN)
ACDPIFVVL

SEQ ID NO: 194235 - protein, 9 aa, Artificial Sequence
  Description of Artificial Sequence: Synthetic peptide
  Seed: ELWPRKFFH (TYRP2_HUMAN)
EFWPRKFFH

SEQ ID NO: 194236 - protein, 10 aa, Artificial Sequence
  Description of Artificial Sequence: Synthetic peptide
  Seed: RNSRFSSWET (TYRP2_HUMAN)
RMSRFSSWEA

SEQ ID NO: 194237 - protein, 9 aa, Artificial Sequence
  Description of Artificial Sequence: Synthetic peptide
  Seed: RQNIHSLSP (TYRP2_HUMAN)
RQNIHSLSV

SEQ ID NO: 194238 - protein, 9 aa, Artificial Sequence
  Description of Artificial Sequence: Synthetic peptide
  Seed: HSFLNGTNA (TYRP2_HUMAN)
HAFLNGTNL

SEQ ID NO: 194239 - protein, 10 aa, Artificial Sequence
  Description of Artificial Sequence: Synthetic peptide
  Seed: HSAANDPIFV (TYRP2_HUMAN)
HMAANDPIFV

SEQ ID NO: 194240 - protein, 9 aa, Artificial Sequence
  Description of Artificial Sequence: Synthetic peptide
  Seed: WMKRFNPPA (TYRP2_HUMAN)
WKKRFNPPY

SEQ ID NO: 194241 - protein, 8 aa, Artificial Sequence
  Description of Artificial Sequence: Synthetic peptide
  Seed: KFFHRTCK (TYRP2_HUMAN)
KFFHRTCR

SEQ ID NO: 194242 - protein, 9 aa, Artificial Sequence
  Description of Artificial Sequence: Synthetic peptide
  Seed: RTCKCTGNF (TYRP2_HUMAN)
RLCKCTGNY

SEQ ID NO: 194243 - protein, 9 aa, Artificial Sequence
  Description of Artificial Sequence: Synthetic peptide
  Seed: IFDEWMKRF (TYRP2_HUMAN)
IWDEWMKRL

SEQ ID NO: 194244 - protein, 9 aa, Artificial Sequence
  Description of Artificial Sequence: Synthetic peptide
  Seed: NMVPFFPPV (TYRP2_HUMAN)
NLVPFFPPK

SEQ ID NO: 194245 - protein, 9 aa, Artificial Sequence
  Description of Artificial Sequence: Synthetic peptide
  Seed: MSPLWWGFL (TYRP2_HUMAN)
MYPLWWGFL

SEQ ID NO: 194246 - protein, 9 aa, Artificial Sequence
  Description of Artificial Sequence: Synthetic peptide
  Seed: CSVYDFFVW (TYRP2_HUMAN)
CTVYDFFVW

SEQ ID NO: 194247 - protein, 10 aa, Artificial Sequence
  Description of Artificial Sequence: Synthetic peptide
  Seed: RELWPRKFFH (TYRP2_HUMAN)
RMLWPRKFFY

SEQ ID NO: 194248 - protein, 11 aa, Artificial Sequence
  Description of Artificial Sequence: Synthetic peptide
  Seed: RDTLLGPGRPY (TYRP2_HUMAN)
RMTLLGPGRPF

SEQ ID NO: 194249 - protein, 10 aa, Artificial Sequence
  Description of Artificial Sequence: Synthetic peptide
  Seed: LVVMGTLVAL (TYRP2_HUMAN)
LYVMGTLVAF

SEQ ID NO: 194250 - protein, 10 aa, Artificial Sequence
  Description of Artificial Sequence: Synthetic peptide
  Seed: AANDPIFVVL (TYRP2_HUMAN)
AFNDPIFVVY

SEQ ID NO: 194251 - protein, 10 aa, Artificial Sequence
  Description of Artificial Sequence: Synthetic peptide
  Seed: LGPGRPYRAI (TYRP2_HUMAN)
LKPGRPYRAL

SEQ ID NO: 194252 - protein, 10 aa, Artificial Sequence
  Description of Artificial Sequence: Synthetic peptide
  Seed: HNRMYNMVPF (TYRP2_HUMAN)
HWRMYNMVPM

SEQ ID NO: 194253 - protein, 11 aa, Artificial Sequence
  Description of Artificial Sequence: Synthetic peptide
  Seed: SLDDYNHLVTL (TYRP2_HUMAN)
SYDDYNHLVTF

SEQ ID NO: 194254 - protein, 9 aa, Artificial Sequence
  Description of Artificial Sequence: Synthetic peptide
  Seed: MTVDSLVNK (TYRP2_HUMAN)
MSVDSLVNY

SEQ ID NO: 194255 - protein, 11 aa, Artificial Sequence
  Description of Artificial Sequence: Synthetic peptide
  Seed: MYNMVPFFPPV (TYRP2_HUMAN)
MKNMVPFFPPL

SEQ ID NO: 194256 - protein, 8 aa, Artificial Sequence
  Description of Artificial Sequence: Synthetic peptide
  Seed: FSHQGPAF (TYRP2_HUMAN)
FFHQGPAF

SEQ ID NO: 194257 - protein, 10 aa, Artificial Sequence
  Description of Artificial Sequence: Synthetic peptide
  Seed: SPLWWGFLLS (TYRP2_HUMAN)
SMLWWGFLLL

SEQ ID NO: 194258 - protein, 10 aa, Artificial Sequence
  Description of Artificial Sequence: Synthetic peptide
  Seed: MSPLWWGFLL (TYRP2_HUMAN)
MEPLWWGFLA

SEQ ID NO: 194259 - protein, 9 aa, Artificial Sequence
  Description of Artificial Sequence: Synthetic peptide
  Seed: YAIDLPVSV (TYRP2_HUMAN)
YVIDLPVSK

SEQ ID NO: 194260 - protein, 9 aa, Artificial Sequence
  Description of Artificial Sequence: Synthetic peptide
  Seed: RKFFHRTCK (TYRP2_HUMAN)
RTFFHRTCG

SEQ ID NO: 194261 - protein, 8 aa, Artificial Sequence
  Description of Artificial Sequence: Synthetic peptide
  Seed: AIDLPVSV (TYRP2_HUMAN)
ASDLPVSV

SEQ ID NO: 194262 - protein, 10 aa, Artificial Sequence
  Description of Artificial Sequence: Synthetic peptide
  Seed: LVVMGTLVAL (TYRP2_HUMAN)
LFVMGTLVAM

SEQ ID NO: 194263 - protein, 10 aa, Artificial Sequence
  Description of Artificial Sequence: Synthetic peptide
  Seed: TQPQFANCSV (TYRP2_HUMAN)
TWPQFANCSL

SEQ ID NO: 194264 - protein, 11 aa, Artificial Sequence
  Description of Artificial Sequence: Synthetic peptide
  Seed: FFPPVTNEELF (TYRP2_HUMAN)
FQPPVTNEELY

SEQ ID NO: 194265 - protein, 9 aa, Artificial Sequence
  Description of Artificial Sequence: Synthetic peptide
  Seed: LIGNESFAL (TYRP2_HUMAN)
LLGNESFAV

SEQ ID NO: 194266 - protein, 11 aa, Artificial Sequence
  Description of Artificial Sequence: Synthetic peptide
  Seed: RADTRPWSGPY (TYRP2_HUMAN)
RHDTRPWSGPK

SEQ ID NO: 194267 - protein, 10 aa, Artificial Sequence
  Description of Artificial Sequence: Synthetic peptide
  Seed: SLQKFDNPPF (TYRP2_HUMAN)
SPQKFDNPPF

SEQ ID NO: 194268 - protein, 10 aa, Artificial Sequence
  Description of Artificial Sequence: Synthetic peptide
  Seed: LQRLIGNESF (TYRP2_HUMAN)
LQRLIGNESY

SEQ ID NO: 194269 - protein, 11 aa, Artificial Sequence
  Description of Artificial Sequence: Synthetic peptide
  Seed: TQPQFANCSVY (TYRP2_HUMAN)
THPQFANCSVF

SEQ ID NO: 194270 - protein, 10 aa, Artificial Sequence
  Description of Artificial Sequence: Synthetic peptide
  Seed: HSFLNGTNAL (TYRP2_HUMAN)
HQFLNGTNAF

SEQ ID NO: 194271 - protein, 9 aa, Artificial Sequence
  Description of Artificial Sequence: Synthetic peptide
  Seed: RPWSGPYIL (TYRP2_HUMAN)
RPWSGPYIV

SEQ ID NO: 194272 - protein, 9 aa, Artificial Sequence
  Description of Artificial Sequence: Synthetic peptide
  Seed: YSYAIDLPV (TYRP2_HUMAN)
YTYAIDLPT

SEQ ID NO: 194273 - protein, 9 aa, Artificial Sequence
  Description of Artificial Sequence: Synthetic peptide
  Seed: NRMYNMVPF (TYRP2_HUMAN)
NQMYNMVPI

SEQ ID NO: 194274 - protein, 9 aa, Artificial Sequence
  Description of Artificial Sequence: Synthetic peptide
  Seed: RLRKGYTPL (TYRP2_HUMAN)
RIRKGYTPC

SEQ ID NO: 194275 - protein, 10 aa, Artificial Sequence
  Description of Artificial Sequence: Synthetic peptide
  Seed: RNSRFSSWET (TYRP2_HUMAN)
RNSRFSSWEA

SEQ ID NO: 194276 - protein, 10 aa, Artificial Sequence
  Description of Artificial Sequence: Synthetic peptide
  Seed: FFQNSTFSFR (TYRP2_HUMAN)
FDQNSTFSFR

SEQ ID NO: 194277 - protein, 10 aa, Artificial Sequence
  Description of Artificial Sequence: Synthetic peptide
  Seed: RNSRFSSWET (TYRP2_HUMAN)
RWSRFSSWES

SEQ ID NO: 194278 - protein, 9 aa, Artificial Sequence
  Description of Artificial Sequence: Synthetic peptide
  Seed: SRNSRFSSW (TYRP2_HUMAN)
SVNSRFSSY

SEQ ID NO: 194279 - protein, 9 aa, Artificial Sequence
  Description of Artificial Sequence: Synthetic peptide
  Seed: YSYAIDLPV (TYRP2_HUMAN)
YGYAIDLPL

SEQ ID NO: 194280 - protein, 10 aa, Artificial Sequence
  Description of Artificial Sequence: Synthetic peptide
  Seed: IDFSHQGPAF (TYRP2_HUMAN)
IIFSHQGPAF

SEQ ID NO: 194281 - protein, 9 aa, Artificial Sequence
  Description of Artificial Sequence: Synthetic peptide
  Seed: FSHQGPAFV (TYRP2_HUMAN)
FRHQGPAFV

SEQ ID NO: 194282 - protein, 10 aa, Artificial Sequence
  Description of Artificial Sequence: Synthetic peptide
  Seed: YSYAIDLPVS (TYRP2_HUMAN)
YVYAIDLPVV

SEQ ID NO: 194283 - protein, 10 aa, Artificial Sequence
  Description of Artificial Sequence: Synthetic peptide
  Seed: ITTQHWLGLL (TYRP2_HUMAN)
ISTQHWLGLF

SEQ ID NO: 194284 - protein, 9 aa, Artificial Sequence
  Description of Artificial Sequence: Synthetic peptide
  Seed: RLIGNESFA (TYRP2_HUMAN)
RIIGNESFV

SEQ ID NO: 194285 - protein, 10 aa, Artificial Sequence
  Description of Artificial Sequence: Synthetic peptide
  Seed: SSWETVCDSL (TYRP2_HUMAN)
SSWETVCDSF

SEQ ID NO: 194286 - protein, 11 aa, Artificial Sequence
  Description of Artificial Sequence: Synthetic peptide
  Seed: YTPLMETHLSS (TYRP2_HUMAN)
YQPLMETHLSV

SEQ ID NO: 194287 - protein, 10 aa, Artificial Sequence
  Description of Artificial Sequence: Synthetic peptide
  Seed: MSPLWWGFLL (TYRP2_HUMAN)
MHPLWWGFLL

SEQ ID NO: 194288 - protein, 10 aa, Artificial Sequence
  Description of Artificial Sequence: Synthetic peptide
  Seed: VVMGTLVALV (TYRP2_HUMAN)
VLMGTLVALA

SEQ ID NO: 194289 - protein, 9 aa, Artificial Sequence
  Description of Artificial Sequence: Synthetic peptide
  Seed: RYHLLCLER (TYRP2_HUMAN)
RTHLLCLEK

SEQ ID NO: 194290 - protein, 9 aa, Artificial Sequence
  Description of Artificial Sequence: Synthetic peptide
  Seed: IFDEWMKRF (TYRP2_HUMAN)
ITDEWMKRW

SEQ ID NO: 194291 - protein, 10 aa, Artificial Sequence
  Description of Artificial Sequence: Synthetic peptide
  Seed: SDQLGYSYAI (TYRP2_HUMAN)
SKQLGYSYAM

SEQ ID NO: 194292 - protein, 11 aa, Artificial Sequence
  Description of Artificial Sequence: Synthetic peptide
  Seed: SLDDYNHLVTL (TYRP2_HUMAN)
SSDDYNHLVTF

SEQ ID NO: 194293 - protein, 9 aa, Artificial Sequence
  Description of Artificial Sequence: Synthetic peptide
  Seed: FQNSTFSFR (TYRP2_HUMAN)
FPNSTFSFK

SEQ ID NO: 194294 - protein, 10 aa, Artificial Sequence
  Description of Artificial Sequence: Synthetic peptide
  Seed: HNRMYNMVPF (TYRP2_HUMAN)
HWRMYNMVPF

SEQ ID NO: 194295 - protein, 9 aa, Artificial Sequence
  Description of Artificial Sequence: Synthetic peptide
  Seed: QFPRVCMTV (TYRP2_HUMAN)
QWPRVCMTL

SEQ ID NO: 194296 - protein, 10 aa, Artificial Sequence
  Description of Artificial Sequence: Synthetic peptide
  Seed: RRLRKGYTPL (TYRP2_HUMAN)
RPLRKGYTPC

SEQ ID NO: 194297 - protein, 11 aa, Artificial Sequence
  Description of Artificial Sequence: Synthetic peptide
  Seed: YNMVPFFPPVT (TYRP2_HUMAN)
YIMVPFFPPVY

SEQ ID NO: 194298 - protein, 9 aa, Artificial Sequence
  Description of Artificial Sequence: Synthetic peptide
  Seed: FLNGTNALP (TYRP2_HUMAN)
FMNGTNALA

SEQ ID NO: 194299 - protein, 10 aa, Artificial Sequence
  Description of Artificial Sequence: Synthetic peptide
  Seed: FTDAIFDEWM (TYRP2_HUMAN)
FLDAIFDEWV

SEQ ID NO: 194300 - protein, 10 aa, Artificial Sequence
  Description of Artificial Sequence: Synthetic peptide
  Seed: ELWPRKFFHR (TYRP2_HUMAN)
EMWPRKFFHR

SEQ ID NO: 194301 - protein, 10 aa, Artificial Sequence
  Description of Artificial Sequence: Synthetic peptide
  Seed: TRPWSGPYIL (TYRP2_HUMAN)
TMPWSGPYIY

SEQ ID NO: 194302 - protein, 9 aa, Artificial Sequence
  Description of Artificial Sequence: Synthetic peptide
  Seed: WPQELAPIG (TYRP2_HUMAN)
WTQELAPIY

SEQ ID NO: 194303 - protein, 9 aa, Artificial Sequence
  Description of Artificial Sequence: Synthetic peptide
  Seed: FPPVTNEEL (TYRP2_HUMAN)
FPPVTNEEV

SEQ ID NO: 194304 - protein, 10 aa, Artificial Sequence
  Description of Artificial Sequence: Synthetic peptide
  Seed: FLLSCLGCKI (TYRP2_HUMAN)
FELSCLGCKL

SEQ ID NO: 194305 - protein, 11 aa, Artificial Sequence
  Description of Artificial Sequence: Synthetic peptide
  Seed: SLQKFDNPPFF (TYRP2_HUMAN)
SQQKFDNPPFY

SEQ ID NO: 194306 - protein, 10 aa, Artificial Sequence
  Description of Artificial Sequence: Synthetic peptide
  Seed: MSPLWWGFLL (TYRP2_HUMAN)
MGPLWWGFLL

SEQ ID NO: 194307 - protein, 9 aa, Artificial Sequence
  Description of Artificial Sequence: Synthetic peptide
  Seed: SLHNLVHSF (TYRP2_HUMAN)
SFHNLVHSL

SEQ ID NO: 194308 - protein, 10 aa, Artificial Sequence
  Description of Artificial Sequence: Synthetic peptide
  Seed: MGRNSMKLPT (TYRP2_HUMAN)
MSRNSMKLPL

SEQ ID NO: 194309 - protein, 10 aa, Artificial Sequence
  Description of Artificial Sequence: Synthetic peptide
  Seed: ADTRPWSGPY (TYRP2_HUMAN)
AFTRPWSGPY

SEQ ID NO: 194310 - protein, 10 aa, Artificial Sequence
  Description of Artificial Sequence: Synthetic peptide
  Seed: ELAPIGHNRM (TYRP2_HUMAN)
ESAPIGHNRV

SEQ ID NO: 194311 - protein, 10 aa, Artificial Sequence
  Description of Artificial Sequence: Synthetic peptide
  Seed: TLLVVMGTLV (TYRP2_HUMAN)
TMLVVMGTLV

SEQ ID NO: 194312 - protein, 10 aa, Artificial Sequence
  Description of Artificial Sequence: Synthetic peptide
  Seed: YHLLCLERDL (TYRP2_HUMAN)
YMLLCLERDI

SEQ ID NO: 194313 - protein, 10 aa, Artificial Sequence
  Description of Artificial Sequence: Synthetic peptide
  Seed: LVVMGTLVAL (TYRP2_HUMAN)
LSVMGTLVAF

SEQ ID NO: 194314 - protein, 9 aa, Artificial Sequence
  Description of Artificial Sequence: Synthetic peptide
  Seed: PQFANCSVY (TYRP2_HUMAN)
PQFANCSVM

SEQ ID NO: 194315 - protein, 11 aa, Artificial Sequence
  Description of Artificial Sequence: Synthetic peptide
  Seed: YNMVPFFPPVT (TYRP2_HUMAN)
YQMVPFFPPVD

SEQ ID NO: 194316 - protein, 9 aa, Artificial Sequence
  Description of Artificial Sequence: Synthetic peptide
  Seed: SQVMSLHNL (TYRP2_HUMAN)
SIVMSLHNA

SEQ ID NO: 194317 - protein, 9 aa, Artificial Sequence
  Description of Artificial Sequence: Synthetic peptide
  Seed: RLRKGYTPL (TYRP2_HUMAN)
RYRKGYTPF

SEQ ID NO: 194318 - protein, 9 aa, Artificial Sequence
  Description of Artificial Sequence: Synthetic peptide
  Seed: TLDSQVMSL (TYRP2_HUMAN)
TFDSQVMSI

SEQ ID NO: 194319 - protein, 9 aa, Artificial Sequence
  Description of Artificial Sequence: Synthetic peptide
  Seed: CSVYDFFVW (TYRP2_HUMAN)
CPVYDFFVM

SEQ ID NO: 194320 - protein, 10 aa, Artificial Sequence
  Description of Artificial Sequence: Synthetic peptide
  Seed: RELWPRKFFH (TYRP2_HUMAN)
RQLWPRKFFH

SEQ ID NO: 194321 - protein, 9 aa, Artificial Sequence
  Description of Artificial Sequence: Synthetic peptide
  Seed: VLHSFTDAI (TYRP2_HUMAN)
VKHSFTDAY

SEQ ID NO: 194322 - protein, 9 aa, Artificial Sequence
  Description of Artificial Sequence: Synthetic peptide
  Seed: YTPLMETHL (TYRP2_HUMAN)
YTPLMETHV

SEQ ID NO: 194323 - protein, 9 aa, Artificial Sequence
  Description of Artificial Sequence: Synthetic peptide
  Seed: IFDEWMKRF (TYRP2_HUMAN)
IYDEWMKRY

SEQ ID NO: 194324 - protein, 9 aa, Artificial Sequence
  Description of Artificial Sequence: Synthetic peptide
  Seed: RDCLSLQKF (TYRP2_HUMAN)
RTCLSLQKW

SEQ ID NO: 194325 - protein, 9 aa, Artificial Sequence
  Description of Artificial Sequence: Synthetic peptide
  Seed: ELAPIGHNR (TYRP2_HUMAN)
ELAPIGHNY

SEQ ID NO: 194326 - protein, 9 aa, Artificial Sequence
  Description of Artificial Sequence: Synthetic peptide
  Seed: MSPLWWGFL (TYRP2_HUMAN)
MVPLWWGFV

SEQ ID NO: 194327 - protein, 9 aa, Artificial Sequence
  Description of Artificial Sequence: Synthetic peptide
  Seed: ALVGLFVLL (TYRP2_HUMAN)
AMVGLFVLI

SEQ ID NO: 194328 - protein, 9 aa, Artificial Sequence
  Description of Artificial Sequence: Synthetic peptide
  Seed: ALPYWNFAT (TYRP2_HUMAN)
AIPYWNFAV

SEQ ID NO: 194329 - protein, 10 aa, Artificial Sequence
  Description of Artificial Sequence: Synthetic peptide
  Seed: RLRKGYTPLM (TYRP2_HUMAN)
RLRKGYTPLI

SEQ ID NO: 194330 - protein, 11 aa, Artificial Sequence
  Description of Artificial Sequence: Synthetic peptide
  Seed: RADTRPWSGPY (TYRP2_HUMAN)
RVDTRPWSGPF

SEQ ID NO: 194331 - protein, 11 aa, Artificial Sequence
  Description of Artificial Sequence: Synthetic peptide
  Seed: RADTRPWSGPY (TYRP2_HUMAN)
REDTRPWSGPF

SEQ ID NO: 194332 - protein, 10 aa, Artificial Sequence
  Description of Artificial Sequence: Synthetic peptide
  Seed: YAIDLPVSVE (TYRP2_HUMAN)
YLIDLPVSVE

SEQ ID NO: 194333 - protein, 10 aa, Artificial Sequence
  Description of Artificial Sequence: Synthetic peptide
  Seed: RPDDPTLISR (TYRP2_HUMAN)
RSDDPTLISM

SEQ ID NO: 194334 - protein, 10 aa, Artificial Sequence
  Description of Artificial Sequence: Synthetic peptide
  Seed: SLDDYNHLVT (TYRP2_HUMAN)
SGDDYNHLVF

SEQ ID NO: 194335 - protein, 9 aa, Artificial Sequence
  Description of Artificial Sequence: Synthetic peptide
  Seed: FPPVTNEEL (TYRP2_HUMAN)
FTPVTNEEF

SEQ ID NO: 194336 - protein, 10 aa, Artificial Sequence
  Description of Artificial Sequence: Synthetic peptide
  Seed: REQFLGALDL (TYRP2_HUMAN)
RKQFLGALDY

SEQ ID NO: 194337 - protein, 9 aa, Artificial Sequence
  Description of Artificial Sequence: Synthetic peptide
  Seed: SLHNLVHSF (TYRP2_HUMAN)
SMHNLVHSR

SEQ ID NO: 194338 - protein, 9 aa, Artificial Sequence
  Description of Artificial Sequence: Synthetic peptide
  Seed: WHRYHLLCL (TYRP2_HUMAN)
WLRYHLLCI

SEQ ID NO: 194339 - protein, 9 aa, Artificial Sequence
  Description of Artificial Sequence: Synthetic peptide
  Seed: ESANVCGSQ (TYRP2_HUMAN)
EMANVCGSK

SEQ ID NO: 194340 - protein, 9 aa, Artificial Sequence
  Description of Artificial Sequence: Synthetic peptide
  Seed: LHSFTDAIF (TYRP2_HUMAN)
LASFTDAIF

SEQ ID NO: 194341 - protein, 9 aa, Artificial Sequence
  Description of Artificial Sequence: Synthetic peptide
  Seed: STFSFRNAL (TYRP2_HUMAN)
SLFSFRNAI

SEQ ID NO: 194342 - protein, 10 aa, Artificial Sequence
  Description of Artificial Sequence: Synthetic peptide
  Seed: SPLWWGFLLS (TYRP2_HUMAN)
STLWWGFLLL

SEQ ID NO: 194343 - protein, 10 aa, Artificial Sequence
  Description of Artificial Sequence: Synthetic peptide
  Seed: FSFRNALEGF (TYRP2_HUMAN)
FYFRNALEGF

SEQ ID NO: 194344 - protein, 10 aa, Artificial Sequence
  Description of Artificial Sequence: Synthetic peptide
  Seed: WPRKFFHRTC (TYRP2_HUMAN)
WPRKFFHRTM

SEQ ID NO: 194345 - protein, 11 aa, Artificial Sequence
  Description of Artificial Sequence: Synthetic peptide
  Seed: MSLHNLVHSFL (TYRP2_HUMAN)
MSLHNLVHSFW

SEQ ID NO: 194346 - protein, 11 aa, Artificial Sequence
  Description of Artificial Sequence: Synthetic peptide
  Seed: RNSRFSSWETV (TYRP2_HUMAN)
RRSRFSSWETM

SEQ ID NO: 194347 - protein, 10 aa, Artificial Sequence
  Description of Artificial Sequence: Synthetic peptide
  Seed: FSFRNALEGF (TYRP2_HUMAN)
FRFRNALEGF

SEQ ID NO: 194348 - protein, 9 aa, Artificial Sequence
  Description of Artificial Sequence: Synthetic peptide
  Seed: FFPPVTNEE (TYRP2_HUMAN)
FYPPVTNEL

SEQ ID NO: 194349 - protein, 11 aa, Artificial Sequence
  Description of Artificial Sequence: Synthetic peptide
  Seed: HSLSPQEREQF (TYRP2_HUMAN)
HALSPQEREQW

SEQ ID NO: 194350 - protein, 9 aa, Artificial Sequence
  Description of Artificial Sequence: Synthetic peptide
  Seed: GTNALPHSA (TYRP2_HUMAN)
GINALPHSI

SEQ ID NO: 194351 - protein, 9 aa, Artificial Sequence
  Description of Artificial Sequence: Synthetic peptide
  Seed: DQLGYSYAI (TYRP2_HUMAN)
DILGYSYAV

SEQ ID NO: 194352 - protein, 10 aa, Artificial Sequence
  Description of Artificial Sequence: Synthetic peptide
  Seed: MSLHNLVHSF (TYRP2_HUMAN)
MTLHNLVHSW

SEQ ID NO: 194353 - protein, 9 aa, Artificial Sequence
  Description of Artificial Sequence: Synthetic peptide
  Seed: SVRDTLLGP (TYRP2_HUMAN)
SGRDTLLGK

SEQ ID NO: 194354 - protein, 10 aa, Artificial Sequence
  Description of Artificial Sequence: Synthetic peptide
  Seed: SPLWWGFLLS (TYRP2_HUMAN)
SQLWWGFLLV

SEQ ID NO: 194355 - protein, 9 aa, Artificial Sequence
  Description of Artificial Sequence: Synthetic peptide
  Seed: GFDKADGTL (TYRP2_HUMAN)
GYDKADGTM

SEQ ID NO: 194356 - protein, 10 aa, Artificial Sequence
  Description of Artificial Sequence: Synthetic peptide
  Seed: AANDPIFVVL (TYRP2_HUMAN)
AQNDPIFVVW

SEQ ID NO: 194357 - protein, 11 aa, Artificial Sequence
  Description of Artificial Sequence: Synthetic peptide
  Seed: ANCSVYDFFVW (TYRP2_HUMAN)
AQCSVYDFFVW

SEQ ID NO: 194358 - protein, 11 aa, Artificial Sequence
  Description of Artificial Sequence: Synthetic peptide
  Seed: LLVVMGTLVAL (TYRP2_HUMAN)
LEVVMGTLVAV

SEQ ID NO: 194359 - protein, 11 aa, Artificial Sequence
  Description of Artificial Sequence: Synthetic peptide
  Seed: QELAPIGHNRM (TYRP2_HUMAN)
QELAPIGHNRY

SEQ ID NO: 194360 - protein, 10 aa, Artificial Sequence
  Description of Artificial Sequence: Synthetic peptide
  Seed: QFANCSVYDF (TYRP2_HUMAN)
QWANCSVYDF

SEQ ID NO: 194361 - protein, 10 aa, Artificial Sequence
  Description of Artificial Sequence: Synthetic peptide
  Seed: SVYDFFVWLH (TYRP2_HUMAN)
SFYDFFVWLR

SEQ ID NO: 194362 - protein, 10 aa, Artificial Sequence
  Description of Artificial Sequence: Synthetic peptide
  Seed: LVVMGTLVAL (TYRP2_HUMAN)
LDVMGTLVAL

SEQ ID NO: 194363 - protein, 11 aa, Artificial Sequence
  Description of Artificial Sequence: Synthetic peptide
  Seed: RDTLLGPGRPY (TYRP2_HUMAN)
RLTLLGPGRPY

SEQ ID NO: 194364 - protein, 10 aa, Artificial Sequence
  Description of Artificial Sequence: Synthetic peptide
  Seed: RMYNMVPFFP (TYRP2_HUMAN)
RVYNMVPFFA

SEQ ID NO: 194365 - protein, 10 aa, Artificial Sequence
  Description of Artificial Sequence: Synthetic peptide
  Seed: SHQGPAFVTW (TYRP2_HUMAN)
SFQGPAFVTW

SEQ ID NO: 194366 - protein, 8 aa, Artificial Sequence
  Description of Artificial Sequence: Synthetic peptide
  Seed: FSHQGPAF (TYRP2_HUMAN)
FIHQGPAL

SEQ ID NO: 194367 - protein, 9 aa, Artificial Sequence
  Description of Artificial Sequence: Synthetic peptide
  Seed: YDFFVWLHY (TYRP2_HUMAN)
YPFFVWLHY

SEQ ID NO: 194368 - protein, 9 aa, Artificial Sequence
  Description of Artificial Sequence: Synthetic peptide
  Seed: AIFDEWMKR (TYRP2_HUMAN)
ALFDEWMKY

SEQ ID NO: 194369 - protein, 10 aa, Artificial Sequence
  Description of Artificial Sequence: Synthetic peptide
  Seed: ADTRPWSGPY (TYRP2_HUMAN)
ATTRPWSGPW

SEQ ID NO: 194370 - protein, 9 aa, Artificial Sequence
  Description of Artificial Sequence: Synthetic peptide
  Seed: STFSFRNAL (TYRP2_HUMAN)
SRFSFRNAV

SEQ ID NO: 194371 - protein, 10 aa, Artificial Sequence
  Description of Artificial Sequence: Synthetic peptide
  Seed: SDQLGYSYAI (TYRP2_HUMAN)
SIQLGYSYAM

SEQ ID NO: 194372 - protein, 9 aa, Artificial Sequence
  Description of Artificial Sequence: Synthetic peptide
  Seed: ECDVCTDQL (TYRP2_HUMAN)
EYDVCTDQL

SEQ ID NO: 194373 - protein, 10 aa, Artificial Sequence
  Description of Artificial Sequence: Synthetic peptide
  Seed: RNSMKLPTLK (TYRP2_HUMAN)
RSSMKLPTLR

SEQ ID NO: 194374 - protein, 10 aa, Artificial Sequence
  Description of Artificial Sequence: Synthetic peptide
  Seed: REQFLGALDL (TYRP2_HUMAN)
RRQFLGALDF

SEQ ID NO: 194375 - protein, 11 aa, Artificial Sequence
  Description of Artificial Sequence: Synthetic peptide
  Seed: CDSLDDYNHLV (TYRP2_HUMAN)
CMSLDDYNHLV

SEQ ID NO: 194376 - protein, 10 aa, Artificial Sequence
  Description of Artificial Sequence: Synthetic peptide
  Seed: VVMGTLVALV (TYRP2_HUMAN)
VMMGTLVALN

SEQ ID NO: 194377 - protein, 10 aa, Artificial Sequence
  Description of Artificial Sequence: Synthetic peptide
  Seed: RMYNMVPFFP (TYRP2_HUMAN)
RQYNMVPFFN

SEQ ID NO: 194378 - protein, 9 aa, Artificial Sequence
  Description of Artificial Sequence: Synthetic peptide
  Seed: RLRKGYTPL (TYRP2_HUMAN)
RLRKGYTPP

SEQ ID NO: 194379 - protein, 11 aa, Artificial Sequence
  Description of Artificial Sequence: Synthetic peptide
  Seed: RELWPRKFFHR (TYRP2_HUMAN)
RYLWPRKFFHK

SEQ ID NO: 194380 - protein, 9 aa, Artificial Sequence
  Description of Artificial Sequence: Synthetic peptide
  Seed: NRMYNMVPF (TYRP2_HUMAN)
NAMYNMVPF

SEQ ID NO: 194381 - protein, 10 aa, Artificial Sequence
  Description of Artificial Sequence: Synthetic peptide
  Seed: SLDDYNHLVT (TYRP2_HUMAN)
SLDDYNHLVL

SEQ ID NO: 194382 - protein, 9 aa, Artificial Sequence
  Description of Artificial Sequence: Synthetic peptide
  Seed: EREQFLGAL (TYRP2_HUMAN)
EHEQFLGAL

SEQ ID NO: 194383 - protein, 10 aa, Artificial Sequence
  Description of Artificial Sequence: Synthetic peptide
  Seed: RMYNMVPFFP (TYRP2_HUMAN)
RLYNMVPFFA

SEQ ID NO: 194384 - protein, 10 aa, Artificial Sequence
  Description of Artificial Sequence: Synthetic peptide
  Seed: RMYNMVPFFP (TYRP2_HUMAN)
RSYNMVPFFA

SEQ ID NO: 194385 - protein, 10 aa, Artificial Sequence
  Description of Artificial Sequence: Synthetic peptide
  Seed: SDQLGYSYAI (TYRP2_HUMAN)
SFQLGYSYAY

SEQ ID NO: 194386 - protein, 9 aa, Artificial Sequence
  Description of Artificial Sequence: Synthetic peptide
  Seed: TLISRNSRF (TYRP2_HUMAN)
TAISRNSRL

SEQ ID NO: 194387 - protein, 10 aa, Artificial Sequence
  Description of Artificial Sequence: Synthetic peptide
  Seed: QGPAFVTWHR (TYRP2_HUMAN)
QAPAFVTWHR

SEQ ID NO: 194388 - protein, 11 aa, Artificial Sequence
  Description of Artificial Sequence: Synthetic peptide
  Seed: TQPQFANCSVY (TYRP2_HUMAN)
TTPQFANCSVY

SEQ ID NO: 194389 - protein, 9 aa, Artificial Sequence
  Description of Artificial Sequence: Synthetic peptide
  Seed: RYHLLCLER (TYRP2_HUMAN)
RAHLLCLER

SEQ ID NO: 194390 - protein, 9 aa, Artificial Sequence
  Description of Artificial Sequence: Synthetic peptide
  Seed: VMSLHNLVH (TYRP2_HUMAN)
VQSLHNLVI

SEQ ID NO: 194391 - protein, 9 aa, Artificial Sequence
  Description of Artificial Sequence: Synthetic peptide
  Seed: YAIDLPVSV (TYRP2_HUMAN)
YVIDLPVSY

SEQ ID NO: 194392 - protein, 9 aa, Artificial Sequence
  Description of Artificial Sequence: Synthetic peptide
  Seed: FLNGTNALP (TYRP2_HUMAN)
FMNGTNALF

SEQ ID NO: 194393 - protein, 11 aa, Artificial Sequence
  Description of Artificial Sequence: Synthetic peptide
  Seed: YTPLMETHLSS (TYRP2_HUMAN)
YAPLMETHLSA

SEQ ID NO: 194394 - protein, 10 aa, Artificial Sequence
  Description of Artificial Sequence: Synthetic peptide
  Seed: YNMVPFFPPV (TYRP2_HUMAN)
YVMVPFFPPM

SEQ ID NO: 194395 - protein, 9 aa, Artificial Sequence
  Description of Artificial Sequence: Synthetic peptide
  Seed: YSYAIDLPV (TYRP2_HUMAN)
YAYAIDLPR

SEQ ID NO: 194396 - protein, 9 aa, Artificial Sequence
  Description of Artificial Sequence: Synthetic peptide
  Seed: DIRDCLSLQ (TYRP2_HUMAN)
DARDCLSLR

SEQ ID NO: 194397 - protein, 9 aa, Artificial Sequence
  Description of Artificial Sequence: Synthetic peptide
  Seed: RNQDDRELW (TYRP2_HUMAN)
RIQDDRELI

SEQ ID NO: 194398 - protein, 9 aa, Artificial Sequence
  Description of Artificial Sequence: Synthetic peptide
  Seed: RNQDDRELW (TYRP2_HUMAN)
RLQDDRELV

SEQ ID NO: 194399 - protein, 8 aa, Artificial Sequence
  Description of Artificial Sequence: Synthetic peptide
  Seed: FFVWLHYY (TYRP2_HUMAN)
FMVWLHYY

SEQ ID NO: 194400 - protein, 9 aa, Artificial Sequence
  Description of Artificial Sequence: Synthetic peptide
  Seed: VHPDYVITT (TYRP2_HUMAN)
VIPDYVITM

SEQ ID NO: 194401 - protein, 9 aa, Artificial Sequence
  Description of Artificial Sequence: Synthetic peptide
  Seed: TLKDIRDCL (TYRP2_HUMAN)
TAKDIRDCY

SEQ ID NO: 194402 - protein, 10 aa, Artificial Sequence
  Description of Artificial Sequence: Synthetic peptide
  Seed: GTLDSQVMSL (TYRP2_HUMAN)
GSLDSQVMSW

SEQ ID NO: 194403 - protein, 11 aa, Artificial Sequence
  Description of Artificial Sequence: Synthetic peptide
  Seed: YTPLMETHLSS (TYRP2_HUMAN)
YIPLMETHLSM

SEQ ID NO: 194404 - protein, 9 aa, Artificial Sequence
  Description of Artificial Sequence: Synthetic peptide
  Seed: TLLGPGRPY (TYRP2_HUMAN)
TTLGPGRPY

SEQ ID NO: 194405 - protein, 9 aa, Artificial Sequence
  Description of Artificial Sequence: Synthetic peptide
  Seed: RAIDFSHQG (TYRP2_HUMAN)
RAIDFSHQH

SEQ ID NO: 194406 - protein, 9 aa, Artificial Sequence
  Description of Artificial Sequence: Synthetic peptide
  Seed: RVCMTVDSL (TYRP2_HUMAN)
RMCMTVDSL

SEQ ID NO: 194407 - protein, 9 aa, Artificial Sequence
  Description of Artificial Sequence: Synthetic peptide
  Seed: DDYNHLVTL (TYRP2_HUMAN)
DLYNHLVTI

SEQ ID NO: 194408 - protein, 10 aa, Artificial Sequence
  Description of Artificial Sequence: Synthetic peptide
  Seed: SLHNLVHSFL (TYRP2_HUMAN)
SMHNLVHSFI

SEQ ID NO: 194409 - protein, 9 aa, Artificial Sequence
  Description of Artificial Sequence: Synthetic peptide
  Seed: LVHSFLNGT (TYRP2_HUMAN)
LQHSFLNGI

SEQ ID NO: 194410 - protein, 11 aa, Artificial Sequence
  Description of Artificial Sequence: Synthetic peptide
  Seed: RELWPRKFFHR (TYRP2_HUMAN)
RALWPRKFFHR

SEQ ID NO: 194411 - protein, 9 aa, Artificial Sequence
  Description of Artificial Sequence: Synthetic peptide
  Seed: AIFDEWMKR (TYRP2_HUMAN)
ATFDEWMKL

SEQ ID NO: 194412 - protein, 10 aa, Artificial Sequence
  Description of Artificial Sequence: Synthetic peptide
  Seed: RNSMKLPTLK (TYRP2_HUMAN)
RQSMKLPTLR

SEQ ID NO: 194413 - protein, 9 aa, Artificial Sequence
  Description of Artificial Sequence: Synthetic peptide
  Seed: ILPGAQGQF (TYRP2_HUMAN)
IAPGAQGQL

SEQ ID NO: 194414 - protein, 10 aa, Artificial Sequence
  Description of Artificial Sequence: Synthetic peptide
  Seed: RRLRKGYTPL (TYRP2_HUMAN)
RSLRKGYTPM

SEQ ID NO: 194415 - protein, 9 aa, Artificial Sequence
  Description of Artificial Sequence: Synthetic peptide
  Seed: LQKFDNPPF (TYRP2_HUMAN)
LLKFDNPPF

SEQ ID NO: 194416 - protein, 11 aa, Artificial Sequence
  Description of Artificial Sequence: Synthetic peptide
  Seed: YSYAIDLPVSV (TYRP2_HUMAN)
YMYAIDLPVSC

SEQ ID NO: 194417 - protein, 9 aa, Artificial Sequence
  Description of Artificial Sequence: Synthetic peptide
  Seed: SLDDYNHLV (TYRP2_HUMAN)
SFDDYNHLA

SEQ ID NO: 194418 - protein, 10 aa, Artificial Sequence
  Description of Artificial Sequence: Synthetic peptide
  Seed: RRLRKGYTPL (TYRP2_HUMAN)
RLLRKGYTPF

SEQ ID NO: 194419 - protein, 10 aa, Artificial Sequence
  Description of Artificial Sequence: Synthetic peptide
  Seed: RNSRFSSWET (TYRP2_HUMAN)
RLSRFSSWEI

SEQ ID NO: 194420 - protein, 9 aa, Artificial Sequence
  Description of Artificial Sequence: Synthetic peptide
  Seed: TSDQLGYSY (TYRP2_HUMAN)
TYDQLGYSF

SEQ ID NO: 194421 - protein, 10 aa, Artificial Sequence
  Description of Artificial Sequence: Synthetic peptide
  Seed: RLRKGYTPLM (TYRP2_HUMAN)
RSRKGYTPLV

SEQ ID NO: 194422 - protein, 9 aa, Artificial Sequence
  Description of Artificial Sequence: Synthetic peptide
  Seed: SRNSRFSSW (TYRP2_HUMAN)
SSNSRFSSY

SEQ ID NO: 194423 - protein, 9 aa, Artificial Sequence
  Description of Artificial Sequence: Synthetic peptide
  Seed: FTDAIFDEW (TYRP2_HUMAN)
FLDAIFDEM

SEQ ID NO: 194424 - protein, 11 aa, Artificial Sequence
  Description of Artificial Sequence: Synthetic peptide
  Seed: YNMVPFFPPVT (TYRP2_HUMAN)
YVMVPFFPPVH

SEQ ID NO: 194425 - protein, 9 aa, Artificial Sequence
  Description of Artificial Sequence: Synthetic peptide
  Seed: AANDPIFVV (TYRP2_HUMAN)
AANDPIFVL

SEQ ID NO: 194426 - protein, 9 aa, Artificial Sequence
  Description of Artificial Sequence: Synthetic peptide
  Seed: NMVPFFPPV (TYRP2_HUMAN)
NWVPFFPPY

SEQ ID NO: 194427 - protein, 9 aa, Artificial Sequence
  Description of Artificial Sequence: Synthetic peptide
  Seed: FPPVTNEEL (TYRP2_HUMAN)
FFPVTNEEL

SEQ ID NO: 194428 - protein, 10 aa, Artificial Sequence
  Description of Artificial Sequence: Synthetic peptide
  Seed: RNSMKLPTLK (TYRP2_HUMAN)
RHSMKLPTLK

SEQ ID NO: 194429 - protein, 10 aa, Artificial Sequence
  Description of Artificial Sequence: Synthetic peptide
  Seed: HNRMYNMVPF (TYRP2_HUMAN)
HHRMYNMVPM

SEQ ID NO: 194430 - protein, 10 aa, Artificial Sequence
  Description of Artificial Sequence: Synthetic peptide
  Seed: TLLGPGRPYR (TYRP2_HUMAN)
TVLGPGRPYR

SEQ ID NO: 194431 - protein, 9 aa, Artificial Sequence
  Description of Artificial Sequence: Synthetic peptide
  Seed: GPAFVTWHR (TYRP2_HUMAN)
GGAFVTWHR

SEQ ID NO: 194432 - protein, 10 aa, Artificial Sequence
  Description of Artificial Sequence: Synthetic peptide
  Seed: FFVWLHYYSV (TYRP2_HUMAN)
FDVWLHYYSV

SEQ ID NO: 194433 - protein, 10 aa, Artificial Sequence
  Description of Artificial Sequence: Synthetic peptide
  Seed: FVWLHYYSVR (TYRP2_HUMAN)
FMWLHYYSVV

SEQ ID NO: 194434 - protein, 11 aa, Artificial Sequence
  Description of Artificial Sequence: Synthetic peptide
  Seed: RMYNMVPFFPP (TYRP2_HUMAN)
RIYNMVPFFPV

SEQ ID NO: 194435 - protein, 9 aa, Artificial Sequence
  Description of Artificial Sequence: Synthetic peptide
  Seed: SLHNLVHSF (TYRP2_HUMAN)
SIHNLVHSY

SEQ ID NO: 194436 - protein, 8 aa, Artificial Sequence
  Description of Artificial Sequence: Synthetic peptide
  Seed: QFANCSVY (TYRP2_HUMAN)
QYANCSVF

SEQ ID NO: 194437 - protein, 10 aa, Artificial Sequence
  Description of Artificial Sequence: Synthetic peptide
  Seed: YNMVPFFPPV (TYRP2_HUMAN)
YQMVPFFPPS

SEQ ID NO: 194438 - protein, 9 aa, Artificial Sequence
  Description of Artificial Sequence: Synthetic peptide
  Seed: RLRKGYTPL (TYRP2_HUMAN)
RFRKGYTPK

SEQ ID NO: 194439 - protein, 10 aa, Artificial Sequence
  Description of Artificial Sequence: Synthetic peptide
  Seed: VGLFVLLAFL (TYRP2_HUMAN)
VSLFVLLAFV

SEQ ID NO: 194440 - protein, 10 aa, Artificial Sequence
  Description of Artificial Sequence: Synthetic peptide
  Seed: AIFDEWMKRF (TYRP2_HUMAN)
ALFDEWMKRR

SEQ ID NO: 194441 - protein, 11 aa, Artificial Sequence
  Description of Artificial Sequence: Synthetic peptide
  Seed: LISRNSRFSSW (TYRP2_HUMAN)
LSSRNSRFSSF

SEQ ID NO: 194442 - protein, 9 aa, Artificial Sequence
  Description of Artificial Sequence: Synthetic peptide
  Seed: ELWPRKFFH (TYRP2_HUMAN)
EPWPRKFFR

SEQ ID NO: 194443 - protein, 10 aa, Artificial Sequence
  Description of Artificial Sequence: Synthetic peptide
  Seed: FFQNSTFSFR (TYRP2_HUMAN)
FFQNSTFSFK

SEQ ID NO: 194444 - protein, 9 aa, Artificial Sequence
  Description of Artificial Sequence: Synthetic peptide
  Seed: GAQGQFPRV (TYRP2_HUMAN)
GVQGQFPRV

SEQ ID NO: 194445 - protein, 9 aa, Artificial Sequence
  Description of Artificial Sequence: Synthetic peptide
  Seed: AARPDDPTL (TYRP2_HUMAN)
AMRPDDPTI

SEQ ID NO: 194446 - protein, 9 aa, Artificial Sequence
  Description of Artificial Sequence: Synthetic peptide
  Seed: VTWHRYHLL (TYRP2_HUMAN)
VMWHRYHLR

SEQ ID NO: 194447 - protein, 11 aa, Artificial Sequence
  Description of Artificial Sequence: Synthetic peptide
  Seed: FQNSTFSFRNA (TYRP2_HUMAN)
FQNSTFSFRNV

SEQ ID NO: 194448 - protein, 10 aa, Artificial Sequence
  Description of Artificial Sequence: Synthetic peptide
  Seed: RLRKGYTPLM (TYRP2_HUMAN)
RVRKGYTPLI

SEQ ID NO: 194449 - protein, 9 aa, Artificial Sequence
  Description of Artificial Sequence: Synthetic peptide
  Seed: SFLNGTNAL (TYRP2_HUMAN)
SQLNGTNAF

SEQ ID NO: 194450 - protein, 10 aa, Artificial Sequence
  Description of Artificial Sequence: Synthetic peptide
  Seed: MTVDSLVNKE (TYRP2_HUMAN)
MAVDSLVNKR

SEQ ID NO: 194451 - protein, 9 aa, Artificial Sequence
  Description of Artificial Sequence: Synthetic peptide
  Seed: SVYDFFVWL (TYRP2_HUMAN)
SQYDFFVWI

SEQ ID NO: 194452 - protein, 9 aa, Artificial Sequence
  Description of Artificial Sequence: Synthetic peptide
  Seed: WMKRFNPPA (TYRP2_HUMAN)
WYKRFNPPK

SEQ ID NO: 194453 - protein, 10 aa, Artificial Sequence
  Description of Artificial Sequence: Synthetic peptide
  Seed: RTCKCTGNFA (TYRP2_HUMAN)
RVCKCTGNFL

SEQ ID NO: 194454 - protein, 10 aa, Artificial Sequence
  Description of Artificial Sequence: Synthetic peptide
  Seed: QPQFANCSVY (TYRP2_HUMAN)
QMQFANCSVW

SEQ ID NO: 194455 - protein, 9 aa, Artificial Sequence
  Description of Artificial Sequence: Synthetic peptide
  Seed: MSPLWWGFL (TYRP2_HUMAN)
MTPLWWGFL

SEQ ID NO: 194456 - protein, 10 aa, Artificial Sequence
  Description of Artificial Sequence: Synthetic peptide
  Seed: LISRNSRFSS (TYRP2_HUMAN)
LMSRNSRFSA

SEQ ID NO: 194457 - protein, 10 aa, Artificial Sequence
  Description of Artificial Sequence: Synthetic peptide
  Seed: CMTVDSLVNK (TYRP2_HUMAN)
CMTVDSLVNR

SEQ ID NO: 194458 - protein, 9 aa, Artificial Sequence
  Description of Artificial Sequence: Synthetic peptide
  Seed: AANDPIFVV (TYRP2_HUMAN)
AQNDPIFVM

SEQ ID NO: 194459 - protein, 9 aa, Artificial Sequence
  Description of Artificial Sequence: Synthetic peptide
  Seed: LWPRKFFHR (TYRP2_HUMAN)
LSPRKFFHR

SEQ ID NO: 194460 - protein, 10 aa, Artificial Sequence
  Description of Artificial Sequence: Synthetic peptide
  Seed: FLLSCLGCKI (TYRP2_HUMAN)
FLLSCLGCKM

SEQ ID NO: 194461 - protein, 9 aa, Artificial Sequence
  Description of Artificial Sequence: Synthetic peptide
  Seed: FANCSVYDF (TYRP2_HUMAN)
FPNCSVYDW

SEQ ID NO: 194462 - protein, 10 aa, Artificial Sequence
  Description of Artificial Sequence: Synthetic peptide
  Seed: LVVMGTLVAL (TYRP2_HUMAN)
LPVMGTLVAI

SEQ ID NO: 194463 - protein, 9 aa, Artificial Sequence
  Description of Artificial Sequence: Synthetic peptide
  Seed: NMVPFFPPV (TYRP2_HUMAN)
NMVPFFPPK

SEQ ID NO: 194464 - protein, 9 aa, Artificial Sequence
  Description of Artificial Sequence: Synthetic peptide
  Seed: SQVMSLHNL (TYRP2_HUMAN)
SIVMSLHNV

SEQ ID NO: 194465 - protein, 10 aa, Artificial Sequence
  Description of Artificial Sequence: Synthetic peptide
  Seed: HSFLNGTNAL (TYRP2_HUMAN)
HLFLNGTNAY

SEQ ID NO: 194466 - protein, 9 aa, Artificial Sequence
  Description of Artificial Sequence: Synthetic peptide
  Seed: KDIRDCLSL (TYRP2_HUMAN)
KEIRDCLSV

SEQ ID NO: 194467 - protein, 9 aa, Artificial Sequence
  Description of Artificial Sequence: Synthetic peptide
  Seed: VLLAFLQYR (TYRP2_HUMAN)
VFLAFLQYR

SEQ ID NO: 194468 - protein, 9 aa, Artificial Sequence
  Description of Artificial Sequence: Synthetic peptide
  Seed: YAIDLPVSV (TYRP2_HUMAN)
YQIDLPVSF

SEQ ID NO: 194469 - protein, 11 aa, Artificial Sequence
  Description of Artificial Sequence: Synthetic peptide
  Seed: QPQFANCSVYD (TYRP2_HUMAN)
QIQFANCSVYF

SEQ ID NO: 194470 - protein, 9 aa, Artificial Sequence
  Description of Artificial Sequence: Synthetic peptide
  Seed: QVMSLHNLV (TYRP2_HUMAN)
QMMSLHNLM

SEQ ID NO: 194471 - protein, 10 aa, Artificial Sequence
  Description of Artificial Sequence: Synthetic peptide
  Seed: RRLRKGYTPL (TYRP2_HUMAN)
RNLRKGYTPF

SEQ ID NO: 194472 - protein, 9 aa, Artificial Sequence
  Description of Artificial Sequence: Synthetic peptide
  Seed: SLDDYNHLV (TYRP2_HUMAN)
SADDYNHLY

SEQ ID NO: 194473 - protein, 11 aa, Artificial Sequence
  Description of Artificial Sequence: Synthetic peptide
  Seed: QFLGALDLAKK (TYRP2_HUMAN)
QILGALDLAKK

SEQ ID NO: 194474 - protein, 9 aa, Artificial Sequence
  Description of Artificial Sequence: Synthetic peptide
  Seed: KECCPRLGA (TYRP2_HUMAN)
KECCPRLGL

SEQ ID NO: 194475 - protein, 9 aa, Artificial Sequence
  Description of Artificial Sequence: Synthetic peptide
  Seed: SQVMSLHNL (TYRP2_HUMAN)
SMVMSLHNA

SEQ ID NO: 194476 - protein, 10 aa, Artificial Sequence
  Description of Artificial Sequence: Synthetic peptide
  Seed: TRPWSGPYIL (TYRP2_HUMAN)
TMPWSGPYIM

SEQ ID NO: 194477 - protein, 10 aa, Artificial Sequence
  Description of Artificial Sequence: Synthetic peptide
  Seed: MSPLWWGFLL (TYRP2_HUMAN)
MPPLWWGFLL

SEQ ID NO: 194478 - protein, 10 aa, Artificial Sequence
  Description of Artificial Sequence: Synthetic peptide
  Seed: FLLSCLGCKI (TYRP2_HUMAN)
FHLSCLGCKL

SEQ ID NO: 194479 - protein, 9 aa, Artificial Sequence
  Description of Artificial Sequence: Synthetic peptide
  Seed: TTQHWLGLL (TYRP2_HUMAN)
TSQHWLGLW

SEQ ID NO: 194480 - protein, 11 aa, Artificial Sequence
  Description of Artificial Sequence: Synthetic peptide
  Seed: RNSRFSSWETV (TYRP2_HUMAN)
RQSRFSSWETF

SEQ ID NO: 194481 - protein, 9 aa, Artificial Sequence
  Description of Artificial Sequence: Synthetic peptide
  Seed: RLRKGYTPL (TYRP2_HUMAN)
RNRKGYTPF

SEQ ID NO: 194482 - protein, 9 aa, Artificial Sequence
  Description of Artificial Sequence: Synthetic peptide
  Seed: AARPDDPTL (TYRP2_HUMAN)
AYRPDDPTF

SEQ ID NO: 194483 - protein, 9 aa, Artificial Sequence
  Description of Artificial Sequence: Synthetic peptide
  Seed: GFDKADGTL (TYRP2_HUMAN)
GFDKADGTM

SEQ ID NO: 194484 - protein, 11 aa, Artificial Sequence
  Description of Artificial Sequence: Synthetic peptide
  Seed: FANCSVYDFFV (TYRP2_HUMAN)
FMNCSVYDFFI

SEQ ID NO: 194485 - protein, 9 aa, Artificial Sequence
  Description of Artificial Sequence: Synthetic peptide
  Seed: TPGWPTTLL (TYRP2_HUMAN)
TAGWPTTLW

SEQ ID NO: 194486 - protein, 11 aa, Artificial Sequence
  Description of Artificial Sequence: Synthetic peptide
  Seed: VCDSLDDYNHL (TYRP2_HUMAN)
VWDSLDDYNHL

SEQ ID NO: 194487 - protein, 10 aa, Artificial Sequence
  Description of Artificial Sequence: Synthetic peptide
  Seed: FLTSDQLGYS (TYRP2_HUMAN)
FTTSDQLGYV

SEQ ID NO: 194488 - protein, 11 aa, Artificial Sequence
  Description of Artificial Sequence: Synthetic peptide
  Seed: SLDDYNHLVTL (TYRP2_HUMAN)
SFDDYNHLVTF

SEQ ID NO: 194489 - protein, 9 aa, Artificial Sequence
  Description of Artificial Sequence: Synthetic peptide
  Seed: APIGHNRMY (TYRP2_HUMAN)
ALIGHNRMY

SEQ ID NO: 194490 - protein, 9 aa, Artificial Sequence
  Description of Artificial Sequence: Synthetic peptide
  Seed: SVYDFFVWL (TYRP2_HUMAN)
SLYDFFVWY

SEQ ID NO: 194491 - protein, 9 aa, Artificial Sequence
  Description of Artificial Sequence: Synthetic peptide
  Seed: TLISRNSRF (TYRP2_HUMAN)
TKISRNSRF

SEQ ID NO: 194492 - protein, 10 aa, Artificial Sequence
  Description of Artificial Sequence: Synthetic peptide
  Seed: RRLRKGYTPL (TYRP2_HUMAN)
RWLRKGYTPK

SEQ ID NO: 194493 - protein, 10 aa, Artificial Sequence
  Description of Artificial Sequence: Synthetic peptide
  Seed: RNSMKLPTLK (TYRP2_HUMAN)
RRSMKLPTLK

SEQ ID NO: 194494 - protein, 10 aa, Artificial Sequence
  Description of Artificial Sequence: Synthetic peptide
  Seed: VVMGTLVALV (TYRP2_HUMAN)
VFMGTLVALL

SEQ ID NO: 194495 - protein, 10 aa, Artificial Sequence
  Description of Artificial Sequence: Synthetic peptide
  Seed: LVVMGTLVAL (TYRP2_HUMAN)
LMVMGTLVAL

SEQ ID NO: 194496 - protein, 9 aa, Artificial Sequence
  Description of Artificial Sequence: Synthetic peptide
  Seed: TLDSQVMSL (TYRP2_HUMAN)
TIDSQVMSV

SEQ ID NO: 194497 - protein, 9 aa, Artificial Sequence
  Description of Artificial Sequence: Synthetic peptide
  Seed: YSYAIDLPV (TYRP2_HUMAN)
YTYAIDLPF

SEQ ID NO: 194498 - protein, 9 aa, Artificial Sequence
  Description of Artificial Sequence: Synthetic peptide
  Seed: FFPPVTNEE (TYRP2_HUMAN)
FFPPVTNEF

SEQ ID NO: 194499 - protein, 10 aa, Artificial Sequence
  Description of Artificial Sequence: Synthetic peptide
  Seed: RLRKGYTPLM (TYRP2_HUMAN)
RSRKGYTPLT

SEQ ID NO: 194500 - protein, 9 aa, Artificial Sequence
  Description of Artificial Sequence: Synthetic peptide
  Seed: RFNPPADAW (TYRP2_HUMAN)
RINPPADAW

SEQ ID NO: 194501 - protein, 10 aa, Artificial Sequence
  Description of Artificial Sequence: Synthetic peptide
  Seed: FLLSCLGCKI (TYRP2_HUMAN)
FMLSCLGCKA

SEQ ID NO: 194502 - protein, 9 aa, Artificial Sequence
  Description of Artificial Sequence: Synthetic peptide
  Seed: ALVGLFVLL (TYRP2_HUMAN)
AAVGLFVLM

SEQ ID NO: 194503 - protein, 10 aa, Artificial Sequence
  Description of Artificial Sequence: Synthetic peptide
  Seed: LHYYSVRDTL (TYRP2_HUMAN)
LGYYSVRDTL

SEQ ID NO: 194504 - protein, 10 aa, Artificial Sequence
  Description of Artificial Sequence: Synthetic peptide
  Seed: SVRDTLLGPG (TYRP2_HUMAN)
STRDTLLGPV

SEQ ID NO: 194505 - protein, 9 aa, Artificial Sequence
  Description of Artificial Sequence: Synthetic peptide
  Seed: VPFFPPVTN (TYRP2_HUMAN)
VPFFPPVTI

SEQ ID NO: 194506 - protein, 8 aa, Artificial Sequence
  Description of Artificial Sequence: Synthetic peptide
  Seed: FQNSTFSF (TYRP2_HUMAN)
FSNSTFSF

SEQ ID NO: 194507 - protein, 10 aa, Artificial Sequence
  Description of Artificial Sequence: Synthetic peptide
  Seed: RLRKGYTPLM (TYRP2_HUMAN)
RTRKGYTPLA

SEQ ID NO: 194508 - protein, 10 aa, Artificial Sequence
  Description of Artificial Sequence: Synthetic peptide
  Seed: QPQFANCSVY (TYRP2_HUMAN)
QGQFANCSVM

SEQ ID NO: 194509 - protein, 11 aa, Artificial Sequence
  Description of Artificial Sequence: Synthetic peptide
  Seed: RADTRPWSGPY (TYRP2_HUMAN)
RMDTRPWSGPA

SEQ ID NO: 194510 - protein, 9 aa, Artificial Sequence
  Description of Artificial Sequence: Synthetic peptide
  Seed: VVMGTLVAL (TYRP2_HUMAN)
VPMGTLVAC

SEQ ID NO: 194511 - protein, 11 aa, Artificial Sequence
  Description of Artificial Sequence: Synthetic peptide
  Seed: SLDDYNHLVTL (TYRP2_HUMAN)
SQDDYNHLVTF

SEQ ID NO: 194512 - protein, 10 aa, Artificial Sequence
  Description of Artificial Sequence: Synthetic peptide
  Seed: FLLSCLGCKI (TYRP2_HUMAN)
FTLSCLGCKV

SEQ ID NO: 194513 - protein, 11 aa, Artificial Sequence
  Description of Artificial Sequence: Synthetic peptide
  Seed: YSYAIDLPVSV (TYRP2_HUMAN)
YIYAIDLPVSV

SEQ ID NO: 194514 - protein, 9 aa, Artificial Sequence
  Description of Artificial Sequence: Synthetic peptide
  Seed: SFLNGTNAL (TYRP2_HUMAN)
SSLNGTNAL

SEQ ID NO: 194515 - protein, 9 aa, Artificial Sequence
  Description of Artificial Sequence: Synthetic peptide
  Seed: VIRQNIHSL (TYRP2_HUMAN)
VSRQNIHSY

SEQ ID NO: 194516 - protein, 10 aa, Artificial Sequence
  Description of Artificial Sequence: Synthetic peptide
  Seed: HSFLNGTNAL (TYRP2_HUMAN)
HRFLNGTNAM

SEQ ID NO: 194517 - protein, 10 aa, Artificial Sequence
  Description of Artificial Sequence: Synthetic peptide
  Seed: LHYYSVRDTL (TYRP2_HUMAN)
LAYYSVRDTW

SEQ ID NO: 194518 - protein, 10 aa, Artificial Sequence
  Description of Artificial Sequence: Synthetic peptide
  Seed: LKDIRDCLSL (TYRP2_HUMAN)
LQDIRDCLSF

SEQ ID NO: 194519 - protein, 10 aa, Artificial Sequence
  Description of Artificial Sequence: Synthetic peptide
  Seed: RLIGNESFAL (TYRP2_HUMAN)
RTIGNESFAF

SEQ ID NO: 194520 - protein, 9 aa, Artificial Sequence
  Description of Artificial Sequence: Synthetic peptide
  Seed: VVMGTLVAL (TYRP2_HUMAN)
VIMGTLVAA

SEQ ID NO: 194521 - protein, 9 aa, Artificial Sequence
  Description of Artificial Sequence: Synthetic peptide
  Seed: VTWHRYHLL (TYRP2_HUMAN)
VTWHRYHLF

SEQ ID NO: 194522 - protein, 9 aa, Artificial Sequence
  Description of Artificial Sequence: Synthetic peptide
  Seed: SQVMSLHNL (TYRP2_HUMAN)
SVVMSLHNI

SEQ ID NO: 194523 - protein, 10 aa, Artificial Sequence
  Description of Artificial Sequence: Synthetic peptide
  Seed: RNSRFSSWET (TYRP2_HUMAN)
RASRFSSWEK

SEQ ID NO: 194524 - protein, 11 aa, Artificial Sequence
  Description of Artificial Sequence: Synthetic peptide
  Seed: SLDDYNHLVTL (TYRP2_HUMAN)
SCDDYNHLVTM

SEQ ID NO: 194525 - protein, 10 aa, Artificial Sequence
  Description of Artificial Sequence: Synthetic peptide
  Seed: SAANDPIFVV (TYRP2_HUMAN)
STANDPIFVI

SEQ ID NO: 194526 - protein, 11 aa, Artificial Sequence
  Description of Artificial Sequence: Synthetic peptide
  Seed: HPDYVITTQHW (TYRP2_HUMAN)
HWDYVITTQHF

SEQ ID NO: 194527 - protein, 9 aa, Artificial Sequence
  Description of Artificial Sequence: Synthetic peptide
  Seed: VWLHYYSVR (TYRP2_HUMAN)
VYLHYYSVR

SEQ ID NO: 194528 - protein, 10 aa, Artificial Sequence
  Description of Artificial Sequence: Synthetic peptide
  Seed: RNSMKLPTLK (TYRP2_HUMAN)
RTSMKLPTLR

SEQ ID NO: 194529 - protein, 10 aa, Artificial Sequence
  Description of Artificial Sequence: Synthetic peptide
  Seed: NLVHSFLNGT (TYRP2_HUMAN)
NMVHSFLNGI

SEQ ID NO: 194530 - protein, 10 aa, Artificial Sequence
  Description of Artificial Sequence: Synthetic peptide
  Seed: REQFLGALDL (TYRP2_HUMAN)
RCQFLGALDM

SEQ ID NO: 194531 - protein, 11 aa, Artificial Sequence
  Description of Artificial Sequence: Synthetic peptide
  Seed: ARPDDPTLISR (TYRP2_HUMAN)
ARPDDPTLISY

SEQ ID NO: 194532 - protein, 9 aa, Artificial Sequence
  Description of Artificial Sequence: Synthetic peptide
  Seed: RLRKGYTPL (TYRP2_HUMAN)
RLRKGYTPG

SEQ ID NO: 194533 - protein, 10 aa, Artificial Sequence
  Description of Artificial Sequence: Synthetic peptide
  Seed: ELAPIGHNRM (TYRP2_HUMAN)
EVAPIGHNRV

SEQ ID NO: 194534 - protein, 9 aa, Artificial Sequence
  Description of Artificial Sequence: Synthetic peptide
  Seed: MTVDSLVNK (TYRP2_HUMAN)
MLVDSLVNL

SEQ ID NO: 194535 - protein, 9 aa, Artificial Sequence
  Description of Artificial Sequence: Synthetic peptide
  Seed: VTWHRYHLL (TYRP2_HUMAN)
VMWHRYHLL

SEQ ID NO: 194536 - protein, 11 aa, Artificial Sequence
  Description of Artificial Sequence: Synthetic peptide
  Seed: YNMVPFFPPVT (TYRP2_HUMAN)
YVMVPFFPPVN

SEQ ID NO: 194537 - protein, 10 aa, Artificial Sequence
  Description of Artificial Sequence: Synthetic peptide
  Seed: SLQKFDNPPF (TYRP2_HUMAN)
SIQKFDNPPY

SEQ ID NO: 194538 - protein, 9 aa, Artificial Sequence
  Description of Artificial Sequence: Synthetic peptide
  Seed: RLGAESANV (TYRP2_HUMAN)
RQGAESANL

SEQ ID NO: 194539 - protein, 9 aa, Artificial Sequence
  Description of Artificial Sequence: Synthetic peptide
  Seed: STFSFRNAL (TYRP2_HUMAN)
SSFSFRNAV

SEQ ID NO: 194540 - protein, 10 aa, Artificial Sequence
  Description of Artificial Sequence: Synthetic peptide
  Seed: LTSDQLGYSY (TYRP2_HUMAN)
LTSDQLGYSF

SEQ ID NO: 194541 - protein, 10 aa, Artificial Sequence
  Description of Artificial Sequence: Synthetic peptide
  Seed: QFLGALDLAK (TYRP2_HUMAN)
QTLGALDLAK

SEQ ID NO: 194542 - protein, 10 aa, Artificial Sequence
  Description of Artificial Sequence: Synthetic peptide
  Seed: FQNSTFSFRN (TYRP2_HUMAN)
FMNSTFSFRR

SEQ ID NO: 194543 - protein, 9 aa, Artificial Sequence
  Description of Artificial Sequence: Synthetic peptide
  Seed: YTPLMETHL (TYRP2_HUMAN)
YSPLMETHM

SEQ ID NO: 194544 - protein, 9 aa, Artificial Sequence
  Description of Artificial Sequence: Synthetic peptide
  Seed: YDFFVWLHY (TYRP2_HUMAN)
YEFFVWLHY

SEQ ID NO: 194545 - protein, 9 aa, Artificial Sequence
  Description of Artificial Sequence: Synthetic peptide
  Seed: GPNGTQPQF (TYRP2_HUMAN)
GVNGTQPQY

SEQ ID NO: 194546 - protein, 9 aa, Artificial Sequence
  Description of Artificial Sequence: Synthetic peptide
  Seed: GPAFVTWHR (TYRP2_HUMAN)
GAAFVTWHK

SEQ ID NO: 194547 - protein, 10 aa, Artificial Sequence
  Description of Artificial Sequence: Synthetic peptide
  Seed: ISRNSRFSSW (TYRP2_HUMAN)
ITRNSRFSSY

SEQ ID NO: 194548 - protein, 9 aa, Artificial Sequence
  Description of Artificial Sequence: Synthetic peptide
  Seed: AARPDDPTL (TYRP2_HUMAN)
ARRPDDPTF

SEQ ID NO: 194549 - protein, 9 aa, Artificial Sequence
  Description of Artificial Sequence: Synthetic peptide
  Seed: STFSFRNAL (TYRP2_HUMAN)
SMFSFRNAF

SEQ ID NO: 194550 - protein, 10 aa, Artificial Sequence
  Description of Artificial Sequence: Synthetic peptide
  Seed: TRPWSGPYIL (TYRP2_HUMAN)
TWPWSGPYIY

SEQ ID NO: 194551 - protein, 9 aa, Artificial Sequence
  Description of Artificial Sequence: Synthetic peptide
  Seed: NQMGRNSMK (TYRP2_HUMAN)
NTMGRNSMK

SEQ ID NO: 194552 - protein, 9 aa, Artificial Sequence
  Description of Artificial Sequence: Synthetic peptide
  Seed: VDSLVNKEC (TYRP2_HUMAN)
VDSLVNKEL

SEQ ID NO: 194553 - protein, 9 aa, Artificial Sequence
  Description of Artificial Sequence: Synthetic peptide
  Seed: FSHQGPAFV (TYRP2_HUMAN)
FAHQGPAFW

SEQ ID NO: 194554 - protein, 10 aa, Artificial Sequence
  Description of Artificial Sequence: Synthetic peptide
  Seed: GTLDSQVMSL (TYRP2_HUMAN)
GLLDSQVMSA

SEQ ID NO: 194555 - protein, 9 aa, Artificial Sequence
  Description of Artificial Sequence: Synthetic peptide
  Seed: TDQLFGAAR (TYRP2_HUMAN)
TAQLFGAAL

SEQ ID NO: 194556 - protein, 9 aa, Artificial Sequence
  Description of Artificial Sequence: Synthetic peptide
  Seed: FQNSTFSFR (TYRP2_HUMAN)
FGNSTFSFK

SEQ ID NO: 194557 - protein, 9 aa, Artificial Sequence
  Description of Artificial Sequence: Synthetic peptide
  Seed: SVRDTLLGP (TYRP2_HUMAN)
SQRDTLLGK

SEQ ID NO: 194558 - protein, 9 aa, Artificial Sequence
  Description of Artificial Sequence: Synthetic peptide
  Seed: SVYDFFVWL (TYRP2_HUMAN)
SLYDFFVWF

SEQ ID NO: 194559 - protein, 11 aa, Artificial Sequence
  Description of Artificial Sequence: Synthetic peptide
  Seed: FLTSDQLGYSY (TYRP2_HUMAN)
FQTSDQLGYSY

SEQ ID NO: 194560 - protein, 9 aa, Artificial Sequence
  Description of Artificial Sequence: Synthetic peptide
  Seed: AQGQFPRVC (TYRP2_HUMAN)
AEGQFPRVA

SEQ ID NO: 194561 - protein, 9 aa, Artificial Sequence
  Description of Artificial Sequence: Synthetic peptide
  Seed: RKFFHRTCK (TYRP2_HUMAN)
RTFFHRTCP

SEQ ID NO: 194562 - protein, 9 aa, Artificial Sequence
  Description of Artificial Sequence: Synthetic peptide
  Seed: TSDQLGYSY (TYRP2_HUMAN)
TYDQLGYSM

SEQ ID NO: 194563 - protein, 10 aa, Artificial Sequence
  Description of Artificial Sequence: Synthetic peptide
  Seed: SLQKFDNPPF (TYRP2_HUMAN)
SMQKFDNPPF

SEQ ID NO: 194564 - protein, 9 aa, Artificial Sequence
  Description of Artificial Sequence: Synthetic peptide
  Seed: YVITTQHWL (TYRP2_HUMAN)
YTITTQHWM

SEQ ID NO: 194565 - protein, 9 aa, Artificial Sequence
  Description of Artificial Sequence: Synthetic peptide
  Seed: FTDAIFDEW (TYRP2_HUMAN)
FMDAIFDEF

SEQ ID NO: 194566 - protein, 10 aa, Artificial Sequence
  Description of Artificial Sequence: Synthetic peptide
  Seed: YNMVPFFPPV (TYRP2_HUMAN)
YQMVPFFPPC

SEQ ID NO: 194567 - protein, 9 aa, Artificial Sequence
  Description of Artificial Sequence: Synthetic peptide
  Seed: ALVGLFVLL (TYRP2_HUMAN)
AMVGLFVLR

SEQ ID NO: 194568 - protein, 9 aa, Artificial Sequence
  Description of Artificial Sequence: Synthetic peptide
  Seed: WHRYHLLCL (TYRP2_HUMAN)
WKRYHLLCM

SEQ ID NO: 194569 - protein, 9 aa, Artificial Sequence
  Description of Artificial Sequence: Synthetic peptide
  Seed: SLHNLVHSF (TYRP2_HUMAN)
SVHNLVHSR

SEQ ID NO: 194570 - protein, 10 aa, Artificial Sequence
  Description of Artificial Sequence: Synthetic peptide
  Seed: RNSRFSSWET (TYRP2_HUMAN)
RDSRFSSWEM

SEQ ID NO: 194571 - protein, 9 aa, Artificial Sequence
  Description of Artificial Sequence: Synthetic peptide
  Seed: VIRQNIHSL (TYRP2_HUMAN)
VVRQNIHSV

SEQ ID NO: 194572 - protein, 9 aa, Artificial Sequence
  Description of Artificial Sequence: Synthetic peptide
  Seed: MTVDSLVNK (TYRP2_HUMAN)
MLVDSLVNM

SEQ ID NO: 194573 - protein, 10 aa, Artificial Sequence
  Description of Artificial Sequence: Synthetic peptide
  Seed: AANDPIFVVL (TYRP2_HUMAN)
ASNDPIFVVF

SEQ ID NO: 194574 - protein, 11 aa, Artificial Sequence
  Description of Artificial Sequence: Synthetic peptide
  Seed: WLHYYSVRDTL (TYRP2_HUMAN)
WPHYYSVRDTF

SEQ ID NO: 194575 - protein, 10 aa, Artificial Sequence
  Description of Artificial Sequence: Synthetic peptide
  Seed: YNMVPFFPPV (TYRP2_HUMAN)
YRMVPFFPPL

SEQ ID NO: 194576 - protein, 10 aa, Artificial Sequence
  Description of Artificial Sequence: Synthetic peptide
  Seed: TLCNGTYEGL (TYRP2_HUMAN)
TMCNGTYEGV

SEQ ID NO: 194577 - protein, 9 aa, Artificial Sequence
  Description of Artificial Sequence: Synthetic peptide
  Seed: SLDDYNHLV (TYRP2_HUMAN)
SFDDYNHLW

SEQ ID NO: 194578 - protein, 9 aa, Artificial Sequence
  Description of Artificial Sequence: Synthetic peptide
  Seed: FVWLHYYSV (TYRP2_HUMAN)
FAWLHYYSI

SEQ ID NO: 194579 - protein, 9 aa, Artificial Sequence
  Description of Artificial Sequence: Synthetic peptide
  Seed: RKFFHRTCK (TYRP2_HUMAN)
RTFFHRTCY

SEQ ID NO: 194580 - protein, 9 aa, Artificial Sequence
  Description of Artificial Sequence: Synthetic peptide
  Seed: LSPQEREQF (TYRP2_HUMAN)
LVPQEREQL

SEQ ID NO: 194581 - protein, 9 aa, Artificial Sequence
  Description of Artificial Sequence: Synthetic peptide
  Seed: ESANVCGSQ (TYRP2_HUMAN)
EIANVCGSY

SEQ ID NO: 194582 - protein, 10 aa, Artificial Sequence
  Description of Artificial Sequence: Synthetic peptide
  Seed: GQFPRVCMTV (TYRP2_HUMAN)
GVFPRVCMTL

SEQ ID NO: 194583 - protein, 9 aa, Artificial Sequence
  Description of Artificial Sequence: Synthetic peptide
  Seed: HSFLNGTNA (TYRP2_HUMAN)
HHFLNGTNV

SEQ ID NO: 194584 - protein, 9 aa, Artificial Sequence
  Description of Artificial Sequence: Synthetic peptide
  Seed: YAIDLPVSV (TYRP2_HUMAN)
YIIDLPVSK

SEQ ID NO: 194585 - protein, 11 aa, Artificial Sequence
  Description of Artificial Sequence: Synthetic peptide
  Seed: WLHYYSVRDTL (TYRP2_HUMAN)
WGHYYSVRDTF

SEQ ID NO: 194586 - protein, 8 aa, Artificial Sequence
  Description of Artificial Sequence: Synthetic peptide
  Seed: IFVVLHSF (TYRP2_HUMAN)
IYVVLHSF

SEQ ID NO: 194587 - protein, 9 aa, Artificial Sequence
  Description of Artificial Sequence: Synthetic peptide
  Seed: QVMSLHNLV (TYRP2_HUMAN)
QQMSLHNLL

SEQ ID NO: 194588 - protein, 11 aa, Artificial Sequence
  Description of Artificial Sequence: Synthetic peptide
  Seed: SQVMSLHNLVH (TYRP2_HUMAN)
SMVMSLHNLVF

SEQ ID NO: 194589 - protein, 9 aa, Artificial Sequence
  Description of Artificial Sequence: Synthetic peptide
  Seed: ETHLSSKRY (TYRP2_HUMAN)
ETHLSSKRR

SEQ ID NO: 194590 - protein, 9 aa, Artificial Sequence
  Description of Artificial Sequence: Synthetic peptide
  Seed: RDCLSLQKF (TYRP2_HUMAN)
RECLSLQKM

SEQ ID NO: 194591 - protein, 9 aa, Artificial Sequence
  Description of Artificial Sequence: Synthetic peptide
  Seed: TLDSQVMSL (TYRP2_HUMAN)
TRDSQVMSY

SEQ ID NO: 194592 - protein, 9 aa, Artificial Sequence
  Description of Artificial Sequence: Synthetic peptide
  Seed: RLRKGYTPL (TYRP2_HUMAN)
RYRKGYTPL

SEQ ID NO: 194593 - protein, 9 aa, Artificial Sequence
  Description of Artificial Sequence: Synthetic peptide
  Seed: YDFFVWLHY (TYRP2_HUMAN)
YHFFVWLHY

SEQ ID NO: 194594 - protein, 9 aa, Artificial Sequence
  Description of Artificial Sequence: Synthetic peptide
  Seed: FFQNSTFSF (TYRP2_HUMAN)
FCQNSTFSY

SEQ ID NO: 194595 - protein, 10 aa, Artificial Sequence
  Description of Artificial Sequence: Synthetic peptide
  Seed: MSLHNLVHSF (TYRP2_HUMAN)
MMLHNLVHSW

SEQ ID NO: 194596 - protein, 9 aa, Artificial Sequence
  Description of Artificial Sequence: Synthetic peptide
  Seed: TTQHWLGLL (TYRP2_HUMAN)
TMQHWLGLI

SEQ ID NO: 194597 - protein, 10 aa, Artificial Sequence
  Description of Artificial Sequence: Synthetic peptide
  Seed: FVWLHYYSVR (TYRP2_HUMAN)
FMWLHYYSVS

SEQ ID NO: 194598 - protein, 9 aa, Artificial Sequence
  Description of Artificial Sequence: Synthetic peptide
  Seed: FLQYRRLRK (TYRP2_HUMAN)
FMQYRRLRK

SEQ ID NO: 194599 - protein, 11 aa, Artificial Sequence
  Description of Artificial Sequence: Synthetic peptide
  Seed: FFPPVTNEELF (TYRP2_HUMAN)
FTPPVTNEELW

SEQ ID NO: 194600 - protein, 9 aa, Artificial Sequence
  Description of Artificial Sequence: Synthetic peptide
  Seed: NMVPFFPPV (TYRP2_HUMAN)
NQVPFFPPF

SEQ ID NO: 194601 - protein, 9 aa, Artificial Sequence
  Description of Artificial Sequence: Synthetic peptide
  Seed: YSYAIDLPV (TYRP2_HUMAN)
YHYAIDLPW

SEQ ID NO: 194602 - protein, 9 aa, Artificial Sequence
  Description of Artificial Sequence: Synthetic peptide
  Seed: FANCSVYDF (TYRP2_HUMAN)
FTNCSVYDW

SEQ ID NO: 194603 - protein, 9 aa, Artificial Sequence
  Description of Artificial Sequence: Synthetic peptide
  Seed: QKFDNPPFF (TYRP2_HUMAN)
QMFDNPPFM

SEQ ID NO: 194604 - protein, 9 aa, Artificial Sequence
  Description of Artificial Sequence: Synthetic peptide
  Seed: RLRKGYTPL (TYRP2_HUMAN)
RIRKGYTPG

SEQ ID NO: 194605 - protein, 9 aa, Artificial Sequence
  Description of Artificial Sequence: Synthetic peptide
  Seed: SLHNLVHSF (TYRP2_HUMAN)
SYHNLVHSI

SEQ ID NO: 194606 - protein, 8 aa, Artificial Sequence
  Description of Artificial Sequence: Synthetic peptide
  Seed: HSFTDAIF (TYRP2_HUMAN)
HMFTDAIF

SEQ ID NO: 194607 - protein, 9 aa, Artificial Sequence
  Description of Artificial Sequence: Synthetic peptide
  Seed: VVMGTLVAL (TYRP2_HUMAN)
VQMGTLVAM

SEQ ID NO: 194608 - protein, 10 aa, Artificial Sequence
  Description of Artificial Sequence: Synthetic peptide
  Seed: MSPLWWGFLL (TYRP2_HUMAN)
MDPLWWGFLW

SEQ ID NO: 194609 - protein, 10 aa, Artificial Sequence
  Description of Artificial Sequence: Synthetic peptide
  Seed: MSPLWWGFLL (TYRP2_HUMAN)
MMPLWWGFLL

SEQ ID NO: 194610 - protein, 9 aa, Artificial Sequence
  Description of Artificial Sequence: Synthetic peptide
  Seed: YTPLMETHL (TYRP2_HUMAN)
YAPLMETHL

SEQ ID NO: 194611 - protein, 10 aa, Artificial Sequence
  Description of Artificial Sequence: Synthetic peptide
  Seed: ELWPRKFFHR (TYRP2_HUMAN)
EVWPRKFFHR

SEQ ID NO: 194612 - protein, 9 aa, Artificial Sequence
  Description of Artificial Sequence: Synthetic peptide
  Seed: ALVGLFVLL (TYRP2_HUMAN)
AMVGLFVLM

SEQ ID NO: 194613 - protein, 10 aa, Artificial Sequence
  Description of Artificial Sequence: Synthetic peptide
  Seed: YAIDLPVSVE (TYRP2_HUMAN)
YQIDLPVSVV

SEQ ID NO: 194614 - protein, 9 aa, Artificial Sequence
  Description of Artificial Sequence: Synthetic peptide
  Seed: HQGPAFVTW (TYRP2_HUMAN)
HHGPAFVTI

SEQ ID NO: 194615 - protein, 9 aa, Artificial Sequence
  Description of Artificial Sequence: Synthetic peptide
  Seed: SRFSSWETV (TYRP2_HUMAN)
SMFSSWETY

SEQ ID NO: 194616 - protein, 9 aa, Artificial Sequence
  Description of Artificial Sequence: Synthetic peptide
  Seed: SVYDFFVWL (TYRP2_HUMAN)
SMYDFFVWF

SEQ ID NO: 194617 - protein, 9 aa, Artificial Sequence
  Description of Artificial Sequence: Synthetic peptide
  Seed: LGYSYAIDL (TYRP2_HUMAN)
LAYSYAIDM

SEQ ID NO: 194618 - protein, 9 aa, Artificial Sequence
  Description of Artificial Sequence: Synthetic peptide
  Seed: NRMYNMVPF (TYRP2_HUMAN)
NSMYNMVPF

SEQ ID NO: 194619 - protein, 10 aa, Artificial Sequence
  Description of Artificial Sequence: Synthetic peptide
  Seed: TDAIFDEWMK (TYRP2_HUMAN)
THAIFDEWMR

SEQ ID NO: 194620 - protein, 10 aa, Artificial Sequence
  Description of Artificial Sequence: Synthetic peptide
  Seed: ADTRPWSGPY (TYRP2_HUMAN)
ALTRPWSGPF

SEQ ID NO: 194621 - protein, 9 aa, Artificial Sequence
  Description of Artificial Sequence: Synthetic peptide
  Seed: FFQNSTFSF (TYRP2_HUMAN)
FVQNSTFSL

SEQ ID NO: 194622 - protein, 9 aa, Artificial Sequence
  Description of Artificial Sequence: Synthetic peptide
  Seed: LVALVGLFV (TYRP2_HUMAN)
LLALVGLFV

SEQ ID NO: 194623 - protein, 9 aa, Artificial Sequence
  Description of Artificial Sequence: Synthetic peptide
  Seed: YAIDLPVSV (TYRP2_HUMAN)
YSIDLPVSW

SEQ ID NO: 194624 - protein, 9 aa, Artificial Sequence
  Description of Artificial Sequence: Synthetic peptide
  Seed: IFDEWMKRF (TYRP2_HUMAN)
IQDEWMKRY

SEQ ID NO: 194625 - protein, 10 aa, Artificial Sequence
  Description of Artificial Sequence: Synthetic peptide
  Seed: SYAIDLPVSV (TYRP2_HUMAN)
SMAIDLPVSV

SEQ ID NO: 194626 - protein, 8 aa, Artificial Sequence
  Description of Artificial Sequence: Synthetic peptide
  Seed: AIDLPVSV (TYRP2_HUMAN)
ALDLPVSL

SEQ ID NO: 194627 - protein, 9 aa, Artificial Sequence
  Description of Artificial Sequence: Synthetic peptide
  Seed: AARPDDPTL (TYRP2_HUMAN)
ARRPDDPTM

SEQ ID NO: 194628 - protein, 9 aa, Artificial Sequence
  Description of Artificial Sequence: Synthetic peptide
  Seed: FSHQGPAFV (TYRP2_HUMAN)
FYHQGPAFM

SEQ ID NO: 194629 - protein, 9 aa, Artificial Sequence
  Description of Artificial Sequence: Synthetic peptide
  Seed: ANDPIFVVL (TYRP2_HUMAN)
AADPIFVVT

SEQ ID NO: 194630 - protein, 11 aa, Artificial Sequence
  Description of Artificial Sequence: Synthetic peptide
  Seed: TQPQFANCSVY (TYRP2_HUMAN)
TYPQFANCSVM

SEQ ID NO: 194631 - protein, 9 aa, Artificial Sequence
  Description of Artificial Sequence: Synthetic peptide
  Seed: DQLGYSYAI (TYRP2_HUMAN)
DMLGYSYAY

SEQ ID NO: 194632 - protein, 9 aa, Artificial Sequence
  Description of Artificial Sequence: Synthetic peptide
  Seed: ETPGWPTTL (TYRP2_HUMAN)
EMPGWPTTL

SEQ ID NO: 194633 - protein, 9 aa, Artificial Sequence
  Description of Artificial Sequence: Synthetic peptide
  Seed: VALVGLFVL (TYRP2_HUMAN)
VVLVGLFVV

SEQ ID NO: 194634 - protein, 9 aa, Artificial Sequence
  Description of Artificial Sequence: Synthetic peptide
  Seed: EGLLRRNQM (TYRP2_HUMAN)
EHLLRRNQL

SEQ ID NO: 194635 - protein, 11 aa, Artificial Sequence
  Description of Artificial Sequence: Synthetic peptide
  Seed: RADTRPWSGPY (TYRP2_HUMAN)
RSDTRPWSGPA

SEQ ID NO: 194636 - protein, 9 aa, Artificial Sequence
  Description of Artificial Sequence: Synthetic peptide
  Seed: SLDDYNHLV (TYRP2_HUMAN)
SMDDYNHLF

SEQ ID NO: 194637 - protein, 9 aa, Artificial Sequence
  Description of Artificial Sequence: Synthetic peptide
  Seed: MSPLWWGFL (TYRP2_HUMAN)
MTPLWWGFW

SEQ ID NO: 194638 - protein, 9 aa, Artificial Sequence
  Description of Artificial Sequence: Synthetic peptide
  Seed: RKFFHRTCK (TYRP2_HUMAN)
RAFFHRTCA

SEQ ID NO: 194639 - protein, 10 aa, Artificial Sequence
  Description of Artificial Sequence: Synthetic peptide
  Seed: GTLDSQVMSL (TYRP2_HUMAN)
GQLDSQVMSL

SEQ ID NO: 194640 - protein, 10 aa, Artificial Sequence
  Description of Artificial Sequence: Synthetic peptide
  Seed: FSFRNALEGF (TYRP2_HUMAN)
FRFRNALEGY

SEQ ID NO: 194641 - protein, 9 aa, Artificial Sequence
  Description of Artificial Sequence: Synthetic peptide
  Seed: SQVMSLHNL (TYRP2_HUMAN)
SEVMSLHNL

SEQ ID NO: 194642 - protein, 9 aa, Artificial Sequence
  Description of Artificial Sequence: Synthetic peptide
  Seed: LHSFTDAIF (TYRP2_HUMAN)
LLSFTDAIY

SEQ ID NO: 194643 - protein, 10 aa, Artificial Sequence
  Description of Artificial Sequence: Synthetic peptide
  Seed: CTDQLFGAAR (TYRP2_HUMAN)
CMDQLFGAAY

SEQ ID NO: 194644 - protein, 9 aa, Artificial Sequence
  Description of Artificial Sequence: Synthetic peptide
  Seed: VHPDYVITT (TYRP2_HUMAN)
VQPDYVITI

SEQ ID NO: 194645 - protein, 10 aa, Artificial Sequence
  Description of Artificial Sequence: Synthetic peptide
  Seed: LISRNSRFSS (TYRP2_HUMAN)
LLSRNSRFSK

SEQ ID NO: 194646 - protein, 9 aa, Artificial Sequence
  Description of Artificial Sequence: Synthetic peptide
  Seed: ESANVCGSQ (TYRP2_HUMAN)
ETANVCGSY

SEQ ID NO: 194647 - protein, 9 aa, Artificial Sequence
  Description of Artificial Sequence: Synthetic peptide
  Seed: RPWSGPYIL (TYRP2_HUMAN)
RYWSGPYIY

SEQ ID NO: 194648 - protein, 10 aa, Artificial Sequence
  Description of Artificial Sequence: Synthetic peptide
  Seed: VLLAFLQYRR (TYRP2_HUMAN)
VNLAFLQYRK

SEQ ID NO: 194649 - protein, 10 aa, Artificial Sequence
  Description of Artificial Sequence: Synthetic peptide
  Seed: AANDPIFVVL (TYRP2_HUMAN)
AANDPIFVVY

SEQ ID NO: 194650 - protein, 9 aa, Artificial Sequence
  Description of Artificial Sequence: Synthetic peptide
  Seed: QKFDNPPFF (TYRP2_HUMAN)
QYFDNPPFM

SEQ ID NO: 194651 - protein, 10 aa, Artificial Sequence
  Description of Artificial Sequence: Synthetic peptide
  Seed: KILPGAQGQF (TYRP2_HUMAN)
KLLPGAQGQR

SEQ ID NO: 194652 - protein, 9 aa, Artificial Sequence
  Description of Artificial Sequence: Synthetic peptide
  Seed: SVYDFFVWL (TYRP2_HUMAN)
SLYDFFVWV

SEQ ID NO: 194653 - protein, 9 aa, Artificial Sequence
  Description of Artificial Sequence: Synthetic peptide
  Seed: FFQNSTFSF (TYRP2_HUMAN)
FSQNSTFSL

SEQ ID NO: 194654 - protein, 9 aa, Artificial Sequence
  Description of Artificial Sequence: Synthetic peptide
  Seed: RKFFHRTCK (TYRP2_HUMAN)
RRFFHRTCV

SEQ ID NO: 194655 - protein, 11 aa, Artificial Sequence
  Description of Artificial Sequence: Synthetic peptide
  Seed: RNSRFSSWETV (TYRP2_HUMAN)
RSSRFSSWETL

SEQ ID NO: 194656 - protein, 9 aa, Artificial Sequence
  Description of Artificial Sequence: Synthetic peptide
  Seed: HSFLNGTNA (TYRP2_HUMAN)
HSFLNGTNY

SEQ ID NO: 194657 - protein, 10 aa, Artificial Sequence
  Description of Artificial Sequence: Synthetic peptide
  Seed: YNMVPFFPPV (TYRP2_HUMAN)
YHMVPFFPPI

SEQ ID NO: 194658 - protein, 9 aa, Artificial Sequence
  Description of Artificial Sequence: Synthetic peptide
  Seed: VTWHRYHLL (TYRP2_HUMAN)
VTWHRYHLW

SEQ ID NO: 194659 - protein, 9 aa, Artificial Sequence
  Description of Artificial Sequence: Synthetic peptide
  Seed: FVWLHYYSV (TYRP2_HUMAN)
FMWLHYYSL

SEQ ID NO: 194660 - protein, 10 aa, Artificial Sequence
  Description of Artificial Sequence: Synthetic peptide
  Seed: RPDDPTLISR (TYRP2_HUMAN)
RPDDPTLISY

SEQ ID NO: 194661 - protein, 9 aa, Artificial Sequence
  Description of Artificial Sequence: Synthetic peptide
  Seed: TLDSQVMSL (TYRP2_HUMAN)
TFDSQVMSF

SEQ ID NO: 194662 - protein, 10 aa, Artificial Sequence
  Description of Artificial Sequence: Synthetic peptide
  Seed: DSLDDYNHLV (TYRP2_HUMAN)
DKLDDYNHLV

SEQ ID NO: 194663 - protein, 11 aa, Artificial Sequence
  Description of Artificial Sequence: Synthetic peptide
  Seed: KADGTLDSQVM (TYRP2_HUMAN)
KQDGTLDSQVW

SEQ ID NO: 194664 - protein, 10 aa, Artificial Sequence
  Description of Artificial Sequence: Synthetic peptide
  Seed: TDAIFDEWMK (TYRP2_HUMAN)
TDAIFDEWMR

SEQ ID NO: 194665 - protein, 9 aa, Artificial Sequence
  Description of Artificial Sequence: Synthetic peptide
  Seed: QKFDNPPFF (TYRP2_HUMAN)
QMFDNPPFL

SEQ ID NO: 194666 - protein, 9 aa, Artificial Sequence
  Description of Artificial Sequence: Synthetic peptide
  Seed: VTNEELFLT (TYRP2_HUMAN)
VMNEELFLT

SEQ ID NO: 194667 - protein, 9 aa, Artificial Sequence
  Description of Artificial Sequence: Synthetic peptide
  Seed: NESFALPYW (TYRP2_HUMAN)
NESFALPYM

SEQ ID NO: 194668 - protein, 10 aa, Artificial Sequence
  Description of Artificial Sequence: Synthetic peptide
  Seed: SPLWWGFLLS (TYRP2_HUMAN)
SLLWWGFLLI

SEQ ID NO: 194669 - protein, 9 aa, Artificial Sequence
  Description of Artificial Sequence: Synthetic peptide
  Seed: VHPDYVITT (TYRP2_HUMAN)
VRPDYVITV

SEQ ID NO: 194670 - protein, 10 aa, Artificial Sequence
  Description of Artificial Sequence: Synthetic peptide
  Seed: FFVWLHYYSV (TYRP2_HUMAN)
FMVWLHYYSI

SEQ ID NO: 194671 - protein, 9 aa, Artificial Sequence
  Description of Artificial Sequence: Synthetic peptide
  Seed: HPDYVITTQ (TYRP2_HUMAN)
HADYVITTM

SEQ ID NO: 194672 - protein, 10 aa, Artificial Sequence
  Description of Artificial Sequence: Synthetic peptide
  Seed: ISRNSRFSSW (TYRP2_HUMAN)
IVRNSRFSSW

SEQ ID NO: 194673 - protein, 11 aa, Artificial Sequence
  Description of Artificial Sequence: Synthetic peptide
  Seed: RELWPRKFFHR (TYRP2_HUMAN)
RHLWPRKFFHR

SEQ ID NO: 194674 - protein, 10 aa, Artificial Sequence
  Description of Artificial Sequence: Synthetic peptide
  Seed: KILPGAQGQF (TYRP2_HUMAN)
KNLPGAQGQW

SEQ ID NO: 194675 - protein, 9 aa, Artificial Sequence
  Description of Artificial Sequence: Synthetic peptide
  Seed: SRFSSWETV (TYRP2_HUMAN)
SYFSSWETF

SEQ ID NO: 194676 - protein, 10 aa, Artificial Sequence
  Description of Artificial Sequence: Synthetic peptide
  Seed: VLLAFLQYRR (TYRP2_HUMAN)
VCLAFLQYRK

SEQ ID NO: 194677 - protein, 10 aa, Artificial Sequence
  Description of Artificial Sequence: Synthetic peptide
  Seed: CCPRLGAESA (TYRP2_HUMAN)
CAPRLGAESL

SEQ ID NO: 194678 - protein, 9 aa, Artificial Sequence
  Description of Artificial Sequence: Synthetic peptide
  Seed: VPFFPPVTN (TYRP2_HUMAN)
VPFFPPVTV

SEQ ID NO: 194679 - protein, 9 aa, Artificial Sequence
  Description of Artificial Sequence: Synthetic peptide
  Seed: SVYDFFVWL (TYRP2_HUMAN)
STYDFFVWF

SEQ ID NO: 194680 - protein, 9 aa, Artificial Sequence
  Description of Artificial Sequence: Synthetic peptide
  Seed: QKFDNPPFF (TYRP2_HUMAN)
QLFDNPPFI

SEQ ID NO: 194681 - protein, 9 aa, Artificial Sequence
  Description of Artificial Sequence: Synthetic peptide
  Seed: FFPPVTNEE (TYRP2_HUMAN)
FFPPVTNEI

SEQ ID NO: 194682 - protein, 9 aa, Artificial Sequence
  Description of Artificial Sequence: Synthetic peptide
  Seed: VIRQNIHSL (TYRP2_HUMAN)
VARQNIHSV

SEQ ID NO: 194683 - protein, 9 aa, Artificial Sequence
  Description of Artificial Sequence: Synthetic peptide
  Seed: VVMGTLVAL (TYRP2_HUMAN)
VMMGTLVAR

SEQ ID NO: 194684 - protein, 9 aa, Artificial Sequence
  Description of Artificial Sequence: Synthetic peptide
  Seed: HSAANDPIF (TYRP2_HUMAN)
HTAANDPIF

SEQ ID NO: 194685 - protein, 11 aa, Artificial Sequence
  Description of Artificial Sequence: Synthetic peptide
  Seed: RADTRPWSGPY (TYRP2_HUMAN)
RYDTRPWSGPK

SEQ ID NO: 194686 - protein, 10 aa, Artificial Sequence
  Description of Artificial Sequence: Synthetic peptide
  Seed: ELAPIGHNRM (TYRP2_HUMAN)
ETAPIGHNRE

SEQ ID NO: 194687 - protein, 9 aa, Artificial Sequence
  Description of Artificial Sequence: Synthetic peptide
  Seed: FPPVTNEEL (TYRP2_HUMAN)
FTPVTNEEM

SEQ ID NO: 194688 - protein, 9 aa, Artificial Sequence
  Description of Artificial Sequence: Synthetic peptide
  Seed: RLGAESANV (TYRP2_HUMAN)
RLGAESANI

SEQ ID NO: 194689 - protein, 10 aa, Artificial Sequence
  Description of Artificial Sequence: Synthetic peptide
  Seed: RPDDPTLISR (TYRP2_HUMAN)
RADDPTLISM

SEQ ID NO: 194690 - protein, 9 aa, Artificial Sequence
  Description of Artificial Sequence: Synthetic peptide
  Seed: VTWHRYHLL (TYRP2_HUMAN)
VMWHRYHLW

SEQ ID NO: 194691 - protein, 10 aa, Artificial Sequence
  Description of Artificial Sequence: Synthetic peptide
  Seed: RLRKGYTPLM (TYRP2_HUMAN)
RRRKGYTPLK

SEQ ID NO: 194692 - protein, 9 aa, Artificial Sequence
  Description of Artificial Sequence: Synthetic peptide
  Seed: APIGHNRMY (TYRP2_HUMAN)
AFIGHNRMY

SEQ ID NO: 194693 - protein, 8 aa, Artificial Sequence
  Description of Artificial Sequence: Synthetic peptide
  Seed: RPDDPTLI (TYRP2_HUMAN)
RVDDPTLI

SEQ ID NO: 194694 - protein, 8 aa, Artificial Sequence
  Description of Artificial Sequence: Synthetic peptide
  Seed: LHNLVHSF (TYRP2_HUMAN)
LHNLVHSA

SEQ ID NO: 194695 - protein, 8 aa, Artificial Sequence
  Description of Artificial Sequence: Synthetic peptide
  Seed: AIDLPVSV (TYRP2_HUMAN)
AVDLPVSI

SEQ ID NO: 194696 - protein, 10 aa, Artificial Sequence
  Description of Artificial Sequence: Synthetic peptide
  Seed: RLRKGYTPLM (TYRP2_HUMAN)
RQRKGYTPLR

SEQ ID NO: 194697 - protein, 11 aa, Artificial Sequence
  Description of Artificial Sequence: Synthetic peptide
  Seed: RADTRPWSGPY (TYRP2_HUMAN)
RHDTRPWSGPF

SEQ ID NO: 194698 - protein, 10 aa, Artificial Sequence
  Description of Artificial Sequence: Synthetic peptide
  Seed: GQFPRVCMTV (TYRP2_HUMAN)
GEFPRVCMTY

SEQ ID NO: 194699 - protein, 9 aa, Artificial Sequence
  Description of Artificial Sequence: Synthetic peptide
  Seed: FSHQGPAFV (TYRP2_HUMAN)
FQHQGPAFM

SEQ ID NO: 194700 - protein, 9 aa, Artificial Sequence
  Description of Artificial Sequence: Synthetic peptide
  Seed: LVALVGLFV (TYRP2_HUMAN)
LQALVGLFV

SEQ ID NO: 194701 - protein, 9 aa, Artificial Sequence
  Description of Artificial Sequence: Synthetic peptide
  Seed: TLVALVGLF (TYRP2_HUMAN)
TMVALVGLY

SEQ ID NO: 194702 - protein, 9 aa, Artificial Sequence
  Description of Artificial Sequence: Synthetic peptide
  Seed: FTDAIFDEW (TYRP2_HUMAN)
FWDAIFDEI

SEQ ID NO: 194703 - protein, 10 aa, Artificial Sequence
  Description of Artificial Sequence: Synthetic peptide
  Seed: QPQFANCSVY (TYRP2_HUMAN)
QFQFANCSVW

SEQ ID NO: 194704 - protein, 11 aa, Artificial Sequence
  Description of Artificial Sequence: Synthetic peptide
  Seed: FVVLHSFTDAI (TYRP2_HUMAN)
FIVLHSFTDAL

SEQ ID NO: 194705 - protein, 10 aa, Artificial Sequence
  Description of Artificial Sequence: Synthetic peptide
  Seed: KRFNPPADAW (TYRP2_HUMAN)
KRFNPPADAF

SEQ ID NO: 194706 - protein, 11 aa, Artificial Sequence
  Description of Artificial Sequence: Synthetic peptide
  Seed: LPVSVEETPGW (TYRP2_HUMAN)
LAVSVEETPGW

SEQ ID NO: 194707 - protein, 11 aa, Artificial Sequence
  Description of Artificial Sequence: Synthetic peptide
  Seed: QRLIGNESFAL (TYRP2_HUMAN)
QALIGNESFAV

SEQ ID NO: 194708 - protein, 10 aa, Artificial Sequence
  Description of Artificial Sequence: Synthetic peptide
  Seed: YNMVPFFPPV (TYRP2_HUMAN)
YWMVPFFPPM

SEQ ID NO: 194709 - protein, 9 aa, Artificial Sequence
  Description of Artificial Sequence: Synthetic peptide
  Seed: ISRNSRFSS (TYRP2_HUMAN)
IQRNSRFSV

SEQ ID NO: 194710 - protein, 9 aa, Artificial Sequence
  Description of Artificial Sequence: Synthetic peptide
  Seed: AIFDEWMKR (TYRP2_HUMAN)
ANFDEWMKY

SEQ ID NO: 194711 - protein, 10 aa, Artificial Sequence
  Description of Artificial Sequence: Synthetic peptide
  Seed: REQFLGALDL (TYRP2_HUMAN)
RRQFLGALDY

SEQ ID NO: 194712 - protein, 9 aa, Artificial Sequence
  Description of Artificial Sequence: Synthetic peptide
  Seed: HSFLNGTNA (TYRP2_HUMAN)
HTFLNGTNV

SEQ ID NO: 194713 - protein, 10 aa, Artificial Sequence
  Description of Artificial Sequence: Synthetic peptide
  Seed: RRLRKGYTPL (TYRP2_HUMAN)
RSLRKGYTPT

SEQ ID NO: 194714 - protein, 9 aa, Artificial Sequence
  Description of Artificial Sequence: Synthetic peptide
  Seed: ALVGLFVLL (TYRP2_HUMAN)
AIVGLFVLV

SEQ ID NO: 194715 - protein, 10 aa, Artificial Sequence
  Description of Artificial Sequence: Synthetic peptide
  Seed: FLTSDQLGYS (TYRP2_HUMAN)
FPTSDQLGYV

SEQ ID NO: 194716 - protein, 9 aa, Artificial Sequence
  Description of Artificial Sequence: Synthetic peptide
  Seed: VLHSFTDAI (TYRP2_HUMAN)
VKHSFTDAL

SEQ ID NO: 194717 - protein, 10 aa, Artificial Sequence
  Description of Artificial Sequence: Synthetic peptide
  Seed: RMYNMVPFFP (TYRP2_HUMAN)
RAYNMVPFFA

SEQ ID NO: 194718 - protein, 9 aa, Artificial Sequence
  Description of Artificial Sequence: Synthetic peptide
  Seed: HYYSVRDTL (TYRP2_HUMAN)
HAYSVRDTF

SEQ ID NO: 194719 - protein, 9 aa, Artificial Sequence
  Description of Artificial Sequence: Synthetic peptide
  Seed: DQLGYSYAI (TYRP2_HUMAN)
DRLGYSYAI

SEQ ID NO: 194720 - protein, 10 aa, Artificial Sequence
  Description of Artificial Sequence: Synthetic peptide
  Seed: MSLHNLVHSF (TYRP2_HUMAN)
MCLHNLVHSW

SEQ ID NO: 194721 - protein, 9 aa, Artificial Sequence
  Description of Artificial Sequence: Synthetic peptide
  Seed: YYSVRDTLL (TYRP2_HUMAN)
YRSVRDTLL

SEQ ID NO: 194722 - protein, 9 aa, Artificial Sequence
  Description of Artificial Sequence: Synthetic peptide
  Seed: RLRKGYTPL (TYRP2_HUMAN)
RPRKGYTPI

SEQ ID NO: 194723 - protein, 9 aa, Artificial Sequence
  Description of Artificial Sequence: Synthetic peptide
  Seed: DAIFDEWMK (TYRP2_HUMAN)
DAIFDEWMR

SEQ ID NO: 194724 - protein, 9 aa, Artificial Sequence
  Description of Artificial Sequence: Synthetic peptide
  Seed: FSHQGPAFV (TYRP2_HUMAN)
FMHQGPAFL

SEQ ID NO: 194725 - protein, 9 aa, Artificial Sequence
  Description of Artificial Sequence: Synthetic peptide
  Seed: FLTSDQLGY (TYRP2_HUMAN)
FFTSDQLGY

SEQ ID NO: 194726 - protein, 10 aa, Artificial Sequence
  Description of Artificial Sequence: Synthetic peptide
  Seed: LPGAQGQFPR (TYRP2_HUMAN)
LFGAQGQFPR

SEQ ID NO: 194727 - protein, 10 aa, Artificial Sequence
  Description of Artificial Sequence: Synthetic peptide
  Seed: FFVWLHYYSV (TYRP2_HUMAN)
FGVWLHYYSV

SEQ ID NO: 194728 - protein, 9 aa, Artificial Sequence
  Description of Artificial Sequence: Synthetic peptide
  Seed: SLDDYNHLV (TYRP2_HUMAN)
SIDDYNHLI

SEQ ID NO: 194729 - protein, 10 aa, Artificial Sequence
  Description of Artificial Sequence: Synthetic peptide
  Seed: SLDDYNHLVT (TYRP2_HUMAN)
SMDDYNHLVT

SEQ ID NO: 194730 - protein, 9 aa, Artificial Sequence
  Description of Artificial Sequence: Synthetic peptide
  Seed: APIGHNRMY (TYRP2_HUMAN)
ASIGHNRML

SEQ ID NO: 194731 - protein, 8 aa, Artificial Sequence
  Description of Artificial Sequence: Synthetic peptide
  Seed: MSPLWWGF (TYRP2_HUMAN)
MSPLWWGW

SEQ ID NO: 194732 - protein, 9 aa, Artificial Sequence
  Description of Artificial Sequence: Synthetic peptide
  Seed: TTQHWLGLL (TYRP2_HUMAN)
TIQHWLGLV

SEQ ID NO: 194733 - protein, 10 aa, Artificial Sequence
  Description of Artificial Sequence: Synthetic peptide
  Seed: NCSVYDFFVW (TYRP2_HUMAN)
NPSVYDFFVW

SEQ ID NO: 194734 - protein, 10 aa, Artificial Sequence
  Description of Artificial Sequence: Synthetic peptide
  Seed: RTCKCTGNFA (TYRP2_HUMAN)
RVCKCTGNFV

SEQ ID NO: 194735 - protein, 9 aa, Artificial Sequence
  Description of Artificial Sequence: Synthetic peptide
  Seed: LPVSVEETP (TYRP2_HUMAN)
LPVSVEETL

SEQ ID NO: 194736 - protein, 9 aa, Artificial Sequence
  Description of Artificial Sequence: Synthetic peptide
  Seed: TLDSQVMSL (TYRP2_HUMAN)
TPDSQVMSL

SEQ ID NO: 194737 - protein, 10 aa, Artificial Sequence
  Description of Artificial Sequence: Synthetic peptide
  Seed: FVLLAFLQYR (TYRP2_HUMAN)
FILLAFLQYR

SEQ ID NO: 194738 - protein, 9 aa, Artificial Sequence
  Description of Artificial Sequence: Synthetic peptide
  Seed: FVWLHYYSV (TYRP2_HUMAN)
FSWLHYYSL

SEQ ID NO: 194739 - protein, 9 aa, Artificial Sequence
  Description of Artificial Sequence: Synthetic peptide
  Seed: SVYDFFVWL (TYRP2_HUMAN)
SLYDFFVWW

SEQ ID NO: 194740 - protein, 11 aa, Artificial Sequence
  Description of Artificial Sequence: Synthetic peptide
  Seed: YNMVPFFPPVT (TYRP2_HUMAN)
YTMVPFFPPVP

SEQ ID NO: 194741 - protein, 9 aa, Artificial Sequence
  Description of Artificial Sequence: Synthetic peptide
  Seed: STFSFRNAL (TYRP2_HUMAN)
SEFSFRNAL

SEQ ID NO: 194742 - protein, 9 aa, Artificial Sequence
  Description of Artificial Sequence: Synthetic peptide
  Seed: AWPQELAPI (TYRP2_HUMAN)
AYPQELAPY

SEQ ID NO: 194743 - protein, 10 aa, Artificial Sequence
  Description of Artificial Sequence: Synthetic peptide
  Seed: FVWLHYYSVR (TYRP2_HUMAN)
FLWLHYYSVQ

SEQ ID NO: 194744 - protein, 9 aa, Artificial Sequence
  Description of Artificial Sequence: Synthetic peptide
  Seed: WPQELAPIG (TYRP2_HUMAN)
WPQELAPIM

SEQ ID NO: 194745 - protein, 10 aa, Artificial Sequence
  Description of Artificial Sequence: Synthetic peptide
  Seed: GQFPRVCMTV (TYRP2_HUMAN)
GMFPRVCMTF

SEQ ID NO: 194746 - protein, 9 aa, Artificial Sequence
  Description of Artificial Sequence: Synthetic peptide
  Seed: NMVPFFPPV (TYRP2_HUMAN)
NMVPFFPPY

SEQ ID NO: 194747 - protein, 9 aa, Artificial Sequence
  Description of Artificial Sequence: Synthetic peptide
  Seed: GTYEGLLRR (TYRP2_HUMAN)
GWYEGLLRY

SEQ ID NO: 194748 - protein, 9 aa, Artificial Sequence
  Description of Artificial Sequence: Synthetic peptide
  Seed: SFLNGTNAL (TYRP2_HUMAN)
SVLNGTNAL

SEQ ID NO: 194749 - protein, 11 aa, Artificial Sequence
  Description of Artificial Sequence: Synthetic peptide
  Seed: QRLIGNESFAL (TYRP2_HUMAN)
QLLIGNESFAV

SEQ ID NO: 194750 - protein, 10 aa, Artificial Sequence
  Description of Artificial Sequence: Synthetic peptide
  Seed: FGWTGPNCER (TYRP2_HUMAN)
FSWTGPNCEM

SEQ ID NO: 194751 - protein, 9 aa, Artificial Sequence
  Description of Artificial Sequence: Synthetic peptide
  Seed: HQGPAFVTW (TYRP2_HUMAN)
HHGPAFVTM

SEQ ID NO: 194752 - protein, 10 aa, Artificial Sequence
  Description of Artificial Sequence: Synthetic peptide
  Seed: RLIGNESFAL (TYRP2_HUMAN)
RMIGNESFAL

SEQ ID NO: 194753 - protein, 9 aa, Artificial Sequence
  Description of Artificial Sequence: Synthetic peptide
  Seed: SFALPYWNF (TYRP2_HUMAN)
SWALPYWNW

SEQ ID NO: 194754 - protein, 11 aa, Artificial Sequence
  Description of Artificial Sequence: Synthetic peptide
  Seed: ANCSVYDFFVW (TYRP2_HUMAN)
AVCSVYDFFVW

SEQ ID NO: 194755 - protein, 11 aa, Artificial Sequence
  Description of Artificial Sequence: Synthetic peptide
  Seed: SLDDYNHLVTL (TYRP2_HUMAN)
SVDDYNHLVTY

SEQ ID NO: 194756 - protein, 9 aa, Artificial Sequence
  Description of Artificial Sequence: Synthetic peptide
  Seed: SFALPYWNF (TYRP2_HUMAN)
SYALPYWNV

SEQ ID NO: 194757 - protein, 9 aa, Artificial Sequence
  Description of Artificial Sequence: Synthetic peptide
  Seed: YSYAIDLPV (TYRP2_HUMAN)
YWYAIDLPF

SEQ ID NO: 194758 - protein, 9 aa, Artificial Sequence
  Description of Artificial Sequence: Synthetic peptide
  Seed: TPGWPTTLL (TYRP2_HUMAN)
TPGWPTTLY

SEQ ID NO: 194759 - protein, 10 aa, Artificial Sequence
  Description of Artificial Sequence: Synthetic peptide
  Seed: RMYNMVPFFP (TYRP2_HUMAN)
RLYNMVPFFV

SEQ ID NO: 194760 - protein, 8 aa, Artificial Sequence
  Description of Artificial Sequence: Synthetic peptide
  Seed: RPDDPTLI (TYRP2_HUMAN)
RIDDPTLV

SEQ ID NO: 194761 - protein, 10 aa, Artificial Sequence
  Description of Artificial Sequence: Synthetic peptide
  Seed: TVDSLVNKEC (TYRP2_HUMAN)
TLDSLVNKEM

SEQ ID NO: 194762 - protein, 9 aa, Artificial Sequence
  Description of Artificial Sequence: Synthetic peptide
  Seed: FTDAIFDEW (TYRP2_HUMAN)
FNDAIFDEY

SEQ ID NO: 194763 - protein, 9 aa, Artificial Sequence
  Description of Artificial Sequence: Synthetic peptide
  Seed: ETPGWPTTL (TYRP2_HUMAN)
EIPGWPTTK

SEQ ID NO: 194764 - protein, 10 aa, Artificial Sequence
  Description of Artificial Sequence: Synthetic peptide
  Seed: LISRNSRFSS (TYRP2_HUMAN)
LWSRNSRFSK

SEQ ID NO: 194765 - protein, 11 aa, Artificial Sequence
  Description of Artificial Sequence: Synthetic peptide
  Seed: RNSRFSSWETV (TYRP2_HUMAN)
RLSRFSSWETL

SEQ ID NO: 194766 - protein, 10 aa, Artificial Sequence
  Description of Artificial Sequence: Synthetic peptide
  Seed: REQFLGALDL (TYRP2_HUMAN)
RGQFLGALDM

SEQ ID NO: 194767 - protein, 10 aa, Artificial Sequence
  Description of Artificial Sequence: Synthetic peptide
  Seed: SVYDFFVWLH (TYRP2_HUMAN)
SMYDFFVWLF

SEQ ID NO: 194768 - protein, 11 aa, Artificial Sequence
  Description of Artificial Sequence: Synthetic peptide
  Seed: YTPLMETHLSS (TYRP2_HUMAN)
YQPLMETHLSI

SEQ ID NO: 194769 - protein, 11 aa, Artificial Sequence
  Description of Artificial Sequence: Synthetic peptide
  Seed: RDTLLGPGRPY (TYRP2_HUMAN)
RKTLLGPGRPY

SEQ ID NO: 194770 - protein, 10 aa, Artificial Sequence
  Description of Artificial Sequence: Synthetic peptide
  Seed: DAIFDEWMKR (TYRP2_HUMAN)
DNIFDEWMKR

SEQ ID NO: 194771 - protein, 9 aa, Artificial Sequence
  Description of Artificial Sequence: Synthetic peptide
  Seed: HQGPAFVTW (TYRP2_HUMAN)
HYGPAFVTL

SEQ ID NO: 194772 - protein, 9 aa, Artificial Sequence
  Description of Artificial Sequence: Synthetic peptide
  Seed: FANCSVYDF (TYRP2_HUMAN)
FTNCSVYDM

SEQ ID NO: 194773 - protein, 9 aa, Artificial Sequence
  Description of Artificial Sequence: Synthetic peptide
  Seed: TSDQLGYSY (TYRP2_HUMAN)
TIDQLGYSM

SEQ ID NO: 194774 - protein, 9 aa, Artificial Sequence
  Description of Artificial Sequence: Synthetic peptide
  Seed: STFSFRNAL (TYRP2_HUMAN)
SQFSFRNAK

SEQ ID NO: 194775 - protein, 9 aa, Artificial Sequence
  Description of Artificial Sequence: Synthetic peptide
  Seed: HQGPAFVTW (TYRP2_HUMAN)
HLGPAFVTY

SEQ ID NO: 194776 - protein, 10 aa, Artificial Sequence
  Description of Artificial Sequence: Synthetic peptide
  Seed: RRLRKGYTPL (TYRP2_HUMAN)
RLLRKGYTPM

SEQ ID NO: 194777 - protein, 10 aa, Artificial Sequence
  Description of Artificial Sequence: Synthetic peptide
  Seed: RLRKGYTPLM (TYRP2_HUMAN)
RVRKGYTPLF

SEQ ID NO: 194778 - protein, 10 aa, Artificial Sequence
  Description of Artificial Sequence: Synthetic peptide
  Seed: DTLLGPGRPY (TYRP2_HUMAN)
DILLGPGRPK

SEQ ID NO: 194779 - protein, 9 aa, Artificial Sequence
  Description of Artificial Sequence: Synthetic peptide
  Seed: KRVHPDYVI (TYRP2_HUMAN)
KRVHPDYVL

SEQ ID NO: 194780 - protein, 10 aa, Artificial Sequence
  Description of Artificial Sequence: Synthetic peptide
  Seed: FFQNSTFSFR (TYRP2_HUMAN)
FYQNSTFSFL

SEQ ID NO: 194781 - protein, 9 aa, Artificial Sequence
  Description of Artificial Sequence: Synthetic peptide
  Seed: PADAWPQEL (TYRP2_HUMAN)
PYDAWPQEF

SEQ ID NO: 194782 - protein, 10 aa, Artificial Sequence
  Description of Artificial Sequence: Synthetic peptide
  Seed: LVVMGTLVAL (TYRP2_HUMAN)
LMVMGTLVAA

SEQ ID NO: 194783 - protein, 10 aa, Artificial Sequence
  Description of Artificial Sequence: Synthetic peptide
  Seed: RNSRFSSWET (TYRP2_HUMAN)
RDSRFSSWEL

SEQ ID NO: 194784 - protein, 9 aa, Artificial Sequence
  Description of Artificial Sequence: Synthetic peptide
  Seed: RQNIHSLSP (TYRP2_HUMAN)
RTNIHSLSF

SEQ ID NO: 194785 - protein, 10 aa, Artificial Sequence
  Description of Artificial Sequence: Synthetic peptide
  Seed: VALVGLFVLL (TYRP2_HUMAN)
VTLVGLFVLW

SEQ ID NO: 194786 - protein, 11 aa, Artificial Sequence
  Description of Artificial Sequence: Synthetic peptide
  Seed: WLHYYSVRDTL (TYRP2_HUMAN)
WQHYYSVRDTF

SEQ ID NO: 194787 - protein, 9 aa, Artificial Sequence
  Description of Artificial Sequence: Synthetic peptide
  Seed: ETPGWPTTL (TYRP2_HUMAN)
EFPGWPTTM

SEQ ID NO: 194788 - protein, 9 aa, Artificial Sequence
  Description of Artificial Sequence: Synthetic peptide
  Seed: FFQNSTFSF (TYRP2_HUMAN)
FMQNSTFSL

SEQ ID NO: 194789 - protein, 9 aa, Artificial Sequence
  Description of Artificial Sequence: Synthetic peptide
  Seed: IFDEWMKRF (TYRP2_HUMAN)
IADEWMKRW

SEQ ID NO: 194790 - protein, 11 aa, Artificial Sequence
  Description of Artificial Sequence: Synthetic peptide
  Seed: RNSRFSSWETV (TYRP2_HUMAN)
RGSRFSSWETL

SEQ ID NO: 194791 - protein, 10 aa, Artificial Sequence
  Description of Artificial Sequence: Synthetic peptide
  Seed: FVWLHYYSVR (TYRP2_HUMAN)
FLWLHYYSVH

SEQ ID NO: 194792 - protein, 9 aa, Artificial Sequence
  Description of Artificial Sequence: Synthetic peptide
  Seed: HQGPAFVTW (TYRP2_HUMAN)
HYGPAFVTM

SEQ ID NO: 194793 - protein, 10 aa, Artificial Sequence
  Description of Artificial Sequence: Synthetic peptide
  Seed: RELWPRKFFH (TYRP2_HUMAN)
RFLWPRKFFH

SEQ ID NO: 194794 - protein, 9 aa, Artificial Sequence
  Description of Artificial Sequence: Synthetic peptide
  Seed: RNQMGRNSM (TYRP2_HUMAN)
RQQMGRNSF

SEQ ID NO: 194795 - protein, 9 aa, Artificial Sequence
  Description of Artificial Sequence: Synthetic peptide
  Seed: DDRELWPRK (TYRP2_HUMAN)
DVRELWPRR

SEQ ID NO: 194796 - protein, 9 aa, Artificial Sequence
  Description of Artificial Sequence: Synthetic peptide
  Seed: RMYNMVPFF (TYRP2_HUMAN)
RWYNMVPFK

SEQ ID NO: 194797 - protein, 9 aa, Artificial Sequence
  Description of Artificial Sequence: Synthetic peptide
  Seed: SQVMSLHNL (TYRP2_HUMAN)
SQVMSLHNV

SEQ ID NO: 194798 - protein, 10 aa, Artificial Sequence
  Description of Artificial Sequence: Synthetic peptide
  Seed: RRLRKGYTPL (TYRP2_HUMAN)
RNLRKGYTPA

SEQ ID NO: 194799 - protein, 9 aa, Artificial Sequence
  Description of Artificial Sequence: Synthetic peptide
  Seed: VIRQNIHSL (TYRP2_HUMAN)
VQRQNIHSF

SEQ ID NO: 194800 - protein, 9 aa, Artificial Sequence
  Description of Artificial Sequence: Synthetic peptide
  Seed: VVMGTLVAL (TYRP2_HUMAN)
VSMGTLVAR

SEQ ID NO: 194801 - protein, 10 aa, Artificial Sequence
  Description of Artificial Sequence: Synthetic peptide
  Seed: FSFRNALEGF (TYRP2_HUMAN)
FQFRNALEGW

SEQ ID NO: 194802 - protein, 9 aa, Artificial Sequence
  Description of Artificial Sequence: Synthetic peptide
  Seed: SQVMSLHNL (TYRP2_HUMAN)
SIVMSLHNI

SEQ ID NO: 194803 - protein, 9 aa, Artificial Sequence
  Description of Artificial Sequence: Synthetic peptide
  Seed: DQLGYSYAI (TYRP2_HUMAN)
DILGYSYAI

SEQ ID NO: 194804 - protein, 11 aa, Artificial Sequence
  Description of Artificial Sequence: Synthetic peptide
  Seed: FFPPVTNEELF (TYRP2_HUMAN)
FGPPVTNEELW

SEQ ID NO: 194805 - protein, 11 aa, Artificial Sequence
  Description of Artificial Sequence: Synthetic peptide
  Seed: YTPLMETHLSS (TYRP2_HUMAN)
YNPLMETHLSV

SEQ ID NO: 194806 - protein, 11 aa, Artificial Sequence
  Description of Artificial Sequence: Synthetic peptide
  Seed: HSLSPQEREQF (TYRP2_HUMAN)
HMLSPQEREQL

SEQ ID NO: 194807 - protein, 9 aa, Artificial Sequence
  Description of Artificial Sequence: Synthetic peptide
  Seed: SLDDYNHLV (TYRP2_HUMAN)
SLDDYNHLM

SEQ ID NO: 194808 - protein, 9 aa, Artificial Sequence
  Description of Artificial Sequence: Synthetic peptide
  Seed: ALPYWNFAT (TYRP2_HUMAN)
AMPYWNFAM

SEQ ID NO: 194809 - protein, 10 aa, Artificial Sequence
  Description of Artificial Sequence: Synthetic peptide
  Seed: VLLAFLQYRR (TYRP2_HUMAN)
VYLAFLQYRK

SEQ ID NO: 194810 - protein, 9 aa, Artificial Sequence
  Description of Artificial Sequence: Synthetic peptide
  Seed: FSHQGPAFV (TYRP2_HUMAN)
FCHQGPAFY

SEQ ID NO: 194811 - protein, 11 aa, Artificial Sequence
  Description of Artificial Sequence: Synthetic peptide
  Seed: YNMVPFFPPVT (TYRP2_HUMAN)
YMMVPFFPPVV

SEQ ID NO: 194812 - protein, 10 aa, Artificial Sequence
  Description of Artificial Sequence: Synthetic peptide
  Seed: ADTRPWSGPY (TYRP2_HUMAN)
AMTRPWSGPW

SEQ ID NO: 194813 - protein, 9 aa, Artificial Sequence
  Description of Artificial Sequence: Synthetic peptide
  Seed: SVYDFFVWL (TYRP2_HUMAN)
SAYDFFVWF

SEQ ID NO: 194814 - protein, 9 aa, Artificial Sequence
  Description of Artificial Sequence: Synthetic peptide
  Seed: RMYNMVPFF (TYRP2_HUMAN)
RVYNMVPFS

SEQ ID NO: 194815 - protein, 10 aa, Artificial Sequence
  Description of Artificial Sequence: Synthetic peptide
  Seed: MSLHNLVHSF (TYRP2_HUMAN)
MQLHNLVHSW

SEQ ID NO: 194816 - protein, 9 aa, Artificial Sequence
  Description of Artificial Sequence: Synthetic peptide
  Seed: RTCKCTGNF (TYRP2_HUMAN)
RACKCTGNY

SEQ ID NO: 194817 - protein, 8 aa, Artificial Sequence
  Description of Artificial Sequence: Synthetic peptide
  Seed: KFFHRTCK (TYRP2_HUMAN)
KMFHRTCR

SEQ ID NO: 194818 - protein, 10 aa, Artificial Sequence
  Description of Artificial Sequence: Synthetic peptide
  Seed: NSTFSFRNAL (TYRP2_HUMAN)
NVTFSFRNAI

SEQ ID NO: 194819 - protein, 9 aa, Artificial Sequence
  Description of Artificial Sequence: Synthetic peptide
  Seed: HYYSVRDTL (TYRP2_HUMAN)
HRYSVRDTF

SEQ ID NO: 194820 - protein, 9 aa, Artificial Sequence
  Description of Artificial Sequence: Synthetic peptide
  Seed: FSHQGPAFV (TYRP2_HUMAN)
FTHQGPAFM

SEQ ID NO: 194821 - protein, 11 aa, Artificial Sequence
  Description of Artificial Sequence: Synthetic peptide
  Seed: YTPLMETHLSS (TYRP2_HUMAN)
YWPLMETHLSI

SEQ ID NO: 194822 - protein, 9 aa, Artificial Sequence
  Description of Artificial Sequence: Synthetic peptide
  Seed: HQGPAFVTW (TYRP2_HUMAN)
HFGPAFVTY

SEQ ID NO: 194823 - protein, 11 aa, Artificial Sequence
  Description of Artificial Sequence: Synthetic peptide
  Seed: MYNMVPFFPPV (TYRP2_HUMAN)
MCNMVPFFPPI

SEQ ID NO: 194824 - protein, 10 aa, Artificial Sequence
  Description of Artificial Sequence: Synthetic peptide
  Seed: YNMVPFFPPV (TYRP2_HUMAN)
YNMVPFFPPT

SEQ ID NO: 194825 - protein, 10 aa, Artificial Sequence
  Description of Artificial Sequence: Synthetic peptide
  Seed: FLTSDQLGYS (TYRP2_HUMAN)
FMTSDQLGYI

SEQ ID NO: 194826 - protein, 10 aa, Artificial Sequence
  Description of Artificial Sequence: Synthetic peptide
  Seed: SHQGPAFVTW (TYRP2_HUMAN)
SMQGPAFVTW

SEQ ID NO: 194827 - protein, 10 aa, Artificial Sequence
  Description of Artificial Sequence: Synthetic peptide
  Seed: REQFLGALDL (TYRP2_HUMAN)
RSQFLGALDF

SEQ ID NO: 194828 - protein, 10 aa, Artificial Sequence
  Description of Artificial Sequence: Synthetic peptide
  Seed: LLAFLQYRRL (TYRP2_HUMAN)
LMAFLQYRRV

SEQ ID NO: 194829 - protein, 10 aa, Artificial Sequence
  Description of Artificial Sequence: Synthetic peptide
  Seed: NSTFSFRNAL (TYRP2_HUMAN)
NDTFSFRNAI

SEQ ID NO: 194830 - protein, 9 aa, Artificial Sequence
  Description of Artificial Sequence: Synthetic peptide
  Seed: RKFFHRTCK (TYRP2_HUMAN)
RQFFHRTCR

SEQ ID NO: 194831 - protein, 10 aa, Artificial Sequence
  Description of Artificial Sequence: Synthetic peptide
  Seed: TDAIFDEWMK (TYRP2_HUMAN)
TSAIFDEWMK

SEQ ID NO: 194832 - protein, 9 aa, Artificial Sequence
  Description of Artificial Sequence: Synthetic peptide
  Seed: FPPVTNEEL (TYRP2_HUMAN)
FGPVTNEEM

SEQ ID NO: 194833 - protein, 9 aa, Artificial Sequence
  Description of Artificial Sequence: Synthetic peptide
  Seed: VIRQNIHSL (TYRP2_HUMAN)
VIRQNIHSV

SEQ ID NO: 194834 - protein, 10 aa, Artificial Sequence
  Description of Artificial Sequence: Synthetic peptide
  Seed: NCSVYDFFVW (TYRP2_HUMAN)
NKSVYDFFVW

SEQ ID NO: 194835 - protein, 9 aa, Artificial Sequence
  Description of Artificial Sequence: Synthetic peptide
  Seed: SLHNLVHSF (TYRP2_HUMAN)
SSHNLVHSV

SEQ ID NO: 194836 - protein, 10 aa, Artificial Sequence
  Description of Artificial Sequence: Synthetic peptide
  Seed: FFPPVTNEEL (TYRP2_HUMAN)
FIPPVTNEEF

SEQ ID NO: 194837 - protein, 10 aa, Artificial Sequence
  Description of Artificial Sequence: Synthetic peptide
  Seed: IGNESFALPY (TYRP2_HUMAN)
IQNESFALPL

SEQ ID NO: 194838 - protein, 9 aa, Artificial Sequence
  Description of Artificial Sequence: Synthetic peptide
  Seed: ANDPIFVVL (TYRP2_HUMAN)
AFDPIFVVM

SEQ ID NO: 194839 - protein, 8 aa, Artificial Sequence
  Description of Artificial Sequence: Synthetic peptide
  Seed: KFDNPPFF (TYRP2_HUMAN)
KIDNPPFL

SEQ ID NO: 194840 - protein, 9 aa, Artificial Sequence
  Description of Artificial Sequence: Synthetic peptide
  Seed: ANDPIFVVL (TYRP2_HUMAN)
ANDPIFVVI

SEQ ID NO: 194841 - protein, 10 aa, Artificial Sequence
  Description of Artificial Sequence: Synthetic peptide
  Seed: TLLGPGRPYR (TYRP2_HUMAN)
TTLGPGRPYR

SEQ ID NO: 194842 - protein, 9 aa, Artificial Sequence
  Description of Artificial Sequence: Synthetic peptide
  Seed: VVMGTLVAL (TYRP2_HUMAN)
VLMGTLVAW

SEQ ID NO: 194843 - protein, 11 aa, Artificial Sequence
  Description of Artificial Sequence: Synthetic peptide
  Seed: RMYNMVPFFPP (TYRP2_HUMAN)
RTYNMVPFFPV

SEQ ID NO: 194844 - protein, 9 aa, Artificial Sequence
  Description of Artificial Sequence: Synthetic peptide
  Seed: RMYNMVPFF (TYRP2_HUMAN)
RIYNMVPFS

SEQ ID NO: 194845 - protein, 9 aa, Artificial Sequence
  Description of Artificial Sequence: Synthetic peptide
  Seed: QKFDNPPFF (TYRP2_HUMAN)
QHFDNPPFI

SEQ ID NO: 194846 - protein, 9 aa, Artificial Sequence
  Description of Artificial Sequence: Synthetic peptide
  Seed: DQLGYSYAI (TYRP2_HUMAN)
DHLGYSYAL

SEQ ID NO: 194847 - protein, 11 aa, Artificial Sequence
  Description of Artificial Sequence: Synthetic peptide
  Seed: MYNMVPFFPPV (TYRP2_HUMAN)
MRNMVPFFPPI

SEQ ID NO: 194848 - protein, 10 aa, Artificial Sequence
  Description of Artificial Sequence: Synthetic peptide
  Seed: NGTYEGLLRR (TYRP2_HUMAN)
NFTYEGLLRK

SEQ ID NO: 194849 - protein, 9 aa, Artificial Sequence
  Description of Artificial Sequence: Synthetic peptide
  Seed: SFALPYWNF (TYRP2_HUMAN)
SFALPYWNI

SEQ ID NO: 194850 - protein, 9 aa, Artificial Sequence
  Description of Artificial Sequence: Synthetic peptide
  Seed: RLRKGYTPL (TYRP2_HUMAN)
RSRKGYTPR

SEQ ID NO: 194851 - protein, 10 aa, Artificial Sequence
  Description of Artificial Sequence: Synthetic peptide
  Seed: FPPVTNEELF (TYRP2_HUMAN)
FTPVTNEELF

SEQ ID NO: 194852 - protein, 9 aa, Artificial Sequence
  Description of Artificial Sequence: Synthetic peptide
  Seed: SLHNLVHSF (TYRP2_HUMAN)
STHNLVHSL

SEQ ID NO: 194853 - protein, 10 aa, Artificial Sequence
  Description of Artificial Sequence: Synthetic peptide
  Seed: RNSRFSSWET (TYRP2_HUMAN)
RFSRFSSWEM

SEQ ID NO: 194854 - protein, 9 aa, Artificial Sequence
  Description of Artificial Sequence: Synthetic peptide
  Seed: YAIDLPVSV (TYRP2_HUMAN)
YFIDLPVSF

SEQ ID NO: 194855 - protein, 9 aa, Artificial Sequence
  Description of Artificial Sequence: Synthetic peptide
  Seed: FVLLAFLQY (TYRP2_HUMAN)
FQLLAFLQY

SEQ ID NO: 194856 - protein, 11 aa, Artificial Sequence
  Description of Artificial Sequence: Synthetic peptide
  Seed: YTPLMETHLSS (TYRP2_HUMAN)
YNPLMETHLSI

SEQ ID NO: 194857 - protein, 10 aa, Artificial Sequence
  Description of Artificial Sequence: Synthetic peptide
  Seed: LHYYSVRDTL (TYRP2_HUMAN)
LMYYSVRDTL

SEQ ID NO: 194858 - protein, 9 aa, Artificial Sequence
  Description of Artificial Sequence: Synthetic peptide
  Seed: YSYAIDLPV (TYRP2_HUMAN)
YGYAIDLPF

SEQ ID NO: 194859 - protein, 9 aa, Artificial Sequence
  Description of Artificial Sequence: Synthetic peptide
  Seed: VVMGTLVAL (TYRP2_HUMAN)
VAMGTLVAF

SEQ ID NO: 194860 - protein, 10 aa, Artificial Sequence
  Description of Artificial Sequence: Synthetic peptide
  Seed: RMYNMVPFFP (TYRP2_HUMAN)
RQYNMVPFFD

SEQ ID NO: 194861 - protein, 10 aa, Artificial Sequence
  Description of Artificial Sequence: Synthetic peptide
  Seed: RLIGNESFAL (TYRP2_HUMAN)
RLIGNESFAW

SEQ ID NO: 194862 - protein, 10 aa, Artificial Sequence
  Description of Artificial Sequence: Synthetic peptide
  Seed: SAANDPIFVV (TYRP2_HUMAN)
SMANDPIFVV

SEQ ID NO: 194863 - protein, 11 aa, Artificial Sequence
  Description of Artificial Sequence: Synthetic peptide
  Seed: MSLHNLVHSFL (TYRP2_HUMAN)
MMLHNLVHSFL

SEQ ID NO: 194864 - protein, 10 aa, Artificial Sequence
  Description of Artificial Sequence: Synthetic peptide
  Seed: FPPVTNEELF (TYRP2_HUMAN)
FGPVTNEELY

SEQ ID NO: 194865 - protein, 9 aa, Artificial Sequence
  Description of Artificial Sequence: Synthetic peptide
  Seed: SLDDYNHLV (TYRP2_HUMAN)
SYDDYNHLC

SEQ ID NO: 194866 - protein, 9 aa, Artificial Sequence
  Description of Artificial Sequence: Synthetic peptide
  Seed: KDIRDCLSL (TYRP2_HUMAN)
KLIRDCLSF

SEQ ID NO: 194867 - protein, 9 aa, Artificial Sequence
  Description of Artificial Sequence: Synthetic peptide
  Seed: GTYEGLLRR (TYRP2_HUMAN)
GVYEGLLRK

SEQ ID NO: 194868 - protein, 10 aa, Artificial Sequence
  Description of Artificial Sequence: Synthetic peptide
  Seed: VVMGTLVALV (TYRP2_HUMAN)
VFMGTLVALV

SEQ ID NO: 194869 - protein, 10 aa, Artificial Sequence
  Description of Artificial Sequence: Synthetic peptide
  Seed: YNMVPFFPPV (TYRP2_HUMAN)
YGMVPFFPPV

SEQ ID NO: 194870 - protein, 10 aa, Artificial Sequence
  Description of Artificial Sequence: Synthetic peptide
  Seed: REQFLGALDL (TYRP2_HUMAN)
RQQFLGALDY

SEQ ID NO: 194871 - protein, 9 aa, Artificial Sequence
  Description of Artificial Sequence: Synthetic peptide
  Seed: RQNIHSLSP (TYRP2_HUMAN)
RINIHSLSM

SEQ ID NO: 194872 - protein, 10 aa, Artificial Sequence
  Description of Artificial Sequence: Synthetic peptide
  Seed: YNMVPFFPPV (TYRP2_HUMAN)
YAMVPFFPPT

SEQ ID NO: 194873 - protein, 10 aa, Artificial Sequence
  Description of Artificial Sequence: Synthetic peptide
  Seed: YNMVPFFPPV (TYRP2_HUMAN)
YGMVPFFPPL

SEQ ID NO: 194874 - protein, 9 aa, Artificial Sequence
  Description of Artificial Sequence: Synthetic peptide
  Seed: TLDSQVMSL (TYRP2_HUMAN)
TIDSQVMSI

SEQ ID NO: 194875 - protein, 10 aa, Artificial Sequence
  Description of Artificial Sequence: Synthetic peptide
  Seed: RLIGNESFAL (TYRP2_HUMAN)
RLIGNESFAY

SEQ ID NO: 194876 - protein, 9 aa, Artificial Sequence
  Description of Artificial Sequence: Synthetic peptide
  Seed: FTDAIFDEW (TYRP2_HUMAN)
FCDAIFDEL

SEQ ID NO: 194877 - protein, 9 aa, Artificial Sequence
  Description of Artificial Sequence: Synthetic peptide
  Seed: IFDEWMKRF (TYRP2_HUMAN)
IFDEWMKRY

SEQ ID NO: 194878 - protein, 9 aa, Artificial Sequence
  Description of Artificial Sequence: Synthetic peptide
  Seed: FQNSTFSFR (TYRP2_HUMAN)
FMNSTFSFR

SEQ ID NO: 194879 - protein, 9 aa, Artificial Sequence
  Description of Artificial Sequence: Synthetic peptide
  Seed: WPTTLLVVM (TYRP2_HUMAN)
WQTTLLVVY

SEQ ID NO: 194880 - protein, 10 aa, Artificial Sequence
  Description of Artificial Sequence: Synthetic peptide
  Seed: FFQNSTFSFR (TYRP2_HUMAN)
FWQNSTFSFL

SEQ ID NO: 194881 - protein, 10 aa, Artificial Sequence
  Description of Artificial Sequence: Synthetic peptide
  Seed: NPPFFQNSTF (TYRP2_HUMAN)
NYPFFQNSTM

SEQ ID NO: 194882 - protein, 9 aa, Artificial Sequence
  Description of Artificial Sequence: Synthetic peptide
  Seed: GNESFALPY (TYRP2_HUMAN)
GMESFALPM

SEQ ID NO: 194883 - protein, 10 aa, Artificial Sequence
  Description of Artificial Sequence: Synthetic peptide
  Seed: RRLRKGYTPL (TYRP2_HUMAN)
RHLRKGYTPF

SEQ ID NO: 194884 - protein, 9 aa, Artificial Sequence
  Description of Artificial Sequence: Synthetic peptide
  Seed: SVRDTLLGP (TYRP2_HUMAN)
SYRDTLLGK

SEQ ID NO: 194885 - protein, 10 aa, Artificial Sequence
  Description of Artificial Sequence: Synthetic peptide
  Seed: REQFLGALDL (TYRP2_HUMAN)
RHQFLGALDL

SEQ ID NO: 194886 - protein, 10 aa, Artificial Sequence
  Description of Artificial Sequence: Synthetic peptide
  Seed: FLTSDQLGYS (TYRP2_HUMAN)
FLTSDQLGYA

SEQ ID NO: 194887 - protein, 9 aa, Artificial Sequence
  Description of Artificial Sequence: Synthetic peptide
  Seed: YVITTQHWL (TYRP2_HUMAN)
YQITTQHWA

SEQ ID NO: 194888 - protein, 9 aa, Artificial Sequence
  Description of Artificial Sequence: Synthetic peptide
  Seed: RTCKCTGNF (TYRP2_HUMAN)
RACKCTGNF

SEQ ID NO: 194889 - protein, 9 aa, Artificial Sequence
  Description of Artificial Sequence: Synthetic peptide
  Seed: TSDQLGYSY (TYRP2_HUMAN)
TNDQLGYSM

SEQ ID NO: 194890 - protein, 9 aa, Artificial Sequence
  Description of Artificial Sequence: Synthetic peptide
  Seed: RDCLSLQKF (TYRP2_HUMAN)
RQCLSLQKF

SEQ ID NO: 194891 - protein, 9 aa, Artificial Sequence
  Description of Artificial Sequence: Synthetic peptide
  Seed: RNQDDRELW (TYRP2_HUMAN)
RLQDDRELL

SEQ ID NO: 194892 - protein, 9 aa, Artificial Sequence
  Description of Artificial Sequence: Synthetic peptide
  Seed: METHLSSKR (TYRP2_HUMAN)
MITHLSSKR

SEQ ID NO: 194893 - protein, 11 aa, Artificial Sequence
  Description of Artificial Sequence: Synthetic peptide
  Seed: RADTRPWSGPY (TYRP2_HUMAN)
RLDTRPWSGPY

SEQ ID NO: 194894 - protein, 9 aa, Artificial Sequence
  Description of Artificial Sequence: Synthetic peptide
  Seed: ELWPRKFFH (TYRP2_HUMAN)
EHWPRKFFR

SEQ ID NO: 194895 - protein, 9 aa, Artificial Sequence
  Description of Artificial Sequence: Synthetic peptide
  Seed: SLHNLVHSF (TYRP2_HUMAN)
SEHNLVHSF

SEQ ID NO: 194896 - protein, 9 aa, Artificial Sequence
  Description of Artificial Sequence: Synthetic peptide
  Seed: LSPQEREQF (TYRP2_HUMAN)
LIPQEREQL

SEQ ID NO: 194897 - protein, 11 aa, Artificial Sequence
  Description of Artificial Sequence: Synthetic peptide
  Seed: RRLRKGYTPLM (TYRP2_HUMAN)
RRLRKGYTPLI

SEQ ID NO: 194898 - protein, 10 aa, Artificial Sequence
  Description of Artificial Sequence: Synthetic peptide
  Seed: DAIFDEWMKR (TYRP2_HUMAN)
DLIFDEWMKR

SEQ ID NO: 194899 - protein, 10 aa, Artificial Sequence
  Description of Artificial Sequence: Synthetic peptide
  Seed: YAIDLPVSVE (TYRP2_HUMAN)
YQIDLPVSVI

SEQ ID NO: 194900 - protein, 9 aa, Artificial Sequence
  Description of Artificial Sequence: Synthetic peptide
  Seed: SQVMSLHNL (TYRP2_HUMAN)
SHVMSLHNY

SEQ ID NO: 194901 - protein, 10 aa, Artificial Sequence
  Description of Artificial Sequence: Synthetic peptide
  Seed: GWPTTLLVVM (TYRP2_HUMAN)
GMPTTLLVVY

SEQ ID NO: 194902 - protein, 8 aa, Artificial Sequence
  Description of Artificial Sequence: Synthetic peptide
  Seed: LAPIGHNR (TYRP2_HUMAN)
LSPIGHNL

SEQ ID NO: 194903 - protein, 10 aa, Artificial Sequence
  Description of Artificial Sequence: Synthetic peptide
  Seed: LVVMGTLVAL (TYRP2_HUMAN)
LAVMGTLVAM

SEQ ID NO: 194904 - protein, 9 aa, Artificial Sequence
  Description of Artificial Sequence: Synthetic peptide
  Seed: RAIDFSHQG (TYRP2_HUMAN)
RTIDFSHQL

SEQ ID NO: 194905 - protein, 10 aa, Artificial Sequence
  Description of Artificial Sequence: Synthetic peptide
  Seed: RRLRKGYTPL (TYRP2_HUMAN)
RVLRKGYTPI

SEQ ID NO: 194906 - protein, 10 aa, Artificial Sequence
  Description of Artificial Sequence: Synthetic peptide
  Seed: QGPAFVTWHR (TYRP2_HUMAN)
QWPAFVTWHR

SEQ ID NO: 194907 - protein, 10 aa, Artificial Sequence
  Description of Artificial Sequence: Synthetic peptide
  Seed: ETPGWPTTLL (TYRP2_HUMAN)
EIPGWPTTLV

SEQ ID NO: 194908 - protein, 9 aa, Artificial Sequence
  Description of Artificial Sequence: Synthetic peptide
  Seed: TSDQLGYSY (TYRP2_HUMAN)
TTDQLGYSM

SEQ ID NO: 194909 - protein, 8 aa, Artificial Sequence
  Description of Artificial Sequence: Synthetic peptide
  Seed: FSHQGPAF (TYRP2_HUMAN)
FVHQGPAY

SEQ ID NO: 194910 - protein, 10 aa, Artificial Sequence
  Description of Artificial Sequence: Synthetic peptide
  Seed: RLRKGYTPLM (TYRP2_HUMAN)
RFRKGYTPLY

SEQ ID NO: 194911 - protein, 10 aa, Artificial Sequence
  Description of Artificial Sequence: Synthetic peptide
  Seed: LGPNGTQPQF (TYRP2_HUMAN)
LLPNGTQPQL

SEQ ID NO: 194912 - protein, 9 aa, Artificial Sequence
  Description of Artificial Sequence: Synthetic peptide
  Seed: RLRKGYTPL (TYRP2_HUMAN)
RTRKGYTPV

SEQ ID NO: 194913 - protein, 10 aa, Artificial Sequence
  Description of Artificial Sequence: Synthetic peptide
  Seed: AANDPIFVVL (TYRP2_HUMAN)
AMNDPIFVVY

SEQ ID NO: 194914 - protein, 9 aa, Artificial Sequence
  Description of Artificial Sequence: Synthetic peptide
  Seed: YYSVRDTLL (TYRP2_HUMAN)
YWSVRDTLM

SEQ ID NO: 194915 - protein, 11 aa, Artificial Sequence
  Description of Artificial Sequence: Synthetic peptide
  Seed: HSLSPQEREQF (TYRP2_HUMAN)
HTLSPQEREQW

SEQ ID NO: 194916 - protein, 10 aa, Artificial Sequence
  Description of Artificial Sequence: Synthetic peptide
  Seed: FPPVTNEELF (TYRP2_HUMAN)
FDPVTNEELW

SEQ ID NO: 194917 - protein, 9 aa, Artificial Sequence
  Description of Artificial Sequence: Synthetic peptide
  Seed: VLHSFTDAI (TYRP2_HUMAN)
VHHSFTDAY

SEQ ID NO: 194918 - protein, 11 aa, Artificial Sequence
  Description of Artificial Sequence: Synthetic peptide
  Seed: FVVLHSFTDAI (TYRP2_HUMAN)
FFVLHSFTDAL

SEQ ID NO: 194919 - protein, 11 aa, Artificial Sequence
  Description of Artificial Sequence: Synthetic peptide
  Seed: TQPQFANCSVY (TYRP2_HUMAN)
TYPQFANCSVY

SEQ ID NO: 194920 - protein, 9 aa, Artificial Sequence
  Description of Artificial Sequence: Synthetic peptide
  Seed: ANCSVYDFF (TYRP2_HUMAN)
AQCSVYDFL

SEQ ID NO: 194921 - protein, 10 aa, Artificial Sequence
  Description of Artificial Sequence: Synthetic peptide
  Seed: YSYAIDLPVS (TYRP2_HUMAN)
YLYAIDLPVM

SEQ ID NO: 194922 - protein, 10 aa, Artificial Sequence
  Description of Artificial Sequence: Synthetic peptide
  Seed: RRLRKGYTPL (TYRP2_HUMAN)
RPLRKGYTPA

SEQ ID NO: 194923 - protein, 10 aa, Artificial Sequence
  Description of Artificial Sequence: Synthetic peptide
  Seed: FQNSTFSFRN (TYRP2_HUMAN)
FSNSTFSFRK

SEQ ID NO: 194924 - protein, 9 aa, Artificial Sequence
  Description of Artificial Sequence: Synthetic peptide
  Seed: QVMSLHNLV (TYRP2_HUMAN)
QLMSLHNLL

SEQ ID NO: 194925 - protein, 9 aa, Artificial Sequence
  Description of Artificial Sequence: Synthetic peptide
  Seed: EGLLRRNQM (TYRP2_HUMAN)
ELLLRRNQL

SEQ ID NO: 194926 - protein, 10 aa, Artificial Sequence
  Description of Artificial Sequence: Synthetic peptide
  Seed: RPWSGPYILR (TYRP2_HUMAN)
RPWSGPYILM

SEQ ID NO: 194927 - protein, 11 aa, Artificial Sequence
  Description of Artificial Sequence: Synthetic peptide
  Seed: YTPLMETHLSS (TYRP2_HUMAN)
YGPLMETHLSI

SEQ ID NO: 194928 - protein, 11 aa, Artificial Sequence
  Description of Artificial Sequence: Synthetic peptide
  Seed: QELAPIGHNRM (TYRP2_HUMAN)
QELAPIGHNRF

SEQ ID NO: 194929 - protein, 9 aa, Artificial Sequence
  Description of Artificial Sequence: Synthetic peptide
  Seed: VLLAFLQYR (TYRP2_HUMAN)
VMLAFLQYK

SEQ ID NO: 194930 - protein, 10 aa, Artificial Sequence
  Description of Artificial Sequence: Synthetic peptide
  Seed: QGPAFVTWHR (TYRP2_HUMAN)
QFPAFVTWHR

SEQ ID NO: 194931 - protein, 8 aa, Artificial Sequence
  Description of Artificial Sequence: Synthetic peptide
  Seed: KFDNPPFF (TYRP2_HUMAN)
KIDNPPFV

SEQ ID NO: 194932 - protein, 9 aa, Artificial Sequence
  Description of Artificial Sequence: Synthetic peptide
  Seed: FVLLAFLQY (TYRP2_HUMAN)
FWLLAFLQY

SEQ ID NO: 194933 - protein, 10 aa, Artificial Sequence
  Description of Artificial Sequence: Synthetic peptide
  Seed: HSFLNGTNAL (TYRP2_HUMAN)
HTFLNGTNAV

SEQ ID NO: 194934 - protein, 10 aa, Artificial Sequence
  Description of Artificial Sequence: Synthetic peptide
  Seed: MTVDSLVNKE (TYRP2_HUMAN)
MTVDSLVNKR

SEQ ID NO: 194935 - protein, 9 aa, Artificial Sequence
  Description of Artificial Sequence: Synthetic peptide
  Seed: VIRQNIHSL (TYRP2_HUMAN)
VMRQNIHSM

SEQ ID NO: 194936 - protein, 9 aa, Artificial Sequence
  Description of Artificial Sequence: Synthetic peptide
  Seed: RNSMKLPTL (TYRP2_HUMAN)
RTSMKLPTV

SEQ ID NO: 194937 - protein, 9 aa, Artificial Sequence
  Description of Artificial Sequence: Synthetic peptide
  Seed: SFRNALEGF (TYRP2_HUMAN)
SVRNALEGY

SEQ ID NO: 194938 - protein, 9 aa, Artificial Sequence
  Description of Artificial Sequence: Synthetic peptide
  Seed: STFSFRNAL (TYRP2_HUMAN)
SNFSFRNAM

SEQ ID NO: 194939 - protein, 9 aa, Artificial Sequence
  Description of Artificial Sequence: Synthetic peptide
  Seed: GWPTTLLVV (TYRP2_HUMAN)
GYPTTLLVY

SEQ ID NO: 194940 - protein, 10 aa, Artificial Sequence
  Description of Artificial Sequence: Synthetic peptide
  Seed: YDFFVWLHYY (TYRP2_HUMAN)
YYFFVWLHYW

SEQ ID NO: 194941 - protein, 9 aa, Artificial Sequence
  Description of Artificial Sequence: Synthetic peptide
  Seed: LVHSFLNGT (TYRP2_HUMAN)
LLHSFLNGV

SEQ ID NO: 194942 - protein, 9 aa, Artificial Sequence
  Description of Artificial Sequence: Synthetic peptide
  Seed: LHSFTDAIF (TYRP2_HUMAN)
LHSFTDAIY

SEQ ID NO: 194943 - protein, 9 aa, Artificial Sequence
  Description of Artificial Sequence: Synthetic peptide
  Seed: FLTSDQLGY (TYRP2_HUMAN)
FATSDQLGM

SEQ ID NO: 194944 - protein, 10 aa, Artificial Sequence
  Description of Artificial Sequence: Synthetic peptide
  Seed: RPWSGPYILR (TYRP2_HUMAN)
RGWSGPYILK

SEQ ID NO: 194945 - protein, 9 aa, Artificial Sequence
  Description of Artificial Sequence: Synthetic peptide
  Seed: YYSVRDTLL (TYRP2_HUMAN)
YTSVRDTLF

SEQ ID NO: 194946 - protein, 9 aa, Artificial Sequence
  Description of Artificial Sequence: Synthetic peptide
  Seed: CERKKPPVI (TYRP2_HUMAN)
CMRKKPPVM

SEQ ID NO: 194947 - protein, 9 aa, Artificial Sequence
  Description of Artificial Sequence: Synthetic peptide
  Seed: DFFVWLHYY (TYRP2_HUMAN)
DVFVWLHYY

SEQ ID NO: 194948 - protein, 10 aa, Artificial Sequence
  Description of Artificial Sequence: Synthetic peptide
  Seed: ELAPIGHNRM (TYRP2_HUMAN)
EVAPIGHNRA

SEQ ID NO: 194949 - protein, 10 aa, Artificial Sequence
  Description of Artificial Sequence: Synthetic peptide
  Seed: TVDSLVNKEC (TYRP2_HUMAN)
TMDSLVNKEF

SEQ ID NO: 194950 - protein, 9 aa, Artificial Sequence
  Description of Artificial Sequence: Synthetic peptide
  Seed: FFQNSTFSF (TYRP2_HUMAN)
FPQNSTFSA

SEQ ID NO: 194951 - protein, 11 aa, Artificial Sequence
  Description of Artificial Sequence: Synthetic peptide
  Seed: RNSRFSSWETV (TYRP2_HUMAN)
RVSRFSSWETI

SEQ ID NO: 194952 - protein, 10 aa, Artificial Sequence
  Description of Artificial Sequence: Synthetic peptide
  Seed: GPAFVTWHRY (TYRP2_HUMAN)
GIAFVTWHRY

SEQ ID NO: 194953 - protein, 10 aa, Artificial Sequence
  Description of Artificial Sequence: Synthetic peptide
  Seed: ELAPIGHNRM (TYRP2_HUMAN)
EAAPIGHNRV

SEQ ID NO: 194954 - protein, 9 aa, Artificial Sequence
  Description of Artificial Sequence: Synthetic peptide
  Seed: MTVDSLVNK (TYRP2_HUMAN)
MLVDSLVNR

SEQ ID NO: 194955 - protein, 10 aa, Artificial Sequence
  Description of Artificial Sequence: Synthetic peptide
  Seed: RLIGNESFAL (TYRP2_HUMAN)
RIIGNESFAL

SEQ ID NO: 194956 - protein, 10 aa, Artificial Sequence
  Description of Artificial Sequence: Synthetic peptide
  Seed: SVYDFFVWLH (TYRP2_HUMAN)
SCYDFFVWLY

SEQ ID NO: 194957 - protein, 10 aa, Artificial Sequence
  Description of Artificial Sequence: Synthetic peptide
  Seed: YNMVPFFPPV (TYRP2_HUMAN)
YAMVPFFPPA

SEQ ID NO: 194958 - protein, 10 aa, Artificial Sequence
  Description of Artificial Sequence: Synthetic peptide
  Seed: LVVMGTLVAL (TYRP2_HUMAN)
LNVMGTLVAF

SEQ ID NO: 194959 - protein, 8 aa, Artificial Sequence
  Description of Artificial Sequence: Synthetic peptide
  Seed: NSMKLPTL (TYRP2_HUMAN)
NQMKLPTV

SEQ ID NO: 194960 - protein, 10 aa, Artificial Sequence
  Description of Artificial Sequence: Synthetic peptide
  Seed: TQPQFANCSV (TYRP2_HUMAN)
TVPQFANCSL

SEQ ID NO: 194961 - protein, 9 aa, Artificial Sequence
  Description of Artificial Sequence: Synthetic peptide
  Seed: YYSVRDTLL (TYRP2_HUMAN)
YYSVRDTLF

SEQ ID NO: 194962 - protein, 10 aa, Artificial Sequence
  Description of Artificial Sequence: Synthetic peptide
  Seed: LHYYSVRDTL (TYRP2_HUMAN)
LTYYSVRDTL

SEQ ID NO: 194963 - protein, 10 aa, Artificial Sequence
  Description of Artificial Sequence: Synthetic peptide
  Seed: YDFFVWLHYY (TYRP2_HUMAN)
YWFFVWLHYF

SEQ ID NO: 194964 - protein, 9 aa, Artificial Sequence
  Description of Artificial Sequence: Synthetic peptide
  Seed: HQGPAFVTW (TYRP2_HUMAN)
HPGPAFVTL

SEQ ID NO: 194965 - protein, 10 aa, Artificial Sequence
  Description of Artificial Sequence: Synthetic peptide
  Seed: SVYDFFVWLH (TYRP2_HUMAN)
STYDFFVWLY

SEQ ID NO: 194966 - protein, 9 aa, Artificial Sequence
  Description of Artificial Sequence: Synthetic peptide
  Seed: VALVGLFVL (TYRP2_HUMAN)
VQLVGLFVL

SEQ ID NO: 194967 - protein, 9 aa, Artificial Sequence
  Description of Artificial Sequence: Synthetic peptide
  Seed: FLLSCLGCK (TYRP2_HUMAN)
FTLSCLGCR

SEQ ID NO: 194968 - protein, 10 aa, Artificial Sequence
  Description of Artificial Sequence: Synthetic peptide
  Seed: NRMYNMVPFF (TYRP2_HUMAN)
NMMYNMVPFY

SEQ ID NO: 194969 - protein, 10 aa, Artificial Sequence
  Description of Artificial Sequence: Synthetic peptide
  Seed: RRLRKGYTPL (TYRP2_HUMAN)
RDLRKGYTPF

SEQ ID NO: 194970 - protein, 11 aa, Artificial Sequence
  Description of Artificial Sequence: Synthetic peptide
  Seed: RADTRPWSGPY (TYRP2_HUMAN)
RRDTRPWSGPF

SEQ ID NO: 194971 - protein, 9 aa, Artificial Sequence
  Description of Artificial Sequence: Synthetic peptide
  Seed: SPLWWGFLL (TYRP2_HUMAN)
STLWWGFLA

SEQ ID NO: 194972 - protein, 10 aa, Artificial Sequence
  Description of Artificial Sequence: Synthetic peptide
  Seed: RMYNMVPFFP (TYRP2_HUMAN)
RIYNMVPFFM

SEQ ID NO: 194973 - protein, 11 aa, Artificial Sequence
  Description of Artificial Sequence: Synthetic peptide
  Seed: YTPLMETHLSS (TYRP2_HUMAN)
YHPLMETHLSL

SEQ ID NO: 194974 - protein, 10 aa, Artificial Sequence
  Description of Artificial Sequence: Synthetic peptide
  Seed: KADGTLDSQV (TYRP2_HUMAN)
KLDGTLDSQL

SEQ ID NO: 194975 - protein, 10 aa, Artificial Sequence
  Description of Artificial Sequence: Synthetic peptide
  Seed: MSLHNLVHSF (TYRP2_HUMAN)
MILHNLVHSF

SEQ ID NO: 194976 - protein, 11 aa, Artificial Sequence
  Description of Artificial Sequence: Synthetic peptide
  Seed: YNMVPFFPPVT (TYRP2_HUMAN)
YLMVPFFPPVT

SEQ ID NO: 194977 - protein, 10 aa, Artificial Sequence
  Description of Artificial Sequence: Synthetic peptide
  Seed: VLHSFTDAIF (TYRP2_HUMAN)
VQHSFTDAIL

SEQ ID NO: 194978 - protein, 9 aa, Artificial Sequence
  Description of Artificial Sequence: Synthetic peptide
  Seed: GTLVALVGL (TYRP2_HUMAN)
GMLVALVGL

SEQ ID NO: 194979 - protein, 9 aa, Artificial Sequence
  Description of Artificial Sequence: Synthetic peptide
  Seed: TLDSQVMSL (TYRP2_HUMAN)
TQDSQVMSL

SEQ ID NO: 194980 - protein, 9 aa, Artificial Sequence
  Description of Artificial Sequence: Synthetic peptide
  Seed: RVHPDYVIT (TYRP2_HUMAN)
RLHPDYVIK

SEQ ID NO: 194981 - protein, 9 aa, Artificial Sequence
  Description of Artificial Sequence: Synthetic peptide
  Seed: ILPGAQGQF (TYRP2_HUMAN)
IWPGAQGQF

SEQ ID NO: 194982 - protein, 9 aa, Artificial Sequence
  Description of Artificial Sequence: Synthetic peptide
  Seed: FTDAIFDEW (TYRP2_HUMAN)
FGDAIFDEL

SEQ ID NO: 194983 - protein, 10 aa, Artificial Sequence
  Description of Artificial Sequence: Synthetic peptide
  Seed: FPPVTNEELF (TYRP2_HUMAN)
FLPVTNEELY

SEQ ID NO: 194984 - protein, 10 aa, Artificial Sequence
  Description of Artificial Sequence: Synthetic peptide
  Seed: RNSMKLPTLK (TYRP2_HUMAN)
RDSMKLPTLR

SEQ ID NO: 194985 - protein, 9 aa, Artificial Sequence
  Description of Artificial Sequence: Synthetic peptide
  Seed: AARPDDPTL (TYRP2_HUMAN)
AKRPDDPTF

SEQ ID NO: 194986 - protein, 11 aa, Artificial Sequence
  Description of Artificial Sequence: Synthetic peptide
  Seed: QFLGALDLAKK (TYRP2_HUMAN)
QVLGALDLAKK

SEQ ID NO: 194987 - protein, 9 aa, Artificial Sequence
  Description of Artificial Sequence: Synthetic peptide
  Seed: HYYSVRDTL (TYRP2_HUMAN)
HHYSVRDTY

SEQ ID NO: 194988 - protein, 9 aa, Artificial Sequence
  Description of Artificial Sequence: Synthetic peptide
  Seed: WMKRFNPPA (TYRP2_HUMAN)
WMKRFNPPL

SEQ ID NO: 194989 - protein, 10 aa, Artificial Sequence
  Description of Artificial Sequence: Synthetic peptide
  Seed: QPQFANCSVY (TYRP2_HUMAN)
QMQFANCSVL

SEQ ID NO: 194990 - protein, 9 aa, Artificial Sequence
  Description of Artificial Sequence: Synthetic peptide
  Seed: FLNGTNALP (TYRP2_HUMAN)
FINGTNALL

SEQ ID NO: 194991 - protein, 9 aa, Artificial Sequence
  Description of Artificial Sequence: Synthetic peptide
  Seed: RMYNMVPFF (TYRP2_HUMAN)
RVYNMVPFT

SEQ ID NO: 194992 - protein, 9 aa, Artificial Sequence
  Description of Artificial Sequence: Synthetic peptide
  Seed: TTQHWLGLL (TYRP2_HUMAN)
TTQHWLGLW

SEQ ID NO: 194993 - protein, 11 aa, Artificial Sequence
  Description of Artificial Sequence: Synthetic peptide
  Seed: FFPPVTNEELF (TYRP2_HUMAN)
FYPPVTNEELW

SEQ ID NO: 194994 - protein, 8 aa, Artificial Sequence
  Description of Artificial Sequence: Synthetic peptide
  Seed: VPFFPPVT (TYRP2_HUMAN)
VPFFPPVI

SEQ ID NO: 194995 - protein, 9 aa, Artificial Sequence
  Description of Artificial Sequence: Synthetic peptide
  Seed: LLGPGRPYR (TYRP2_HUMAN)
LFGPGRPYR

SEQ ID NO: 194996 - protein, 9 aa, Artificial Sequence
  Description of Artificial Sequence: Synthetic peptide
  Seed: VVMGTLVAL (TYRP2_HUMAN)
VSMGTLVAM

SEQ ID NO: 194997 - protein, 11 aa, Artificial Sequence
  Description of Artificial Sequence: Synthetic peptide
  Seed: LPVSVEETPGW (TYRP2_HUMAN)
LHVSVEETPGW

SEQ ID NO: 194998 - protein, 8 aa, Artificial Sequence
  Description of Artificial Sequence: Synthetic peptide
  Seed: KFDNPPFF (TYRP2_HUMAN)
KSDNPPFI

SEQ ID NO: 194999 - protein, 10 aa, Artificial Sequence
  Description of Artificial Sequence: Synthetic peptide
  Seed: GNESFALPYW (TYRP2_HUMAN)
GEESFALPYW

SEQ ID NO: 195000 - protein, 10 aa, Artificial Sequence
  Description of Artificial Sequence: Synthetic peptide
  Seed: DSLDDYNHLV (TYRP2_HUMAN)
DMLDDYNHLL

SEQ ID NO: 195001 - protein, 9 aa, Artificial Sequence
  Description of Artificial Sequence: Synthetic peptide
  Seed: VLLAFLQYR (TYRP2_HUMAN)
VALAFLQYR

SEQ ID NO: 195002 - protein, 10 aa, Artificial Sequence
  Description of Artificial Sequence: Synthetic peptide
  Seed: TRPWSGPYIL (TYRP2_HUMAN)
TRPWSGPYII

SEQ ID NO: 195003 - protein, 9 aa, Artificial Sequence
  Description of Artificial Sequence: Synthetic peptide
  Seed: FSHQGPAFV (TYRP2_HUMAN)
FIHQGPAFF

SEQ ID NO: 195004 - protein, 10 aa, Artificial Sequence
  Description of Artificial Sequence: Synthetic peptide
  Seed: MSPLWWGFLL (TYRP2_HUMAN)
MTPLWWGFLL

SEQ ID NO: 195005 - protein, 10 aa, Artificial Sequence
  Description of Artificial Sequence: Synthetic peptide
  Seed: VVMGTLVALV (TYRP2_HUMAN)
VGMGTLVALV

SEQ ID NO: 195006 - protein, 10 aa, Artificial Sequence
  Description of Artificial Sequence: Synthetic peptide
  Seed: VVMGTLVALV (TYRP2_HUMAN)
VVMGTLVALL

SEQ ID NO: 195007 - protein, 8 aa, Artificial Sequence
  Description of Artificial Sequence: Synthetic peptide
  Seed: QFANCSVY (TYRP2_HUMAN)
QYANCSVY

SEQ ID NO: 195008 - protein, 11 aa, Artificial Sequence
  Description of Artificial Sequence: Synthetic peptide
  Seed: MYNMVPFFPPV (TYRP2_HUMAN)
MFNMVPFFPPV

SEQ ID NO: 195009 - protein, 10 aa, Artificial Sequence
  Description of Artificial Sequence: Synthetic peptide
  Seed: YNMVPFFPPV (TYRP2_HUMAN)
YIMVPFFPPL

SEQ ID NO: 195010 - protein, 10 aa, Artificial Sequence
  Description of Artificial Sequence: Synthetic peptide
  Seed: SVYDFFVWLH (TYRP2_HUMAN)
SVYDFFVWLR

SEQ ID NO: 195011 - protein, 10 aa, Artificial Sequence
  Description of Artificial Sequence: Synthetic peptide
  Seed: VLLAFLQYRR (TYRP2_HUMAN)
VPLAFLQYRK

SEQ ID NO: 195012 - protein, 9 aa, Artificial Sequence
  Description of Artificial Sequence: Synthetic peptide
  Seed: FPPVTNEEL (TYRP2_HUMAN)
FYPVTNEEF

SEQ ID NO: 195013 - protein, 9 aa, Artificial Sequence
  Description of Artificial Sequence: Synthetic peptide
  Seed: GLFVLLAFL (TYRP2_HUMAN)
GMFVLLAFM

SEQ ID NO: 195014 - protein, 10 aa, Artificial Sequence
  Description of Artificial Sequence: Synthetic peptide
  Seed: MSPLWWGFLL (TYRP2_HUMAN)
MDPLWWGFLF

SEQ ID NO: 195015 - protein, 10 aa, Artificial Sequence
  Description of Artificial Sequence: Synthetic peptide
  Seed: LTSDQLGYSY (TYRP2_HUMAN)
LVSDQLGYSW

SEQ ID NO: 195016 - protein, 8 aa, Artificial Sequence
  Description of Artificial Sequence: Synthetic peptide
  Seed: SLDDYNHL (TYRP2_HUMAN)
STDDYNHL

SEQ ID NO: 195017 - protein, 11 aa, Artificial Sequence
  Description of Artificial Sequence: Synthetic peptide
  Seed: VCDSLDDYNHL (TYRP2_HUMAN)
VADSLDDYNHF

SEQ ID NO: 195018 - protein, 9 aa, Artificial Sequence
  Description of Artificial Sequence: Synthetic peptide
  Seed: RLRKGYTPL (TYRP2_HUMAN)
RSRKGYTPN

SEQ ID NO: 195019 - protein, 9 aa, Artificial Sequence
  Description of Artificial Sequence: Synthetic peptide
  Seed: ANDPIFVVL (TYRP2_HUMAN)
AADPIFVVF

SEQ ID NO: 195020 - protein, 9 aa, Artificial Sequence
  Description of Artificial Sequence: Synthetic peptide
  Seed: VGLFVLLAF (TYRP2_HUMAN)
VKLFVLLAL

SEQ ID NO: 195021 - protein, 10 aa, Artificial Sequence
  Description of Artificial Sequence: Synthetic peptide
  Seed: LTSDQLGYSY (TYRP2_HUMAN)
LCSDQLGYSY

SEQ ID NO: 195022 - protein, 10 aa, Artificial Sequence
  Description of Artificial Sequence: Synthetic peptide
  Seed: NGTYEGLLRR (TYRP2_HUMAN)
NNTYEGLLRR

SEQ ID NO: 195023 - protein, 11 aa, Artificial Sequence
  Description of Artificial Sequence: Synthetic peptide
  Seed: YTPLMETHLSS (TYRP2_HUMAN)
YMPLMETHLST

SEQ ID NO: 195024 - protein, 10 aa, Artificial Sequence
  Description of Artificial Sequence: Synthetic peptide
  Seed: FVVLHSFTDA (TYRP2_HUMAN)
FQVLHSFTDV

SEQ ID NO: 195025 - protein, 10 aa, Artificial Sequence
  Description of Artificial Sequence: Synthetic peptide
  Seed: ALVGLFVLLA (TYRP2_HUMAN)
AQVGLFVLLA

SEQ ID NO: 195026 - protein, 9 aa, Artificial Sequence
  Description of Artificial Sequence: Synthetic peptide
  Seed: HQGPAFVTW (TYRP2_HUMAN)
HCGPAFVTW

SEQ ID NO: 195027 - protein, 9 aa, Artificial Sequence
  Description of Artificial Sequence: Synthetic peptide
  Seed: RLRKGYTPL (TYRP2_HUMAN)
RFRKGYTPN

SEQ ID NO: 195028 - protein, 11 aa, Artificial Sequence
  Description of Artificial Sequence: Synthetic peptide
  Seed: YTPLMETHLSS (TYRP2_HUMAN)
YFPLMETHLSI

SEQ ID NO: 195029 - protein, 11 aa, Artificial Sequence
  Description of Artificial Sequence: Synthetic peptide
  Seed: YNMVPFFPPVT (TYRP2_HUMAN)
YQMVPFFPPVQ

SEQ ID NO: 195030 - protein, 9 aa, Artificial Sequence
  Description of Artificial Sequence: Synthetic peptide
  Seed: AARPDDPTL (TYRP2_HUMAN)
AIRPDDPTF

SEQ ID NO: 195031 - protein, 9 aa, Artificial Sequence
  Description of Artificial Sequence: Synthetic peptide
  Seed: NVCGSQQGR (TYRP2_HUMAN)
NACGSQQGR

SEQ ID NO: 195032 - protein, 9 aa, Artificial Sequence
  Description of Artificial Sequence: Synthetic peptide
  Seed: YSYAIDLPV (TYRP2_HUMAN)
YKYAIDLPV

SEQ ID NO: 195033 - protein, 9 aa, Artificial Sequence
  Description of Artificial Sequence: Synthetic peptide
  Seed: YTPLMETHL (TYRP2_HUMAN)
YFPLMETHF

SEQ ID NO: 195034 - protein, 9 aa, Artificial Sequence
  Description of Artificial Sequence: Synthetic peptide
  Seed: VEETPGWPT (TYRP2_HUMAN)
VEETPGWPI

SEQ ID NO: 195035 - protein, 9 aa, Artificial Sequence
  Description of Artificial Sequence: Synthetic peptide
  Seed: VVMGTLVAL (TYRP2_HUMAN)
VPMGTLVAT

SEQ ID NO: 195036 - protein, 11 aa, Artificial Sequence
  Description of Artificial Sequence: Synthetic peptide
  Seed: FGAARPDDPTL (TYRP2_HUMAN)
FAAARPDDPTL

SEQ ID NO: 195037 - protein, 10 aa, Artificial Sequence
  Description of Artificial Sequence: Synthetic peptide
  Seed: SHQGPAFVTW (TYRP2_HUMAN)
SHQGPAFVTF

SEQ ID NO: 195038 - protein, 9 aa, Artificial Sequence
  Description of Artificial Sequence: Synthetic peptide
  Seed: HSFLNGTNA (TYRP2_HUMAN)
HHFLNGTNL

SEQ ID NO: 195039 - protein, 9 aa, Artificial Sequence
  Description of Artificial Sequence: Synthetic peptide
  Seed: QKFDNPPFF (TYRP2_HUMAN)
QLFDNPPFL

SEQ ID NO: 195040 - protein, 11 aa, Artificial Sequence
  Description of Artificial Sequence: Synthetic peptide
  Seed: RNSRFSSWETV (TYRP2_HUMAN)
RWSRFSSWETF

SEQ ID NO: 195041 - protein, 10 aa, Artificial Sequence
  Description of Artificial Sequence: Synthetic peptide
  Seed: YDFFVWLHYY (TYRP2_HUMAN)
YMFFVWLHYW

SEQ ID NO: 195042 - protein, 9 aa, Artificial Sequence
  Description of Artificial Sequence: Synthetic peptide
  Seed: SFLNGTNAL (TYRP2_HUMAN)
SALNGTNAV

SEQ ID NO: 195043 - protein, 11 aa, Artificial Sequence
  Description of Artificial Sequence: Synthetic peptide
  Seed: FSHQGPAFVTW (TYRP2_HUMAN)
FVHQGPAFVTW

SEQ ID NO: 195044 - protein, 9 aa, Artificial Sequence
  Description of Artificial Sequence: Synthetic peptide
  Seed: YYSVRDTLL (TYRP2_HUMAN)
YASVRDTLM

SEQ ID NO: 195045 - protein, 10 aa, Artificial Sequence
  Description of Artificial Sequence: Synthetic peptide
  Seed: LHYYSVRDTL (TYRP2_HUMAN)
LYYYSVRDTI

SEQ ID NO: 195046 - protein, 10 aa, Artificial Sequence
  Description of Artificial Sequence: Synthetic peptide
  Seed: RLIGNESFAL (TYRP2_HUMAN)
RQIGNESFAF

SEQ ID NO: 195047 - protein, 10 aa, Artificial Sequence
  Description of Artificial Sequence: Synthetic peptide
  Seed: SLDDYNHLVT (TYRP2_HUMAN)
SCDDYNHLVL

SEQ ID NO: 195048 - protein, 11 aa, Artificial Sequence
  Description of Artificial Sequence: Synthetic peptide
  Seed: YTPLMETHLSS (TYRP2_HUMAN)
YKPLMETHLST

SEQ ID NO: 195049 - protein, 10 aa, Artificial Sequence
  Description of Artificial Sequence: Synthetic peptide
  Seed: LVVMGTLVAL (TYRP2_HUMAN)
LRVMGTLVAL

SEQ ID NO: 195050 - protein, 9 aa, Artificial Sequence
  Description of Artificial Sequence: Synthetic peptide
  Seed: GTYEGLLRR (TYRP2_HUMAN)
GLYEGLLRL

SEQ ID NO: 195051 - protein, 9 aa, Artificial Sequence
  Description of Artificial Sequence: Synthetic peptide
  Seed: AANDPIFVV (TYRP2_HUMAN)
ASNDPIFVY

SEQ ID NO: 195052 - protein, 11 aa, Artificial Sequence
  Description of Artificial Sequence: Synthetic peptide
  Seed: LLVVMGTLVAL (TYRP2_HUMAN)
LLVVMGTLVAV

SEQ ID NO: 195053 - protein, 9 aa, Artificial Sequence
  Description of Artificial Sequence: Synthetic peptide
  Seed: EQFLGALDL (TYRP2_HUMAN)
EAFLGALDY

SEQ ID NO: 195054 - protein, 9 aa, Artificial Sequence
  Description of Artificial Sequence: Synthetic peptide
  Seed: SVYDFFVWL (TYRP2_HUMAN)
SQYDFFVWL

SEQ ID NO: 195055 - protein, 9 aa, Artificial Sequence
  Description of Artificial Sequence: Synthetic peptide
  Seed: RDCLSLQKF (TYRP2_HUMAN)
RLCLSLQKW

SEQ ID NO: 195056 - protein, 9 aa, Artificial Sequence
  Description of Artificial Sequence: Synthetic peptide
  Seed: RVCMTVDSL (TYRP2_HUMAN)
RMCMTVDSI

SEQ ID NO: 195057 - protein, 9 aa, Artificial Sequence
  Description of Artificial Sequence: Synthetic peptide
  Seed: SVYDFFVWL (TYRP2_HUMAN)
SAYDFFVWY

SEQ ID NO: 195058 - protein, 10 aa, Artificial Sequence
  Description of Artificial Sequence: Synthetic peptide
  Seed: HNRMYNMVPF (TYRP2_HUMAN)
HDRMYNMVPM

SEQ ID NO: 195059 - protein, 10 aa, Artificial Sequence
  Description of Artificial Sequence: Synthetic peptide
  Seed: LSPQEREQFL (TYRP2_HUMAN)
LTPQEREQFW

SEQ ID NO: 195060 - protein, 10 aa, Artificial Sequence
  Description of Artificial Sequence: Synthetic peptide
  Seed: RRLRKGYTPL (TYRP2_HUMAN)
RPLRKGYTPM

SEQ ID NO: 195061 - protein, 11 aa, Artificial Sequence
  Description of Artificial Sequence: Synthetic peptide
  Seed: FLTSDQLGYSY (TYRP2_HUMAN)
FCTSDQLGYSY

SEQ ID NO: 195062 - protein, 9 aa, Artificial Sequence
  Description of Artificial Sequence: Synthetic peptide
  Seed: VVMGTLVAL (TYRP2_HUMAN)
VNMGTLVAM

SEQ ID NO: 195063 - protein, 11 aa, Artificial Sequence
  Description of Artificial Sequence: Synthetic peptide
  Seed: SLSPQEREQFL (TYRP2_HUMAN)
SQSPQEREQFF

SEQ ID NO: 195064 - protein, 10 aa, Artificial Sequence
  Description of Artificial Sequence: Synthetic peptide
  Seed: YNMVPFFPPV (TYRP2_HUMAN)
YKMVPFFPPT

SEQ ID NO: 195065 - protein, 10 aa, Artificial Sequence
  Description of Artificial Sequence: Synthetic peptide
  Seed: VVMGTLVALV (TYRP2_HUMAN)
VNMGTLVALV

SEQ ID NO: 195066 - protein, 9 aa, Artificial Sequence
  Description of Artificial Sequence: Synthetic peptide
  Seed: DDYNHLVTL (TYRP2_HUMAN)
DHYNHLVTA

SEQ ID NO: 195067 - protein, 9 aa, Artificial Sequence
  Description of Artificial Sequence: Synthetic peptide
  Seed: LLRRNQMGR (TYRP2_HUMAN)
LMRRNQMGK

SEQ ID NO: 195068 - protein, 9 aa, Artificial Sequence
  Description of Artificial Sequence: Synthetic peptide
  Seed: HSAANDPIF (TYRP2_HUMAN)
HIAANDPIF

SEQ ID NO: 195069 - protein, 10 aa, Artificial Sequence
  Description of Artificial Sequence: Synthetic peptide
  Seed: SDQLGYSYAI (TYRP2_HUMAN)
SKQLGYSYAF

SEQ ID NO: 195070 - protein, 9 aa, Artificial Sequence
  Description of Artificial Sequence: Synthetic peptide
  Seed: APIGHNRMY (TYRP2_HUMAN)
ATIGHNRMY

SEQ ID NO: 195071 - protein, 9 aa, Artificial Sequence
  Description of Artificial Sequence: Synthetic peptide
  Seed: WPTTLLVVM (TYRP2_HUMAN)
WPTTLLVVH

SEQ ID NO: 195072 - protein, 9 aa, Artificial Sequence
  Description of Artificial Sequence: Synthetic peptide
  Seed: YSYAIDLPV (TYRP2_HUMAN)
YIYAIDLPL

SEQ ID NO: 195073 - protein, 10 aa, Artificial Sequence
  Description of Artificial Sequence: Synthetic peptide
  Seed: CMTVDSLVNK (TYRP2_HUMAN)
CHTVDSLVNK

SEQ ID NO: 195074 - protein, 9 aa, Artificial Sequence
  Description of Artificial Sequence: Synthetic peptide
  Seed: LSPQEREQF (TYRP2_HUMAN)
LVPQEREQM

SEQ ID NO: 195075 - protein, 10 aa, Artificial Sequence
  Description of Artificial Sequence: Synthetic peptide
  Seed: FSFRNALEGF (TYRP2_HUMAN)
FFFRNALEGM

SEQ ID NO: 195076 - protein, 11 aa, Artificial Sequence
  Description of Artificial Sequence: Synthetic peptide
  Seed: FVVLHSFTDAI (TYRP2_HUMAN)
FAVLHSFTDAV

SEQ ID NO: 195077 - protein, 9 aa, Artificial Sequence
  Description of Artificial Sequence: Synthetic peptide
  Seed: ERKKPPVIR (TYRP2_HUMAN)
EIKKPPVIR

SEQ ID NO: 195078 - protein, 11 aa, Artificial Sequence
  Description of Artificial Sequence: Synthetic peptide
  Seed: YTPLMETHLSS (TYRP2_HUMAN)
YGPLMETHLSA

SEQ ID NO: 195079 - protein, 10 aa, Artificial Sequence
  Description of Artificial Sequence: Synthetic peptide
  Seed: SQVMSLHNLV (TYRP2_HUMAN)
SDVMSLHNLV

SEQ ID NO: 195080 - protein, 10 aa, Artificial Sequence
  Description of Artificial Sequence: Synthetic peptide
  Seed: FVWLHYYSVR (TYRP2_HUMAN)
FLWLHYYSVK

SEQ ID NO: 195081 - protein, 9 aa, Artificial Sequence
  Description of Artificial Sequence: Synthetic peptide
  Seed: FANCSVYDF (TYRP2_HUMAN)
FLNCSVYDF

SEQ ID NO: 195082 - protein, 8 aa, Artificial Sequence
  Description of Artificial Sequence: Synthetic peptide
  Seed: MSPLWWGF (TYRP2_HUMAN)
MTPLWWGW

SEQ ID NO: 195083 - protein, 9 aa, Artificial Sequence
  Description of Artificial Sequence: Synthetic peptide
  Seed: VHPDYVITT (TYRP2_HUMAN)
VNPDYVITM

SEQ ID NO: 195084 - protein, 9 aa, Artificial Sequence
  Description of Artificial Sequence: Synthetic peptide
  Seed: AANDPIFVV (TYRP2_HUMAN)
ALNDPIFVW

SEQ ID NO: 195085 - protein, 9 aa, Artificial Sequence
  Description of Artificial Sequence: Synthetic peptide
  Seed: RQNIHSLSP (TYRP2_HUMAN)
RVNIHSLSF

SEQ ID NO: 195086 - protein, 9 aa, Artificial Sequence
  Description of Artificial Sequence: Synthetic peptide
  Seed: LSPQEREQF (TYRP2_HUMAN)
LYPQEREQL

SEQ ID NO: 195087 - protein, 10 aa, Artificial Sequence
  Description of Artificial Sequence: Synthetic peptide
  Seed: SRFSSWETVC (TYRP2_HUMAN)
SRFSSWETVV

SEQ ID NO: 195088 - protein, 9 aa, Artificial Sequence
  Description of Artificial Sequence: Synthetic peptide
  Seed: WMKRFNPPA (TYRP2_HUMAN)
WQKRFNPPK

SEQ ID NO: 195089 - protein, 9 aa, Artificial Sequence
  Description of Artificial Sequence: Synthetic peptide
  Seed: VVMGTLVAL (TYRP2_HUMAN)
VQMGTLVAT

SEQ ID NO: 195090 - protein, 9 aa, Artificial Sequence
  Description of Artificial Sequence: Synthetic peptide
  Seed: EGLLRRNQM (TYRP2_HUMAN)
EMLLRRNQI

SEQ ID NO: 195091 - protein, 9 aa, Artificial Sequence
  Description of Artificial Sequence: Synthetic peptide
  Seed: VALVGLFVL (TYRP2_HUMAN)
VSLVGLFVW

SEQ ID NO: 195092 - protein, 11 aa, Artificial Sequence
  Description of Artificial Sequence: Synthetic peptide
  Seed: VCDSLDDYNHL (TYRP2_HUMAN)
VVDSLDDYNHL

SEQ ID NO: 195093 - protein, 10 aa, Artificial Sequence
  Description of Artificial Sequence: Synthetic peptide
  Seed: LFVLLAFLQY (TYRP2_HUMAN)
LYVLLAFLQY

SEQ ID NO: 195094 - protein, 9 aa, Artificial Sequence
  Description of Artificial Sequence: Synthetic peptide
  Seed: WPTTLLVVM (TYRP2_HUMAN)
WPTTLLVVV

SEQ ID NO: 195095 - protein, 10 aa, Artificial Sequence
  Description of Artificial Sequence: Synthetic peptide
  Seed: FFVWLHYYSV (TYRP2_HUMAN)
FMVWLHYYST

SEQ ID NO: 195096 - protein, 9 aa, Artificial Sequence
  Description of Artificial Sequence: Synthetic peptide
  Seed: QRLIGNESF (TYRP2_HUMAN)
QHLIGNESY

SEQ ID NO: 195097 - protein, 9 aa, Artificial Sequence
  Description of Artificial Sequence: Synthetic peptide
  Seed: MSPLWWGFL (TYRP2_HUMAN)
MWPLWWGFF

SEQ ID NO: 195098 - protein, 10 aa, Artificial Sequence
  Description of Artificial Sequence: Synthetic peptide
  Seed: FVLLAFLQYR (TYRP2_HUMAN)
FMLLAFLQYR

SEQ ID NO: 195099 - protein, 11 aa, Artificial Sequence
  Description of Artificial Sequence: Synthetic peptide
  Seed: SLSPQEREQFL (TYRP2_HUMAN)
SQSPQEREQFL

SEQ ID NO: 195100 - protein, 9 aa, Artificial Sequence
  Description of Artificial Sequence: Synthetic peptide
  Seed: ANDPIFVVL (TYRP2_HUMAN)
AVDPIFVVV

SEQ ID NO: 195101 - protein, 9 aa, Artificial Sequence
  Description of Artificial Sequence: Synthetic peptide
  Seed: GPNGTQPQF (TYRP2_HUMAN)
GMNGTQPQY

SEQ ID NO: 195102 - protein, 11 aa, Artificial Sequence
  Description of Artificial Sequence: Synthetic peptide
  Seed: FANCSVYDFFV (TYRP2_HUMAN)
FMNCSVYDFFL

SEQ ID NO: 195103 - protein, 9 aa, Artificial Sequence
  Description of Artificial Sequence: Synthetic peptide
  Seed: FFPPVTNEE (TYRP2_HUMAN)
FWPPVTNEL

SEQ ID NO: 195104 - protein, 9 aa, Artificial Sequence
  Description of Artificial Sequence: Synthetic peptide
  Seed: NEELFLTSD (TYRP2_HUMAN)
NEELFLTSC

SEQ ID NO: 195105 - protein, 11 aa, Artificial Sequence
  Description of Artificial Sequence: Synthetic peptide
  Seed: FFPPVTNEELF (TYRP2_HUMAN)
FPPPVTNEELY

SEQ ID NO: 195106 - protein, 9 aa, Artificial Sequence
  Description of Artificial Sequence: Synthetic peptide
  Seed: GPAFVTWHR (TYRP2_HUMAN)
GMAFVTWHR

SEQ ID NO: 195107 - protein, 11 aa, Artificial Sequence
  Description of Artificial Sequence: Synthetic peptide
  Seed: RLIGNESFALP (TYRP2_HUMAN)
RIIGNESFALV

SEQ ID NO: 195108 - protein, 10 aa, Artificial Sequence
  Description of Artificial Sequence: Synthetic peptide
  Seed: SDQLGYSYAI (TYRP2_HUMAN)
SYQLGYSYAF

SEQ ID NO: 195109 - protein, 9 aa, Artificial Sequence
  Description of Artificial Sequence: Synthetic peptide
  Seed: ETPGWPTTL (TYRP2_HUMAN)
ERPGWPTTF

SEQ ID NO: 195110 - protein, 8 aa, Artificial Sequence
  Description of Artificial Sequence: Synthetic peptide
  Seed: LDDYNHLV (TYRP2_HUMAN)
LLDYNHLL

SEQ ID NO: 195111 - protein, 10 aa, Artificial Sequence
  Description of Artificial Sequence: Synthetic peptide
  Seed: SLDDYNHLVT (TYRP2_HUMAN)
SMDDYNHLVC

SEQ ID NO: 195112 - protein, 9 aa, Artificial Sequence
  Description of Artificial Sequence: Synthetic peptide
  Seed: ANDPIFVVL (TYRP2_HUMAN)
AMDPIFVVF

SEQ ID NO: 195113 - protein, 9 aa, Artificial Sequence
  Description of Artificial Sequence: Synthetic peptide
  Seed: RDCLSLQKF (TYRP2_HUMAN)
RQCLSLQKI

SEQ ID NO: 195114 - protein, 8 aa, Artificial Sequence
  Description of Artificial Sequence: Synthetic peptide
  Seed: LLGPGRPY (TYRP2_HUMAN)
LSGPGRPL

SEQ ID NO: 195115 - protein, 10 aa, Artificial Sequence
  Description of Artificial Sequence: Synthetic peptide
  Seed: NCSVYDFFVW (TYRP2_HUMAN)
NMSVYDFFVW

SEQ ID NO: 195116 - protein, 11 aa, Artificial Sequence
  Description of Artificial Sequence: Synthetic peptide
  Seed: RNSRFSSWETV (TYRP2_HUMAN)
RWSRFSSWETI

SEQ ID NO: 195117 - protein, 9 aa, Artificial Sequence
  Description of Artificial Sequence: Synthetic peptide
  Seed: IFDEWMKRF (TYRP2_HUMAN)
IGDEWMKRM

SEQ ID NO: 195118 - protein, 9 aa, Artificial Sequence
  Description of Artificial Sequence: Synthetic peptide
  Seed: VIRQNIHSL (TYRP2_HUMAN)
VLRQNIHSR

SEQ ID NO: 195119 - protein, 9 aa, Artificial Sequence
  Description of Artificial Sequence: Synthetic peptide
  Seed: IFDEWMKRF (TYRP2_HUMAN)
ITDEWMKRV

SEQ ID NO: 195120 - protein, 10 aa, Artificial Sequence
  Description of Artificial Sequence: Synthetic peptide
  Seed: ADTRPWSGPY (TYRP2_HUMAN)
AMTRPWSGPF

SEQ ID NO: 195121 - protein, 10 aa, Artificial Sequence
  Description of Artificial Sequence: Synthetic peptide
  Seed: LVVMGTLVAL (TYRP2_HUMAN)
LTVMGTLVAL

SEQ ID NO: 195122 - protein, 10 aa, Artificial Sequence
  Description of Artificial Sequence: Synthetic peptide
  Seed: HRYHLLCLER (TYRP2_HUMAN)
HMYHLLCLER

SEQ ID NO: 195123 - protein, 10 aa, Artificial Sequence
  Description of Artificial Sequence: Synthetic peptide
  Seed: SVYDFFVWLH (TYRP2_HUMAN)
SSYDFFVWLY

SEQ ID NO: 195124 - protein, 10 aa, Artificial Sequence
  Description of Artificial Sequence: Synthetic peptide
  Seed: SLDDYNHLVT (TYRP2_HUMAN)
SLDDYNHLVV

SEQ ID NO: 195125 - protein, 11 aa, Artificial Sequence
  Description of Artificial Sequence: Synthetic peptide
  Seed: WLHYYSVRDTL (TYRP2_HUMAN)
WVHYYSVRDTF

SEQ ID NO: 195126 - protein, 11 aa, Artificial Sequence
  Description of Artificial Sequence: Synthetic peptide
  Seed: RADTRPWSGPY (TYRP2_HUMAN)
RADTRPWSGPK

SEQ ID NO: 195127 - protein, 10 aa, Artificial Sequence
  Description of Artificial Sequence: Synthetic peptide
  Seed: CCPRLGAESA (TYRP2_HUMAN)
CEPRLGAESM

SEQ ID NO: 195128 - protein, 9 aa, Artificial Sequence
  Description of Artificial Sequence: Synthetic peptide
  Seed: FFQNSTFSF (TYRP2_HUMAN)
FVQNSTFSW

SEQ ID NO: 195129 - protein, 9 aa, Artificial Sequence
  Description of Artificial Sequence: Synthetic peptide
  Seed: VLHSFTDAI (TYRP2_HUMAN)
VMHSFTDAM

SEQ ID NO: 195130 - protein, 9 aa, Artificial Sequence
  Description of Artificial Sequence: Synthetic peptide
  Seed: IFDEWMKRF (TYRP2_HUMAN)
IGDEWMKRL

SEQ ID NO: 195131 - protein, 11 aa, Artificial Sequence
  Description of Artificial Sequence: Synthetic peptide
  Seed: ANCSVYDFFVW (TYRP2_HUMAN)
AFCSVYDFFVW

SEQ ID NO: 195132 - protein, 11 aa, Artificial Sequence
  Description of Artificial Sequence: Synthetic peptide
  Seed: YRRLRKGYTPL (TYRP2_HUMAN)
YARLRKGYTPL

SEQ ID NO: 195133 - protein, 10 aa, Artificial Sequence
  Description of Artificial Sequence: Synthetic peptide
  Seed: SDQLGYSYAI (TYRP2_HUMAN)
SNQLGYSYAF

SEQ ID NO: 195134 - protein, 10 aa, Artificial Sequence
  Description of Artificial Sequence: Synthetic peptide
  Seed: FFPPVTNEEL (TYRP2_HUMAN)
FRPPVTNEEY

SEQ ID NO: 195135 - protein, 10 aa, Artificial Sequence
  Description of Artificial Sequence: Synthetic peptide
  Seed: SLDDYNHLVT (TYRP2_HUMAN)
SQDDYNHLVL

SEQ ID NO: 195136 - protein, 9 aa, Artificial Sequence
  Description of Artificial Sequence: Synthetic peptide
  Seed: GTLVALVGL (TYRP2_HUMAN)
GMLVALVGA

SEQ ID NO: 195137 - protein, 9 aa, Artificial Sequence
  Description of Artificial Sequence: Synthetic peptide
  Seed: NMVPFFPPV (TYRP2_HUMAN)
NQVPFFPPY

SEQ ID NO: 195138 - protein, 9 aa, Artificial Sequence
  Description of Artificial Sequence: Synthetic peptide
  Seed: SFLNGTNAL (TYRP2_HUMAN)
SILNGTNAF

SEQ ID NO: 195139 - protein, 9 aa, Artificial Sequence
  Description of Artificial Sequence: Synthetic peptide
  Seed: IFDEWMKRF (TYRP2_HUMAN)
IYDEWMKRV

SEQ ID NO: 195140 - protein, 9 aa, Artificial Sequence
  Description of Artificial Sequence: Synthetic peptide
  Seed: DFFVWLHYY (TYRP2_HUMAN)
DYFVWLHYR

SEQ ID NO: 195141 - protein, 9 aa, Artificial Sequence
  Description of Artificial Sequence: Synthetic peptide
  Seed: SLHNLVHSF (TYRP2_HUMAN)
SMHNLVHST

SEQ ID NO: 195142 - protein, 10 aa, Artificial Sequence
  Description of Artificial Sequence: Synthetic peptide
  Seed: FFPPVTNEEL (TYRP2_HUMAN)
FLPPVTNEEM

SEQ ID NO: 195143 - protein, 8 aa, Artificial Sequence
  Description of Artificial Sequence: Synthetic peptide
  Seed: ADAWPQEL (TYRP2_HUMAN)
AEAWPQEM

SEQ ID NO: 195144 - protein, 9 aa, Artificial Sequence
  Description of Artificial Sequence: Synthetic peptide
  Seed: VVMGTLVAL (TYRP2_HUMAN)
VVMGTLVAW

SEQ ID NO: 195145 - protein, 9 aa, Artificial Sequence
  Description of Artificial Sequence: Synthetic peptide
  Seed: AANDPIFVV (TYRP2_HUMAN)
AMNDPIFVF

SEQ ID NO: 195146 - protein, 9 aa, Artificial Sequence
  Description of Artificial Sequence: Synthetic peptide
  Seed: ANDPIFVVL (TYRP2_HUMAN)
ALDPIFVVF

SEQ ID NO: 195147 - protein, 11 aa, Artificial Sequence
  Description of Artificial Sequence: Synthetic peptide
  Seed: HPDYVITTQHW (TYRP2_HUMAN)
HNDYVITTQHF

SEQ ID NO: 195148 - protein, 8 aa, Artificial Sequence
  Description of Artificial Sequence: Synthetic peptide
  Seed: RPDDPTLI (TYRP2_HUMAN)
RVDDPTLV

SEQ ID NO: 195149 - protein, 10 aa, Artificial Sequence
  Description of Artificial Sequence: Synthetic peptide
  Seed: QPQFANCSVY (TYRP2_HUMAN)
QSQFANCSVY

SEQ ID NO: 195150 - protein, 11 aa, Artificial Sequence
  Description of Artificial Sequence: Synthetic peptide
  Seed: TQPQFANCSVY (TYRP2_HUMAN)
TPPQFANCSVY

SEQ ID NO: 195151 - protein, 11 aa, Artificial Sequence
  Description of Artificial Sequence: Synthetic peptide
  Seed: YTPLMETHLSS (TYRP2_HUMAN)
YTPLMETHLSL

SEQ ID NO: 195152 - protein, 10 aa, Artificial Sequence
  Description of Artificial Sequence: Synthetic peptide
  Seed: LVVMGTLVAL (TYRP2_HUMAN)
LMVMGTLVAT

SEQ ID NO: 195153 - protein, 9 aa, Artificial Sequence
  Description of Artificial Sequence: Synthetic peptide
  Seed: HPDYVITTQ (TYRP2_HUMAN)
HVDYVITTY

SEQ ID NO: 195154 - protein, 10 aa, Artificial Sequence
  Description of Artificial Sequence: Synthetic peptide
  Seed: TQPQFANCSV (TYRP2_HUMAN)
TYPQFANCSL

SEQ ID NO: 195155 - protein, 9 aa, Artificial Sequence
  Description of Artificial Sequence: Synthetic peptide
  Seed: AARPDDPTL (TYRP2_HUMAN)
AMRPDDPTK

SEQ ID NO: 195156 - protein, 8 aa, Artificial Sequence
  Description of Artificial Sequence: Synthetic peptide
  Seed: FQNSTFSF (TYRP2_HUMAN)
FMNSTFSF

SEQ ID NO: 195157 - protein, 10 aa, Artificial Sequence
  Description of Artificial Sequence: Synthetic peptide
  Seed: MSPLWWGFLL (TYRP2_HUMAN)
MRPLWWGFLF

SEQ ID NO: 195158 - protein, 9 aa, Artificial Sequence
  Description of Artificial Sequence: Synthetic peptide
  Seed: VWLHYYSVR (TYRP2_HUMAN)
VMLHYYSVR

SEQ ID NO: 195159 - protein, 10 aa, Artificial Sequence
  Description of Artificial Sequence: Synthetic peptide
  Seed: FQNSTFSFRN (TYRP2_HUMAN)
FSNSTFSFRR

SEQ ID NO: 195160 - protein, 10 aa, Artificial Sequence
  Description of Artificial Sequence: Synthetic peptide
  Seed: LVVMGTLVAL (TYRP2_HUMAN)
LTVMGTLVAY

SEQ ID NO: 195161 - protein, 9 aa, Artificial Sequence
  Description of Artificial Sequence: Synthetic peptide
  Seed: NMVPFFPPV (TYRP2_HUMAN)
NLVPFFPPV

SEQ ID NO: 195162 - protein, 10 aa, Artificial Sequence
  Description of Artificial Sequence: Synthetic peptide
  Seed: NSTFSFRNAL (TYRP2_HUMAN)
NQTFSFRNAV

SEQ ID NO: 195163 - protein, 10 aa, Artificial Sequence
  Description of Artificial Sequence: Synthetic peptide
  Seed: LAFLQYRRLR (TYRP2_HUMAN)
LLFLQYRRLR

SEQ ID NO: 195164 - protein, 10 aa, Artificial Sequence
  Description of Artificial Sequence: Synthetic peptide
  Seed: YNMVPFFPPV (TYRP2_HUMAN)
YFMVPFFPPV

SEQ ID NO: 195165 - protein, 9 aa, Artificial Sequence
  Description of Artificial Sequence: Synthetic peptide
  Seed: STFSFRNAL (TYRP2_HUMAN)
SHFSFRNAI

SEQ ID NO: 195166 - protein, 11 aa, Artificial Sequence
  Description of Artificial Sequence: Synthetic peptide
  Seed: YTPLMETHLSS (TYRP2_HUMAN)
YNPLMETHLSM

SEQ ID NO: 195167 - protein, 10 aa, Artificial Sequence
  Description of Artificial Sequence: Synthetic peptide
  Seed: FFPPVTNEEL (TYRP2_HUMAN)
FIPPVTNEEI

SEQ ID NO: 195168 - protein, 11 aa, Artificial Sequence
  Description of Artificial Sequence: Synthetic peptide
  Seed: ESFALPYWNFA (TYRP2_HUMAN)
EVFALPYWNFV

SEQ ID NO: 195169 - protein, 9 aa, Artificial Sequence
  Description of Artificial Sequence: Synthetic peptide
  Seed: STFSFRNAL (TYRP2_HUMAN)
SRFSFRNAM

SEQ ID NO: 195170 - protein, 9 aa, Artificial Sequence
  Description of Artificial Sequence: Synthetic peptide
  Seed: VVMGTLVAL (TYRP2_HUMAN)
VEMGTLVAY

SEQ ID NO: 195171 - protein, 10 aa, Artificial Sequence
  Description of Artificial Sequence: Synthetic peptide
  Seed: VVLHSFTDAI (TYRP2_HUMAN)
VSLHSFTDAV

SEQ ID NO: 195172 - protein, 10 aa, Artificial Sequence
  Description of Artificial Sequence: Synthetic peptide
  Seed: YAIDLPVSVE (TYRP2_HUMAN)
YLIDLPVSVV

SEQ ID NO: 195173 - protein, 11 aa, Artificial Sequence
  Description of Artificial Sequence: Synthetic peptide
  Seed: FFVWLHYYSVR (TYRP2_HUMAN)
FTVWLHYYSVR

SEQ ID NO: 195174 - protein, 11 aa, Artificial Sequence
  Description of Artificial Sequence: Synthetic peptide
  Seed: FLTSDQLGYSY (TYRP2_HUMAN)
FPTSDQLGYSY

SEQ ID NO: 195175 - protein, 10 aa, Artificial Sequence
  Description of Artificial Sequence: Synthetic peptide
  Seed: GTLDSQVMSL (TYRP2_HUMAN)
GMLDSQVMSW

SEQ ID NO: 195176 - protein, 9 aa, Artificial Sequence
  Description of Artificial Sequence: Synthetic peptide
  Seed: RYHLLCLER (TYRP2_HUMAN)
RAHLLCLEK

SEQ ID NO: 195177 - protein, 9 aa, Artificial Sequence
  Description of Artificial Sequence: Synthetic peptide
  Seed: RTCKCTGNF (TYRP2_HUMAN)
RVCKCTGNF

SEQ ID NO: 195178 - protein, 9 aa, Artificial Sequence
  Description of Artificial Sequence: Synthetic peptide
  Seed: YAIDLPVSV (TYRP2_HUMAN)
YAIDLPVSR

SEQ ID NO: 195179 - protein, 9 aa, Artificial Sequence
  Description of Artificial Sequence: Synthetic peptide
  Seed: GFDKADGTL (TYRP2_HUMAN)
GADKADGTM

SEQ ID NO: 195180 - protein, 10 aa, Artificial Sequence
  Description of Artificial Sequence: Synthetic peptide
  Seed: VLHSFTDAIF (TYRP2_HUMAN)
VAHSFTDAIF

SEQ ID NO: 195181 - protein, 11 aa, Artificial Sequence
  Description of Artificial Sequence: Synthetic peptide
  Seed: FANCSVYDFFV (TYRP2_HUMAN)
FMNCSVYDFFM

SEQ ID NO: 195182 - protein, 9 aa, Artificial Sequence
  Description of Artificial Sequence: Synthetic peptide
  Seed: FVWLHYYSV (TYRP2_HUMAN)
FMWLHYYST

SEQ ID NO: 195183 - protein, 8 aa, Artificial Sequence
  Description of Artificial Sequence: Synthetic peptide
  Seed: AIDLPVSV (TYRP2_HUMAN)
AMDLPVSL

SEQ ID NO: 195184 - protein, 9 aa, Artificial Sequence
  Description of Artificial Sequence: Synthetic peptide
  Seed: FLGALDLAK (TYRP2_HUMAN)
FAGALDLAL

SEQ ID NO: 195185 - protein, 9 aa, Artificial Sequence
  Description of Artificial Sequence: Synthetic peptide
  Seed: SRFSSWETV (TYRP2_HUMAN)
SAFSSWETY

SEQ ID NO: 195186 - protein, 9 aa, Artificial Sequence
  Description of Artificial Sequence: Synthetic peptide
  Seed: DFFVWLHYY (TYRP2_HUMAN)
DIFVWLHYR

SEQ ID NO: 195187 - protein, 9 aa, Artificial Sequence
  Description of Artificial Sequence: Synthetic peptide
  Seed: RMYNMVPFF (TYRP2_HUMAN)
RVYNMVPFK

SEQ ID NO: 195188 - protein, 10 aa, Artificial Sequence
  Description of Artificial Sequence: Synthetic peptide
  Seed: MSLHNLVHSF (TYRP2_HUMAN)
MCLHNLVHSY

SEQ ID NO: 195189 - protein, 11 aa, Artificial Sequence
  Description of Artificial Sequence: Synthetic peptide
  Seed: SVYDFFVWLHY (TYRP2_HUMAN)
SVYDFFVWLHK

SEQ ID NO: 195190 - protein, 11 aa, Artificial Sequence
  Description of Artificial Sequence: Synthetic peptide
  Seed: TQPQFANCSVY (TYRP2_HUMAN)
THPQFANCSVY

SEQ ID NO: 195191 - protein, 9 aa, Artificial Sequence
  Description of Artificial Sequence: Synthetic peptide
  Seed: RFNPPADAW (TYRP2_HUMAN)
RANPPADAW

SEQ ID NO: 195192 - protein, 9 aa, Artificial Sequence
  Description of Artificial Sequence: Synthetic peptide
  Seed: SVRDTLLGP (TYRP2_HUMAN)
SLRDTLLGK

SEQ ID NO: 195193 - protein, 9 aa, Artificial Sequence
  Description of Artificial Sequence: Synthetic peptide
  Seed: RKFFHRTCK (TYRP2_HUMAN)
RSFFHRTCR

SEQ ID NO: 195194 - protein, 10 aa, Artificial Sequence
  Description of Artificial Sequence: Synthetic peptide
  Seed: SLSPQEREQF (TYRP2_HUMAN)
SQSPQEREQI

SEQ ID NO: 195195 - protein, 10 aa, Artificial Sequence
  Description of Artificial Sequence: Synthetic peptide
  Seed: FPPVTNEELF (TYRP2_HUMAN)
FNPVTNEELW

SEQ ID NO: 195196 - protein, 10 aa, Artificial Sequence
  Description of Artificial Sequence: Synthetic peptide
  Seed: TLLGPGRPYR (TYRP2_HUMAN)
TVLGPGRPYK

SEQ ID NO: 195197 - protein, 8 aa, Artificial Sequence
  Description of Artificial Sequence: Synthetic peptide
  Seed: AIDLPVSV (TYRP2_HUMAN)
AADLPVSI

SEQ ID NO: 195198 - protein, 9 aa, Artificial Sequence
  Description of Artificial Sequence: Synthetic peptide
  Seed: VHPDYVITT (TYRP2_HUMAN)
VTPDYVITM

SEQ ID NO: 195199 - protein, 10 aa, Artificial Sequence
  Description of Artificial Sequence: Synthetic peptide
  Seed: FVVLHSFTDA (TYRP2_HUMAN)
FQVLHSFTDI

SEQ ID NO: 195200 - protein, 11 aa, Artificial Sequence
  Description of Artificial Sequence: Synthetic peptide
  Seed: LSLQKFDNPPF (TYRP2_HUMAN)
LMLQKFDNPPF

SEQ ID NO: 195201 - protein, 11 aa, Artificial Sequence
  Description of Artificial Sequence: Synthetic peptide
  Seed: FSHQGPAFVTW (TYRP2_HUMAN)
FVHQGPAFVTY

SEQ ID NO: 195202 - protein, 8 aa, Artificial Sequence
  Description of Artificial Sequence: Synthetic peptide
  Seed: SLDDYNHL (TYRP2_HUMAN)
SFDDYNHV

SEQ ID NO: 195203 - protein, 9 aa, Artificial Sequence
  Description of Artificial Sequence: Synthetic peptide
  Seed: RLRKGYTPL (TYRP2_HUMAN)
RSRKGYTPP

SEQ ID NO: 195204 - protein, 10 aa, Artificial Sequence
  Description of Artificial Sequence: Synthetic peptide
  Seed: VLHSFTDAIF (TYRP2_HUMAN)
VHHSFTDAIY

SEQ ID NO: 195205 - protein, 9 aa, Artificial Sequence
  Description of Artificial Sequence: Synthetic peptide
  Seed: IFDEWMKRF (TYRP2_HUMAN)
ITDEWMKRY

SEQ ID NO: 195206 - protein, 9 aa, Artificial Sequence
  Description of Artificial Sequence: Synthetic peptide
  Seed: VHPDYVITT (TYRP2_HUMAN)
VYPDYVITM

SEQ ID NO: 195207 - protein, 9 aa, Artificial Sequence
  Description of Artificial Sequence: Synthetic peptide
  Seed: RPWSGPYIL (TYRP2_HUMAN)
RAWSGPYIY

SEQ ID NO: 195208 - protein, 10 aa, Artificial Sequence
  Description of Artificial Sequence: Synthetic peptide
  Seed: FLLSCLGCKI (TYRP2_HUMAN)
FCLSCLGCKV

SEQ ID NO: 195209 - protein, 11 aa, Artificial Sequence
  Description of Artificial Sequence: Synthetic peptide
  Seed: YNMVPFFPPVT (TYRP2_HUMAN)
YVMVPFFPPVK

SEQ ID NO: 195210 - protein, 9 aa, Artificial Sequence
  Description of Artificial Sequence: Synthetic peptide
  Seed: SLDDYNHLV (TYRP2_HUMAN)
SCDDYNHLL

SEQ ID NO: 195211 - protein, 10 aa, Artificial Sequence
  Description of Artificial Sequence: Synthetic peptide
  Seed: RNSRFSSWET (TYRP2_HUMAN)
RMSRFSSWEK

SEQ ID NO: 195212 - protein, 9 aa, Artificial Sequence
  Description of Artificial Sequence: Synthetic peptide
  Seed: RAIDFSHQG (TYRP2_HUMAN)
RQIDFSHQF

SEQ ID NO: 195213 - protein, 9 aa, Artificial Sequence
  Description of Artificial Sequence: Synthetic peptide
  Seed: TLDSQVMSL (TYRP2_HUMAN)
TIDSQVMSF

SEQ ID NO: 195214 - protein, 9 aa, Artificial Sequence
  Description of Artificial Sequence: Synthetic peptide
  Seed: ALVGLFVLL (TYRP2_HUMAN)
AMVGLFVLV

SEQ ID NO: 195215 - protein, 11 aa, Artificial Sequence
  Description of Artificial Sequence: Synthetic peptide
  Seed: AIDFSHQGPAF (TYRP2_HUMAN)
AVDFSHQGPAY

SEQ ID NO: 195216 - protein, 9 aa, Artificial Sequence
  Description of Artificial Sequence: Synthetic peptide
  Seed: LVALVGLFV (TYRP2_HUMAN)
LAALVGLFL

SEQ ID NO: 195217 - protein, 10 aa, Artificial Sequence
  Description of Artificial Sequence: Synthetic peptide
  Seed: YNMVPFFPPV (TYRP2_HUMAN)
YLMVPFFPPI

SEQ ID NO: 195218 - protein, 9 aa, Artificial Sequence
  Description of Artificial Sequence: Synthetic peptide
  Seed: FSHQGPAFV (TYRP2_HUMAN)
FQHQGPAFV

SEQ ID NO: 195219 - protein, 9 aa, Artificial Sequence
  Description of Artificial Sequence: Synthetic peptide
  Seed: ALPYWNFAT (TYRP2_HUMAN)
AVPYWNFAI

SEQ ID NO: 195220 - protein, 10 aa, Artificial Sequence
  Description of Artificial Sequence: Synthetic peptide
  Seed: QPQFANCSVY (TYRP2_HUMAN)
QRQFANCSVY

SEQ ID NO: 195221 - protein, 9 aa, Artificial Sequence
  Description of Artificial Sequence: Synthetic peptide
  Seed: LLSCLGCKI (TYRP2_HUMAN)
LMSCLGCKA

SEQ ID NO: 195222 - protein, 10 aa, Artificial Sequence
  Description of Artificial Sequence: Synthetic peptide
  Seed: SSWETVCDSL (TYRP2_HUMAN)
SQWETVCDSV

SEQ ID NO: 195223 - protein, 10 aa, Artificial Sequence
  Description of Artificial Sequence: Synthetic peptide
  Seed: LHYYSVRDTL (TYRP2_HUMAN)
LHYYSVRDTI

SEQ ID NO: 195224 - protein, 9 aa, Artificial Sequence
  Description of Artificial Sequence: Synthetic peptide
  Seed: SLDDYNHLV (TYRP2_HUMAN)
SQDDYNHLF

SEQ ID NO: 195225 - protein, 8 aa, Artificial Sequence
  Description of Artificial Sequence: Synthetic peptide
  Seed: VMGTLVAL (TYRP2_HUMAN)
VQGTLVAV

SEQ ID NO: 195226 - protein, 11 aa, Artificial Sequence
  Description of Artificial Sequence: Synthetic peptide
  Seed: TQPQFANCSVY (TYRP2_HUMAN)
TDPQFANCSVY

SEQ ID NO: 195227 - protein, 9 aa, Artificial Sequence
  Description of Artificial Sequence: Synthetic peptide
  Seed: FANCSVYDF (TYRP2_HUMAN)
FANCSVYDL

SEQ ID NO: 195228 - protein, 9 aa, Artificial Sequence
  Description of Artificial Sequence: Synthetic peptide
  Seed: AANDPIFVV (TYRP2_HUMAN)
AMNDPIFVT

SEQ ID NO: 195229 - protein, 10 aa, Artificial Sequence
  Description of Artificial Sequence: Synthetic peptide
  Seed: LISRNSRFSS (TYRP2_HUMAN)
LKSRNSRFSA

SEQ ID NO: 195230 - protein, 11 aa, Artificial Sequence
  Description of Artificial Sequence: Synthetic peptide
  Seed: LPVSVEETPGW (TYRP2_HUMAN)
LRVSVEETPGW

SEQ ID NO: 195231 - protein, 10 aa, Artificial Sequence
  Description of Artificial Sequence: Synthetic peptide
  Seed: QPQFANCSVY (TYRP2_HUMAN)
QAQFANCSVF

SEQ ID NO: 195232 - protein, 10 aa, Artificial Sequence
  Description of Artificial Sequence: Synthetic peptide
  Seed: RRLRKGYTPL (TYRP2_HUMAN)
RALRKGYTPI

SEQ ID NO: 195233 - protein, 9 aa, Artificial Sequence
  Description of Artificial Sequence: Synthetic peptide
  Seed: RLRKGYTPL (TYRP2_HUMAN)
RTRKGYTPF

SEQ ID NO: 195234 - protein, 9 aa, Artificial Sequence
  Description of Artificial Sequence: Synthetic peptide
  Seed: ELWPRKFFH (TYRP2_HUMAN)
EQWPRKFFK

SEQ ID NO: 195235 - protein, 11 aa, Artificial Sequence
  Description of Artificial Sequence: Synthetic peptide
  Seed: HQGPAFVTWHR (TYRP2_HUMAN)
HVGPAFVTWHR

SEQ ID NO: 195236 - protein, 10 aa, Artificial Sequence
  Description of Artificial Sequence: Synthetic peptide
  Seed: LDDYNHLVTL (TYRP2_HUMAN)
LEDYNHLVTL

SEQ ID NO: 195237 - protein, 9 aa, Artificial Sequence
  Description of Artificial Sequence: Synthetic peptide
  Seed: SPQEREQFL (TYRP2_HUMAN)
SPQEREQFM

SEQ ID NO: 195238 - protein, 10 aa, Artificial Sequence
  Description of Artificial Sequence: Synthetic peptide
  Seed: RPDDPTLISR (TYRP2_HUMAN)
RVDDPTLISF

SEQ ID NO: 195239 - protein, 9 aa, Artificial Sequence
  Description of Artificial Sequence: Synthetic peptide
  Seed: QFPRVCMTV (TYRP2_HUMAN)
QYPRVCMTM

SEQ ID NO: 195240 - protein, 10 aa, Artificial Sequence
  Description of Artificial Sequence: Synthetic peptide
  Seed: MSLHNLVHSF (TYRP2_HUMAN)
MYLHNLVHSY

SEQ ID NO: 195241 - protein, 11 aa, Artificial Sequence
  Description of Artificial Sequence: Synthetic peptide
  Seed: MYNMVPFFPPV (TYRP2_HUMAN)
MYNMVPFFPPW

SEQ ID NO: 195242 - protein, 9 aa, Artificial Sequence
  Description of Artificial Sequence: Synthetic peptide
  Seed: DDYNHLVTL (TYRP2_HUMAN)
DGYNHLVTY

SEQ ID NO: 195243 - protein, 9 aa, Artificial Sequence
  Description of Artificial Sequence: Synthetic peptide
  Seed: VGLFVLLAF (TYRP2_HUMAN)
VHLFVLLAY

SEQ ID NO: 195244 - protein, 10 aa, Artificial Sequence
  Description of Artificial Sequence: Synthetic peptide
  Seed: AIDFSHQGPA (TYRP2_HUMAN)
AMDFSHQGPV

SEQ ID NO: 195245 - protein, 9 aa, Artificial Sequence
  Description of Artificial Sequence: Synthetic peptide
  Seed: FTDAIFDEW (TYRP2_HUMAN)
FLDAIFDEI

SEQ ID NO: 195246 - protein, 9 aa, Artificial Sequence
  Description of Artificial Sequence: Synthetic peptide
  Seed: ETPGWPTTL (TYRP2_HUMAN)
ESPGWPTTF

SEQ ID NO: 195247 - protein, 9 aa, Artificial Sequence
  Description of Artificial Sequence: Synthetic peptide
  Seed: RNQDDRELW (TYRP2_HUMAN)
RSQDDRELF

SEQ ID NO: 195248 - protein, 10 aa, Artificial Sequence
  Description of Artificial Sequence: Synthetic peptide
  Seed: TDAIFDEWMK (TYRP2_HUMAN)
TLAIFDEWMR

SEQ ID NO: 195249 - protein, 10 aa, Artificial Sequence
  Description of Artificial Sequence: Synthetic peptide
  Seed: MSPLWWGFLL (TYRP2_HUMAN)
MIPLWWGFLM

SEQ ID NO: 195250 - protein, 10 aa, Artificial Sequence
  Description of Artificial Sequence: Synthetic peptide
  Seed: DTLLGPGRPY (TYRP2_HUMAN)
DILLGPGRPR

SEQ ID NO: 195251 - protein, 9 aa, Artificial Sequence
  Description of Artificial Sequence: Synthetic peptide
  Seed: METHLSSKR (TYRP2_HUMAN)
MFTHLSSKR

SEQ ID NO: 195252 - protein, 9 aa, Artificial Sequence
  Description of Artificial Sequence: Synthetic peptide
  Seed: VVMGTLVAL (TYRP2_HUMAN)
VPMGTLVAM

SEQ ID NO: 195253 - protein, 10 aa, Artificial Sequence
  Description of Artificial Sequence: Synthetic peptide
  Seed: FFPPVTNEEL (TYRP2_HUMAN)
FTPPVTNEEM

SEQ ID NO: 195254 - protein, 11 aa, Artificial Sequence
  Description of Artificial Sequence: Synthetic peptide
  Seed: ALPYWNFATGR (TYRP2_HUMAN)
AIPYWNFATGR

SEQ ID NO: 195255 - protein, 9 aa, Artificial Sequence
  Description of Artificial Sequence: Synthetic peptide
  Seed: RLRKGYTPL (TYRP2_HUMAN)
RARKGYTPQ

SEQ ID NO: 195256 - protein, 9 aa, Artificial Sequence
  Description of Artificial Sequence: Synthetic peptide
  Seed: DDYNHLVTL (TYRP2_HUMAN)
DIYNHLVTF

SEQ ID NO: 195257 - protein, 9 aa, Artificial Sequence
  Description of Artificial Sequence: Synthetic peptide
  Seed: LLGPGRPYR (TYRP2_HUMAN)
LMGPGRPYR

SEQ ID NO: 195258 - protein, 9 aa, Artificial Sequence
  Description of Artificial Sequence: Synthetic peptide
  Seed: VMGTLVALV (TYRP2_HUMAN)
VLGTLVALL

SEQ ID NO: 195259 - protein, 9 aa, Artificial Sequence
  Description of Artificial Sequence: Synthetic peptide
  Seed: AANDPIFVV (TYRP2_HUMAN)
AINDPIFVY

SEQ ID NO: 195260 - protein, 9 aa, Artificial Sequence
  Description of Artificial Sequence: Synthetic peptide
  Seed: SLHNLVHSF (TYRP2_HUMAN)
SVHNLVHSK

SEQ ID NO: 195261 - protein, 10 aa, Artificial Sequence
  Description of Artificial Sequence: Synthetic peptide
  Seed: MSLHNLVHSF (TYRP2_HUMAN)
MALHNLVHSY

SEQ ID NO: 195262 - protein, 11 aa, Artificial Sequence
  Description of Artificial Sequence: Synthetic peptide
  Seed: VCDSLDDYNHL (TYRP2_HUMAN)
VIDSLDDYNHL

SEQ ID NO: 195263 - protein, 10 aa, Artificial Sequence
  Description of Artificial Sequence: Synthetic peptide
  Seed: AFVTWHRYHL (TYRP2_HUMAN)
AWVTWHRYHF

SEQ ID NO: 195264 - protein, 10 aa, Artificial Sequence
  Description of Artificial Sequence: Synthetic peptide
  Seed: AANDPIFVVL (TYRP2_HUMAN)
AGNDPIFVVY

SEQ ID NO: 195265 - protein, 10 aa, Artificial Sequence
  Description of Artificial Sequence: Synthetic peptide
  Seed: LVVMGTLVAL (TYRP2_HUMAN)
LKVMGTLVAV

SEQ ID NO: 195266 - protein, 8 aa, Artificial Sequence
  Description of Artificial Sequence: Synthetic peptide
  Seed: YYSVRDTL (TYRP2_HUMAN)
YASVRDTF

SEQ ID NO: 195267 - protein, 9 aa, Artificial Sequence
  Description of Artificial Sequence: Synthetic peptide
  Seed: ELWPRKFFH (TYRP2_HUMAN)
EYWPRKFFR

SEQ ID NO: 195268 - protein, 10 aa, Artificial Sequence
  Description of Artificial Sequence: Synthetic peptide
  Seed: LGPGRPYRAI (TYRP2_HUMAN)
LRPGRPYRAL

SEQ ID NO: 195269 - protein, 10 aa, Artificial Sequence
  Description of Artificial Sequence: Synthetic peptide
  Seed: LTSDQLGYSY (TYRP2_HUMAN)
LGSDQLGYSY

SEQ ID NO: 195270 - protein, 9 aa, Artificial Sequence
  Description of Artificial Sequence: Synthetic peptide
  Seed: LLGPGRPYR (TYRP2_HUMAN)
LSGPGRPYR

SEQ ID NO: 195271 - protein, 9 aa, Artificial Sequence
  Description of Artificial Sequence: Synthetic peptide
  Seed: YAIDLPVSV (TYRP2_HUMAN)
YYIDLPVSH

SEQ ID NO: 195272 - protein, 9 aa, Artificial Sequence
  Description of Artificial Sequence: Synthetic peptide
  Seed: LLGPGRPYR (TYRP2_HUMAN)
LQGPGRPYR

SEQ ID NO: 195273 - protein, 10 aa, Artificial Sequence
  Description of Artificial Sequence: Synthetic peptide
  Seed: KILPGAQGQF (TYRP2_HUMAN)
KQLPGAQGQW

SEQ ID NO: 195274 - protein, 10 aa, Artificial Sequence
  Description of Artificial Sequence: Synthetic peptide
  Seed: REQFLGALDL (TYRP2_HUMAN)
RFQFLGALDL

SEQ ID NO: 195275 - protein, 10 aa, Artificial Sequence
  Description of Artificial Sequence: Synthetic peptide
  Seed: FLTSDQLGYS (TYRP2_HUMAN)
FMTSDQLGYA

SEQ ID NO: 195276 - protein, 9 aa, Artificial Sequence
  Description of Artificial Sequence: Synthetic peptide
  Seed: WPRKFFHRT (TYRP2_HUMAN)
WPRKFFHRV

SEQ ID NO: 195277 - protein, 10 aa, Artificial Sequence
  Description of Artificial Sequence: Synthetic peptide
  Seed: NLVHSFLNGT (TYRP2_HUMAN)
NYVHSFLNGV

SEQ ID NO: 195278 - protein, 10 aa, Artificial Sequence
  Description of Artificial Sequence: Synthetic peptide
  Seed: FFPPVTNEEL (TYRP2_HUMAN)
FLPPVTNEEF

SEQ ID NO: 195279 - protein, 10 aa, Artificial Sequence
  Description of Artificial Sequence: Synthetic peptide
  Seed: VVLHSFTDAI (TYRP2_HUMAN)
VFLHSFTDAV

SEQ ID NO: 195280 - protein, 10 aa, Artificial Sequence
  Description of Artificial Sequence: Synthetic peptide
  Seed: EETPGWPTTL (TYRP2_HUMAN)
EETPGWPTTW

SEQ ID NO: 195281 - protein, 11 aa, Artificial Sequence
  Description of Artificial Sequence: Synthetic peptide
  Seed: VCDSLDDYNHL (TYRP2_HUMAN)
VYDSLDDYNHL

SEQ ID NO: 195282 - protein, 8 aa, Artificial Sequence
  Description of Artificial Sequence: Synthetic peptide
  Seed: FLNGTNAL (TYRP2_HUMAN)
FFNGTNAL

SEQ ID NO: 195283 - protein, 10 aa, Artificial Sequence
  Description of Artificial Sequence: Synthetic peptide
  Seed: RNQMGRNSMK (TYRP2_HUMAN)
RVQMGRNSMR

SEQ ID NO: 195284 - protein, 9 aa, Artificial Sequence
  Description of Artificial Sequence: Synthetic peptide
  Seed: FANCSVYDF (TYRP2_HUMAN)
FANCSVYDV

SEQ ID NO: 195285 - protein, 8 aa, Artificial Sequence
  Description of Artificial Sequence: Synthetic peptide
  Seed: YYSVRDTL (TYRP2_HUMAN)
YYSVRDTF

SEQ ID NO: 195286 - protein, 10 aa, Artificial Sequence
  Description of Artificial Sequence: Synthetic peptide
  Seed: RNSRFSSWET (TYRP2_HUMAN)
RCSRFSSWEV

SEQ ID NO: 195287 - protein, 9 aa, Artificial Sequence
  Description of Artificial Sequence: Synthetic peptide
  Seed: ITTQHWLGL (TYRP2_HUMAN)
ISTQHWLGM

SEQ ID NO: 195288 - protein, 10 aa, Artificial Sequence
  Description of Artificial Sequence: Synthetic peptide
  Seed: MSLHNLVHSF (TYRP2_HUMAN)
MLLHNLVHSW

SEQ ID NO: 195289 - protein, 9 aa, Artificial Sequence
  Description of Artificial Sequence: Synthetic peptide
  Seed: DDYNHLVTL (TYRP2_HUMAN)
DGYNHLVTI

SEQ ID NO: 195290 - protein, 9 aa, Artificial Sequence
  Description of Artificial Sequence: Synthetic peptide
  Seed: RKFFHRTCK (TYRP2_HUMAN)
RYFFHRTCS

SEQ ID NO: 195291 - protein, 9 aa, Artificial Sequence
  Description of Artificial Sequence: Synthetic peptide
  Seed: RVHPDYVIT (TYRP2_HUMAN)
RVHPDYVIA

SEQ ID NO: 195292 - protein, 10 aa, Artificial Sequence
  Description of Artificial Sequence: Synthetic peptide
  Seed: FTDAIFDEWM (TYRP2_HUMAN)
FIDAIFDEWV

SEQ ID NO: 195293 - protein, 9 aa, Artificial Sequence
  Description of Artificial Sequence: Synthetic peptide
  Seed: SLDDYNHLV (TYRP2_HUMAN)
SSDDYNHLI

SEQ ID NO: 195294 - protein, 10 aa, Artificial Sequence
  Description of Artificial Sequence: Synthetic peptide
  Seed: YSYAIDLPVS (TYRP2_HUMAN)
YLYAIDLPVA

SEQ ID NO: 195295 - protein, 8 aa, Artificial Sequence
  Description of Artificial Sequence: Synthetic peptide
  Seed: SDQLGYSY (TYRP2_HUMAN)
SDQLGYSF

SEQ ID NO: 195296 - protein, 11 aa, Artificial Sequence
  Description of Artificial Sequence: Synthetic peptide
  Seed: RADTRPWSGPY (TYRP2_HUMAN)
RYDTRPWSGPA

SEQ ID NO: 195297 - protein, 11 aa, Artificial Sequence
  Description of Artificial Sequence: Synthetic peptide
  Seed: YTPLMETHLSS (TYRP2_HUMAN)
YLPLMETHLSM

SEQ ID NO: 195298 - protein, 9 aa, Artificial Sequence
  Description of Artificial Sequence: Synthetic peptide
  Seed: SRNSRFSSW (TYRP2_HUMAN)
SANSRFSSM

SEQ ID NO: 195299 - protein, 9 aa, Artificial Sequence
  Description of Artificial Sequence: Synthetic peptide
  Seed: VVMGTLVAL (TYRP2_HUMAN)
VTMGTLVAW

SEQ ID NO: 195300 - protein, 10 aa, Artificial Sequence
  Description of Artificial Sequence: Synthetic peptide
  Seed: ESANVCGSQQ (TYRP2_HUMAN)
EAANVCGSQR

SEQ ID NO: 195301 - protein, 9 aa, Artificial Sequence
  Description of Artificial Sequence: Synthetic peptide
  Seed: QVMSLHNLV (TYRP2_HUMAN)
QVMSLHNLL

SEQ ID NO: 195302 - protein, 9 aa, Artificial Sequence
  Description of Artificial Sequence: Synthetic peptide
  Seed: HQGPAFVTW (TYRP2_HUMAN)
HMGPAFVTM

SEQ ID NO: 195303 - protein, 9 aa, Artificial Sequence
  Description of Artificial Sequence: Synthetic peptide
  Seed: SLHNLVHSF (TYRP2_HUMAN)
SVHNLVHSW

SEQ ID NO: 195304 - protein, 8 aa, Artificial Sequence
  Description of Artificial Sequence: Synthetic peptide
  Seed: VPFFPPVT (TYRP2_HUMAN)
VPFFPPVV

SEQ ID NO: 195305 - protein, 9 aa, Artificial Sequence
  Description of Artificial Sequence: Synthetic peptide
  Seed: YTPLMETHL (TYRP2_HUMAN)
YMPLMETHV

SEQ ID NO: 195306 - protein, 10 aa, Artificial Sequence
  Description of Artificial Sequence: Synthetic peptide
  Seed: LGPNGTQPQF (TYRP2_HUMAN)
LKPNGTQPQW

SEQ ID NO: 195307 - protein, 9 aa, Artificial Sequence
  Description of Artificial Sequence: Synthetic peptide
  Seed: YAIDLPVSV (TYRP2_HUMAN)
YQIDLPVSY

SEQ ID NO: 195308 - protein, 9 aa, Artificial Sequence
  Description of Artificial Sequence: Synthetic peptide
  Seed: FPPVTNEEL (TYRP2_HUMAN)
FPPVTNEEW

SEQ ID NO: 195309 - protein, 9 aa, Artificial Sequence
  Description of Artificial Sequence: Synthetic peptide
  Seed: VVLHSFTDA (TYRP2_HUMAN)
VMLHSFTDL

SEQ ID NO: 195310 - protein, 10 aa, Artificial Sequence
  Description of Artificial Sequence: Synthetic peptide
  Seed: MSLHNLVHSF (TYRP2_HUMAN)
MSLHNLVHSL

SEQ ID NO: 195311 - protein, 10 aa, Artificial Sequence
  Description of Artificial Sequence: Synthetic peptide
  Seed: RELWPRKFFH (TYRP2_HUMAN)
RSLWPRKFFH

SEQ ID NO: 195312 - protein, 10 aa, Artificial Sequence
  Description of Artificial Sequence: Synthetic peptide
  Seed: YNMVPFFPPV (TYRP2_HUMAN)
YPMVPFFPPM

SEQ ID NO: 195313 - protein, 10 aa, Artificial Sequence
  Description of Artificial Sequence: Synthetic peptide
  Seed: RLIGNESFAL (TYRP2_HUMAN)
RMIGNESFAF

SEQ ID NO: 195314 - protein, 10 aa, Artificial Sequence
  Description of Artificial Sequence: Synthetic peptide
  Seed: QVMSLHNLVH (TYRP2_HUMAN)
QSMSLHNLVK

SEQ ID NO: 195315 - protein, 9 aa, Artificial Sequence
  Description of Artificial Sequence: Synthetic peptide
  Seed: KCTGNFAGY (TYRP2_HUMAN)
KATGNFAGF

SEQ ID NO: 195316 - protein, 9 aa, Artificial Sequence
  Description of Artificial Sequence: Synthetic peptide
  Seed: RTCKCTGNF (TYRP2_HUMAN)
RLCKCTGNW

SEQ ID NO: 195317 - protein, 9 aa, Artificial Sequence
  Description of Artificial Sequence: Synthetic peptide
  Seed: RNSMKLPTL (TYRP2_HUMAN)
RRSMKLPTI

SEQ ID NO: 195318 - protein, 9 aa, Artificial Sequence
  Description of Artificial Sequence: Synthetic peptide
  Seed: STFSFRNAL (TYRP2_HUMAN)
SIFSFRNAF

SEQ ID NO: 195319 - protein, 10 aa, Artificial Sequence
  Description of Artificial Sequence: Synthetic peptide
  Seed: FQNSTFSFRN (TYRP2_HUMAN)
FWNSTFSFRR

SEQ ID NO: 195320 - protein, 9 aa, Artificial Sequence
  Description of Artificial Sequence: Synthetic peptide
  Seed: VALVGLFVL (TYRP2_HUMAN)
VLLVGLFVA

SEQ ID NO: 195321 - protein, 9 aa, Artificial Sequence
  Description of Artificial Sequence: Synthetic peptide
  Seed: AANDPIFVV (TYRP2_HUMAN)
AMNDPIFVI

SEQ ID NO: 195322 - protein, 10 aa, Artificial Sequence
  Description of Artificial Sequence: Synthetic peptide
  Seed: LAFLQYRRLR (TYRP2_HUMAN)
LVFLQYRRLR

SEQ ID NO: 195323 - protein, 9 aa, Artificial Sequence
  Description of Artificial Sequence: Synthetic peptide
  Seed: YAIDLPVSV (TYRP2_HUMAN)
YIIDLPVSI

SEQ ID NO: 195324 - protein, 10 aa, Artificial Sequence
  Description of Artificial Sequence: Synthetic peptide
  Seed: RRLRKGYTPL (TYRP2_HUMAN)
RVLRKGYTPG

SEQ ID NO: 195325 - protein, 9 aa, Artificial Sequence
  Description of Artificial Sequence: Synthetic peptide
  Seed: AQGQFPRVC (TYRP2_HUMAN)
AEGQFPRVT

SEQ ID NO: 195326 - protein, 9 aa, Artificial Sequence
  Description of Artificial Sequence: Synthetic peptide
  Seed: STFSFRNAL (TYRP2_HUMAN)
SYFSFRNAV

SEQ ID NO: 195327 - protein, 9 aa, Artificial Sequence
  Description of Artificial Sequence: Synthetic peptide
  Seed: ANCSVYDFF (TYRP2_HUMAN)
AQCSVYDFI

SEQ ID NO: 195328 - protein, 9 aa, Artificial Sequence
  Description of Artificial Sequence: Synthetic peptide
  Seed: HQGPAFVTW (TYRP2_HUMAN)
HWGPAFVTL

SEQ ID NO: 195329 - protein, 10 aa, Artificial Sequence
  Description of Artificial Sequence: Synthetic peptide
  Seed: QFANCSVYDF (TYRP2_HUMAN)
QYANCSVYDF

SEQ ID NO: 195330 - protein, 11 aa, Artificial Sequence
  Description of Artificial Sequence: Synthetic peptide
  Seed: RRNQMGRNSMK (TYRP2_HUMAN)
RTNQMGRNSMR

SEQ ID NO: 195331 - protein, 9 aa, Artificial Sequence
  Description of Artificial Sequence: Synthetic peptide
  Seed: YAIDLPVSV (TYRP2_HUMAN)
YIIDLPVSM

SEQ ID NO: 195332 - protein, 9 aa, Artificial Sequence
  Description of Artificial Sequence: Synthetic peptide
  Seed: ANDPIFVVL (TYRP2_HUMAN)
AEDPIFVVF

SEQ ID NO: 195333 - protein, 9 aa, Artificial Sequence
  Description of Artificial Sequence: Synthetic peptide
  Seed: STFSFRNAL (TYRP2_HUMAN)
SPFSFRNAV

SEQ ID NO: 195334 - protein, 9 aa, Artificial Sequence
  Description of Artificial Sequence: Synthetic peptide
  Seed: TLISRNSRF (TYRP2_HUMAN)
TKISRNSRY

SEQ ID NO: 195335 - protein, 9 aa, Artificial Sequence
  Description of Artificial Sequence: Synthetic peptide
  Seed: WPTTLLVVM (TYRP2_HUMAN)
WPTTLLVVT

SEQ ID NO: 195336 - protein, 9 aa, Artificial Sequence
  Description of Artificial Sequence: Synthetic peptide
  Seed: ESANVCGSQ (TYRP2_HUMAN)
ESANVCGSR

SEQ ID NO: 195337 - protein, 9 aa, Artificial Sequence
  Description of Artificial Sequence: Synthetic peptide
  Seed: IGHNRMYNM (TYRP2_HUMAN)
ISHNRMYNL

SEQ ID NO: 195338 - protein, 9 aa, Artificial Sequence
  Description of Artificial Sequence: Synthetic peptide
  Seed: TQHWLGLLG (TYRP2_HUMAN)
TMHWLGLLM

SEQ ID NO: 195339 - protein, 10 aa, Artificial Sequence
  Description of Artificial Sequence: Synthetic peptide
  Seed: FSFRNALEGF (TYRP2_HUMAN)
FYFRNALEGW

SEQ ID NO: 195340 - protein, 9 aa, Artificial Sequence
  Description of Artificial Sequence: Synthetic peptide
  Seed: DDYNHLVTL (TYRP2_HUMAN)
DKYNHLVTI

SEQ ID NO: 195341 - protein, 10 aa, Artificial Sequence
  Description of Artificial Sequence: Synthetic peptide
  Seed: ELAPIGHNRM (TYRP2_HUMAN)
ELAPIGHNRR

SEQ ID NO: 195342 - protein, 9 aa, Artificial Sequence
  Description of Artificial Sequence: Synthetic peptide
  Seed: VVMGTLVAL (TYRP2_HUMAN)
VIMGTLVAY

SEQ ID NO: 195343 - protein, 11 aa, Artificial Sequence
  Description of Artificial Sequence: Synthetic peptide
  Seed: ANCSVYDFFVW (TYRP2_HUMAN)
APCSVYDFFVW

SEQ ID NO: 195344 - protein, 9 aa, Artificial Sequence
  Description of Artificial Sequence: Synthetic peptide
  Seed: AARPDDPTL (TYRP2_HUMAN)
AARPDDPTW

SEQ ID NO: 195345 - protein, 9 aa, Artificial Sequence
  Description of Artificial Sequence: Synthetic peptide
  Seed: GQFPRVCMT (TYRP2_HUMAN)
GLFPRVCMI

SEQ ID NO: 195346 - protein, 9 aa, Artificial Sequence
  Description of Artificial Sequence: Synthetic peptide
  Seed: RQNIHSLSP (TYRP2_HUMAN)
RQNIHSLSY

SEQ ID NO: 195347 - protein, 10 aa, Artificial Sequence
  Description of Artificial Sequence: Synthetic peptide
  Seed: GYSYAIDLPV (TYRP2_HUMAN)
GMSYAIDLPV

SEQ ID NO: 195348 - protein, 10 aa, Artificial Sequence
  Description of Artificial Sequence: Synthetic peptide
  Seed: FGWTGPNCER (TYRP2_HUMAN)
FYWTGPNCER

SEQ ID NO: 195349 - protein, 9 aa, Artificial Sequence
  Description of Artificial Sequence: Synthetic peptide
  Seed: EETPGWPTT (TYRP2_HUMAN)
EETPGWPTF

SEQ ID NO: 195350 - protein, 10 aa, Artificial Sequence
  Description of Artificial Sequence: Synthetic peptide
  Seed: SLQKFDNPPF (TYRP2_HUMAN)
SSQKFDNPPF

SEQ ID NO: 195351 - protein, 9 aa, Artificial Sequence
  Description of Artificial Sequence: Synthetic peptide
  Seed: DDYNHLVTL (TYRP2_HUMAN)
DPYNHLVTY

SEQ ID NO: 195352 - protein, 10 aa, Artificial Sequence
  Description of Artificial Sequence: Synthetic peptide
  Seed: NGTYEGLLRR (TYRP2_HUMAN)
NRTYEGLLRR

SEQ ID NO: 195353 - protein, 10 aa, Artificial Sequence
  Description of Artificial Sequence: Synthetic peptide
  Seed: RNSMKLPTLK (TYRP2_HUMAN)
RPSMKLPTLR

SEQ ID NO: 195354 - protein, 10 aa, Artificial Sequence
  Description of Artificial Sequence: Synthetic peptide
  Seed: NPPFFQNSTF (TYRP2_HUMAN)
NCPFFQNSTW

SEQ ID NO: 195355 - protein, 10 aa, Artificial Sequence
  Description of Artificial Sequence: Synthetic peptide
  Seed: MSPLWWGFLL (TYRP2_HUMAN)
MFPLWWGFLW

SEQ ID NO: 195356 - protein, 10 aa, Artificial Sequence
  Description of Artificial Sequence: Synthetic peptide
  Seed: AIFDEWMKRF (TYRP2_HUMAN)
AAFDEWMKRW

SEQ ID NO: 195357 - protein, 9 aa, Artificial Sequence
  Description of Artificial Sequence: Synthetic peptide
  Seed: DFFVWLHYY (TYRP2_HUMAN)
DCFVWLHYR

SEQ ID NO: 195358 - protein, 9 aa, Artificial Sequence
  Description of Artificial Sequence: Synthetic peptide
  Seed: HYYSVRDTL (TYRP2_HUMAN)
HYYSVRDTF

SEQ ID NO: 195359 - protein, 10 aa, Artificial Sequence
  Description of Artificial Sequence: Synthetic peptide
  Seed: MSPLWWGFLL (TYRP2_HUMAN)
MCPLWWGFLL

SEQ ID NO: 195360 - protein, 10 aa, Artificial Sequence
  Description of Artificial Sequence: Synthetic peptide
  Seed: RRLRKGYTPL (TYRP2_HUMAN)
RALRKGYTPF

SEQ ID NO: 195361 - protein, 9 aa, Artificial Sequence
  Description of Artificial Sequence: Synthetic peptide
  Seed: VMSLHNLVH (TYRP2_HUMAN)
VESLHNLVF

SEQ ID NO: 195362 - protein, 9 aa, Artificial Sequence
  Description of Artificial Sequence: Synthetic peptide
  Seed: FPPVTNEEL (TYRP2_HUMAN)
FQPVTNEEF

SEQ ID NO: 195363 - protein, 9 aa, Artificial Sequence
  Description of Artificial Sequence: Synthetic peptide
  Seed: FSHQGPAFV (TYRP2_HUMAN)
FRHQGPAFY

SEQ ID NO: 195364 - protein, 9 aa, Artificial Sequence
  Description of Artificial Sequence: Synthetic peptide
  Seed: NMVPFFPPV (TYRP2_HUMAN)
NVVPFFPPM

SEQ ID NO: 195365 - protein, 11 aa, Artificial Sequence
  Description of Artificial Sequence: Synthetic peptide
  Seed: YTPLMETHLSS (TYRP2_HUMAN)
YQPLMETHLSA

SEQ ID NO: 195366 - protein, 10 aa, Artificial Sequence
  Description of Artificial Sequence: Synthetic peptide
  Seed: YNMVPFFPPV (TYRP2_HUMAN)
YPMVPFFPPL

SEQ ID NO: 195367 - protein, 9 aa, Artificial Sequence
  Description of Artificial Sequence: Synthetic peptide
  Seed: ALVGLFVLL (TYRP2_HUMAN)
ALVGLFVLA

SEQ ID NO: 195368 - protein, 10 aa, Artificial Sequence
  Description of Artificial Sequence: Synthetic peptide
  Seed: LQKFDNPPFF (TYRP2_HUMAN)
LKKFDNPPFF

SEQ ID NO: 195369 - protein, 9 aa, Artificial Sequence
  Description of Artificial Sequence: Synthetic peptide
  Seed: VMSLHNLVH (TYRP2_HUMAN)
VVSLHNLVF

SEQ ID NO: 195370 - protein, 10 aa, Artificial Sequence
  Description of Artificial Sequence: Synthetic peptide
  Seed: NMVPFFPPVT (TYRP2_HUMAN)
NVVPFFPPVV

SEQ ID NO: 195371 - protein, 10 aa, Artificial Sequence
  Description of Artificial Sequence: Synthetic peptide
  Seed: FSFRNALEGF (TYRP2_HUMAN)
FPFRNALEGL

SEQ ID NO: 195372 - protein, 10 aa, Artificial Sequence
  Description of Artificial Sequence: Synthetic peptide
  Seed: ADTRPWSGPY (TYRP2_HUMAN)
AATRPWSGPW

SEQ ID NO: 195373 - protein, 9 aa, Artificial Sequence
  Description of Artificial Sequence: Synthetic peptide
  Seed: SLDDYNHLV (TYRP2_HUMAN)
SHDDYNHLM

SEQ ID NO: 195374 - protein, 10 aa, Artificial Sequence
  Description of Artificial Sequence: Synthetic peptide
  Seed: ADTRPWSGPY (TYRP2_HUMAN)
ASTRPWSGPF

SEQ ID NO: 195375 - protein, 10 aa, Artificial Sequence
  Description of Artificial Sequence: Synthetic peptide
  Seed: HNRMYNMVPF (TYRP2_HUMAN)
HKRMYNMVPY

SEQ ID NO: 195376 - protein, 10 aa, Artificial Sequence
  Description of Artificial Sequence: Synthetic peptide
  Seed: FFPPVTNEEL (TYRP2_HUMAN)
FIPPVTNEEV

SEQ ID NO: 195377 - protein, 10 aa, Artificial Sequence
  Description of Artificial Sequence: Synthetic peptide
  Seed: RELWPRKFFH (TYRP2_HUMAN)
RYLWPRKFFH

SEQ ID NO: 195378 - protein, 9 aa, Artificial Sequence
  Description of Artificial Sequence: Synthetic peptide
  Seed: VVMGTLVAL (TYRP2_HUMAN)
VRMGTLVAF

SEQ ID NO: 195379 - protein, 10 aa, Artificial Sequence
  Description of Artificial Sequence: Synthetic peptide
  Seed: MSPLWWGFLL (TYRP2_HUMAN)
MDPLWWGFLL

SEQ ID NO: 195380 - protein, 9 aa, Artificial Sequence
  Description of Artificial Sequence: Synthetic peptide
  Seed: DDYNHLVTL (TYRP2_HUMAN)
DEYNHLVTI

SEQ ID NO: 195381 - protein, 10 aa, Artificial Sequence
  Description of Artificial Sequence: Synthetic peptide
  Seed: FFQNSTFSFR (TYRP2_HUMAN)
FAQNSTFSFK

SEQ ID NO: 195382 - protein, 9 aa, Artificial Sequence
  Description of Artificial Sequence: Synthetic peptide
  Seed: RLRKGYTPL (TYRP2_HUMAN)
RVRKGYTPD

SEQ ID NO: 195383 - protein, 10 aa, Artificial Sequence
  Description of Artificial Sequence: Synthetic peptide
  Seed: VVLHSFTDAI (TYRP2_HUMAN)
VTLHSFTDAV

SEQ ID NO: 195384 - protein, 9 aa, Artificial Sequence
  Description of Artificial Sequence: Synthetic peptide
  Seed: AANDPIFVV (TYRP2_HUMAN)
ALNDPIFVY

SEQ ID NO: 195385 - protein, 10 aa, Artificial Sequence
  Description of Artificial Sequence: Synthetic peptide
  Seed: QGPAFVTWHR (TYRP2_HUMAN)
QSPAFVTWHR

SEQ ID NO: 195386 - protein, 9 aa, Artificial Sequence
  Description of Artificial Sequence: Synthetic peptide
  Seed: ILPGAQGQF (TYRP2_HUMAN)
IFPGAQGQF

SEQ ID NO: 195387 - protein, 9 aa, Artificial Sequence
  Description of Artificial Sequence: Synthetic peptide
  Seed: STFSFRNAL (TYRP2_HUMAN)
SYFSFRNAM

SEQ ID NO: 195388 - protein, 9 aa, Artificial Sequence
  Description of Artificial Sequence: Synthetic peptide
  Seed: LVALVGLFV (TYRP2_HUMAN)
LSALVGLFL

SEQ ID NO: 195389 - protein, 9 aa, Artificial Sequence
  Description of Artificial Sequence: Synthetic peptide
  Seed: CSVYDFFVW (TYRP2_HUMAN)
CPVYDFFVY

SEQ ID NO: 195390 - protein, 9 aa, Artificial Sequence
  Description of Artificial Sequence: Synthetic peptide
  Seed: EQFLGALDL (TYRP2_HUMAN)
EHFLGALDF

SEQ ID NO: 195391 - protein, 9 aa, Artificial Sequence
  Description of Artificial Sequence: Synthetic peptide
  Seed: FSHQGPAFV (TYRP2_HUMAN)
FGHQGPAFF

SEQ ID NO: 195392 - protein, 10 aa, Artificial Sequence
  Description of Artificial Sequence: Synthetic peptide
  Seed: NCSVYDFFVW (TYRP2_HUMAN)
NTSVYDFFVW

SEQ ID NO: 195393 - protein, 9 aa, Artificial Sequence
  Description of Artificial Sequence: Synthetic peptide
  Seed: SLDDYNHLV (TYRP2_HUMAN)
SRDDYNHLF

SEQ ID NO: 195394 - protein, 11 aa, Artificial Sequence
  Description of Artificial Sequence: Synthetic peptide
  Seed: YNMVPFFPPVT (TYRP2_HUMAN)
YIMVPFFPPVQ

SEQ ID NO: 195395 - protein, 10 aa, Artificial Sequence
  Description of Artificial Sequence: Synthetic peptide
  Seed: RRLRKGYTPL (TYRP2_HUMAN)
RFLRKGYTPK

SEQ ID NO: 195396 - protein, 9 aa, Artificial Sequence
  Description of Artificial Sequence: Synthetic peptide
  Seed: RNQMGRNSM (TYRP2_HUMAN)
RKQMGRNSM

SEQ ID NO: 195397 - protein, 9 aa, Artificial Sequence
  Description of Artificial Sequence: Synthetic peptide
  Seed: TLDSQVMSL (TYRP2_HUMAN)
TLDSQVMSM

SEQ ID NO: 195398 - protein, 9 aa, Artificial Sequence
  Description of Artificial Sequence: Synthetic peptide
  Seed: FVLLAFLQY (TYRP2_HUMAN)
FKLLAFLQM

SEQ ID NO: 195399 - protein, 8 aa, Artificial Sequence
  Description of Artificial Sequence: Synthetic peptide
  Seed: FSHQGPAF (TYRP2_HUMAN)
FWHQGPAF

SEQ ID NO: 195400 - protein, 9 aa, Artificial Sequence
  Description of Artificial Sequence: Synthetic peptide
  Seed: RVCMTVDSL (TYRP2_HUMAN)
RMCMTVDSF

SEQ ID NO: 195401 - protein, 11 aa, Artificial Sequence
  Description of Artificial Sequence: Synthetic peptide
  Seed: MYNMVPFFPPV (TYRP2_HUMAN)
MTNMVPFFPPV

SEQ ID NO: 195402 - protein, 10 aa, Artificial Sequence
  Description of Artificial Sequence: Synthetic peptide
  Seed: SLDDYNHLVT (TYRP2_HUMAN)
SMDDYNHLVI

SEQ ID NO: 195403 - protein, 9 aa, Artificial Sequence
  Description of Artificial Sequence: Synthetic peptide
  Seed: FANCSVYDF (TYRP2_HUMAN)
FSNCSVYDW

SEQ ID NO: 195404 - protein, 10 aa, Artificial Sequence
  Description of Artificial Sequence: Synthetic peptide
  Seed: RMYNMVPFFP (TYRP2_HUMAN)
RFYNMVPFFK

SEQ ID NO: 195405 - protein, 9 aa, Artificial Sequence
  Description of Artificial Sequence: Synthetic peptide
  Seed: FLTSDQLGY (TYRP2_HUMAN)
FATSDQLGF

SEQ ID NO: 195406 - protein, 9 aa, Artificial Sequence
  Description of Artificial Sequence: Synthetic peptide
  Seed: YSYAIDLPV (TYRP2_HUMAN)
YCYAIDLPM

SEQ ID NO: 195407 - protein, 9 aa, Artificial Sequence
  Description of Artificial Sequence: Synthetic peptide
  Seed: ALDLAKKRV (TYRP2_HUMAN)
AIDLAKKRL

SEQ ID NO: 195408 - protein, 9 aa, Artificial Sequence
  Description of Artificial Sequence: Synthetic peptide
  Seed: TLLVVMGTL (TYRP2_HUMAN)
TLLVVMGTF

SEQ ID NO: 195409 - protein, 10 aa, Artificial Sequence
  Description of Artificial Sequence: Synthetic peptide
  Seed: SLHNLVHSFL (TYRP2_HUMAN)
SLHNLVHSFV

SEQ ID NO: 195410 - protein, 11 aa, Artificial Sequence
  Description of Artificial Sequence: Synthetic peptide
  Seed: MYNMVPFFPPV (TYRP2_HUMAN)
MDNMVPFFPPV

SEQ ID NO: 195411 - protein, 9 aa, Artificial Sequence
  Description of Artificial Sequence: Synthetic peptide
  Seed: RNQDDRELW (TYRP2_HUMAN)
RMQDDRELW

SEQ ID NO: 195412 - protein, 10 aa, Artificial Sequence
  Description of Artificial Sequence: Synthetic peptide
  Seed: RRLRKGYTPL (TYRP2_HUMAN)
RRLRKGYTPK

SEQ ID NO: 195413 - protein, 9 aa, Artificial Sequence
  Description of Artificial Sequence: Synthetic peptide
  Seed: DQLGYSYAI (TYRP2_HUMAN)
DVLGYSYAV

SEQ ID NO: 195414 - protein, 11 aa, Artificial Sequence
  Description of Artificial Sequence: Synthetic peptide
  Seed: CDSLDDYNHLV (TYRP2_HUMAN)
CWSLDDYNHLV

SEQ ID NO: 195415 - protein, 11 aa, Artificial Sequence
  Description of Artificial Sequence: Synthetic peptide
  Seed: TQPQFANCSVY (TYRP2_HUMAN)
TRPQFANCSVY

SEQ ID NO: 195416 - protein, 11 aa, Artificial Sequence
  Description of Artificial Sequence: Synthetic peptide
  Seed: VCMTVDSLVNK (TYRP2_HUMAN)
VIMTVDSLVNR

SEQ ID NO: 195417 - protein, 9 aa, Artificial Sequence
  Description of Artificial Sequence: Synthetic peptide
  Seed: NRMYNMVPF (TYRP2_HUMAN)
NMMYNMVPM

SEQ ID NO: 195418 - protein, 10 aa, Artificial Sequence
  Description of Artificial Sequence: Synthetic peptide
  Seed: FFQNSTFSFR (TYRP2_HUMAN)
FYQNSTFSFE

SEQ ID NO: 195419 - protein, 9 aa, Artificial Sequence
  Description of Artificial Sequence: Synthetic peptide
  Seed: NMVPFFPPV (TYRP2_HUMAN)
NVVPFFPPA

SEQ ID NO: 195420 - protein, 9 aa, Artificial Sequence
  Description of Artificial Sequence: Synthetic peptide
  Seed: FVWLHYYSV (TYRP2_HUMAN)
FSWLHYYSK

SEQ ID NO: 195421 - protein, 10 aa, Artificial Sequence
  Description of Artificial Sequence: Synthetic peptide
  Seed: LVVMGTLVAL (TYRP2_HUMAN)
LDVMGTLVAF

SEQ ID NO: 195422 - protein, 9 aa, Artificial Sequence
  Description of Artificial Sequence: Synthetic peptide
  Seed: LVHSFLNGT (TYRP2_HUMAN)
LIHSFLNGA

SEQ ID NO: 195423 - protein, 10 aa, Artificial Sequence
  Description of Artificial Sequence: Synthetic peptide
  Seed: CCPRLGAESA (TYRP2_HUMAN)
CIPRLGAESM

SEQ ID NO: 195424 - protein, 11 aa, Artificial Sequence
  Description of Artificial Sequence: Synthetic peptide
  Seed: FLTSDQLGYSY (TYRP2_HUMAN)
FETSDQLGYSY

SEQ ID NO: 195425 - protein, 8 aa, Artificial Sequence
  Description of Artificial Sequence: Synthetic peptide
  Seed: LDDYNHLV (TYRP2_HUMAN)
LMDYNHLV

SEQ ID NO: 195426 - protein, 9 aa, Artificial Sequence
  Description of Artificial Sequence: Synthetic peptide
  Seed: SFALPYWNF (TYRP2_HUMAN)
SYALPYWNW

SEQ ID NO: 195427 - protein, 9 aa, Artificial Sequence
  Description of Artificial Sequence: Synthetic peptide
  Seed: ELWPRKFFH (TYRP2_HUMAN)
EQWPRKFFR

SEQ ID NO: 195428 - protein, 9 aa, Artificial Sequence
  Description of Artificial Sequence: Synthetic peptide
  Seed: VTWHRYHLL (TYRP2_HUMAN)
VPWHRYHLL

SEQ ID NO: 195429 - protein, 9 aa, Artificial Sequence
  Description of Artificial Sequence: Synthetic peptide
  Seed: DAIFDEWMK (TYRP2_HUMAN)
DMIFDEWMK

SEQ ID NO: 195430 - protein, 9 aa, Artificial Sequence
  Description of Artificial Sequence: Synthetic peptide
  Seed: FFPPVTNEE (TYRP2_HUMAN)
FSPPVTNEL

SEQ ID NO: 195431 - protein, 9 aa, Artificial Sequence
  Description of Artificial Sequence: Synthetic peptide
  Seed: VLLAFLQYR (TYRP2_HUMAN)
VILAFLQYR

SEQ ID NO: 195432 - protein, 9 aa, Artificial Sequence
  Description of Artificial Sequence: Synthetic peptide
  Seed: RKFFHRTCK (TYRP2_HUMAN)
RTFFHRTCS

SEQ ID NO: 195433 - protein, 11 aa, Artificial Sequence
  Description of Artificial Sequence: Synthetic peptide
  Seed: SLDDYNHLVTL (TYRP2_HUMAN)
SADDYNHLVTV

SEQ ID NO: 195434 - protein, 10 aa, Artificial Sequence
  Description of Artificial Sequence: Synthetic peptide
  Seed: VYDFFVWLHY (TYRP2_HUMAN)
VWDFFVWLHY

SEQ ID NO: 195435 - protein, 8 aa, Artificial Sequence
  Description of Artificial Sequence: Synthetic peptide
  Seed: FPRVCMTV (TYRP2_HUMAN)
FPRVCMTL

SEQ ID NO: 195436 - protein, 9 aa, Artificial Sequence
  Description of Artificial Sequence: Synthetic peptide
  Seed: VLHSFTDAI (TYRP2_HUMAN)
VEHSFTDAF

SEQ ID NO: 195437 - protein, 10 aa, Artificial Sequence
  Description of Artificial Sequence: Synthetic peptide
  Seed: AFVTWHRYHL (TYRP2_HUMAN)
AYVTWHRYHW

SEQ ID NO: 195438 - protein, 9 aa, Artificial Sequence
  Description of Artificial Sequence: Synthetic peptide
  Seed: VLHSFTDAI (TYRP2_HUMAN)
VMHSFTDAV

SEQ ID NO: 195439 - protein, 10 aa, Artificial Sequence
  Description of Artificial Sequence: Synthetic peptide
  Seed: RLRKGYTPLM (TYRP2_HUMAN)
RTRKGYTPLC

SEQ ID NO: 195440 - protein, 11 aa, Artificial Sequence
  Description of Artificial Sequence: Synthetic peptide
  Seed: YTPLMETHLSS (TYRP2_HUMAN)
YQPLMETHLST

SEQ ID NO: 195441 - protein, 9 aa, Artificial Sequence
  Description of Artificial Sequence: Synthetic peptide
  Seed: DQLGYSYAI (TYRP2_HUMAN)
DELGYSYAW

SEQ ID NO: 195442 - protein, 9 aa, Artificial Sequence
  Description of Artificial Sequence: Synthetic peptide
  Seed: YAIDLPVSV (TYRP2_HUMAN)
YQIDLPVSI

SEQ ID NO: 195443 - protein, 10 aa, Artificial Sequence
  Description of Artificial Sequence: Synthetic peptide
  Seed: LAPIGHNRMY (TYRP2_HUMAN)
LSPIGHNRMW

SEQ ID NO: 195444 - protein, 10 aa, Artificial Sequence
  Description of Artificial Sequence: Synthetic peptide
  Seed: GTLDSQVMSL (TYRP2_HUMAN)
GYLDSQVMSI

SEQ ID NO: 195445 - protein, 9 aa, Artificial Sequence
  Description of Artificial Sequence: Synthetic peptide
  Seed: VGLFVLLAF (TYRP2_HUMAN)
VALFVLLAW

SEQ ID NO: 195446 - protein, 9 aa, Artificial Sequence
  Description of Artificial Sequence: Synthetic peptide
  Seed: SVYDFFVWL (TYRP2_HUMAN)
SGYDFFVWR

SEQ ID NO: 195447 - protein, 10 aa, Artificial Sequence
  Description of Artificial Sequence: Synthetic peptide
  Seed: CMTVDSLVNK (TYRP2_HUMAN)
CLTVDSLVNK

SEQ ID NO: 195448 - protein, 10 aa, Artificial Sequence
  Description of Artificial Sequence: Synthetic peptide
  Seed: MSLHNLVHSF (TYRP2_HUMAN)
MALHNLVHSF

SEQ ID NO: 195449 - protein, 10 aa, Artificial Sequence
  Description of Artificial Sequence: Synthetic peptide
  Seed: MSLHNLVHSF (TYRP2_HUMAN)
MKLHNLVHSM

SEQ ID NO: 195450 - protein, 9 aa, Artificial Sequence
  Description of Artificial Sequence: Synthetic peptide
  Seed: NMVPFFPPV (TYRP2_HUMAN)
NLVPFFPPM

SEQ ID NO: 195451 - protein, 9 aa, Artificial Sequence
  Description of Artificial Sequence: Synthetic peptide
  Seed: RVCMTVDSL (TYRP2_HUMAN)
RLCMTVDSV

SEQ ID NO: 195452 - protein, 10 aa, Artificial Sequence
  Description of Artificial Sequence: Synthetic peptide
  Seed: YNMVPFFPPV (TYRP2_HUMAN)
YLMVPFFPPT

SEQ ID NO: 195453 - protein, 10 aa, Artificial Sequence
  Description of Artificial Sequence: Synthetic peptide
  Seed: HNRMYNMVPF (TYRP2_HUMAN)
HRRMYNMVPK

SEQ ID NO: 195454 - protein, 9 aa, Artificial Sequence
  Description of Artificial Sequence: Synthetic peptide
  Seed: HYYSVRDTL (TYRP2_HUMAN)
HMYSVRDTY

SEQ ID NO: 195455 - protein, 9 aa, Artificial Sequence
  Description of Artificial Sequence: Synthetic peptide
  Seed: IFDEWMKRF (TYRP2_HUMAN)
IVDEWMKRM

SEQ ID NO: 195456 - protein, 11 aa, Artificial Sequence
  Description of Artificial Sequence: Synthetic peptide
  Seed: ALPYWNFATGR (TYRP2_HUMAN)
AQPYWNFATGR

SEQ ID NO: 195457 - protein, 9 aa, Artificial Sequence
  Description of Artificial Sequence: Synthetic peptide
  Seed: STFSFRNAL (TYRP2_HUMAN)
SAFSFRNAH

SEQ ID NO: 195458 - protein, 10 aa, Artificial Sequence
  Description of Artificial Sequence: Synthetic peptide
  Seed: HNRMYNMVPF (TYRP2_HUMAN)
HGRMYNMVPY

SEQ ID NO: 195459 - protein, 10 aa, Artificial Sequence
  Description of Artificial Sequence: Synthetic peptide
  Seed: KILPGAQGQF (TYRP2_HUMAN)
KLLPGAQGQL

SEQ ID NO: 195460 - protein, 10 aa, Artificial Sequence
  Description of Artificial Sequence: Synthetic peptide
  Seed: FSFRNALEGF (TYRP2_HUMAN)
FFFRNALEGL

SEQ ID NO: 195461 - protein, 10 aa, Artificial Sequence
  Description of Artificial Sequence: Synthetic peptide
  Seed: FVWLHYYSVR (TYRP2_HUMAN)
FLWLHYYSVF

SEQ ID NO: 195462 - protein, 10 aa, Artificial Sequence
  Description of Artificial Sequence: Synthetic peptide
  Seed: FLTSDQLGYS (TYRP2_HUMAN)
FVTSDQLGYL

SEQ ID NO: 195463 - protein, 9 aa, Artificial Sequence
  Description of Artificial Sequence: Synthetic peptide
  Seed: GPGRPYRAI (TYRP2_HUMAN)
GPGRPYRAM

SEQ ID NO: 195464 - protein, 10 aa, Artificial Sequence
  Description of Artificial Sequence: Synthetic peptide
  Seed: FLTSDQLGYS (TYRP2_HUMAN)
FLTSDQLGYM

SEQ ID NO: 195465 - protein, 9 aa, Artificial Sequence
  Description of Artificial Sequence: Synthetic peptide
  Seed: VIRQNIHSL (TYRP2_HUMAN)
VWRQNIHSM

SEQ ID NO: 195466 - protein, 10 aa, Artificial Sequence
  Description of Artificial Sequence: Synthetic peptide
  Seed: LHYYSVRDTL (TYRP2_HUMAN)
LTYYSVRDTW

SEQ ID NO: 195467 - protein, 9 aa, Artificial Sequence
  Description of Artificial Sequence: Synthetic peptide
  Seed: RKFFHRTCK (TYRP2_HUMAN)
RTFFHRTCI

SEQ ID NO: 195468 - protein, 10 aa, Artificial Sequence
  Description of Artificial Sequence: Synthetic peptide
  Seed: FFPPVTNEEL (TYRP2_HUMAN)
FFPPVTNEEY

SEQ ID NO: 195469 - protein, 10 aa, Artificial Sequence
  Description of Artificial Sequence: Synthetic peptide
  Seed: SDQLGYSYAI (TYRP2_HUMAN)
SSQLGYSYAY

SEQ ID NO: 195470 - protein, 9 aa, Artificial Sequence
  Description of Artificial Sequence: Synthetic peptide
  Seed: AARPDDPTL (TYRP2_HUMAN)
ALRPDDPTM

SEQ ID NO: 195471 - protein, 8 aa, Artificial Sequence
  Description of Artificial Sequence: Synthetic peptide
  Seed: RPDDPTLI (TYRP2_HUMAN)
RLDDPTLM

SEQ ID NO: 195472 - protein, 10 aa, Artificial Sequence
  Description of Artificial Sequence: Synthetic peptide
  Seed: SFTDAIFDEW (TYRP2_HUMAN)
STTDAIFDEF

SEQ ID NO: 195473 - protein, 9 aa, Artificial Sequence
  Description of Artificial Sequence: Synthetic peptide
  Seed: FVWLHYYSV (TYRP2_HUMAN)
FLWLHYYSA

SEQ ID NO: 195474 - protein, 9 aa, Artificial Sequence
  Description of Artificial Sequence: Synthetic peptide
  Seed: HQGPAFVTW (TYRP2_HUMAN)
HWGPAFVTI

SEQ ID NO: 195475 - protein, 9 aa, Artificial Sequence
  Description of Artificial Sequence: Synthetic peptide
  Seed: RNQDDRELW (TYRP2_HUMAN)
RQQDDRELV

SEQ ID NO: 195476 - protein, 10 aa, Artificial Sequence
  Description of Artificial Sequence: Synthetic peptide
  Seed: KILPGAQGQF (TYRP2_HUMAN)
KTLPGAQGQW

SEQ ID NO: 195477 - protein, 10 aa, Artificial Sequence
  Description of Artificial Sequence: Synthetic peptide
  Seed: YNMVPFFPPV (TYRP2_HUMAN)
YTMVPFFPPI

SEQ ID NO: 195478 - protein, 10 aa, Artificial Sequence
  Description of Artificial Sequence: Synthetic peptide
  Seed: VVMGTLVALV (TYRP2_HUMAN)
VMMGTLVALQ

SEQ ID NO: 195479 - protein, 10 aa, Artificial Sequence
  Description of Artificial Sequence: Synthetic peptide
  Seed: TVDSLVNKEC (TYRP2_HUMAN)
TSDSLVNKEF

SEQ ID NO: 195480 - protein, 10 aa, Artificial Sequence
  Description of Artificial Sequence: Synthetic peptide
  Seed: MSLHNLVHSF (TYRP2_HUMAN)
MNLHNLVHSW

SEQ ID NO: 195481 - protein, 9 aa, Artificial Sequence
  Description of Artificial Sequence: Synthetic peptide
  Seed: TLDSQVMSL (TYRP2_HUMAN)
TADSQVMSC

SEQ ID NO: 195482 - protein, 9 aa, Artificial Sequence
  Description of Artificial Sequence: Synthetic peptide
  Seed: RLRKGYTPL (TYRP2_HUMAN)
RVRKGYTPM

SEQ ID NO: 195483 - protein, 9 aa, Artificial Sequence
  Description of Artificial Sequence: Synthetic peptide
  Seed: GAQGQFPRV (TYRP2_HUMAN)
GLQGQFPRL

SEQ ID NO: 195484 - protein, 9 aa, Artificial Sequence
  Description of Artificial Sequence: Synthetic peptide
  Seed: SFRNALEGF (TYRP2_HUMAN)
SARNALEGM

SEQ ID NO: 195485 - protein, 9 aa, Artificial Sequence
  Description of Artificial Sequence: Synthetic peptide
  Seed: RNQDDRELW (TYRP2_HUMAN)
RVQDDRELW

SEQ ID NO: 195486 - protein, 9 aa, Artificial Sequence
  Description of Artificial Sequence: Synthetic peptide
  Seed: FFQNSTFSF (TYRP2_HUMAN)
FPQNSTFSF

SEQ ID NO: 195487 - protein, 9 aa, Artificial Sequence
  Description of Artificial Sequence: Synthetic peptide
  Seed: HQGPAFVTW (TYRP2_HUMAN)
HGGPAFVTM

SEQ ID NO: 195488 - protein, 10 aa, Artificial Sequence
  Description of Artificial Sequence: Synthetic peptide
  Seed: LHYYSVRDTL (TYRP2_HUMAN)
LNYYSVRDTW

SEQ ID NO: 195489 - protein, 10 aa, Artificial Sequence
  Description of Artificial Sequence: Synthetic peptide
  Seed: SPLWWGFLLS (TYRP2_HUMAN)
SLLWWGFLLA

SEQ ID NO: 195490 - protein, 10 aa, Artificial Sequence
  Description of Artificial Sequence: Synthetic peptide
  Seed: VALVGLFVLL (TYRP2_HUMAN)
VMLVGLFVLL

SEQ ID NO: 195491 - protein, 8 aa, Artificial Sequence
  Description of Artificial Sequence: Synthetic peptide
  Seed: SDQLGYSY (TYRP2_HUMAN)
SEQLGYSY

SEQ ID NO: 195492 - protein, 10 aa, Artificial Sequence
  Description of Artificial Sequence: Synthetic peptide
  Seed: IGNESFALPY (TYRP2_HUMAN)
IQNESFALPF

SEQ ID NO: 195493 - protein, 10 aa, Artificial Sequence
  Description of Artificial Sequence: Synthetic peptide
  Seed: METHLSSKRY (TYRP2_HUMAN)
MSTHLSSKRF

SEQ ID NO: 195494 - protein, 11 aa, Artificial Sequence
  Description of Artificial Sequence: Synthetic peptide
  Seed: SLDDYNHLVTL (TYRP2_HUMAN)
SMDDYNHLVTY

SEQ ID NO: 195495 - protein, 10 aa, Artificial Sequence
  Description of Artificial Sequence: Synthetic peptide
  Seed: FFQNSTFSFR (TYRP2_HUMAN)
FPQNSTFSFR

SEQ ID NO: 195496 - protein, 9 aa, Artificial Sequence
  Description of Artificial Sequence: Synthetic peptide
  Seed: DQLGYSYAI (TYRP2_HUMAN)
DELGYSYAY

SEQ ID NO: 195497 - protein, 10 aa, Artificial Sequence
  Description of Artificial Sequence: Synthetic peptide
  Seed: CLGCKILPGA (TYRP2_HUMAN)
CLGCKILPGV

SEQ ID NO: 195498 - protein, 10 aa, Artificial Sequence
  Description of Artificial Sequence: Synthetic peptide
  Seed: RLRKGYTPLM (TYRP2_HUMAN)
RIRKGYTPLV

SEQ ID NO: 195499 - protein, 9 aa, Artificial Sequence
  Description of Artificial Sequence: Synthetic peptide
  Seed: FPPVTNEEL (TYRP2_HUMAN)
FPPVTNEEF

SEQ ID NO: 195500 - protein, 10 aa, Artificial Sequence
  Description of Artificial Sequence: Synthetic peptide
  Seed: RNSRFSSWET (TYRP2_HUMAN)
RMSRFSSWEI

SEQ ID NO: 195501 - protein, 10 aa, Artificial Sequence
  Description of Artificial Sequence: Synthetic peptide
  Seed: RMYNMVPFFP (TYRP2_HUMAN)
RQYNMVPFFF

SEQ ID NO: 195502 - protein, 9 aa, Artificial Sequence
  Description of Artificial Sequence: Synthetic peptide
  Seed: RLRKGYTPL (TYRP2_HUMAN)
RWRKGYTPF

SEQ ID NO: 195503 - protein, 9 aa, Artificial Sequence
  Description of Artificial Sequence: Synthetic peptide
  Seed: DQLGYSYAI (TYRP2_HUMAN)
DTLGYSYAA

SEQ ID NO: 195504 - protein, 9 aa, Artificial Sequence
  Description of Artificial Sequence: Synthetic peptide
  Seed: TLLGPGRPY (TYRP2_HUMAN)
TVLGPGRPF

SEQ ID NO: 195505 - protein, 10 aa, Artificial Sequence
  Description of Artificial Sequence: Synthetic peptide
  Seed: YDFFVWLHYY (TYRP2_HUMAN)
YMFFVWLHYA

SEQ ID NO: 195506 - protein, 9 aa, Artificial Sequence
  Description of Artificial Sequence: Synthetic peptide
  Seed: VALVGLFVL (TYRP2_HUMAN)
VALVGLFVW

SEQ ID NO: 195507 - protein, 10 aa, Artificial Sequence
  Description of Artificial Sequence: Synthetic peptide
  Seed: LVVMGTLVAL (TYRP2_HUMAN)
LQVMGTLVAI

SEQ ID NO: 195508 - protein, 9 aa, Artificial Sequence
  Description of Artificial Sequence: Synthetic peptide
  Seed: AIFDEWMKR (TYRP2_HUMAN)
ATFDEWMKF

SEQ ID NO: 195509 - protein, 9 aa, Artificial Sequence
  Description of Artificial Sequence: Synthetic peptide
  Seed: SLHNLVHSF (TYRP2_HUMAN)
STHNLVHSY

SEQ ID NO: 195510 - protein, 11 aa, Artificial Sequence
  Description of Artificial Sequence: Synthetic peptide
  Seed: AIDFSHQGPAF (TYRP2_HUMAN)
AADFSHQGPAM

SEQ ID NO: 195511 - protein, 9 aa, Artificial Sequence
  Description of Artificial Sequence: Synthetic peptide
  Seed: VTWHRYHLL (TYRP2_HUMAN)
VLWHRYHLC

SEQ ID NO: 195512 - protein, 9 aa, Artificial Sequence
  Description of Artificial Sequence: Synthetic peptide
  Seed: LHNLVHSFL (TYRP2_HUMAN)
LQNLVHSFL

SEQ ID NO: 195513 - protein, 9 aa, Artificial Sequence
  Description of Artificial Sequence: Synthetic peptide
  Seed: FTDAIFDEW (TYRP2_HUMAN)
FCDAIFDEV

SEQ ID NO: 195514 - protein, 9 aa, Artificial Sequence
  Description of Artificial Sequence: Synthetic peptide
  Seed: VVMGTLVAL (TYRP2_HUMAN)
VSMGTLVAY

SEQ ID NO: 195515 - protein, 9 aa, Artificial Sequence
  Description of Artificial Sequence: Synthetic peptide
  Seed: FFQNSTFSF (TYRP2_HUMAN)
FSQNSTFSM

SEQ ID NO: 195516 - protein, 10 aa, Artificial Sequence
  Description of Artificial Sequence: Synthetic peptide
  Seed: RLRKGYTPLM (TYRP2_HUMAN)
RMRKGYTPLM

SEQ ID NO: 195517 - protein, 9 aa, Artificial Sequence
  Description of Artificial Sequence: Synthetic peptide
  Seed: RFNPPADAW (TYRP2_HUMAN)
RWNPPADAY

SEQ ID NO: 195518 - protein, 8 aa, Artificial Sequence
  Description of Artificial Sequence: Synthetic peptide
  Seed: FSHQGPAF (TYRP2_HUMAN)
FGHQGPAL

SEQ ID NO: 195519 - protein, 10 aa, Artificial Sequence
  Description of Artificial Sequence: Synthetic peptide
  Seed: CCPRLGAESA (TYRP2_HUMAN)
CMPRLGAESM

SEQ ID NO: 195520 - protein, 9 aa, Artificial Sequence
  Description of Artificial Sequence: Synthetic peptide
  Seed: AANDPIFVV (TYRP2_HUMAN)
AYNDPIFVM

SEQ ID NO: 195521 - protein, 9 aa, Artificial Sequence
  Description of Artificial Sequence: Synthetic peptide
  Seed: LLSCLGCKI (TYRP2_HUMAN)
LVSCLGCKL

SEQ ID NO: 195522 - protein, 11 aa, Artificial Sequence
  Description of Artificial Sequence: Synthetic peptide
  Seed: WLHYYSVRDTL (TYRP2_HUMAN)
WNHYYSVRDTF

SEQ ID NO: 195523 - protein, 10 aa, Artificial Sequence
  Description of Artificial Sequence: Synthetic peptide
  Seed: MSPLWWGFLL (TYRP2_HUMAN)
MLPLWWGFLI

SEQ ID NO: 195524 - protein, 10 aa, Artificial Sequence
  Description of Artificial Sequence: Synthetic peptide
  Seed: TLLGPGRPYR (TYRP2_HUMAN)
TQLGPGRPYR

SEQ ID NO: 195525 - protein, 10 aa, Artificial Sequence
  Description of Artificial Sequence: Synthetic peptide
  Seed: YNMVPFFPPV (TYRP2_HUMAN)
YVMVPFFPPV

SEQ ID NO: 195526 - protein, 9 aa, Artificial Sequence
  Description of Artificial Sequence: Synthetic peptide
  Seed: VVMGTLVAL (TYRP2_HUMAN)
VCMGTLVAY

SEQ ID NO: 195527 - protein, 9 aa, Artificial Sequence
  Description of Artificial Sequence: Synthetic peptide
  Seed: LPHSAANDP (TYRP2_HUMAN)
LPHSAANDA

SEQ ID NO: 195528 - protein, 9 aa, Artificial Sequence
  Description of Artificial Sequence: Synthetic peptide
  Seed: RKFFHRTCK (TYRP2_HUMAN)
RYFFHRTCR

SEQ ID NO: 195529 - protein, 9 aa, Artificial Sequence
  Description of Artificial Sequence: Synthetic peptide
  Seed: GTLVALVGL (TYRP2_HUMAN)
GQLVALVGI

SEQ ID NO: 195530 - protein, 10 aa, Artificial Sequence
  Description of Artificial Sequence: Synthetic peptide
  Seed: MTVDSLVNKE (TYRP2_HUMAN)
MVVDSLVNKR

SEQ ID NO: 195531 - protein, 9 aa, Artificial Sequence
  Description of Artificial Sequence: Synthetic peptide
  Seed: RLRKGYTPL (TYRP2_HUMAN)
RMRKGYTPF

SEQ ID NO: 195532 - protein, 10 aa, Artificial Sequence
  Description of Artificial Sequence: Synthetic peptide
  Seed: RELWPRKFFH (TYRP2_HUMAN)
RQLWPRKFFR

SEQ ID NO: 195533 - protein, 9 aa, Artificial Sequence
  Description of Artificial Sequence: Synthetic peptide
  Seed: QVMSLHNLV (TYRP2_HUMAN)
QTMSLHNLK

SEQ ID NO: 195534 - protein, 11 aa, Artificial Sequence
  Description of Artificial Sequence: Synthetic peptide
  Seed: YTPLMETHLSS (TYRP2_HUMAN)
YHPLMETHLSA

SEQ ID NO: 195535 - protein, 10 aa, Artificial Sequence
  Description of Artificial Sequence: Synthetic peptide
  Seed: LQKFDNPPFF (TYRP2_HUMAN)
LMKFDNPPFF

SEQ ID NO: 195536 - protein, 10 aa, Artificial Sequence
  Description of Artificial Sequence: Synthetic peptide
  Seed: VLLAFLQYRR (TYRP2_HUMAN)
VFLAFLQYRK

SEQ ID NO: 195537 - protein, 9 aa, Artificial Sequence
  Description of Artificial Sequence: Synthetic peptide
  Seed: RVCMTVDSL (TYRP2_HUMAN)
RICMTVDSL

SEQ ID NO: 195538 - protein, 11 aa, Artificial Sequence
  Description of Artificial Sequence: Synthetic peptide
  Seed: ELAPIGHNRMY (TYRP2_HUMAN)
EVAPIGHNRMW

SEQ ID NO: 195539 - protein, 10 aa, Artificial Sequence
  Description of Artificial Sequence: Synthetic peptide
  Seed: RNSRFSSWET (TYRP2_HUMAN)
RTSRFSSWEA

SEQ ID NO: 195540 - protein, 10 aa, Artificial Sequence
  Description of Artificial Sequence: Synthetic peptide
  Seed: TRPWSGPYIL (TYRP2_HUMAN)
TWPWSGPYIM

SEQ ID NO: 195541 - protein, 10 aa, Artificial Sequence
  Description of Artificial Sequence: Synthetic peptide
  Seed: PFFQNSTFSF (TYRP2_HUMAN)
PFFQNSTFSY

SEQ ID NO: 195542 - protein, 9 aa, Artificial Sequence
  Description of Artificial Sequence: Synthetic peptide
  Seed: LHNLVHSFL (TYRP2_HUMAN)
LHNLVHSFI

SEQ ID NO: 195543 - protein, 10 aa, Artificial Sequence
  Description of Artificial Sequence: Synthetic peptide
  Seed: HNRMYNMVPF (TYRP2_HUMAN)
HMRMYNMVPY

SEQ ID NO: 195544 - protein, 10 aa, Artificial Sequence
  Description of Artificial Sequence: Synthetic peptide
  Seed: SRFSSWETVC (TYRP2_HUMAN)
SHFSSWETVA

SEQ ID NO: 195545 - protein, 9 aa, Artificial Sequence
  Description of Artificial Sequence: Synthetic peptide
  Seed: GAQGQFPRV (TYRP2_HUMAN)
GQQGQFPRL

SEQ ID NO: 195546 - protein, 9 aa, Artificial Sequence
  Description of Artificial Sequence: Synthetic peptide
  Seed: HYYSVRDTL (TYRP2_HUMAN)
HGYSVRDTY

SEQ ID NO: 195547 - protein, 9 aa, Artificial Sequence
  Description of Artificial Sequence: Synthetic peptide
  Seed: EREQFLGAL (TYRP2_HUMAN)
EHEQFLGAF

SEQ ID NO: 195548 - protein, 9 aa, Artificial Sequence
  Description of Artificial Sequence: Synthetic peptide
  Seed: RLRKGYTPL (TYRP2_HUMAN)
RMRKGYTPC

SEQ ID NO: 195549 - protein, 11 aa, Artificial Sequence
  Description of Artificial Sequence: Synthetic peptide
  Seed: MYNMVPFFPPV (TYRP2_HUMAN)
MNNMVPFFPPL

SEQ ID NO: 195550 - protein, 10 aa, Artificial Sequence
  Description of Artificial Sequence: Synthetic peptide
  Seed: SHQGPAFVTW (TYRP2_HUMAN)
SQQGPAFVTL

SEQ ID NO: 195551 - protein, 9 aa, Artificial Sequence
  Description of Artificial Sequence: Synthetic peptide
  Seed: TTLLVVMGT (TYRP2_HUMAN)
TVLLVVMGV

SEQ ID NO: 195552 - protein, 10 aa, Artificial Sequence
  Description of Artificial Sequence: Synthetic peptide
  Seed: LGPNGTQPQF (TYRP2_HUMAN)
LVPNGTQPQL

SEQ ID NO: 195553 - protein, 10 aa, Artificial Sequence
  Description of Artificial Sequence: Synthetic peptide
  Seed: MSLHNLVHSF (TYRP2_HUMAN)
MPLHNLVHSY

SEQ ID NO: 195554 - protein, 10 aa, Artificial Sequence
  Description of Artificial Sequence: Synthetic peptide
  Seed: MSPLWWGFLL (TYRP2_HUMAN)
MLPLWWGFLL

SEQ ID NO: 195555 - protein, 10 aa, Artificial Sequence
  Description of Artificial Sequence: Synthetic peptide
  Seed: LTSDQLGYSY (TYRP2_HUMAN)
LDSDQLGYSY

SEQ ID NO: 195556 - protein, 10 aa, Artificial Sequence
  Description of Artificial Sequence: Synthetic peptide
  Seed: SAANDPIFVV (TYRP2_HUMAN)
SIANDPIFVI

SEQ ID NO: 195557 - protein, 9 aa, Artificial Sequence
  Description of Artificial Sequence: Synthetic peptide
  Seed: RPWSGPYIL (TYRP2_HUMAN)
RQWSGPYIY

SEQ ID NO: 195558 - protein, 10 aa, Artificial Sequence
  Description of Artificial Sequence: Synthetic peptide
  Seed: NSRFSSWETV (TYRP2_HUMAN)
NFRFSSWETL

SEQ ID NO: 195559 - protein, 10 aa, Artificial Sequence
  Description of Artificial Sequence: Synthetic peptide
  Seed: RMYNMVPFFP (TYRP2_HUMAN)
RLYNMVPFFW

SEQ ID NO: 195560 - protein, 10 aa, Artificial Sequence
  Description of Artificial Sequence: Synthetic peptide
  Seed: RPWSGPYILR (TYRP2_HUMAN)
RQWSGPYILR

SEQ ID NO: 195561 - protein, 10 aa, Artificial Sequence
  Description of Artificial Sequence: Synthetic peptide
  Seed: SPLWWGFLLS (TYRP2_HUMAN)
SKLWWGFLLV

SEQ ID NO: 195562 - protein, 10 aa, Artificial Sequence
  Description of Artificial Sequence: Synthetic peptide
  Seed: SLSPQEREQF (TYRP2_HUMAN)
SVSPQEREQW

SEQ ID NO: 195563 - protein, 10 aa, Artificial Sequence
  Description of Artificial Sequence: Synthetic peptide
  Seed: FVWLHYYSVR (TYRP2_HUMAN)
FLWLHYYSVR

SEQ ID NO: 195564 - protein, 10 aa, Artificial Sequence
  Description of Artificial Sequence: Synthetic peptide
  Seed: RNSRFSSWET (TYRP2_HUMAN)
RQSRFSSWEA

SEQ ID NO: 195565 - protein, 10 aa, Artificial Sequence
  Description of Artificial Sequence: Synthetic peptide
  Seed: FFPPVTNEEL (TYRP2_HUMAN)
FMPPVTNEEV

SEQ ID NO: 195566 - protein, 10 aa, Artificial Sequence
  Description of Artificial Sequence: Synthetic peptide
  Seed: FFPPVTNEEL (TYRP2_HUMAN)
FWPPVTNEEL

SEQ ID NO: 195567 - protein, 9 aa, Artificial Sequence
  Description of Artificial Sequence: Synthetic peptide
  Seed: SQVMSLHNL (TYRP2_HUMAN)
SSVMSLHNY

SEQ ID NO: 195568 - protein, 10 aa, Artificial Sequence
  Description of Artificial Sequence: Synthetic peptide
  Seed: DAIFDEWMKR (TYRP2_HUMAN)
DWIFDEWMKR

SEQ ID NO: 195569 - protein, 9 aa, Artificial Sequence
  Description of Artificial Sequence: Synthetic peptide
  Seed: NRMYNMVPF (TYRP2_HUMAN)
NFMYNMVPY

SEQ ID NO: 195570 - protein, 9 aa, Artificial Sequence
  Description of Artificial Sequence: Synthetic peptide
  Seed: DFSHQGPAF (TYRP2_HUMAN)
DLSHQGPAF

SEQ ID NO: 195571 - protein, 11 aa, Artificial Sequence
  Description of Artificial Sequence: Synthetic peptide
  Seed: YTPLMETHLSS (TYRP2_HUMAN)
YTPLMETHLSM

SEQ ID NO: 195572 - protein, 10 aa, Artificial Sequence
  Description of Artificial Sequence: Synthetic peptide
  Seed: SDQLGYSYAI (TYRP2_HUMAN)
SHQLGYSYAY

SEQ ID NO: 195573 - protein, 9 aa, Artificial Sequence
  Description of Artificial Sequence: Synthetic peptide
  Seed: VDSLVNKEC (TYRP2_HUMAN)
VESLVNKEP

SEQ ID NO: 195574 - protein, 9 aa, Artificial Sequence
  Description of Artificial Sequence: Synthetic peptide
  Seed: GQFPRVCMT (TYRP2_HUMAN)
GVFPRVCMA

SEQ ID NO: 195575 - protein, 10 aa, Artificial Sequence
  Description of Artificial Sequence: Synthetic peptide
  Seed: RMYNMVPFFP (TYRP2_HUMAN)
RLYNMVPFFI

SEQ ID NO: 195576 - protein, 9 aa, Artificial Sequence
  Description of Artificial Sequence: Synthetic peptide
  Seed: NSMKLPTLK (TYRP2_HUMAN)
NYMKLPTLR

SEQ ID NO: 195577 - protein, 8 aa, Artificial Sequence
  Description of Artificial Sequence: Synthetic peptide
  Seed: SLDDYNHL (TYRP2_HUMAN)
SIDDYNHI

SEQ ID NO: 195578 - protein, 9 aa, Artificial Sequence
  Description of Artificial Sequence: Synthetic peptide
  Seed: RLRKGYTPL (TYRP2_HUMAN)
RVRKGYTPS

SEQ ID NO: 195579 - protein, 10 aa, Artificial Sequence
  Description of Artificial Sequence: Synthetic peptide
  Seed: ELAPIGHNRM (TYRP2_HUMAN)
ELAPIGHNRV

SEQ ID NO: 195580 - protein, 9 aa, Artificial Sequence
  Description of Artificial Sequence: Synthetic peptide
  Seed: FVLLAFLQY (TYRP2_HUMAN)
FPLLAFLQM

SEQ ID NO: 195581 - protein, 9 aa, Artificial Sequence
  Description of Artificial Sequence: Synthetic peptide
  Seed: SQVMSLHNL (TYRP2_HUMAN)
SLVMSLHNA

SEQ ID NO: 195582 - protein, 8 aa, Artificial Sequence
  Description of Artificial Sequence: Synthetic peptide
  Seed: AIDLPVSV (TYRP2_HUMAN)
AVDLPVSL

SEQ ID NO: 195583 - protein, 10 aa, Artificial Sequence
  Description of Artificial Sequence: Synthetic peptide
  Seed: QGPAFVTWHR (TYRP2_HUMAN)
QLPAFVTWHR

SEQ ID NO: 195584 - protein, 9 aa, Artificial Sequence
  Description of Artificial Sequence: Synthetic peptide
  Seed: VVMGTLVAL (TYRP2_HUMAN)
VIMGTLVAT

SEQ ID NO: 195585 - protein, 10 aa, Artificial Sequence
  Description of Artificial Sequence: Synthetic peptide
  Seed: MSPLWWGFLL (TYRP2_HUMAN)
MWPLWWGFLV

SEQ ID NO: 195586 - protein, 9 aa, Artificial Sequence
  Description of Artificial Sequence: Synthetic peptide
  Seed: EGLLRRNQM (TYRP2_HUMAN)
ELLLRRNQM

SEQ ID NO: 195587 - protein, 11 aa, Artificial Sequence
  Description of Artificial Sequence: Synthetic peptide
  Seed: FANCSVYDFFV (TYRP2_HUMAN)
FLNCSVYDFFA

SEQ ID NO: 195588 - protein, 10 aa, Artificial Sequence
  Description of Artificial Sequence: Synthetic peptide
  Seed: MSLHNLVHSF (TYRP2_HUMAN)
MSLHNLVHSM

SEQ ID NO: 195589 - protein, 9 aa, Artificial Sequence
  Description of Artificial Sequence: Synthetic peptide
  Seed: SLDDYNHLV (TYRP2_HUMAN)
STDDYNHLK

SEQ ID NO: 195590 - protein, 10 aa, Artificial Sequence
  Description of Artificial Sequence: Synthetic peptide
  Seed: LGPGRPYRAI (TYRP2_HUMAN)
LCPGRPYRAL

SEQ ID NO: 195591 - protein, 10 aa, Artificial Sequence
  Description of Artificial Sequence: Synthetic peptide
  Seed: RLIGNESFAL (TYRP2_HUMAN)
RLIGNESFAI

SEQ ID NO: 195592 - protein, 10 aa, Artificial Sequence
  Description of Artificial Sequence: Synthetic peptide
  Seed: GNESFALPYW (TYRP2_HUMAN)
GWESFALPYW

SEQ ID NO: 195593 - protein, 10 aa, Artificial Sequence
  Description of Artificial Sequence: Synthetic peptide
  Seed: FQNSTFSFRN (TYRP2_HUMAN)
FLNSTFSFRK

SEQ ID NO: 195594 - protein, 9 aa, Artificial Sequence
  Description of Artificial Sequence: Synthetic peptide
  Seed: VVLHSFTDA (TYRP2_HUMAN)
VLLHSFTDL

SEQ ID NO: 195595 - protein, 9 aa, Artificial Sequence
  Description of Artificial Sequence: Synthetic peptide
  Seed: RLRKGYTPL (TYRP2_HUMAN)
RYRKGYTPT

SEQ ID NO: 195596 - protein, 9 aa, Artificial Sequence
  Description of Artificial Sequence: Synthetic peptide
  Seed: AARPDDPTL (TYRP2_HUMAN)
APRPDDPTI

SEQ ID NO: 195597 - protein, 11 aa, Artificial Sequence
  Description of Artificial Sequence: Synthetic peptide
  Seed: HSLSPQEREQF (TYRP2_HUMAN)
HQLSPQEREQL

SEQ ID NO: 195598 - protein, 10 aa, Artificial Sequence
  Description of Artificial Sequence: Synthetic peptide
  Seed: YDFFVWLHYY (TYRP2_HUMAN)
YMFFVWLHYP

SEQ ID NO: 195599 - protein, 9 aa, Artificial Sequence
  Description of Artificial Sequence: Synthetic peptide
  Seed: VVMGTLVAL (TYRP2_HUMAN)
VVMGTLVAR

SEQ ID NO: 195600 - protein, 9 aa, Artificial Sequence
  Description of Artificial Sequence: Synthetic peptide
  Seed: FVWLHYYSV (TYRP2_HUMAN)
FAWLHYYSA

SEQ ID NO: 195601 - protein, 10 aa, Artificial Sequence
  Description of Artificial Sequence: Synthetic peptide
  Seed: GLFVLLAFLQ (TYRP2_HUMAN)
GLFVLLAFLL

SEQ ID NO: 195602 - protein, 9 aa, Artificial Sequence
  Description of Artificial Sequence: Synthetic peptide
  Seed: VVMGTLVAL (TYRP2_HUMAN)
VPMGTLVAH

SEQ ID NO: 195603 - protein, 11 aa, Artificial Sequence
  Description of Artificial Sequence: Synthetic peptide
  Seed: FFQNSTFSFRN (TYRP2_HUMAN)
FFQNSTFSFRR

SEQ ID NO: 195604 - protein, 8 aa, Artificial Sequence
  Description of Artificial Sequence: Synthetic peptide
  Seed: SLDDYNHL (TYRP2_HUMAN)
STDDYNHV

SEQ ID NO: 195605 - protein, 10 aa, Artificial Sequence
  Description of Artificial Sequence: Synthetic peptide
  Seed: NSTFSFRNAL (TYRP2_HUMAN)
NGTFSFRNAV

SEQ ID NO: 195606 - protein, 11 aa, Artificial Sequence
  Description of Artificial Sequence: Synthetic peptide
  Seed: YNMVPFFPPVT (TYRP2_HUMAN)
YMMVPFFPPVM

SEQ ID NO: 195607 - protein, 10 aa, Artificial Sequence
  Description of Artificial Sequence: Synthetic peptide
  Seed: SDQLGYSYAI (TYRP2_HUMAN)
SQQLGYSYAY

SEQ ID NO: 195608 - protein, 10 aa, Artificial Sequence
  Description of Artificial Sequence: Synthetic peptide
  Seed: SPLWWGFLLS (TYRP2_HUMAN)
SWLWWGFLLA

SEQ ID NO: 195609 - protein, 10 aa, Artificial Sequence
  Description of Artificial Sequence: Synthetic peptide
  Seed: SDQLGYSYAI (TYRP2_HUMAN)
SPQLGYSYAI

SEQ ID NO: 195610 - protein, 9 aa, Artificial Sequence
  Description of Artificial Sequence: Synthetic peptide
  Seed: YAIDLPVSV (TYRP2_HUMAN)
YVIDLPVSM

SEQ ID NO: 195611 - protein, 9 aa, Artificial Sequence
  Description of Artificial Sequence: Synthetic peptide
  Seed: RDCLSLQKF (TYRP2_HUMAN)
RECLSLQKF

SEQ ID NO: 195612 - protein, 9 aa, Artificial Sequence
  Description of Artificial Sequence: Synthetic peptide
  Seed: TQHWLGLLG (TYRP2_HUMAN)
TKHWLGLLM

SEQ ID NO: 195613 - protein, 9 aa, Artificial Sequence
  Description of Artificial Sequence: Synthetic peptide
  Seed: LLRRNQMGR (TYRP2_HUMAN)
LLRRNQMGK

SEQ ID NO: 195614 - protein, 9 aa, Artificial Sequence
  Description of Artificial Sequence: Synthetic peptide
  Seed: RQNIHSLSP (TYRP2_HUMAN)
RMNIHSLSY

SEQ ID NO: 195615 - protein, 10 aa, Artificial Sequence
  Description of Artificial Sequence: Synthetic peptide
  Seed: FFPPVTNEEL (TYRP2_HUMAN)
FIPPVTNEEM

SEQ ID NO: 195616 - protein, 9 aa, Artificial Sequence
  Description of Artificial Sequence: Synthetic peptide
  Seed: DQLGYSYAI (TYRP2_HUMAN)
DALGYSYAV

SEQ ID NO: 195617 - protein, 9 aa, Artificial Sequence
  Description of Artificial Sequence: Synthetic peptide
  Seed: SLHNLVHSF (TYRP2_HUMAN)
SFHNLVHSI

SEQ ID NO: 195618 - protein, 9 aa, Artificial Sequence
  Description of Artificial Sequence: Synthetic peptide
  Seed: YAIDLPVSV (TYRP2_HUMAN)
YFIDLPVSV

SEQ ID NO: 195619 - protein, 9 aa, Artificial Sequence
  Description of Artificial Sequence: Synthetic peptide
  Seed: SRFSSWETV (TYRP2_HUMAN)
SRFSSWETY

SEQ ID NO: 195620 - protein, 9 aa, Artificial Sequence
  Description of Artificial Sequence: Synthetic peptide
  Seed: RNSMKLPTL (TYRP2_HUMAN)
RQSMKLPTM

SEQ ID NO: 195621 - protein, 9 aa, Artificial Sequence
  Description of Artificial Sequence: Synthetic peptide
  Seed: VSVEETPGW (TYRP2_HUMAN)
VSVEETPGM

SEQ ID NO: 195622 - protein, 9 aa, Artificial Sequence
  Description of Artificial Sequence: Synthetic peptide
  Seed: AANDPIFVV (TYRP2_HUMAN)
AVNDPIFVI

SEQ ID NO: 195623 - protein, 10 aa, Artificial Sequence
  Description of Artificial Sequence: Synthetic peptide
  Seed: RLRKGYTPLM (TYRP2_HUMAN)
RFRKGYTPLS

SEQ ID NO: 195624 - protein, 11 aa, Artificial Sequence
  Description of Artificial Sequence: Synthetic peptide
  Seed: RLIGNESFALP (TYRP2_HUMAN)
RLIGNESFALV

SEQ ID NO: 195625 - protein, 11 aa, Artificial Sequence
  Description of Artificial Sequence: Synthetic peptide
  Seed: LPVSVEETPGW (TYRP2_HUMAN)
LIVSVEETPGW

SEQ ID NO: 195626 - protein, 9 aa, Artificial Sequence
  Description of Artificial Sequence: Synthetic peptide
  Seed: DDYNHLVTL (TYRP2_HUMAN)
DVYNHLVTI

SEQ ID NO: 195627 - protein, 9 aa, Artificial Sequence
  Description of Artificial Sequence: Synthetic peptide
  Seed: HYYSVRDTL (TYRP2_HUMAN)
HRYSVRDTL

SEQ ID NO: 195628 - protein, 11 aa, Artificial Sequence
  Description of Artificial Sequence: Synthetic peptide
  Seed: FVLLAFLQYRR (TYRP2_HUMAN)
FTLLAFLQYRK

SEQ ID NO: 195629 - protein, 10 aa, Artificial Sequence
  Description of Artificial Sequence: Synthetic peptide
  Seed: RNSMKLPTLK (TYRP2_HUMAN)
RISMKLPTLK

SEQ ID NO: 195630 - protein, 9 aa, Artificial Sequence
  Description of Artificial Sequence: Synthetic peptide
  Seed: APIGHNRMY (TYRP2_HUMAN)
ATIGHNRMM

SEQ ID NO: 195631 - protein, 8 aa, Artificial Sequence
  Description of Artificial Sequence: Synthetic peptide
  Seed: FSHQGPAF (TYRP2_HUMAN)
FIHQGPAM

SEQ ID NO: 195632 - protein, 9 aa, Artificial Sequence
  Description of Artificial Sequence: Synthetic peptide
  Seed: SLHNLVHSF (TYRP2_HUMAN)
SLHNLVHSV

SEQ ID NO: 195633 - protein, 9 aa, Artificial Sequence
  Description of Artificial Sequence: Synthetic peptide
  Seed: KCTGNFAGY (TYRP2_HUMAN)
KMTGNFAGY

SEQ ID NO: 195634 - protein, 10 aa, Artificial Sequence
  Description of Artificial Sequence: Synthetic peptide
  Seed: SAANDPIFVV (TYRP2_HUMAN)
SMANDPIFVL

SEQ ID NO: 195635 - protein, 10 aa, Artificial Sequence
  Description of Artificial Sequence: Synthetic peptide
  Seed: ELAPIGHNRM (TYRP2_HUMAN)
ESAPIGHNRI

SEQ ID NO: 195636 - protein, 9 aa, Artificial Sequence
  Description of Artificial Sequence: Synthetic peptide
  Seed: TTQHWLGLL (TYRP2_HUMAN)
TSQHWLGLF

SEQ ID NO: 195637 - protein, 9 aa, Artificial Sequence
  Description of Artificial Sequence: Synthetic peptide
  Seed: SQVMSLHNL (TYRP2_HUMAN)
SHVMSLHNL

SEQ ID NO: 195638 - protein, 9 aa, Artificial Sequence
  Description of Artificial Sequence: Synthetic peptide
  Seed: FFPPVTNEE (TYRP2_HUMAN)
FAPPVTNEM

SEQ ID NO: 195639 - protein, 11 aa, Artificial Sequence
  Description of Artificial Sequence: Synthetic peptide
  Seed: TFSFRNALEGF (TYRP2_HUMAN)
TYSFRNALEGF

SEQ ID NO: 195640 - protein, 9 aa, Artificial Sequence
  Description of Artificial Sequence: Synthetic peptide
  Seed: ETPGWPTTL (TYRP2_HUMAN)
ERPGWPTTM

SEQ ID NO: 195641 - protein, 9 aa, Artificial Sequence
  Description of Artificial Sequence: Synthetic peptide
  Seed: ILPGAQGQF (TYRP2_HUMAN)
IGPGAQGQM

SEQ ID NO: 195642 - protein, 9 aa, Artificial Sequence
  Description of Artificial Sequence: Synthetic peptide
  Seed: LHSFTDAIF (TYRP2_HUMAN)
LMSFTDAIF

SEQ ID NO: 195643 - protein, 10 aa, Artificial Sequence
  Description of Artificial Sequence: Synthetic peptide
  Seed: SLQKFDNPPF (TYRP2_HUMAN)
SEQKFDNPPF

SEQ ID NO: 195644 - protein, 10 aa, Artificial Sequence
  Description of Artificial Sequence: Synthetic peptide
  Seed: RPWSGPYILR (TYRP2_HUMAN)
REWSGPYILR

SEQ ID NO: 195645 - protein, 11 aa, Artificial Sequence
  Description of Artificial Sequence: Synthetic peptide
  Seed: YRRLRKGYTPL (TYRP2_HUMAN)
YMRLRKGYTPV

SEQ ID NO: 195646 - protein, 9 aa, Artificial Sequence
  Description of Artificial Sequence: Synthetic peptide
  Seed: VIRQNIHSL (TYRP2_HUMAN)
VFRQNIHSM

SEQ ID NO: 195647 - protein, 10 aa, Artificial Sequence
  Description of Artificial Sequence: Synthetic peptide
  Seed: REQFLGALDL (TYRP2_HUMAN)
RYQFLGALDM

SEQ ID NO: 195648 - protein, 9 aa, Artificial Sequence
  Description of Artificial Sequence: Synthetic peptide
  Seed: RNQDDRELW (TYRP2_HUMAN)
RLQDDRELI

SEQ ID NO: 195649 - protein, 9 aa, Artificial Sequence
  Description of Artificial Sequence: Synthetic peptide
  Seed: ETPGWPTTL (TYRP2_HUMAN)
ELPGWPTTR

SEQ ID NO: 195650 - protein, 11 aa, Artificial Sequence
  Description of Artificial Sequence: Synthetic peptide
  Seed: QPQFANCSVYD (TYRP2_HUMAN)
QHQFANCSVYF

SEQ ID NO: 195651 - protein, 9 aa, Artificial Sequence
  Description of Artificial Sequence: Synthetic peptide
  Seed: VVMGTLVAL (TYRP2_HUMAN)
VAMGTLVAL

SEQ ID NO: 195652 - protein, 11 aa, Artificial Sequence
  Description of Artificial Sequence: Synthetic peptide
  Seed: VCMTVDSLVNK (TYRP2_HUMAN)
VLMTVDSLVNR

SEQ ID NO: 195653 - protein, 10 aa, Artificial Sequence
  Description of Artificial Sequence: Synthetic peptide
  Seed: RNSRFSSWET (TYRP2_HUMAN)
RTSRFSSWEI

SEQ ID NO: 195654 - protein, 9 aa, Artificial Sequence
  Description of Artificial Sequence: Synthetic peptide
  Seed: VVMGTLVAL (TYRP2_HUMAN)
VRMGTLVAM

SEQ ID NO: 195655 - protein, 11 aa, Artificial Sequence
  Description of Artificial Sequence: Synthetic peptide
  Seed: RADTRPWSGPY (TYRP2_HUMAN)
RIDTRPWSGPK

SEQ ID NO: 195656 - protein, 10 aa, Artificial Sequence
  Description of Artificial Sequence: Synthetic peptide
  Seed: METHLSSKRY (TYRP2_HUMAN)
MTTHLSSKRF

SEQ ID NO: 195657 - protein, 10 aa, Artificial Sequence
  Description of Artificial Sequence: Synthetic peptide
  Seed: RVCMTVDSLV (TYRP2_HUMAN)
RLCMTVDSLI

SEQ ID NO: 195658 - protein, 10 aa, Artificial Sequence
  Description of Artificial Sequence: Synthetic peptide
  Seed: TRPWSGPYIL (TYRP2_HUMAN)
TSPWSGPYIF

SEQ ID NO: 195659 - protein, 9 aa, Artificial Sequence
  Description of Artificial Sequence: Synthetic peptide
  Seed: DDYNHLVTL (TYRP2_HUMAN)
DTYNHLVTV

SEQ ID NO: 195660 - protein, 9 aa, Artificial Sequence
  Description of Artificial Sequence: Synthetic peptide
  Seed: YAIDLPVSV (TYRP2_HUMAN)
YMIDLPVSF

SEQ ID NO: 195661 - protein, 10 aa, Artificial Sequence
  Description of Artificial Sequence: Synthetic peptide
  Seed: YSYAIDLPVS (TYRP2_HUMAN)
YMYAIDLPVM

SEQ ID NO: 195662 - protein, 10 aa, Artificial Sequence
  Description of Artificial Sequence: Synthetic peptide
  Seed: SHQGPAFVTW (TYRP2_HUMAN)
SYQGPAFVTY

SEQ ID NO: 195663 - protein, 10 aa, Artificial Sequence
  Description of Artificial Sequence: Synthetic peptide
  Seed: NCSVYDFFVW (TYRP2_HUMAN)
NISVYDFFVW

SEQ ID NO: 195664 - protein, 9 aa, Artificial Sequence
  Description of Artificial Sequence: Synthetic peptide
  Seed: VLHSFTDAI (TYRP2_HUMAN)
VKHSFTDAF

SEQ ID NO: 195665 - protein, 11 aa, Artificial Sequence
  Description of Artificial Sequence: Synthetic peptide
  Seed: FFVWLHYYSVR (TYRP2_HUMAN)
FMVWLHYYSVR

SEQ ID NO: 195666 - protein, 9 aa, Artificial Sequence
  Description of Artificial Sequence: Synthetic peptide
  Seed: RLRKGYTPL (TYRP2_HUMAN)
RYRKGYTPS

SEQ ID NO: 195667 - protein, 9 aa, Artificial Sequence
  Description of Artificial Sequence: Synthetic peptide
  Seed: GLFVLLAFL (TYRP2_HUMAN)
GMFVLLAFR

SEQ ID NO: 195668 - protein, 10 aa, Artificial Sequence
  Description of Artificial Sequence: Synthetic peptide
  Seed: SVRDTLLGPG (TYRP2_HUMAN)
SYRDTLLGPK

SEQ ID NO: 195669 - protein, 10 aa, Artificial Sequence
  Description of Artificial Sequence: Synthetic peptide
  Seed: KRFNPPADAW (TYRP2_HUMAN)
KYFNPPADAY

SEQ ID NO: 195670 - protein, 11 aa, Artificial Sequence
  Description of Artificial Sequence: Synthetic peptide
  Seed: MYNMVPFFPPV (TYRP2_HUMAN)
MVNMVPFFPPV

SEQ ID NO: 195671 - protein, 9 aa, Artificial Sequence
  Description of Artificial Sequence: Synthetic peptide
  Seed: RLRKGYTPL (TYRP2_HUMAN)
RIRKGYTPR

SEQ ID NO: 195672 - protein, 11 aa, Artificial Sequence
  Description of Artificial Sequence: Synthetic peptide
  Seed: SVYDFFVWLHY (TYRP2_HUMAN)
SIYDFFVWLHY

SEQ ID NO: 195673 - protein, 10 aa, Artificial Sequence
  Description of Artificial Sequence: Synthetic peptide
  Seed: GLFVLLAFLQ (TYRP2_HUMAN)
GMFVLLAFLL

SEQ ID NO: 195674 - protein, 10 aa, Artificial Sequence
  Description of Artificial Sequence: Synthetic peptide
  Seed: SVYDFFVWLH (TYRP2_HUMAN)
STYDFFVWLR

SEQ ID NO: 195675 - protein, 9 aa, Artificial Sequence
  Description of Artificial Sequence: Synthetic peptide
  Seed: VTWHRYHLL (TYRP2_HUMAN)
VVWHRYHLL

SEQ ID NO: 195676 - protein, 9 aa, Artificial Sequence
  Description of Artificial Sequence: Synthetic peptide
  Seed: AANDPIFVV (TYRP2_HUMAN)
AQNDPIFVI

SEQ ID NO: 195677 - protein, 9 aa, Artificial Sequence
  Description of Artificial Sequence: Synthetic peptide
  Seed: FSHQGPAFV (TYRP2_HUMAN)
FQHQGPAFI

SEQ ID NO: 195678 - protein, 9 aa, Artificial Sequence
  Description of Artificial Sequence: Synthetic peptide
  Seed: VVMGTLVAL (TYRP2_HUMAN)
VTMGTLVAF

SEQ ID NO: 195679 - protein, 9 aa, Artificial Sequence
  Description of Artificial Sequence: Synthetic peptide
  Seed: SLDDYNHLV (TYRP2_HUMAN)
SRDDYNHLL

SEQ ID NO: 195680 - protein, 8 aa, Artificial Sequence
  Description of Artificial Sequence: Synthetic peptide
  Seed: FQNSTFSF (TYRP2_HUMAN)
FYNSTFSW

SEQ ID NO: 195681 - protein, 11 aa, Artificial Sequence
  Description of Artificial Sequence: Synthetic peptide
  Seed: FSHQGPAFVTW (TYRP2_HUMAN)
FTHQGPAFVTY

SEQ ID NO: 195682 - protein, 11 aa, Artificial Sequence
  Description of Artificial Sequence: Synthetic peptide
  Seed: RADTRPWSGPY (TYRP2_HUMAN)
RQDTRPWSGPY

SEQ ID NO: 195683 - protein, 10 aa, Artificial Sequence
  Description of Artificial Sequence: Synthetic peptide
  Seed: CMTVDSLVNK (TYRP2_HUMAN)
CQTVDSLVNK

SEQ ID NO: 195684 - protein, 9 aa, Artificial Sequence
  Description of Artificial Sequence: Synthetic peptide
  Seed: TLDSQVMSL (TYRP2_HUMAN)
TCDSQVMSM

SEQ ID NO: 195685 - protein, 10 aa, Artificial Sequence
  Description of Artificial Sequence: Synthetic peptide
  Seed: RNSMKLPTLK (TYRP2_HUMAN)
RGSMKLPTLR

SEQ ID NO: 195686 - protein, 9 aa, Artificial Sequence
  Description of Artificial Sequence: Synthetic peptide
  Seed: NMVPFFPPV (TYRP2_HUMAN)
NLVPFFPPY

SEQ ID NO: 195687 - protein, 9 aa, Artificial Sequence
  Description of Artificial Sequence: Synthetic peptide
  Seed: RVHPDYVIT (TYRP2_HUMAN)
RMHPDYVIK

SEQ ID NO: 195688 - protein, 10 aa, Artificial Sequence
  Description of Artificial Sequence: Synthetic peptide
  Seed: YAIDLPVSVE (TYRP2_HUMAN)
YLIDLPVSVK

SEQ ID NO: 195689 - protein, 9 aa, Artificial Sequence
  Description of Artificial Sequence: Synthetic peptide
  Seed: ISRNSRFSS (TYRP2_HUMAN)
IVRNSRFSG

SEQ ID NO: 195690 - protein, 10 aa, Artificial Sequence
  Description of Artificial Sequence: Synthetic peptide
  Seed: FFVWLHYYSV (TYRP2_HUMAN)
FIVWLHYYSV

SEQ ID NO: 195691 - protein, 11 aa, Artificial Sequence
  Description of Artificial Sequence: Synthetic peptide
  Seed: FVVLHSFTDAI (TYRP2_HUMAN)
FEVLHSFTDAI

SEQ ID NO: 195692 - protein, 11 aa, Artificial Sequence
  Description of Artificial Sequence: Synthetic peptide
  Seed: FVVLHSFTDAI (TYRP2_HUMAN)
FGVLHSFTDAV

SEQ ID NO: 195693 - protein, 11 aa, Artificial Sequence
  Description of Artificial Sequence: Synthetic peptide
  Seed: RNSRFSSWETV (TYRP2_HUMAN)
RSSRFSSWETM

SEQ ID NO: 195694 - protein, 10 aa, Artificial Sequence
  Description of Artificial Sequence: Synthetic peptide
  Seed: SPLWWGFLLS (TYRP2_HUMAN)
SELWWGFLLV

SEQ ID NO: 195695 - protein, 11 aa, Artificial Sequence
  Description of Artificial Sequence: Synthetic peptide
  Seed: FVVLHSFTDAI (TYRP2_HUMAN)
FNVLHSFTDAV

SEQ ID NO: 195696 - protein, 10 aa, Artificial Sequence
  Description of Artificial Sequence: Synthetic peptide
  Seed: DPTLISRNSR (TYRP2_HUMAN)
DFTLISRNSR

SEQ ID NO: 195697 - protein, 9 aa, Artificial Sequence
  Description of Artificial Sequence: Synthetic peptide
  Seed: STFSFRNAL (TYRP2_HUMAN)
SQFSFRNAA

SEQ ID NO: 195698 - protein, 10 aa, Artificial Sequence
  Description of Artificial Sequence: Synthetic peptide
  Seed: FFVWLHYYSV (TYRP2_HUMAN)
FMVWLHYYSV

SEQ ID NO: 195699 - protein, 9 aa, Artificial Sequence
  Description of Artificial Sequence: Synthetic peptide
  Seed: STFSFRNAL (TYRP2_HUMAN)
SMFSFRNAH

SEQ ID NO: 195700 - protein, 9 aa, Artificial Sequence
  Description of Artificial Sequence: Synthetic peptide
  Seed: FFQNSTFSF (TYRP2_HUMAN)
FQQNSTFSF

SEQ ID NO: 195701 - protein, 10 aa, Artificial Sequence
  Description of Artificial Sequence: Synthetic peptide
  Seed: MSLHNLVHSF (TYRP2_HUMAN)
MLLHNLVHSF

SEQ ID NO: 195702 - protein, 8 aa, Artificial Sequence
  Description of Artificial Sequence: Synthetic peptide
  Seed: REQFLGAL (TYRP2_HUMAN)
REQFLGAM

SEQ ID NO: 195703 - protein, 11 aa, Artificial Sequence
  Description of Artificial Sequence: Synthetic peptide
  Seed: YSYAIDLPVSV (TYRP2_HUMAN)
YLYAIDLPVSC

SEQ ID NO: 195704 - protein, 9 aa, Artificial Sequence
  Description of Artificial Sequence: Synthetic peptide
  Seed: HQGPAFVTW (TYRP2_HUMAN)
HAGPAFVTH

SEQ ID NO: 195705 - protein, 9 aa, Artificial Sequence
  Description of Artificial Sequence: Synthetic peptide
  Seed: HSAANDPIF (TYRP2_HUMAN)
HMAANDPIW

SEQ ID NO: 195706 - protein, 10 aa, Artificial Sequence
  Description of Artificial Sequence: Synthetic peptide
  Seed: GTLDSQVMSL (TYRP2_HUMAN)
GQLDSQVMSW

SEQ ID NO: 195707 - protein, 11 aa, Artificial Sequence
  Description of Artificial Sequence: Synthetic peptide
  Seed: YRRLRKGYTPL (TYRP2_HUMAN)
YIRLRKGYTPL

SEQ ID NO: 195708 - protein, 9 aa, Artificial Sequence
  Description of Artificial Sequence: Synthetic peptide
  Seed: RPYRAIDFS (TYRP2_HUMAN)
RPYRAIDFA

SEQ ID NO: 195709 - protein, 10 aa, Artificial Sequence
  Description of Artificial Sequence: Synthetic peptide
  Seed: MSPLWWGFLL (TYRP2_HUMAN)
MCPLWWGFLW

SEQ ID NO: 195710 - protein, 9 aa, Artificial Sequence
  Description of Artificial Sequence: Synthetic peptide
  Seed: FLNGTNALP (TYRP2_HUMAN)
FTNGTNALL

SEQ ID NO: 195711 - protein, 9 aa, Artificial Sequence
  Description of Artificial Sequence: Synthetic peptide
  Seed: SLDDYNHLV (TYRP2_HUMAN)
SQDDYNHLI

SEQ ID NO: 195712 - protein, 9 aa, Artificial Sequence
  Description of Artificial Sequence: Synthetic peptide
  Seed: YSYAIDLPV (TYRP2_HUMAN)
YKYAIDLPW

SEQ ID NO: 195713 - protein, 8 aa, Artificial Sequence
  Description of Artificial Sequence: Synthetic peptide
  Seed: RMYNMVPF (TYRP2_HUMAN)
RFYNMVPM

SEQ ID NO: 195714 - protein, 10 aa, Artificial Sequence
  Description of Artificial Sequence: Synthetic peptide
  Seed: QELAPIGHNR (TYRP2_HUMAN)
QWLAPIGHNR

SEQ ID NO: 195715 - protein, 9 aa, Artificial Sequence
  Description of Artificial Sequence: Synthetic peptide
  Seed: SVYDFFVWL (TYRP2_HUMAN)
SAYDFFVWL

SEQ ID NO: 195716 - protein, 10 aa, Artificial Sequence
  Description of Artificial Sequence: Synthetic peptide
  Seed: RLRKGYTPLM (TYRP2_HUMAN)
RSRKGYTPLA

SEQ ID NO: 195717 - protein, 9 aa, Artificial Sequence
  Description of Artificial Sequence: Synthetic peptide
  Seed: ETPGWPTTL (TYRP2_HUMAN)
EIPGWPTTY

SEQ ID NO: 195718 - protein, 8 aa, Artificial Sequence
  Description of Artificial Sequence: Synthetic peptide
  Seed: SLDDYNHL (TYRP2_HUMAN)
SYDDYNHM

SEQ ID NO: 195719 - protein, 10 aa, Artificial Sequence
  Description of Artificial Sequence: Synthetic peptide
  Seed: RNSRFSSWET (TYRP2_HUMAN)
RVSRFSSWES

SEQ ID NO: 195720 - protein, 9 aa, Artificial Sequence
  Description of Artificial Sequence: Synthetic peptide
  Seed: PADAWPQEL (TYRP2_HUMAN)
PSDAWPQEM

SEQ ID NO: 195721 - protein, 9 aa, Artificial Sequence
  Description of Artificial Sequence: Synthetic peptide
  Seed: WMKRFNPPA (TYRP2_HUMAN)
WIKRFNPPK

SEQ ID NO: 195722 - protein, 10 aa, Artificial Sequence
  Description of Artificial Sequence: Synthetic peptide
  Seed: SVYDFFVWLH (TYRP2_HUMAN)
SFYDFFVWLK

SEQ ID NO: 195723 - protein, 9 aa, Artificial Sequence
  Description of Artificial Sequence: Synthetic peptide
  Seed: SFALPYWNF (TYRP2_HUMAN)
SLALPYWNY

SEQ ID NO: 195724 - protein, 11 aa, Artificial Sequence
  Description of Artificial Sequence: Synthetic peptide
  Seed: FANCSVYDFFV (TYRP2_HUMAN)
FLNCSVYDFFV

SEQ ID NO: 195725 - protein, 10 aa, Artificial Sequence
  Description of Artificial Sequence: Synthetic peptide
  Seed: MSPLWWGFLL (TYRP2_HUMAN)
MKPLWWGFLF

SEQ ID NO: 195726 - protein, 9 aa, Artificial Sequence
  Description of Artificial Sequence: Synthetic peptide
  Seed: RKFFHRTCK (TYRP2_HUMAN)
RIFFHRTCR

SEQ ID NO: 195727 - protein, 10 aa, Artificial Sequence
  Description of Artificial Sequence: Synthetic peptide
  Seed: CMTVDSLVNK (TYRP2_HUMAN)
CRTVDSLVNR

SEQ ID NO: 195728 - protein, 9 aa, Artificial Sequence
  Description of Artificial Sequence: Synthetic peptide
  Seed: SLHNLVHSF (TYRP2_HUMAN)
STHNLVHSF

SEQ ID NO: 195729 - protein, 10 aa, Artificial Sequence
  Description of Artificial Sequence: Synthetic peptide
  Seed: RPDDPTLISR (TYRP2_HUMAN)
RSDDPTLISF

SEQ ID NO: 195730 - protein, 10 aa, Artificial Sequence
  Description of Artificial Sequence: Synthetic peptide
  Seed: MGRNSMKLPT (TYRP2_HUMAN)
MYRNSMKLPA

SEQ ID NO: 195731 - protein, 9 aa, Artificial Sequence
  Description of Artificial Sequence: Synthetic peptide
  Seed: SLHNLVHSF (TYRP2_HUMAN)
SIHNLVHSV

SEQ ID NO: 195732 - protein, 10 aa, Artificial Sequence
  Description of Artificial Sequence: Synthetic peptide
  Seed: TVDSLVNKEC (TYRP2_HUMAN)
TSDSLVNKEM

SEQ ID NO: 195733 - protein, 11 aa, Artificial Sequence
  Description of Artificial Sequence: Synthetic peptide
  Seed: FVVLHSFTDAI (TYRP2_HUMAN)
FRVLHSFTDAI

SEQ ID NO: 195734 - protein, 10 aa, Artificial Sequence
  Description of Artificial Sequence: Synthetic peptide
  Seed: FLLSCLGCKI (TYRP2_HUMAN)
FSLSCLGCKL

SEQ ID NO: 195735 - protein, 9 aa, Artificial Sequence
  Description of Artificial Sequence: Synthetic peptide
  Seed: SRNSRFSSW (TYRP2_HUMAN)
SRNSRFSSY

SEQ ID NO: 195736 - protein, 10 aa, Artificial Sequence
  Description of Artificial Sequence: Synthetic peptide
  Seed: SLDDYNHLVT (TYRP2_HUMAN)
SMDDYNHLVF

SEQ ID NO: 195737 - protein, 10 aa, Artificial Sequence
  Description of Artificial Sequence: Synthetic peptide
  Seed: YAIDLPVSVE (TYRP2_HUMAN)
YMIDLPVSVA

SEQ ID NO: 195738 - protein, 10 aa, Artificial Sequence
  Description of Artificial Sequence: Synthetic peptide
  Seed: ELAPIGHNRM (TYRP2_HUMAN)
ETAPIGHNRI

SEQ ID NO: 195739 - protein, 9 aa, Artificial Sequence
  Description of Artificial Sequence: Synthetic peptide
  Seed: YVITTQHWL (TYRP2_HUMAN)
YVITTQHWV

SEQ ID NO: 195740 - protein, 9 aa, Artificial Sequence
  Description of Artificial Sequence: Synthetic peptide
  Seed: LLSCLGCKI (TYRP2_HUMAN)
LLSCLGCKM

SEQ ID NO: 195741 - protein, 9 aa, Artificial Sequence
  Description of Artificial Sequence: Synthetic peptide
  Seed: RPDDPTLIS (TYRP2_HUMAN)
RPDDPTLIL

SEQ ID NO: 195742 - protein, 8 aa, Artificial Sequence
  Description of Artificial Sequence: Synthetic peptide
  Seed: FSHQGPAF (TYRP2_HUMAN)
FFHQGPAM

SEQ ID NO: 195743 - protein, 10 aa, Artificial Sequence
  Description of Artificial Sequence: Synthetic peptide
  Seed: VEETPGWPTT (TYRP2_HUMAN)
VEETPGWPTA

SEQ ID NO: 195744 - protein, 10 aa, Artificial Sequence
  Description of Artificial Sequence: Synthetic peptide
  Seed: RLRKGYTPLM (TYRP2_HUMAN)
RTRKGYTPLN

SEQ ID NO: 195745 - protein, 9 aa, Artificial Sequence
  Description of Artificial Sequence: Synthetic peptide
  Seed: FANCSVYDF (TYRP2_HUMAN)
FKNCSVYDF

SEQ ID NO: 195746 - protein, 10 aa, Artificial Sequence
  Description of Artificial Sequence: Synthetic peptide
  Seed: QELAPIGHNR (TYRP2_HUMAN)
QLLAPIGHNK

SEQ ID NO: 195747 - protein, 9 aa, Artificial Sequence
  Description of Artificial Sequence: Synthetic peptide
  Seed: ILPGAQGQF (TYRP2_HUMAN)
IFPGAQGQL

SEQ ID NO: 195748 - protein, 9 aa, Artificial Sequence
  Description of Artificial Sequence: Synthetic peptide
  Seed: SLHNLVHSF (TYRP2_HUMAN)
SIHNLVHSK

SEQ ID NO: 195749 - protein, 10 aa, Artificial Sequence
  Description of Artificial Sequence: Synthetic peptide
  Seed: FFVWLHYYSV (TYRP2_HUMAN)
FLVWLHYYSV

SEQ ID NO: 195750 - protein, 10 aa, Artificial Sequence
  Description of Artificial Sequence: Synthetic peptide
  Seed: TQPQFANCSV (TYRP2_HUMAN)
TCPQFANCSL

SEQ ID NO: 195751 - protein, 9 aa, Artificial Sequence
  Description of Artificial Sequence: Synthetic peptide
  Seed: TLDSQVMSL (TYRP2_HUMAN)
TSDSQVMSA

SEQ ID NO: 195752 - protein, 9 aa, Artificial Sequence
  Description of Artificial Sequence: Synthetic peptide
  Seed: ETPGWPTTL (TYRP2_HUMAN)
ETPGWPTTV

SEQ ID NO: 195753 - protein, 9 aa, Artificial Sequence
  Description of Artificial Sequence: Synthetic peptide
  Seed: LHNLVHSFL (TYRP2_HUMAN)
LQNLVHSFY

SEQ ID NO: 195754 - protein, 10 aa, Artificial Sequence
  Description of Artificial Sequence: Synthetic peptide
  Seed: RTCKCTGNFA (TYRP2_HUMAN)
RICKCTGNFK

SEQ ID NO: 195755 - protein, 9 aa, Artificial Sequence
  Description of Artificial Sequence: Synthetic peptide
  Seed: GTNALPHSA (TYRP2_HUMAN)
GVNALPHSI

SEQ ID NO: 195756 - protein, 9 aa, Artificial Sequence
  Description of Artificial Sequence: Synthetic peptide
  Seed: NRMYNMVPF (TYRP2_HUMAN)
NEMYNMVPF

SEQ ID NO: 195757 - protein, 10 aa, Artificial Sequence
  Description of Artificial Sequence: Synthetic peptide
  Seed: NSRFSSWETV (TYRP2_HUMAN)
NRRFSSWETL

SEQ ID NO: 195758 - protein, 11 aa, Artificial Sequence
  Description of Artificial Sequence: Synthetic peptide
  Seed: RNSRFSSWETV (TYRP2_HUMAN)
RCSRFSSWETF

SEQ ID NO: 195759 - protein, 10 aa, Artificial Sequence
  Description of Artificial Sequence: Synthetic peptide
  Seed: RPWSGPYILR (TYRP2_HUMAN)
RYWSGPYILR

SEQ ID NO: 195760 - protein, 11 aa, Artificial Sequence
  Description of Artificial Sequence: Synthetic peptide
  Seed: LPVSVEETPGW (TYRP2_HUMAN)
LPVSVEETPGY

SEQ ID NO: 195761 - protein, 9 aa, Artificial Sequence
  Description of Artificial Sequence: Synthetic peptide
  Seed: SDQLGYSYA (TYRP2_HUMAN)
SEQLGYSYA

SEQ ID NO: 195762 - protein, 10 aa, Artificial Sequence
  Description of Artificial Sequence: Synthetic peptide
  Seed: IDFSHQGPAF (TYRP2_HUMAN)
IFFSHQGPAY

SEQ ID NO: 195763 - protein, 10 aa, Artificial Sequence
  Description of Artificial Sequence: Synthetic peptide
  Seed: YSYAIDLPVS (TYRP2_HUMAN)
YQYAIDLPVF

SEQ ID NO: 195764 - protein, 10 aa, Artificial Sequence
  Description of Artificial Sequence: Synthetic peptide
  Seed: TLLGPGRPYR (TYRP2_HUMAN)
TTLGPGRPYK

SEQ ID NO: 195765 - protein, 9 aa, Artificial Sequence
  Description of Artificial Sequence: Synthetic peptide
  Seed: TLDSQVMSL (TYRP2_HUMAN)
TYDSQVMSA

SEQ ID NO: 195766 - protein, 10 aa, Artificial Sequence
  Description of Artificial Sequence: Synthetic peptide
  Seed: NSTFSFRNAL (TYRP2_HUMAN)
NLTFSFRNAL

SEQ ID NO: 195767 - protein, 10 aa, Artificial Sequence
  Description of Artificial Sequence: Synthetic peptide
  Seed: AARPDDPTLI (TYRP2_HUMAN)
AARPDDPTLM

SEQ ID NO: 195768 - protein, 9 aa, Artificial Sequence
  Description of Artificial Sequence: Synthetic peptide
  Seed: VIRQNIHSL (TYRP2_HUMAN)
VYRQNIHSV

SEQ ID NO: 195769 - protein, 9 aa, Artificial Sequence
  Description of Artificial Sequence: Synthetic peptide
  Seed: SVYDFFVWL (TYRP2_HUMAN)
STYDFFVWY

SEQ ID NO: 195770 - protein, 9 aa, Artificial Sequence
  Description of Artificial Sequence: Synthetic peptide
  Seed: RLRKGYTPL (TYRP2_HUMAN)
RQRKGYTPA

SEQ ID NO: 195771 - protein, 10 aa, Artificial Sequence
  Description of Artificial Sequence: Synthetic peptide
  Seed: HSFLNGTNAL (TYRP2_HUMAN)
HFFLNGTNAF

SEQ ID NO: 195772 - protein, 9 aa, Artificial Sequence
  Description of Artificial Sequence: Synthetic peptide
  Seed: RKFFHRTCK (TYRP2_HUMAN)
RVFFHRTCS

SEQ ID NO: 195773 - protein, 9 aa, Artificial Sequence
  Description of Artificial Sequence: Synthetic peptide
  Seed: NGTYEGLLR (TYRP2_HUMAN)
NVTYEGLLK

SEQ ID NO: 195774 - protein, 10 aa, Artificial Sequence
  Description of Artificial Sequence: Synthetic peptide
  Seed: AANDPIFVVL (TYRP2_HUMAN)
ATNDPIFVVV

SEQ ID NO: 195775 - protein, 10 aa, Artificial Sequence
  Description of Artificial Sequence: Synthetic peptide
  Seed: IDFSHQGPAF (TYRP2_HUMAN)
ISFSHQGPAF

SEQ ID NO: 195776 - protein, 10 aa, Artificial Sequence
  Description of Artificial Sequence: Synthetic peptide
  Seed: FPPVTNEELF (TYRP2_HUMAN)
FYPVTNEELF

SEQ ID NO: 195777 - protein, 11 aa, Artificial Sequence
  Description of Artificial Sequence: Synthetic peptide
  Seed: MSLHNLVHSFL (TYRP2_HUMAN)
MTLHNLVHSFF

SEQ ID NO: 195778 - protein, 9 aa, Artificial Sequence
  Description of Artificial Sequence: Synthetic peptide
  Seed: NMVPFFPPV (TYRP2_HUMAN)
NQVPFFPPM

SEQ ID NO: 195779 - protein, 11 aa, Artificial Sequence
  Description of Artificial Sequence: Synthetic peptide
  Seed: QRLIGNESFAL (TYRP2_HUMAN)
QYLIGNESFAV

SEQ ID NO: 195780 - protein, 9 aa, Artificial Sequence
  Description of Artificial Sequence: Synthetic peptide
  Seed: HQGPAFVTW (TYRP2_HUMAN)
HNGPAFVTY

SEQ ID NO: 195781 - protein, 9 aa, Artificial Sequence
  Description of Artificial Sequence: Synthetic peptide
  Seed: NSMKLPTLK (TYRP2_HUMAN)
NAMKLPTLF

SEQ ID NO: 195782 - protein, 11 aa, Artificial Sequence
  Description of Artificial Sequence: Synthetic peptide
  Seed: MYNMVPFFPPV (TYRP2_HUMAN)
MNNMVPFFPPV

SEQ ID NO: 195783 - protein, 10 aa, Artificial Sequence
  Description of Artificial Sequence: Synthetic peptide
  Seed: HNRMYNMVPF (TYRP2_HUMAN)
HNRMYNMVPY

SEQ ID NO: 195784 - protein, 9 aa, Artificial Sequence
  Description of Artificial Sequence: Synthetic peptide
  Seed: NGTYEGLLR (TYRP2_HUMAN)
NATYEGLLR

SEQ ID NO: 195785 - protein, 10 aa, Artificial Sequence
  Description of Artificial Sequence: Synthetic peptide
  Seed: SLHNLVHSFL (TYRP2_HUMAN)
SLHNLVHSFA

SEQ ID NO: 195786 - protein, 9 aa, Artificial Sequence
  Description of Artificial Sequence: Synthetic peptide
  Seed: SLHNLVHSF (TYRP2_HUMAN)
SWHNLVHSY

SEQ ID NO: 195787 - protein, 9 aa, Artificial Sequence
  Description of Artificial Sequence: Synthetic peptide
  Seed: ETPGWPTTL (TYRP2_HUMAN)
ETPGWPTTR

SEQ ID NO: 195788 - protein, 10 aa, Artificial Sequence
  Description of Artificial Sequence: Synthetic peptide
  Seed: RLRKGYTPLM (TYRP2_HUMAN)
RNRKGYTPLA

SEQ ID NO: 195789 - protein, 9 aa, Artificial Sequence
  Description of Artificial Sequence: Synthetic peptide
  Seed: STFSFRNAL (TYRP2_HUMAN)
SQFSFRNAL

SEQ ID NO: 195790 - protein, 10 aa, Artificial Sequence
  Description of Artificial Sequence: Synthetic peptide
  Seed: SLQKFDNPPF (TYRP2_HUMAN)
SWQKFDNPPF

SEQ ID NO: 195791 - protein, 10 aa, Artificial Sequence
  Description of Artificial Sequence: Synthetic peptide
  Seed: SVYDFFVWLH (TYRP2_HUMAN)
SHYDFFVWLY

SEQ ID NO: 195792 - protein, 9 aa, Artificial Sequence
  Description of Artificial Sequence: Synthetic peptide
  Seed: RLRKGYTPL (TYRP2_HUMAN)
RLRKGYTPK

SEQ ID NO: 195793 - protein, 10 aa, Artificial Sequence
  Description of Artificial Sequence: Synthetic peptide
  Seed: LPHSAANDPI (TYRP2_HUMAN)
LPHSAANDPM

SEQ ID NO: 195794 - protein, 9 aa, Artificial Sequence
  Description of Artificial Sequence: Synthetic peptide
  Seed: VTWHRYHLL (TYRP2_HUMAN)
VAWHRYHLY

SEQ ID NO: 195795 - protein, 10 aa, Artificial Sequence
  Description of Artificial Sequence: Synthetic peptide
  Seed: SLQKFDNPPF (TYRP2_HUMAN)
SSQKFDNPPY

SEQ ID NO: 195796 - protein, 9 aa, Artificial Sequence
  Description of Artificial Sequence: Synthetic peptide
  Seed: WMKRFNPPA (TYRP2_HUMAN)
WQKRFNPPI

SEQ ID NO: 195797 - protein, 9 aa, Artificial Sequence
  Description of Artificial Sequence: Synthetic peptide
  Seed: TLVALVGLF (TYRP2_HUMAN)
TAVALVGLY

SEQ ID NO: 195798 - protein, 9 aa, Artificial Sequence
  Description of Artificial Sequence: Synthetic peptide
  Seed: FPPVTNEEL (TYRP2_HUMAN)
FMPVTNEEF

SEQ ID NO: 195799 - protein, 9 aa, Artificial Sequence
  Description of Artificial Sequence: Synthetic peptide
  Seed: YTPLMETHL (TYRP2_HUMAN)
YLPLMETHI

SEQ ID NO: 195800 - protein, 9 aa, Artificial Sequence
  Description of Artificial Sequence: Synthetic peptide
  Seed: WMKRFNPPA (TYRP2_HUMAN)
WTKRFNPPK

SEQ ID NO: 195801 - protein, 9 aa, Artificial Sequence
  Description of Artificial Sequence: Synthetic peptide
  Seed: YAIDLPVSV (TYRP2_HUMAN)
YHIDLPVSF

SEQ ID NO: 195802 - protein, 9 aa, Artificial Sequence
  Description of Artificial Sequence: Synthetic peptide
  Seed: VVMGTLVAL (TYRP2_HUMAN)
VIMGTLVAV

SEQ ID NO: 195803 - protein, 10 aa, Artificial Sequence
  Description of Artificial Sequence: Synthetic peptide
  Seed: LVVMGTLVAL (TYRP2_HUMAN)
LFVMGTLVAL

SEQ ID NO: 195804 - protein, 9 aa, Artificial Sequence
  Description of Artificial Sequence: Synthetic peptide
  Seed: LLAFLQYRR (TYRP2_HUMAN)
LYAFLQYRK

SEQ ID NO: 195805 - protein, 9 aa, Artificial Sequence
  Description of Artificial Sequence: Synthetic peptide
  Seed: NALEGFDKA (TYRP2_HUMAN)
NALEGFDKL

SEQ ID NO: 195806 - protein, 9 aa, Artificial Sequence
  Description of Artificial Sequence: Synthetic peptide
  Seed: AWPQELAPI (TYRP2_HUMAN)
AYPQELAPF

SEQ ID NO: 195807 - protein, 9 aa, Artificial Sequence
  Description of Artificial Sequence: Synthetic peptide
  Seed: YAIDLPVSV (TYRP2_HUMAN)
YCIDLPVSV

SEQ ID NO: 195808 - protein, 9 aa, Artificial Sequence
  Description of Artificial Sequence: Synthetic peptide
  Seed: AANDPIFVV (TYRP2_HUMAN)
ATNDPIFVV

SEQ ID NO: 195809 - protein, 9 aa, Artificial Sequence
  Description of Artificial Sequence: Synthetic peptide
  Seed: DQLGYSYAI (TYRP2_HUMAN)
DTLGYSYAL

SEQ ID NO: 195810 - protein, 9 aa, Artificial Sequence
  Description of Artificial Sequence: Synthetic peptide
  Seed: FQNSTFSFR (TYRP2_HUMAN)
FLNSTFSFR

SEQ ID NO: 195811 - protein, 10 aa, Artificial Sequence
  Description of Artificial Sequence: Synthetic peptide
  Seed: RNQMGRNSMK (TYRP2_HUMAN)
RHQMGRNSMR

SEQ ID NO: 195812 - protein, 10 aa, Artificial Sequence
  Description of Artificial Sequence: Synthetic peptide
  Seed: VLHSFTDAIF (TYRP2_HUMAN)
VLHSFTDAIY

SEQ ID NO: 195813 - protein, 9 aa, Artificial Sequence
  Description of Artificial Sequence: Synthetic peptide
  Seed: LVGLFVLLA (TYRP2_HUMAN)
LLGLFVLLI

SEQ ID NO: 195814 - protein, 10 aa, Artificial Sequence
  Description of Artificial Sequence: Synthetic peptide
  Seed: RRLRKGYTPL (TYRP2_HUMAN)
RQLRKGYTPY

SEQ ID NO: 195815 - protein, 9 aa, Artificial Sequence
  Description of Artificial Sequence: Synthetic peptide
  Seed: MSPLWWGFL (TYRP2_HUMAN)
MSPLWWGFV

SEQ ID NO: 195816 - protein, 9 aa, Artificial Sequence
  Description of Artificial Sequence: Synthetic peptide
  Seed: YSYAIDLPV (TYRP2_HUMAN)
YLYAIDLPH

SEQ ID NO: 195817 - protein, 10 aa, Artificial Sequence
  Description of Artificial Sequence: Synthetic peptide
  Seed: SSWETVCDSL (TYRP2_HUMAN)
SMWETVCDSA

SEQ ID NO: 195818 - protein, 9 aa, Artificial Sequence
  Description of Artificial Sequence: Synthetic peptide
  Seed: ANDPIFVVL (TYRP2_HUMAN)
AFDPIFVVV

SEQ ID NO: 195819 - protein, 10 aa, Artificial Sequence
  Description of Artificial Sequence: Synthetic peptide
  Seed: QPQFANCSVY (TYRP2_HUMAN)
QNQFANCSVM

SEQ ID NO: 195820 - protein, 10 aa, Artificial Sequence
  Description of Artificial Sequence: Synthetic peptide
  Seed: DPTLISRNSR (TYRP2_HUMAN)
DTTLISRNSR

SEQ ID NO: 195821 - protein, 9 aa, Artificial Sequence
  Description of Artificial Sequence: Synthetic peptide
  Seed: AIFDEWMKR (TYRP2_HUMAN)
AMFDEWMKF

SEQ ID NO: 195822 - protein, 9 aa, Artificial Sequence
  Description of Artificial Sequence: Synthetic peptide
  Seed: RKFFHRTCK (TYRP2_HUMAN)
RRFFHRTCI

SEQ ID NO: 195823 - protein, 9 aa, Artificial Sequence
  Description of Artificial Sequence: Synthetic peptide
  Seed: MTVDSLVNK (TYRP2_HUMAN)
MAVDSLVNY

SEQ ID NO: 195824 - protein, 10 aa, Artificial Sequence
  Description of Artificial Sequence: Synthetic peptide
  Seed: GPAFVTWHRY (TYRP2_HUMAN)
GWAFVTWHRY

SEQ ID NO: 195825 - protein, 9 aa, Artificial Sequence
  Description of Artificial Sequence: Synthetic peptide
  Seed: RKFFHRTCK (TYRP2_HUMAN)
RRFFHRTCL

SEQ ID NO: 195826 - protein, 9 aa, Artificial Sequence
  Description of Artificial Sequence: Synthetic peptide
  Seed: HSAANDPIF (TYRP2_HUMAN)
HQAANDPIL

SEQ ID NO: 195827 - protein, 10 aa, Artificial Sequence
  Description of Artificial Sequence: Synthetic peptide
  Seed: VVLHSFTDAI (TYRP2_HUMAN)
VFLHSFTDAI

SEQ ID NO: 195828 - protein, 9 aa, Artificial Sequence
  Description of Artificial Sequence: Synthetic peptide
  Seed: SPLWWGFLL (TYRP2_HUMAN)
SVLWWGFLV

SEQ ID NO: 195829 - protein, 9 aa, Artificial Sequence
  Description of Artificial Sequence: Synthetic peptide
  Seed: WMKRFNPPA (TYRP2_HUMAN)
WRKRFNPPY

SEQ ID NO: 195830 - protein, 9 aa, Artificial Sequence
  Description of Artificial Sequence: Synthetic peptide
  Seed: MTVDSLVNK (TYRP2_HUMAN)
MSVDSLVNR

SEQ ID NO: 195831 - protein, 11 aa, Artificial Sequence
  Description of Artificial Sequence: Synthetic peptide
  Seed: FSHQGPAFVTW (TYRP2_HUMAN)
FAHQGPAFVTF

SEQ ID NO: 195832 - protein, 11 aa, Artificial Sequence
  Description of Artificial Sequence: Synthetic peptide
  Seed: RNSRFSSWETV (TYRP2_HUMAN)
RASRFSSWETV

SEQ ID NO: 195833 - protein, 10 aa, Artificial Sequence
  Description of Artificial Sequence: Synthetic peptide
  Seed: YDFFVWLHYY (TYRP2_HUMAN)
YLFFVWLHYY

SEQ ID NO: 195834 - protein, 9 aa, Artificial Sequence
  Description of Artificial Sequence: Synthetic peptide
  Seed: FFQNSTFSF (TYRP2_HUMAN)
FVQNSTFSM

SEQ ID NO: 195835 - protein, 10 aa, Artificial Sequence
  Description of Artificial Sequence: Synthetic peptide
  Seed: REQFLGALDL (TYRP2_HUMAN)
RTQFLGALDY

SEQ ID NO: 195836 - protein, 9 aa, Artificial Sequence
  Description of Artificial Sequence: Synthetic peptide
  Seed: TLISRNSRF (TYRP2_HUMAN)
TQISRNSRY

SEQ ID NO: 195837 - protein, 9 aa, Artificial Sequence
  Description of Artificial Sequence: Synthetic peptide
  Seed: VMSLHNLVH (TYRP2_HUMAN)
VNSLHNLVF

SEQ ID NO: 195838 - protein, 9 aa, Artificial Sequence
  Description of Artificial Sequence: Synthetic peptide
  Seed: MSPLWWGFL (TYRP2_HUMAN)
MIPLWWGFV

SEQ ID NO: 195839 - protein, 9 aa, Artificial Sequence
  Description of Artificial Sequence: Synthetic peptide
  Seed: SQVMSLHNL (TYRP2_HUMAN)
SLVMSLHNI

SEQ ID NO: 195840 - protein, 9 aa, Artificial Sequence
  Description of Artificial Sequence: Synthetic peptide
  Seed: VVMGTLVAL (TYRP2_HUMAN)
VVMGTLVAA

SEQ ID NO: 195841 - protein, 9 aa, Artificial Sequence
  Description of Artificial Sequence: Synthetic peptide
  Seed: ECDVCTDQL (TYRP2_HUMAN)
EFDVCTDQF

SEQ ID NO: 195842 - protein, 10 aa, Artificial Sequence
  Description of Artificial Sequence: Synthetic peptide
  Seed: WPTTLLVVMG (TYRP2_HUMAN)
WPTTLLVVMF

SEQ ID NO: 195843 - protein, 9 aa, Artificial Sequence
  Description of Artificial Sequence: Synthetic peptide
  Seed: VHPDYVITT (TYRP2_HUMAN)
VKPDYVITL

SEQ ID NO: 195844 - protein, 11 aa, Artificial Sequence
  Description of Artificial Sequence: Synthetic peptide
  Seed: ELAPIGHNRMY (TYRP2_HUMAN)
EVAPIGHNRMK

SEQ ID NO: 195845 - protein, 9 aa, Artificial Sequence
  Description of Artificial Sequence: Synthetic peptide
  Seed: TLDSQVMSL (TYRP2_HUMAN)
TMDSQVMSC

SEQ ID NO: 195846 - protein, 11 aa, Artificial Sequence
  Description of Artificial Sequence: Synthetic peptide
  Seed: YTPLMETHLSS (TYRP2_HUMAN)
YLPLMETHLST

SEQ ID NO: 195847 - protein, 10 aa, Artificial Sequence
  Description of Artificial Sequence: Synthetic peptide
  Seed: LHYYSVRDTL (TYRP2_HUMAN)
LFYYSVRDTM

SEQ ID NO: 195848 - protein, 9 aa, Artificial Sequence
  Description of Artificial Sequence: Synthetic peptide
  Seed: VMGTLVALV (TYRP2_HUMAN)
VAGTLVALV

SEQ ID NO: 195849 - protein, 9 aa, Artificial Sequence
  Description of Artificial Sequence: Synthetic peptide
  Seed: YSYAIDLPV (TYRP2_HUMAN)
YQYAIDLPN

SEQ ID NO: 195850 - protein, 9 aa, Artificial Sequence
  Description of Artificial Sequence: Synthetic peptide
  Seed: YSYAIDLPV (TYRP2_HUMAN)
YGYAIDLPY

SEQ ID NO: 195851 - protein, 9 aa, Artificial Sequence
  Description of Artificial Sequence: Synthetic peptide
  Seed: ETPGWPTTL (TYRP2_HUMAN)
EYPGWPTTI

SEQ ID NO: 195852 - protein, 10 aa, Artificial Sequence
  Description of Artificial Sequence: Synthetic peptide
  Seed: AIFDEWMKRF (TYRP2_HUMAN)
AQFDEWMKRI

SEQ ID NO: 195853 - protein, 11 aa, Artificial Sequence
  Description of Artificial Sequence: Synthetic peptide
  Seed: RNSRFSSWETV (TYRP2_HUMAN)
RHSRFSSWETV

SEQ ID NO: 195854 - protein, 9 aa, Artificial Sequence
  Description of Artificial Sequence: Synthetic peptide
  Seed: SAANDPIFV (TYRP2_HUMAN)
SLANDPIFI

SEQ ID NO: 195855 - protein, 9 aa, Artificial Sequence
  Description of Artificial Sequence: Synthetic peptide
  Seed: SLHNLVHSF (TYRP2_HUMAN)
SMHNLVHSA

SEQ ID NO: 195856 - protein, 9 aa, Artificial Sequence
  Description of Artificial Sequence: Synthetic peptide
  Seed: SPQEREQFL (TYRP2_HUMAN)
SVQEREQFL

SEQ ID NO: 195857 - protein, 10 aa, Artificial Sequence
  Description of Artificial Sequence: Synthetic peptide
  Seed: FFPPVTNEEL (TYRP2_HUMAN)
FFPPVTNEEM

SEQ ID NO: 195858 - protein, 9 aa, Artificial Sequence
  Description of Artificial Sequence: Synthetic peptide
  Seed: RMYNMVPFF (TYRP2_HUMAN)
RNYNMVPFK

SEQ ID NO: 195859 - protein, 10 aa, Artificial Sequence
  Description of Artificial Sequence: Synthetic peptide
  Seed: VVLHSFTDAI (TYRP2_HUMAN)
VRLHSFTDAV

SEQ ID NO: 195860 - protein, 10 aa, Artificial Sequence
  Description of Artificial Sequence: Synthetic peptide
  Seed: GLFVLLAFLQ (TYRP2_HUMAN)
GLFVLLAFLI

SEQ ID NO: 195861 - protein, 9 aa, Artificial Sequence
  Description of Artificial Sequence: Synthetic peptide
  Seed: TLLGPGRPY (TYRP2_HUMAN)
TALGPGRPY

SEQ ID NO: 195862 - protein, 9 aa, Artificial Sequence
  Description of Artificial Sequence: Synthetic peptide
  Seed: RKFFHRTCK (TYRP2_HUMAN)
RMFFHRTCG

SEQ ID NO: 195863 - protein, 11 aa, Artificial Sequence
  Description of Artificial Sequence: Synthetic peptide
  Seed: TQPQFANCSVY (TYRP2_HUMAN)
TDPQFANCSVF

SEQ ID NO: 195864 - protein, 10 aa, Artificial Sequence
  Description of Artificial Sequence: Synthetic peptide
  Seed: AIFDEWMKRF (TYRP2_HUMAN)
AQFDEWMKRF

SEQ ID NO: 195865 - protein, 9 aa, Artificial Sequence
  Description of Artificial Sequence: Synthetic peptide
  Seed: RMYNMVPFF (TYRP2_HUMAN)
RAYNMVPFR

SEQ ID NO: 195866 - protein, 10 aa, Artificial Sequence
  Description of Artificial Sequence: Synthetic peptide
  Seed: CCPRLGAESA (TYRP2_HUMAN)
CSPRLGAESL

SEQ ID NO: 195867 - protein, 10 aa, Artificial Sequence
  Description of Artificial Sequence: Synthetic peptide
  Seed: MSPLWWGFLL (TYRP2_HUMAN)
MPPLWWGFLW

SEQ ID NO: 195868 - protein, 10 aa, Artificial Sequence
  Description of Artificial Sequence: Synthetic peptide
  Seed: YNMVPFFPPV (TYRP2_HUMAN)
YYMVPFFPPL

SEQ ID NO: 195869 - protein, 10 aa, Artificial Sequence
  Description of Artificial Sequence: Synthetic peptide
  Seed: FFVWLHYYSV (TYRP2_HUMAN)
FQVWLHYYSA

SEQ ID NO: 195870 - protein, 10 aa, Artificial Sequence
  Description of Artificial Sequence: Synthetic peptide
  Seed: RELWPRKFFH (TYRP2_HUMAN)
RYLWPRKFFK

SEQ ID NO: 195871 - protein, 10 aa, Artificial Sequence
  Description of Artificial Sequence: Synthetic peptide
  Seed: NGTYEGLLRR (TYRP2_HUMAN)
NMTYEGLLRK

SEQ ID NO: 195872 - protein, 11 aa, Artificial Sequence
  Description of Artificial Sequence: Synthetic peptide
  Seed: YTPLMETHLSS (TYRP2_HUMAN)
YAPLMETHLSL

SEQ ID NO: 195873 - protein, 9 aa, Artificial Sequence
  Description of Artificial Sequence: Synthetic peptide
  Seed: VTWHRYHLL (TYRP2_HUMAN)
VYWHRYHLV

SEQ ID NO: 195874 - protein, 10 aa, Artificial Sequence
  Description of Artificial Sequence: Synthetic peptide
  Seed: FVWLHYYSVR (TYRP2_HUMAN)
FMWLHYYSVA

SEQ ID NO: 195875 - protein, 10 aa, Artificial Sequence
  Description of Artificial Sequence: Synthetic peptide
  Seed: KRFNPPADAW (TYRP2_HUMAN)
KSFNPPADAW

SEQ ID NO: 195876 - protein, 9 aa, Artificial Sequence
  Description of Artificial Sequence: Synthetic peptide
  Seed: VVMGTLVAL (TYRP2_HUMAN)
VAMGTLVAM

SEQ ID NO: 195877 - protein, 10 aa, Artificial Sequence
  Description of Artificial Sequence: Synthetic peptide
  Seed: TVDSLVNKEC (TYRP2_HUMAN)
TIDSLVNKEM

SEQ ID NO: 195878 - protein, 11 aa, Artificial Sequence
  Description of Artificial Sequence: Synthetic peptide
  Seed: RELWPRKFFHR (TYRP2_HUMAN)
RMLWPRKFFHK

SEQ ID NO: 195879 - protein, 10 aa, Artificial Sequence
  Description of Artificial Sequence: Synthetic peptide
  Seed: RLRKGYTPLM (TYRP2_HUMAN)
RPRKGYTPLS

SEQ ID NO: 195880 - protein, 10 aa, Artificial Sequence
  Description of Artificial Sequence: Synthetic peptide
  Seed: IGNESFALPY (TYRP2_HUMAN)
IHNESFALPF

SEQ ID NO: 195881 - protein, 10 aa, Artificial Sequence
  Description of Artificial Sequence: Synthetic peptide
  Seed: SLVNKECCPR (TYRP2_HUMAN)
STVNKECCPR

SEQ ID NO: 195882 - protein, 9 aa, Artificial Sequence
  Description of Artificial Sequence: Synthetic peptide
  Seed: RLRKGYTPL (TYRP2_HUMAN)
RPRKGYTPP

SEQ ID NO: 195883 - protein, 10 aa, Artificial Sequence
  Description of Artificial Sequence: Synthetic peptide
  Seed: MGRNSMKLPT (TYRP2_HUMAN)
MSRNSMKLPM

SEQ ID NO: 195884 - protein, 9 aa, Artificial Sequence
  Description of Artificial Sequence: Synthetic peptide
  Seed: WMKRFNPPA (TYRP2_HUMAN)
WGKRFNPPK

SEQ ID NO: 195885 - protein, 10 aa, Artificial Sequence
  Description of Artificial Sequence: Synthetic peptide
  Seed: MSPLWWGFLL (TYRP2_HUMAN)
MGPLWWGFLF

SEQ ID NO: 195886 - protein, 9 aa, Artificial Sequence
  Description of Artificial Sequence: Synthetic peptide
  Seed: IFDEWMKRF (TYRP2_HUMAN)
IGDEWMKRI

SEQ ID NO: 195887 - protein, 8 aa, Artificial Sequence
  Description of Artificial Sequence: Synthetic peptide
  Seed: QKFDNPPF (TYRP2_HUMAN)
QMFDNPPF

SEQ ID NO: 195888 - protein, 9 aa, Artificial Sequence
  Description of Artificial Sequence: Synthetic peptide
  Seed: VLHSFTDAI (TYRP2_HUMAN)
VVHSFTDAF

SEQ ID NO: 195889 - protein, 10 aa, Artificial Sequence
  Description of Artificial Sequence: Synthetic peptide
  Seed: NGTYEGLLRR (TYRP2_HUMAN)
NQTYEGLLRK

SEQ ID NO: 195890 - protein, 11 aa, Artificial Sequence
  Description of Artificial Sequence: Synthetic peptide
  Seed: RNSRFSSWETV (TYRP2_HUMAN)
RASRFSSWETL

SEQ ID NO: 195891 - protein, 10 aa, Artificial Sequence
  Description of Artificial Sequence: Synthetic peptide
  Seed: VGLFVLLAFL (TYRP2_HUMAN)
VGLFVLLAFV

SEQ ID NO: 195892 - protein, 8 aa, Artificial Sequence
  Description of Artificial Sequence: Synthetic peptide
  Seed: FSHQGPAF (TYRP2_HUMAN)
FVHQGPAL

SEQ ID NO: 195893 - protein, 10 aa, Artificial Sequence
  Description of Artificial Sequence: Synthetic peptide
  Seed: RMYNMVPFFP (TYRP2_HUMAN)
RIYNMVPFFA

SEQ ID NO: 195894 - protein, 9 aa, Artificial Sequence
  Description of Artificial Sequence: Synthetic peptide
  Seed: VWLHYYSVR (TYRP2_HUMAN)
VVLHYYSVR

SEQ ID NO: 195895 - protein, 9 aa, Artificial Sequence
  Description of Artificial Sequence: Synthetic peptide
  Seed: YAIDLPVSV (TYRP2_HUMAN)
YVIDLPVSW

SEQ ID NO: 195896 - protein, 10 aa, Artificial Sequence
  Description of Artificial Sequence: Synthetic peptide
  Seed: RNSMKLPTLK (TYRP2_HUMAN)
RASMKLPTLK

SEQ ID NO: 195897 - protein, 9 aa, Artificial Sequence
  Description of Artificial Sequence: Synthetic peptide
  Seed: DDYNHLVTL (TYRP2_HUMAN)
DRYNHLVTI

SEQ ID NO: 195898 - protein, 10 aa, Artificial Sequence
  Description of Artificial Sequence: Synthetic peptide
  Seed: METHLSSKRY (TYRP2_HUMAN)
METHLSSKRW

SEQ ID NO: 195899 - protein, 10 aa, Artificial Sequence
  Description of Artificial Sequence: Synthetic peptide
  Seed: FFPPVTNEEL (TYRP2_HUMAN)
FSPPVTNEEI

SEQ ID NO: 195900 - protein, 10 aa, Artificial Sequence
  Description of Artificial Sequence: Synthetic peptide
  Seed: SPLWWGFLLS (TYRP2_HUMAN)
SCLWWGFLLV

SEQ ID NO: 195901 - protein, 9 aa, Artificial Sequence
  Description of Artificial Sequence: Synthetic peptide
  Seed: GLFVLLAFL (TYRP2_HUMAN)
GTFVLLAFR

SEQ ID NO: 195902 - protein, 10 aa, Artificial Sequence
  Description of Artificial Sequence: Synthetic peptide
  Seed: YNMVPFFPPV (TYRP2_HUMAN)
YTMVPFFPPS

SEQ ID NO: 195903 - protein, 11 aa, Artificial Sequence
  Description of Artificial Sequence: Synthetic peptide
  Seed: YNMVPFFPPVT (TYRP2_HUMAN)
YVMVPFFPPVC

SEQ ID NO: 195904 - protein, 10 aa, Artificial Sequence
  Description of Artificial Sequence: Synthetic peptide
  Seed: MSLHNLVHSF (TYRP2_HUMAN)
MCLHNLVHSF

SEQ ID NO: 195905 - protein, 10 aa, Artificial Sequence
  Description of Artificial Sequence: Synthetic peptide
  Seed: SDQLGYSYAI (TYRP2_HUMAN)
SNQLGYSYAI

SEQ ID NO: 195906 - protein, 9 aa, Artificial Sequence
  Description of Artificial Sequence: Synthetic peptide
  Seed: ETPGWPTTL (TYRP2_HUMAN)
EVPGWPTTR

SEQ ID NO: 195907 - protein, 10 aa, Artificial Sequence
  Description of Artificial Sequence: Synthetic peptide
  Seed: HPDYVITTQH (TYRP2_HUMAN)
HPDYVITTQF

SEQ ID NO: 195908 - protein, 9 aa, Artificial Sequence
  Description of Artificial Sequence: Synthetic peptide
  Seed: DDYNHLVTL (TYRP2_HUMAN)
DHYNHLVTM

SEQ ID NO: 195909 - protein, 9 aa, Artificial Sequence
  Description of Artificial Sequence: Synthetic peptide
  Seed: RLRKGYTPL (TYRP2_HUMAN)
RERKGYTPF

SEQ ID NO: 195910 - protein, 9 aa, Artificial Sequence
  Description of Artificial Sequence: Synthetic peptide
  Seed: SVYDFFVWL (TYRP2_HUMAN)
SIYDFFVWT

SEQ ID NO: 195911 - protein, 10 aa, Artificial Sequence
  Description of Artificial Sequence: Synthetic peptide
  Seed: FFVWLHYYSV (TYRP2_HUMAN)
FLVWLHYYSI

SEQ ID NO: 195912 - protein, 9 aa, Artificial Sequence
  Description of Artificial Sequence: Synthetic peptide
  Seed: GFDKADGTL (TYRP2_HUMAN)
GVDKADGTL

SEQ ID NO: 195913 - protein, 10 aa, Artificial Sequence
  Description of Artificial Sequence: Synthetic peptide
  Seed: LISRNSRFSS (TYRP2_HUMAN)
LCSRNSRFSK

SEQ ID NO: 195914 - protein, 9 aa, Artificial Sequence
  Description of Artificial Sequence: Synthetic peptide
  Seed: ANDPIFVVL (TYRP2_HUMAN)
AHDPIFVVW

SEQ ID NO: 195915 - protein, 9 aa, Artificial Sequence
  Description of Artificial Sequence: Synthetic peptide
  Seed: AANDPIFVV (TYRP2_HUMAN)
AANDPIFVH

SEQ ID NO: 195916 - protein, 10 aa, Artificial Sequence
  Description of Artificial Sequence: Synthetic peptide
  Seed: LVVMGTLVAL (TYRP2_HUMAN)
LPVMGTLVAF

SEQ ID NO: 195917 - protein, 9 aa, Artificial Sequence
  Description of Artificial Sequence: Synthetic peptide
  Seed: FVWLHYYSV (TYRP2_HUMAN)
FVWLHYYSI

SEQ ID NO: 195918 - protein, 9 aa, Artificial Sequence
  Description of Artificial Sequence: Synthetic peptide
  Seed: TLDSQVMSL (TYRP2_HUMAN)
TVDSQVMSI

SEQ ID NO: 195919 - protein, 9 aa, Artificial Sequence
  Description of Artificial Sequence: Synthetic peptide
  Seed: STFSFRNAL (TYRP2_HUMAN)
SGFSFRNAY

SEQ ID NO: 195920 - protein, 10 aa, Artificial Sequence
  Description of Artificial Sequence: Synthetic peptide
  Seed: SHQGPAFVTW (TYRP2_HUMAN)
SEQGPAFVTW

SEQ ID NO: 195921 - protein, 10 aa, Artificial Sequence
  Description of Artificial Sequence: Synthetic peptide
  Seed: MSPLWWGFLL (TYRP2_HUMAN)
MTPLWWGFLY

SEQ ID NO: 195922 - protein, 10 aa, Artificial Sequence
  Description of Artificial Sequence: Synthetic peptide
  Seed: MSPLWWGFLL (TYRP2_HUMAN)
MNPLWWGFLA

SEQ ID NO: 195923 - protein, 10 aa, Artificial Sequence
  Description of Artificial Sequence: Synthetic peptide
  Seed: REQFLGALDL (TYRP2_HUMAN)
REQFLGALDI

SEQ ID NO: 195924 - protein, 9 aa, Artificial Sequence
  Description of Artificial Sequence: Synthetic peptide
  Seed: SQVMSLHNL (TYRP2_HUMAN)
SAVMSLHNF

SEQ ID NO: 195925 - protein, 9 aa, Artificial Sequence
  Description of Artificial Sequence: Synthetic peptide
  Seed: RMYNMVPFF (TYRP2_HUMAN)
RLYNMVPFT

SEQ ID NO: 195926 - protein, 11 aa, Artificial Sequence
  Description of Artificial Sequence: Synthetic peptide
  Seed: SLDDYNHLVTL (TYRP2_HUMAN)
STDDYNHLVTY

SEQ ID NO: 195927 - protein, 9 aa, Artificial Sequence
  Description of Artificial Sequence: Synthetic peptide
  Seed: SLHNLVHSF (TYRP2_HUMAN)
SGHNLVHSF

SEQ ID NO: 195928 - protein, 9 aa, Artificial Sequence
  Description of Artificial Sequence: Synthetic peptide
  Seed: NQMGRNSMK (TYRP2_HUMAN)
NVMGRNSMK

SEQ ID NO: 195929 - protein, 9 aa, Artificial Sequence
  Description of Artificial Sequence: Synthetic peptide
  Seed: RFNPPADAW (TYRP2_HUMAN)
RVNPPADAW

SEQ ID NO: 195930 - protein, 9 aa, Artificial Sequence
  Description of Artificial Sequence: Synthetic peptide
  Seed: YSVRDTLLG (TYRP2_HUMAN)
YAVRDTLLW

SEQ ID NO: 195931 - protein, 9 aa, Artificial Sequence
  Description of Artificial Sequence: Synthetic peptide
  Seed: RRLRKGYTP (TYRP2_HUMAN)
RRLRKGYTL

SEQ ID NO: 195932 - protein, 10 aa, Artificial Sequence
  Description of Artificial Sequence: Synthetic peptide
  Seed: CCPRLGAESA (TYRP2_HUMAN)
CLPRLGAESM

SEQ ID NO: 195933 - protein, 10 aa, Artificial Sequence
  Description of Artificial Sequence: Synthetic peptide
  Seed: TLDSQVMSLH (TYRP2_HUMAN)
TMDSQVMSLY

SEQ ID NO: 195934 - protein, 9 aa, Artificial Sequence
  Description of Artificial Sequence: Synthetic peptide
  Seed: NMVPFFPPV (TYRP2_HUMAN)
NTVPFFPPA

SEQ ID NO: 195935 - protein, 9 aa, Artificial Sequence
  Description of Artificial Sequence: Synthetic peptide
  Seed: HPDYVITTQ (TYRP2_HUMAN)
HVDYVITTF

SEQ ID NO: 195936 - protein, 9 aa, Artificial Sequence
  Description of Artificial Sequence: Synthetic peptide
  Seed: LRNQDDREL (TYRP2_HUMAN)
LHNQDDREL

SEQ ID NO: 195937 - protein, 9 aa, Artificial Sequence
  Description of Artificial Sequence: Synthetic peptide
  Seed: FTDAIFDEW (TYRP2_HUMAN)
FCDAIFDEF

SEQ ID NO: 195938 - protein, 9 aa, Artificial Sequence
  Description of Artificial Sequence: Synthetic peptide
  Seed: YVITTQHWL (TYRP2_HUMAN)
YAITTQHWF

SEQ ID NO: 195939 - protein, 9 aa, Artificial Sequence
  Description of Artificial Sequence: Synthetic peptide
  Seed: HSFLNGTNA (TYRP2_HUMAN)
HTFLNGTNY

SEQ ID NO: 195940 - protein, 8 aa, Artificial Sequence
  Description of Artificial Sequence: Synthetic peptide
  Seed: MVPFFPPV (TYRP2_HUMAN)
MLPFFPPL

SEQ ID NO: 195941 - protein, 11 aa, Artificial Sequence
  Description of Artificial Sequence: Synthetic peptide
  Seed: PFFQNSTFSFR (TYRP2_HUMAN)
PHFQNSTFSFR

SEQ ID NO: 195942 - protein, 11 aa, Artificial Sequence
  Description of Artificial Sequence: Synthetic peptide
  Seed: FFPPVTNEELF (TYRP2_HUMAN)
FVPPVTNEELY

SEQ ID NO: 195943 - protein, 9 aa, Artificial Sequence
  Description of Artificial Sequence: Synthetic peptide
  Seed: LHNLVHSFL (TYRP2_HUMAN)
LHNLVHSFF

SEQ ID NO: 195944 - protein, 9 aa, Artificial Sequence
  Description of Artificial Sequence: Synthetic peptide
  Seed: YVITTQHWL (TYRP2_HUMAN)
YMITTQHWW

SEQ ID NO: 195945 - protein, 8 aa, Artificial Sequence
  Description of Artificial Sequence: Synthetic peptide
  Seed: RPDDPTLI (TYRP2_HUMAN)
RADDPTLI

SEQ ID NO: 195946 - protein, 11 aa, Artificial Sequence
  Description of Artificial Sequence: Synthetic peptide
  Seed: MYNMVPFFPPV (TYRP2_HUMAN)
MENMVPFFPPL

SEQ ID NO: 195947 - protein, 10 aa, Artificial Sequence
  Description of Artificial Sequence: Synthetic peptide
  Seed: RNSRFSSWET (TYRP2_HUMAN)
RTSRFSSWEV

SEQ ID NO: 195948 - protein, 10 aa, Artificial Sequence
  Description of Artificial Sequence: Synthetic peptide
  Seed: MSLHNLVHSF (TYRP2_HUMAN)
MVLHNLVHSF

SEQ ID NO: 195949 - protein, 11 aa, Artificial Sequence
  Description of Artificial Sequence: Synthetic peptide
  Seed: WLHYYSVRDTL (TYRP2_HUMAN)
WRHYYSVRDTW

SEQ ID NO: 195950 - protein, 9 aa, Artificial Sequence
  Description of Artificial Sequence: Synthetic peptide
  Seed: SRNSRFSSW (TYRP2_HUMAN)
SMNSRFSSM

SEQ ID NO: 195951 - protein, 9 aa, Artificial Sequence
  Description of Artificial Sequence: Synthetic peptide
  Seed: YVITTQHWL (TYRP2_HUMAN)
YQITTQHWV

SEQ ID NO: 195952 - protein, 9 aa, Artificial Sequence
  Description of Artificial Sequence: Synthetic peptide
  Seed: VLHSFTDAI (TYRP2_HUMAN)
VQHSFTDAW

SEQ ID NO: 195953 - protein, 9 aa, Artificial Sequence
  Description of Artificial Sequence: Synthetic peptide
  Seed: SQVMSLHNL (TYRP2_HUMAN)
SSVMSLHNV

SEQ ID NO: 195954 - protein, 9 aa, Artificial Sequence
  Description of Artificial Sequence: Synthetic peptide
  Seed: STFSFRNAL (TYRP2_HUMAN)
STFSFRNAV

SEQ ID NO: 195955 - protein, 9 aa, Artificial Sequence
  Description of Artificial Sequence: Synthetic peptide
  Seed: PADAWPQEL (TYRP2_HUMAN)
PFDAWPQEM

SEQ ID NO: 195956 - protein, 9 aa, Artificial Sequence
  Description of Artificial Sequence: Synthetic peptide
  Seed: VGLFVLLAF (TYRP2_HUMAN)
VKLFVLLAY

SEQ ID NO: 195957 - protein, 10 aa, Artificial Sequence
  Description of Artificial Sequence: Synthetic peptide
  Seed: ELAPIGHNRM (TYRP2_HUMAN)
EVAPIGHNRK

SEQ ID NO: 195958 - protein, 9 aa, Artificial Sequence
  Description of Artificial Sequence: Synthetic peptide
  Seed: ERKKPPVIR (TYRP2_HUMAN)
EYKKPPVIR

SEQ ID NO: 195959 - protein, 9 aa, Artificial Sequence
  Description of Artificial Sequence: Synthetic peptide
  Seed: SLDDYNHLV (TYRP2_HUMAN)
SSDDYNHLV

SEQ ID NO: 195960 - protein, 10 aa, Artificial Sequence
  Description of Artificial Sequence: Synthetic peptide
  Seed: VVMGTLVALV (TYRP2_HUMAN)
VIMGTLVALI

SEQ ID NO: 195961 - protein, 9 aa, Artificial Sequence
  Description of Artificial Sequence: Synthetic peptide
  Seed: RNQMGRNSM (TYRP2_HUMAN)
RMQMGRNSL

SEQ ID NO: 195962 - protein, 9 aa, Artificial Sequence
  Description of Artificial Sequence: Synthetic peptide
  Seed: TTLLVVMGT (TYRP2_HUMAN)
TTLLVVMGI

SEQ ID NO: 195963 - protein, 9 aa, Artificial Sequence
  Description of Artificial Sequence: Synthetic peptide
  Seed: EGLLRRNQM (TYRP2_HUMAN)
EVLLRRNQL

SEQ ID NO: 195964 - protein, 9 aa, Artificial Sequence
  Description of Artificial Sequence: Synthetic peptide
  Seed: VLHSFTDAI (TYRP2_HUMAN)
VSHSFTDAF

SEQ ID NO: 195965 - protein, 9 aa, Artificial Sequence
  Description of Artificial Sequence: Synthetic peptide
  Seed: YAIDLPVSV (TYRP2_HUMAN)
YMIDLPVSI

SEQ ID NO: 195966 - protein, 11 aa, Artificial Sequence
  Description of Artificial Sequence: Synthetic peptide
  Seed: QRLIGNESFAL (TYRP2_HUMAN)
QMLIGNESFAV

SEQ ID NO: 195967 - protein, 10 aa, Artificial Sequence
  Description of Artificial Sequence: Synthetic peptide
  Seed: MGRNSMKLPT (TYRP2_HUMAN)
MFRNSMKLPK

SEQ ID NO: 195968 - protein, 11 aa, Artificial Sequence
  Description of Artificial Sequence: Synthetic peptide
  Seed: YNMVPFFPPVT (TYRP2_HUMAN)
YMMVPFFPPVA

SEQ ID NO: 195969 - protein, 9 aa, Artificial Sequence
  Description of Artificial Sequence: Synthetic peptide
  Seed: LQKFDNPPF (TYRP2_HUMAN)
LTKFDNPPY

SEQ ID NO: 195970 - protein, 9 aa, Artificial Sequence
  Description of Artificial Sequence: Synthetic peptide
  Seed: TLDSQVMSL (TYRP2_HUMAN)
TQDSQVMSF

SEQ ID NO: 195971 - protein, 9 aa, Artificial Sequence
  Description of Artificial Sequence: Synthetic peptide
  Seed: GTYEGLLRR (TYRP2_HUMAN)
GYYEGLLRY

SEQ ID NO: 195972 - protein, 10 aa, Artificial Sequence
  Description of Artificial Sequence: Synthetic peptide
  Seed: MSPLWWGFLL (TYRP2_HUMAN)
MMPLWWGFLA

SEQ ID NO: 195973 - protein, 10 aa, Artificial Sequence
  Description of Artificial Sequence: Synthetic peptide
  Seed: YNMVPFFPPV (TYRP2_HUMAN)
YFMVPFFPPL

SEQ ID NO: 195974 - protein, 10 aa, Artificial Sequence
  Description of Artificial Sequence: Synthetic peptide
  Seed: SPLWWGFLLS (TYRP2_HUMAN)
SMLWWGFLLP

SEQ ID NO: 195975 - protein, 9 aa, Artificial Sequence
  Description of Artificial Sequence: Synthetic peptide
  Seed: QRLIGNESF (TYRP2_HUMAN)
QHLIGNESL

SEQ ID NO: 195976 - protein, 11 aa, Artificial Sequence
  Description of Artificial Sequence: Synthetic peptide
  Seed: YSYAIDLPVSV (TYRP2_HUMAN)
YMYAIDLPVSA

SEQ ID NO: 195977 - protein, 9 aa, Artificial Sequence
  Description of Artificial Sequence: Synthetic peptide
  Seed: ALVGLFVLL (TYRP2_HUMAN)
ASVGLFVLY

SEQ ID NO: 195978 - protein, 9 aa, Artificial Sequence
  Description of Artificial Sequence: Synthetic peptide
  Seed: LERDLQRLI (TYRP2_HUMAN)
LERDLQRLY

SEQ ID NO: 195979 - protein, 10 aa, Artificial Sequence
  Description of Artificial Sequence: Synthetic peptide
  Seed: FFQNSTFSFR (TYRP2_HUMAN)
FYQNSTFSFA

SEQ ID NO: 195980 - protein, 10 aa, Artificial Sequence
  Description of Artificial Sequence: Synthetic peptide
  Seed: RRLRKGYTPL (TYRP2_HUMAN)
RTLRKGYTPP

SEQ ID NO: 195981 - protein, 10 aa, Artificial Sequence
  Description of Artificial Sequence: Synthetic peptide
  Seed: SLDDYNHLVT (TYRP2_HUMAN)
SMDDYNHLVL

SEQ ID NO: 195982 - protein, 10 aa, Artificial Sequence
  Description of Artificial Sequence: Synthetic peptide
  Seed: VGLFVLLAFL (TYRP2_HUMAN)
VQLFVLLAFV

SEQ ID NO: 195983 - protein, 10 aa, Artificial Sequence
  Description of Artificial Sequence: Synthetic peptide
  Seed: LVVMGTLVAL (TYRP2_HUMAN)
LMVMGTLVAY

SEQ ID NO: 195984 - protein, 10 aa, Artificial Sequence
  Description of Artificial Sequence: Synthetic peptide
  Seed: RMYNMVPFFP (TYRP2_HUMAN)
RIYNMVPFFV

SEQ ID NO: 195985 - protein, 9 aa, Artificial Sequence
  Description of Artificial Sequence: Synthetic peptide
  Seed: SFALPYWNF (TYRP2_HUMAN)
SWALPYWNI

SEQ ID NO: 195986 - protein, 11 aa, Artificial Sequence
  Description of Artificial Sequence: Synthetic peptide
  Seed: QPQFANCSVYD (TYRP2_HUMAN)
QSQFANCSVYF

SEQ ID NO: 195987 - protein, 10 aa, Artificial Sequence
  Description of Artificial Sequence: Synthetic peptide
  Seed: SDQLGYSYAI (TYRP2_HUMAN)
SWQLGYSYAM

SEQ ID NO: 195988 - protein, 10 aa, Artificial Sequence
  Description of Artificial Sequence: Synthetic peptide
  Seed: FLLSCLGCKI (TYRP2_HUMAN)
FMLSCLGCKT

SEQ ID NO: 195989 - protein, 10 aa, Artificial Sequence
  Description of Artificial Sequence: Synthetic peptide
  Seed: NQDDRELWPR (TYRP2_HUMAN)
NSDDRELWPY

SEQ ID NO: 195990 - protein, 9 aa, Artificial Sequence
  Description of Artificial Sequence: Synthetic peptide
  Seed: NMVPFFPPV (TYRP2_HUMAN)
NYVPFFPPY

SEQ ID NO: 195991 - protein, 9 aa, Artificial Sequence
  Description of Artificial Sequence: Synthetic peptide
  Seed: LAPIGHNRM (TYRP2_HUMAN)
LTPIGHNRL

SEQ ID NO: 195992 - protein, 10 aa, Artificial Sequence
  Description of Artificial Sequence: Synthetic peptide
  Seed: CCPRLGAESA (TYRP2_HUMAN)
CRPRLGAESL

SEQ ID NO: 195993 - protein, 9 aa, Artificial Sequence
  Description of Artificial Sequence: Synthetic peptide
  Seed: FFQNSTFSF (TYRP2_HUMAN)
FNQNSTFSY

SEQ ID NO: 195994 - protein, 9 aa, Artificial Sequence
  Description of Artificial Sequence: Synthetic peptide
  Seed: AIFDEWMKR (TYRP2_HUMAN)
AVFDEWMKR

SEQ ID NO: 195995 - protein, 9 aa, Artificial Sequence
  Description of Artificial Sequence: Synthetic peptide
  Seed: AANDPIFVV (TYRP2_HUMAN)
ALNDPIFVL

SEQ ID NO: 195996 - protein, 10 aa, Artificial Sequence
  Description of Artificial Sequence: Synthetic peptide
  Seed: FPPVTNEELF (TYRP2_HUMAN)
FFPVTNEELY

SEQ ID NO: 195997 - protein, 9 aa, Artificial Sequence
  Description of Artificial Sequence: Synthetic peptide
  Seed: NRMYNMVPF (TYRP2_HUMAN)
NYMYNMVPV

SEQ ID NO: 195998 - protein, 9 aa, Artificial Sequence
  Description of Artificial Sequence: Synthetic peptide
  Seed: RKFFHRTCK (TYRP2_HUMAN)
RYFFHRTCM

SEQ ID NO: 195999 - protein, 9 aa, Artificial Sequence
  Description of Artificial Sequence: Synthetic peptide
  Seed: VLHSFTDAI (TYRP2_HUMAN)
VKHSFTDAM

SEQ ID NO: 196000 - protein, 9 aa, Artificial Sequence
  Description of Artificial Sequence: Synthetic peptide
  Seed: FPPVTNEEL (TYRP2_HUMAN)
FSPVTNEEY

SEQ ID NO: 196001 - protein, 11 aa, Artificial Sequence
  Description of Artificial Sequence: Synthetic peptide
  Seed: SLDDYNHLVTL (TYRP2_HUMAN)
SSDDYNHLVTL

SEQ ID NO: 196002 - protein, 9 aa, Artificial Sequence
  Description of Artificial Sequence: Synthetic peptide
  Seed: TSDQLGYSY (TYRP2_HUMAN)
TVDQLGYSI

SEQ ID NO: 196003 - protein, 9 aa, Artificial Sequence
  Description of Artificial Sequence: Synthetic peptide
  Seed: CSVYDFFVW (TYRP2_HUMAN)
CSVYDFFVF

SEQ ID NO: 196004 - protein, 9 aa, Artificial Sequence
  Description of Artificial Sequence: Synthetic peptide
  Seed: FVLLAFLQY (TYRP2_HUMAN)
FKLLAFLQY

SEQ ID NO: 196005 - protein, 10 aa, Artificial Sequence
  Description of Artificial Sequence: Synthetic peptide
  Seed: MSPLWWGFLL (TYRP2_HUMAN)
MPPLWWGFLF

SEQ ID NO: 196006 - protein, 9 aa, Artificial Sequence
  Description of Artificial Sequence: Synthetic peptide
  Seed: RLRKGYTPL (TYRP2_HUMAN)
RQRKGYTPH

SEQ ID NO: 196007 - protein, 9 aa, Artificial Sequence
  Description of Artificial Sequence: Synthetic peptide
  Seed: TLDSQVMSL (TYRP2_HUMAN)
TYDSQVMSC

SEQ ID NO: 196008 - protein, 10 aa, Artificial Sequence
  Description of Artificial Sequence: Synthetic peptide
  Seed: RRLRKGYTPL (TYRP2_HUMAN)
RQLRKGYTPA

SEQ ID NO: 196009 - protein, 10 aa, Artificial Sequence
  Description of Artificial Sequence: Synthetic peptide
  Seed: QPQFANCSVY (TYRP2_HUMAN)
QKQFANCSVY

SEQ ID NO: 196010 - protein, 10 aa, Artificial Sequence
  Description of Artificial Sequence: Synthetic peptide
  Seed: VVMGTLVALV (TYRP2_HUMAN)
VLMGTLVALY

SEQ ID NO: 196011 - protein, 10 aa, Artificial Sequence
  Description of Artificial Sequence: Synthetic peptide
  Seed: MSPLWWGFLL (TYRP2_HUMAN)
MKPLWWGFLV

SEQ ID NO: 196012 - protein, 9 aa, Artificial Sequence
  Description of Artificial Sequence: Synthetic peptide
  Seed: STFSFRNAL (TYRP2_HUMAN)
SMFSFRNAA

SEQ ID NO: 196013 - protein, 10 aa, Artificial Sequence
  Description of Artificial Sequence: Synthetic peptide
  Seed: VGLFVLLAFL (TYRP2_HUMAN)
VILFVLLAFV

SEQ ID NO: 196014 - protein, 9 aa, Artificial Sequence
  Description of Artificial Sequence: Synthetic peptide
  Seed: GTYEGLLRR (TYRP2_HUMAN)
GAYEGLLRR

SEQ ID NO: 196015 - protein, 9 aa, Artificial Sequence
  Description of Artificial Sequence: Synthetic peptide
  Seed: IFDEWMKRF (TYRP2_HUMAN)
IFDEWMKRM

SEQ ID NO: 196016 - protein, 9 aa, Artificial Sequence
  Description of Artificial Sequence: Synthetic peptide
  Seed: STFSFRNAL (TYRP2_HUMAN)
SIFSFRNAR

SEQ ID NO: 196017 - protein, 9 aa, Artificial Sequence
  Description of Artificial Sequence: Synthetic peptide
  Seed: YAIDLPVSV (TYRP2_HUMAN)
YLIDLPVSW

SEQ ID NO: 196018 - protein, 10 aa, Artificial Sequence
  Description of Artificial Sequence: Synthetic peptide
  Seed: FFQNSTFSFR (TYRP2_HUMAN)
FMQNSTFSFK

SEQ ID NO: 196019 - protein, 9 aa, Artificial Sequence
  Description of Artificial Sequence: Synthetic peptide
  Seed: QEREQFLGA (TYRP2_HUMAN)
QEREQFLGT

SEQ ID NO: 196020 - protein, 11 aa, Artificial Sequence
  Description of Artificial Sequence: Synthetic peptide
  Seed: YTPLMETHLSS (TYRP2_HUMAN)
YKPLMETHLSI

SEQ ID NO: 196021 - protein, 10 aa, Artificial Sequence
  Description of Artificial Sequence: Synthetic peptide
  Seed: FLTSDQLGYS (TYRP2_HUMAN)
FMTSDQLGYL

SEQ ID NO: 196022 - protein, 9 aa, Artificial Sequence
  Description of Artificial Sequence: Synthetic peptide
  Seed: HSAANDPIF (TYRP2_HUMAN)
HLAANDPIF

SEQ ID NO: 196023 - protein, 9 aa, Artificial Sequence
  Description of Artificial Sequence: Synthetic peptide
  Seed: RKFFHRTCK (TYRP2_HUMAN)
RIFFHRTCA

SEQ ID NO: 196024 - protein, 10 aa, Artificial Sequence
  Description of Artificial Sequence: Synthetic peptide
  Seed: NPPFFQNSTF (TYRP2_HUMAN)
NDPFFQNSTY

SEQ ID NO: 196025 - protein, 9 aa, Artificial Sequence
  Description of Artificial Sequence: Synthetic peptide
  Seed: AANDPIFVV (TYRP2_HUMAN)
AFNDPIFVF

SEQ ID NO: 196026 - protein, 9 aa, Artificial Sequence
  Description of Artificial Sequence: Synthetic peptide
  Seed: LVGLFVLLA (TYRP2_HUMAN)
LMGLFVLLI

SEQ ID NO: 196027 - protein, 9 aa, Artificial Sequence
  Description of Artificial Sequence: Synthetic peptide
  Seed: STFSFRNAL (TYRP2_HUMAN)
SMFSFRNAV

SEQ ID NO: 196028 - protein, 10 aa, Artificial Sequence
  Description of Artificial Sequence: Synthetic peptide
  Seed: YNMVPFFPPV (TYRP2_HUMAN)
YIMVPFFPPM

SEQ ID NO: 196029 - protein, 9 aa, Artificial Sequence
  Description of Artificial Sequence: Synthetic peptide
  Seed: SVYDFFVWL (TYRP2_HUMAN)
SMYDFFVWR

SEQ ID NO: 196030 - protein, 11 aa, Artificial Sequence
  Description of Artificial Sequence: Synthetic peptide
  Seed: RLIGNESFALP (TYRP2_HUMAN)
RMIGNESFALL

SEQ ID NO: 196031 - protein, 10 aa, Artificial Sequence
  Description of Artificial Sequence: Synthetic peptide
  Seed: VGLFVLLAFL (TYRP2_HUMAN)
VCLFVLLAFV

SEQ ID NO: 196032 - protein, 9 aa, Artificial Sequence
  Description of Artificial Sequence: Synthetic peptide
  Seed: TLLGPGRPY (TYRP2_HUMAN)
TLLGPGRPF

SEQ ID NO: 196033 - protein, 10 aa, Artificial Sequence
  Description of Artificial Sequence: Synthetic peptide
  Seed: SDQLGYSYAI (TYRP2_HUMAN)
SYQLGYSYAV

SEQ ID NO: 196034 - protein, 9 aa, Artificial Sequence
  Description of Artificial Sequence: Synthetic peptide
  Seed: YSYAIDLPV (TYRP2_HUMAN)
YQYAIDLPM

SEQ ID NO: 196035 - protein, 10 aa, Artificial Sequence
  Description of Artificial Sequence: Synthetic peptide
  Seed: FLTSDQLGYS (TYRP2_HUMAN)
FLTSDQLGYL

SEQ ID NO: 196036 - protein, 10 aa, Artificial Sequence
  Description of Artificial Sequence: Synthetic peptide
  Seed: RRLRKGYTPL (TYRP2_HUMAN)
RALRKGYTPK

SEQ ID NO: 196037 - protein, 9 aa, Artificial Sequence
  Description of Artificial Sequence: Synthetic peptide
  Seed: STFSFRNAL (TYRP2_HUMAN)
SFFSFRNAL

SEQ ID NO: 196038 - protein, 11 aa, Artificial Sequence
  Description of Artificial Sequence: Synthetic peptide
  Seed: FFPPVTNEELF (TYRP2_HUMAN)
FFPPVTNEELW

SEQ ID NO: 196039 - protein, 10 aa, Artificial Sequence
  Description of Artificial Sequence: Synthetic peptide
  Seed: RLRKGYTPLM (TYRP2_HUMAN)
RWRKGYTPLV

SEQ ID NO: 196040 - protein, 10 aa, Artificial Sequence
  Description of Artificial Sequence: Synthetic peptide
  Seed: RLRKGYTPLM (TYRP2_HUMAN)
RWRKGYTPLI

SEQ ID NO: 196041 - protein, 10 aa, Artificial Sequence
  Description of Artificial Sequence: Synthetic peptide
  Seed: NIHSLSPQER (TYRP2_HUMAN)
NYHSLSPQER

SEQ ID NO: 196042 - protein, 11 aa, Artificial Sequence
  Description of Artificial Sequence: Synthetic peptide
  Seed: MSLHNLVHSFL (TYRP2_HUMAN)
MMLHNLVHSFV

SEQ ID NO: 196043 - protein, 10 aa, Artificial Sequence
  Description of Artificial Sequence: Synthetic peptide
  Seed: NSTFSFRNAL (TYRP2_HUMAN)
NATFSFRNAV

SEQ ID NO: 196044 - protein, 9 aa, Artificial Sequence
  Description of Artificial Sequence: Synthetic peptide
  Seed: ETPGWPTTL (TYRP2_HUMAN)
EFPGWPTTY

SEQ ID NO: 196045 - protein, 9 aa, Artificial Sequence
  Description of Artificial Sequence: Synthetic peptide
  Seed: ELWPRKFFH (TYRP2_HUMAN)
ESWPRKFFK

SEQ ID NO: 196046 - protein, 11 aa, Artificial Sequence
  Description of Artificial Sequence: Synthetic peptide
  Seed: YTPLMETHLSS (TYRP2_HUMAN)
YKPLMETHLSA

SEQ ID NO: 196047 - protein, 9 aa, Artificial Sequence
  Description of Artificial Sequence: Synthetic peptide
  Seed: FVWLHYYSV (TYRP2_HUMAN)
FVWLHYYSM

SEQ ID NO: 196048 - protein, 9 aa, Artificial Sequence
  Description of Artificial Sequence: Synthetic peptide
  Seed: IFDEWMKRF (TYRP2_HUMAN)
IIDEWMKRV

SEQ ID NO: 196049 - protein, 9 aa, Artificial Sequence
  Description of Artificial Sequence: Synthetic peptide
  Seed: SWETVCDSL (TYRP2_HUMAN)
SYETVCDSW

SEQ ID NO: 196050 - protein, 10 aa, Artificial Sequence
  Description of Artificial Sequence: Synthetic peptide
  Seed: LQYRRLRKGY (TYRP2_HUMAN)
LQYRRLRKGF

SEQ ID NO: 196051 - protein, 9 aa, Artificial Sequence
  Description of Artificial Sequence: Synthetic peptide
  Seed: ANDPIFVVL (TYRP2_HUMAN)
AVDPIFVVF

SEQ ID NO: 196052 - protein, 9 aa, Artificial Sequence
  Description of Artificial Sequence: Synthetic peptide
  Seed: SFALPYWNF (TYRP2_HUMAN)
SQALPYWNY

SEQ ID NO: 196053 - protein, 10 aa, Artificial Sequence
  Description of Artificial Sequence: Synthetic peptide
  Seed: HRYHLLCLER (TYRP2_HUMAN)
HFYHLLCLER

SEQ ID NO: 196054 - protein, 10 aa, Artificial Sequence
  Description of Artificial Sequence: Synthetic peptide
  Seed: AANDPIFVVL (TYRP2_HUMAN)
AMNDPIFVVI

SEQ ID NO: 196055 - protein, 9 aa, Artificial Sequence
  Description of Artificial Sequence: Synthetic peptide
  Seed: SRNSRFSSW (TYRP2_HUMAN)
STNSRFSSY

SEQ ID NO: 196056 - protein, 11 aa, Artificial Sequence
  Description of Artificial Sequence: Synthetic peptide
  Seed: FVLLAFLQYRR (TYRP2_HUMAN)
FSLLAFLQYRR

SEQ ID NO: 196057 - protein, 10 aa, Artificial Sequence
  Description of Artificial Sequence: Synthetic peptide
  Seed: SRFSSWETVC (TYRP2_HUMAN)
SRFSSWETVI

SEQ ID NO: 196058 - protein, 10 aa, Artificial Sequence
  Description of Artificial Sequence: Synthetic peptide
  Seed: HNRMYNMVPF (TYRP2_HUMAN)
HGRMYNMVPF

SEQ ID NO: 196059 - protein, 9 aa, Artificial Sequence
  Description of Artificial Sequence: Synthetic peptide
  Seed: DDYNHLVTL (TYRP2_HUMAN)
DMYNHLVTF

SEQ ID NO: 196060 - protein, 10 aa, Artificial Sequence
  Description of Artificial Sequence: Synthetic peptide
  Seed: VGLFVLLAFL (TYRP2_HUMAN)
VALFVLLAFV

SEQ ID NO: 196061 - protein, 9 aa, Artificial Sequence
  Description of Artificial Sequence: Synthetic peptide
  Seed: AFLQYRRLR (TYRP2_HUMAN)
AALQYRRLR

SEQ ID NO: 196062 - protein, 9 aa, Artificial Sequence
  Description of Artificial Sequence: Synthetic peptide
  Seed: LSPQEREQF (TYRP2_HUMAN)
LAPQEREQM

SEQ ID NO: 196063 - protein, 10 aa, Artificial Sequence
  Description of Artificial Sequence: Synthetic peptide
  Seed: YNMVPFFPPV (TYRP2_HUMAN)
YTMVPFFPPA

SEQ ID NO: 196064 - protein, 10 aa, Artificial Sequence
  Description of Artificial Sequence: Synthetic peptide
  Seed: RPDDPTLISR (TYRP2_HUMAN)
RMDDPTLISF

SEQ ID NO: 196065 - protein, 9 aa, Artificial Sequence
  Description of Artificial Sequence: Synthetic peptide
  Seed: HPDYVITTQ (TYRP2_HUMAN)
HPDYVITTW

SEQ ID NO: 196066 - protein, 9 aa, Artificial Sequence
  Description of Artificial Sequence: Synthetic peptide
  Seed: VALVGLFVL (TYRP2_HUMAN)
VQLVGLFVI

SEQ ID NO: 196067 - protein, 9 aa, Artificial Sequence
  Description of Artificial Sequence: Synthetic peptide
  Seed: SLHNLVHSF (TYRP2_HUMAN)
SKHNLVHSF

SEQ ID NO: 196068 - protein, 8 aa, Artificial Sequence
  Description of Artificial Sequence: Synthetic peptide
  Seed: FLNGTNAL (TYRP2_HUMAN)
FYNGTNAF

SEQ ID NO: 196069 - protein, 9 aa, Artificial Sequence
  Description of Artificial Sequence: Synthetic peptide
  Seed: SLDDYNHLV (TYRP2_HUMAN)
SMDDYNHLY

SEQ ID NO: 196070 - protein, 9 aa, Artificial Sequence
  Description of Artificial Sequence: Synthetic peptide
  Seed: AFLQYRRLR (TYRP2_HUMAN)
AYLQYRRLR

SEQ ID NO: 196071 - protein, 9 aa, Artificial Sequence
  Description of Artificial Sequence: Synthetic peptide
  Seed: TLLGPGRPY (TYRP2_HUMAN)
TYLGPGRPM

SEQ ID NO: 196072 - protein, 9 aa, Artificial Sequence
  Description of Artificial Sequence: Synthetic peptide
  Seed: FLLSCLGCK (TYRP2_HUMAN)
FMLSCLGCR

SEQ ID NO: 196073 - protein, 9 aa, Artificial Sequence
  Description of Artificial Sequence: Synthetic peptide
  Seed: TTLLVVMGT (TYRP2_HUMAN)
TTLLVVMGV

SEQ ID NO: 196074 - protein, 9 aa, Artificial Sequence
  Description of Artificial Sequence: Synthetic peptide
  Seed: RNSMKLPTL (TYRP2_HUMAN)
RQSMKLPTV

SEQ ID NO: 196075 - protein, 10 aa, Artificial Sequence
  Description of Artificial Sequence: Synthetic peptide
  Seed: GYSYAIDLPV (TYRP2_HUMAN)
GLSYAIDLPL

SEQ ID NO: 196076 - protein, 9 aa, Artificial Sequence
  Description of Artificial Sequence: Synthetic peptide
  Seed: QVMSLHNLV (TYRP2_HUMAN)
QQMSLHNLV

SEQ ID NO: 196077 - protein, 11 aa, Artificial Sequence
  Description of Artificial Sequence: Synthetic peptide
  Seed: YNMVPFFPPVT (TYRP2_HUMAN)
YVMVPFFPPVS

SEQ ID NO: 196078 - protein, 10 aa, Artificial Sequence
  Description of Artificial Sequence: Synthetic peptide
  Seed: WPRKFFHRTC (TYRP2_HUMAN)
WPRKFFHRTA

SEQ ID NO: 196079 - protein, 10 aa, Artificial Sequence
  Description of Artificial Sequence: Synthetic peptide
  Seed: RELWPRKFFH (TYRP2_HUMAN)
RQLWPRKFFK

SEQ ID NO: 196080 - protein, 9 aa, Artificial Sequence
  Description of Artificial Sequence: Synthetic peptide
  Seed: PADAWPQEL (TYRP2_HUMAN)
PFDAWPQEF

SEQ ID NO: 196081 - protein, 10 aa, Artificial Sequence
  Description of Artificial Sequence: Synthetic peptide
  Seed: RPWSGPYILR (TYRP2_HUMAN)
RAWSGPYILK

SEQ ID NO: 196082 - protein, 11 aa, Artificial Sequence
  Description of Artificial Sequence: Synthetic peptide
  Seed: YNMVPFFPPVT (TYRP2_HUMAN)
YTMVPFFPPVD

SEQ ID NO: 196083 - protein, 10 aa, Artificial Sequence
  Description of Artificial Sequence: Synthetic peptide
  Seed: IDFSHQGPAF (TYRP2_HUMAN)
IEFSHQGPAY

SEQ ID NO: 196084 - protein, 10 aa, Artificial Sequence
  Description of Artificial Sequence: Synthetic peptide
  Seed: SPLWWGFLLS (TYRP2_HUMAN)
SPLWWGFLLI

SEQ ID NO: 196085 - protein, 9 aa, Artificial Sequence
  Description of Artificial Sequence: Synthetic peptide
  Seed: NESFALPYW (TYRP2_HUMAN)
NESFALPYF

SEQ ID NO: 196086 - protein, 11 aa, Artificial Sequence
  Description of Artificial Sequence: Synthetic peptide
  Seed: TQPQFANCSVY (TYRP2_HUMAN)
TKPQFANCSVM

SEQ ID NO: 196087 - protein, 9 aa, Artificial Sequence
  Description of Artificial Sequence: Synthetic peptide
  Seed: TDQLFGAAR (TYRP2_HUMAN)
TIQLFGAAR

SEQ ID NO: 196088 - protein, 9 aa, Artificial Sequence
  Description of Artificial Sequence: Synthetic peptide
  Seed: NRMYNMVPF (TYRP2_HUMAN)
NLMYNMVPY

SEQ ID NO: 196089 - protein, 9 aa, Artificial Sequence
  Description of Artificial Sequence: Synthetic peptide
  Seed: FVWLHYYSV (TYRP2_HUMAN)
FIWLHYYSV

SEQ ID NO: 196090 - protein, 10 aa, Artificial Sequence
  Description of Artificial Sequence: Synthetic peptide
  Seed: VVLHSFTDAI (TYRP2_HUMAN)
VGLHSFTDAV

SEQ ID NO: 196091 - protein, 9 aa, Artificial Sequence
  Description of Artificial Sequence: Synthetic peptide
  Seed: ARPDDPTLI (TYRP2_HUMAN)
ARPDDPTLY

SEQ ID NO: 196092 - protein, 10 aa, Artificial Sequence
  Description of Artificial Sequence: Synthetic peptide
  Seed: MGRNSMKLPT (TYRP2_HUMAN)
MMRNSMKLPK

SEQ ID NO: 196093 - protein, 11 aa, Artificial Sequence
  Description of Artificial Sequence: Synthetic peptide
  Seed: ANCSVYDFFVW (TYRP2_HUMAN)
AICSVYDFFVW

SEQ ID NO: 196094 - protein, 10 aa, Artificial Sequence
  Description of Artificial Sequence: Synthetic peptide
  Seed: YNMVPFFPPV (TYRP2_HUMAN)
YEMVPFFPPI

SEQ ID NO: 196095 - protein, 11 aa, Artificial Sequence
  Description of Artificial Sequence: Synthetic peptide
  Seed: YSYAIDLPVSV (TYRP2_HUMAN)
YLYAIDLPVSL

SEQ ID NO: 196096 - protein, 9 aa, Artificial Sequence
  Description of Artificial Sequence: Synthetic peptide
  Seed: LQKFDNPPF (TYRP2_HUMAN)
LLKFDNPPY

SEQ ID NO: 196097 - protein, 9 aa, Artificial Sequence
  Description of Artificial Sequence: Synthetic peptide
  Seed: SLHNLVHSF (TYRP2_HUMAN)
SIHNLVHSM

SEQ ID NO: 196098 - protein, 10 aa, Artificial Sequence
  Description of Artificial Sequence: Synthetic peptide
  Seed: FPPVTNEELF (TYRP2_HUMAN)
FDPVTNEELY

SEQ ID NO: 196099 - protein, 9 aa, Artificial Sequence
  Description of Artificial Sequence: Synthetic peptide
  Seed: FTDAIFDEW (TYRP2_HUMAN)
FADAIFDEW

SEQ ID NO: 196100 - protein, 9 aa, Artificial Sequence
  Description of Artificial Sequence: Synthetic peptide
  Seed: RKFFHRTCK (TYRP2_HUMAN)
RRFFHRTCF

SEQ ID NO: 196101 - protein, 10 aa, Artificial Sequence
  Description of Artificial Sequence: Synthetic peptide
  Seed: FFQNSTFSFR (TYRP2_HUMAN)
FSQNSTFSFR

SEQ ID NO: 196102 - protein, 9 aa, Artificial Sequence
  Description of Artificial Sequence: Synthetic peptide
  Seed: LIGNESFAL (TYRP2_HUMAN)
LLGNESFAL

SEQ ID NO: 196103 - protein, 10 aa, Artificial Sequence
  Description of Artificial Sequence: Synthetic peptide
  Seed: MSLHNLVHSF (TYRP2_HUMAN)
MALHNLVHSM

SEQ ID NO: 196104 - protein, 9 aa, Artificial Sequence
  Description of Artificial Sequence: Synthetic peptide
  Seed: NQMGRNSMK (TYRP2_HUMAN)
NAMGRNSMK

SEQ ID NO: 196105 - protein, 10 aa, Artificial Sequence
  Description of Artificial Sequence: Synthetic peptide
  Seed: RNSMKLPTLK (TYRP2_HUMAN)
RCSMKLPTLR

SEQ ID NO: 196106 - protein, 11 aa, Artificial Sequence
  Description of Artificial Sequence: Synthetic peptide
  Seed: PPFFQNSTFSF (TYRP2_HUMAN)
PRFFQNSTFSF

SEQ ID NO: 196107 - protein, 9 aa, Artificial Sequence
  Description of Artificial Sequence: Synthetic peptide
  Seed: KCTGNFAGY (TYRP2_HUMAN)
KITGNFAGF

SEQ ID NO: 196108 - protein, 10 aa, Artificial Sequence
  Description of Artificial Sequence: Synthetic peptide
  Seed: CMTVDSLVNK (TYRP2_HUMAN)
CGTVDSLVNR

SEQ ID NO: 196109 - protein, 9 aa, Artificial Sequence
  Description of Artificial Sequence: Synthetic peptide
  Seed: SRNSRFSSW (TYRP2_HUMAN)
SANSRFSSY

SEQ ID NO: 196110 - protein, 11 aa, Artificial Sequence
  Description of Artificial Sequence: Synthetic peptide
  Seed: LLVVMGTLVAL (TYRP2_HUMAN)
LQVVMGTLVAL

SEQ ID NO: 196111 - protein, 11 aa, Artificial Sequence
  Description of Artificial Sequence: Synthetic peptide
  Seed: YTPLMETHLSS (TYRP2_HUMAN)
YTPLMETHLST

SEQ ID NO: 196112 - protein, 8 aa, Artificial Sequence
  Description of Artificial Sequence: Synthetic peptide
  Seed: YYSVRDTL (TYRP2_HUMAN)
YFSVRDTM

SEQ ID NO: 196113 - protein, 9 aa, Artificial Sequence
  Description of Artificial Sequence: Synthetic peptide
  Seed: FTDAIFDEW (TYRP2_HUMAN)
FGDAIFDEY

SEQ ID NO: 196114 - protein, 10 aa, Artificial Sequence
  Description of Artificial Sequence: Synthetic peptide
  Seed: DSLDDYNHLV (TYRP2_HUMAN)
DTLDDYNHLV

SEQ ID NO: 196115 - protein, 9 aa, Artificial Sequence
  Description of Artificial Sequence: Synthetic peptide
  Seed: VVMGTLVAL (TYRP2_HUMAN)
VVMGTLVAI

SEQ ID NO: 196116 - protein, 9 aa, Artificial Sequence
  Description of Artificial Sequence: Synthetic peptide
  Seed: RFNPPADAW (TYRP2_HUMAN)
RMNPPADAY

SEQ ID NO: 196117 - protein, 10 aa, Artificial Sequence
  Description of Artificial Sequence: Synthetic peptide
  Seed: FLTSDQLGYS (TYRP2_HUMAN)
FLTSDQLGYT

SEQ ID NO: 196118 - protein, 10 aa, Artificial Sequence
  Description of Artificial Sequence: Synthetic peptide
  Seed: SPLWWGFLLS (TYRP2_HUMAN)
SRLWWGFLLA

SEQ ID NO: 196119 - protein, 10 aa, Artificial Sequence
  Description of Artificial Sequence: Synthetic peptide
  Seed: CMTVDSLVNK (TYRP2_HUMAN)
CTTVDSLVNR

SEQ ID NO: 196120 - protein, 10 aa, Artificial Sequence
  Description of Artificial Sequence: Synthetic peptide
  Seed: YNMVPFFPPV (TYRP2_HUMAN)
YCMVPFFPPM

SEQ ID NO: 196121 - protein, 9 aa, Artificial Sequence
  Description of Artificial Sequence: Synthetic peptide
  Seed: YAIDLPVSV (TYRP2_HUMAN)
YMIDLPVSR

SEQ ID NO: 196122 - protein, 9 aa, Artificial Sequence
  Description of Artificial Sequence: Synthetic peptide
  Seed: APIGHNRMY (TYRP2_HUMAN)
AQIGHNRMY

SEQ ID NO: 196123 - protein, 10 aa, Artificial Sequence
  Description of Artificial Sequence: Synthetic peptide
  Seed: RLRKGYTPLM (TYRP2_HUMAN)
RSRKGYTPLG

SEQ ID NO: 196124 - protein, 10 aa, Artificial Sequence
  Description of Artificial Sequence: Synthetic peptide
  Seed: QELAPIGHNR (TYRP2_HUMAN)
QVLAPIGHNK

SEQ ID NO: 196125 - protein, 9 aa, Artificial Sequence
  Description of Artificial Sequence: Synthetic peptide
  Seed: LQKFDNPPF (TYRP2_HUMAN)
LAKFDNPPM

SEQ ID NO: 196126 - protein, 10 aa, Artificial Sequence
  Description of Artificial Sequence: Synthetic peptide
  Seed: SPLWWGFLLS (TYRP2_HUMAN)
SILWWGFLLV

SEQ ID NO: 196127 - protein, 9 aa, Artificial Sequence
  Description of Artificial Sequence: Synthetic peptide
  Seed: YTPLMETHL (TYRP2_HUMAN)
YYPLMETHF

SEQ ID NO: 196128 - protein, 9 aa, Artificial Sequence
  Description of Artificial Sequence: Synthetic peptide
  Seed: RRLRKGYTP (TYRP2_HUMAN)
RQLRKGYTF

SEQ ID NO: 196129 - protein, 10 aa, Artificial Sequence
  Description of Artificial Sequence: Synthetic peptide
  Seed: ESANVCGSQQ (TYRP2_HUMAN)
ETANVCGSQK

SEQ ID NO: 196130 - protein, 10 aa, Artificial Sequence
  Description of Artificial Sequence: Synthetic peptide
  Seed: LGPNGTQPQF (TYRP2_HUMAN)
LAPNGTQPQY

SEQ ID NO: 196131 - protein, 9 aa, Artificial Sequence
  Description of Artificial Sequence: Synthetic peptide
  Seed: VLHSFTDAI (TYRP2_HUMAN)
VSHSFTDAL

SEQ ID NO: 196132 - protein, 10 aa, Artificial Sequence
  Description of Artificial Sequence: Synthetic peptide
  Seed: IDFSHQGPAF (TYRP2_HUMAN)
IAFSHQGPAL

SEQ ID NO: 196133 - protein, 10 aa, Artificial Sequence
  Description of Artificial Sequence: Synthetic peptide
  Seed: YNMVPFFPPV (TYRP2_HUMAN)
YHMVPFFPPT

SEQ ID NO: 196134 - protein, 11 aa, Artificial Sequence
  Description of Artificial Sequence: Synthetic peptide
  Seed: KADGTLDSQVM (TYRP2_HUMAN)
KMDGTLDSQVL

SEQ ID NO: 196135 - protein, 9 aa, Artificial Sequence
  Description of Artificial Sequence: Synthetic peptide
  Seed: FANCSVYDF (TYRP2_HUMAN)
FFNCSVYDF

SEQ ID NO: 196136 - protein, 10 aa, Artificial Sequence
  Description of Artificial Sequence: Synthetic peptide
  Seed: RLRKGYTPLM (TYRP2_HUMAN)
RFRKGYTPLK

SEQ ID NO: 196137 - protein, 9 aa, Artificial Sequence
  Description of Artificial Sequence: Synthetic peptide
  Seed: RFNPPADAW (TYRP2_HUMAN)
RGNPPADAW

SEQ ID NO: 196138 - protein, 9 aa, Artificial Sequence
  Description of Artificial Sequence: Synthetic peptide
  Seed: YSYAIDLPV (TYRP2_HUMAN)
YIYAIDLPM

SEQ ID NO: 196139 - protein, 8 aa, Artificial Sequence
  Description of Artificial Sequence: Synthetic peptide
  Seed: TFSFRNAL (TYRP2_HUMAN)
TYSFRNAF

SEQ ID NO: 196140 - protein, 10 aa, Artificial Sequence
  Description of Artificial Sequence: Synthetic peptide
  Seed: YAIDLPVSVE (TYRP2_HUMAN)
YLIDLPVSVD

SEQ ID NO: 196141 - protein, 11 aa, Artificial Sequence
  Description of Artificial Sequence: Synthetic peptide
  Seed: RNSRFSSWETV (TYRP2_HUMAN)
RRSRFSSWETI

SEQ ID NO: 196142 - protein, 11 aa, Artificial Sequence
  Description of Artificial Sequence: Synthetic peptide
  Seed: LLVVMGTLVAL (TYRP2_HUMAN)
LMVVMGTLVAI

SEQ ID NO: 196143 - protein, 9 aa, Artificial Sequence
  Description of Artificial Sequence: Synthetic peptide
  Seed: SHQGPAFVT (TYRP2_HUMAN)
SHQGPAFVF

SEQ ID NO: 196144 - protein, 9 aa, Artificial Sequence
  Description of Artificial Sequence: Synthetic peptide
  Seed: TLLGPGRPY (TYRP2_HUMAN)
TQLGPGRPW

SEQ ID NO: 196145 - protein, 9 aa, Artificial Sequence
  Description of Artificial Sequence: Synthetic peptide
  Seed: VIRQNIHSL (TYRP2_HUMAN)
VQRQNIHSM

SEQ ID NO: 196146 - protein, 10 aa, Artificial Sequence
  Description of Artificial Sequence: Synthetic peptide
  Seed: RPWSGPYILR (TYRP2_HUMAN)
RLWSGPYILK

SEQ ID NO: 196147 - protein, 10 aa, Artificial Sequence
  Description of Artificial Sequence: Synthetic peptide
  Seed: FVVLHSFTDA (TYRP2_HUMAN)
FGVLHSFTDV

SEQ ID NO: 196148 - protein, 9 aa, Artificial Sequence
  Description of Artificial Sequence: Synthetic peptide
  Seed: HSAANDPIF (TYRP2_HUMAN)
HIAANDPIY

SEQ ID NO: 196149 - protein, 9 aa, Artificial Sequence
  Description of Artificial Sequence: Synthetic peptide
  Seed: YSYAIDLPV (TYRP2_HUMAN)
YKYAIDLPM

SEQ ID NO: 196150 - protein, 9 aa, Artificial Sequence
  Description of Artificial Sequence: Synthetic peptide
  Seed: DQLGYSYAI (TYRP2_HUMAN)
DKLGYSYAL

SEQ ID NO: 196151 - protein, 9 aa, Artificial Sequence
  Description of Artificial Sequence: Synthetic peptide
  Seed: ITTQHWLGL (TYRP2_HUMAN)
IMTQHWLGI

SEQ ID NO: 196152 - protein, 11 aa, Artificial Sequence
  Description of Artificial Sequence: Synthetic peptide
  Seed: RADTRPWSGPY (TYRP2_HUMAN)
RRDTRPWSGPK

SEQ ID NO: 196153 - protein, 9 aa, Artificial Sequence
  Description of Artificial Sequence: Synthetic peptide
  Seed: VTWHRYHLL (TYRP2_HUMAN)
VIWHRYHLF

SEQ ID NO: 196154 - protein, 9 aa, Artificial Sequence
  Description of Artificial Sequence: Synthetic peptide
  Seed: FVWLHYYSV (TYRP2_HUMAN)
FAWLHYYSF

SEQ ID NO: 196155 - protein, 9 aa, Artificial Sequence
  Description of Artificial Sequence: Synthetic peptide
  Seed: ANCSVYDFF (TYRP2_HUMAN)
ATCSVYDFF

SEQ ID NO: 196156 - protein, 10 aa, Artificial Sequence
  Description of Artificial Sequence: Synthetic peptide
  Seed: MSLHNLVHSF (TYRP2_HUMAN)
MTLHNLVHSY

SEQ ID NO: 196157 - protein, 9 aa, Artificial Sequence
  Description of Artificial Sequence: Synthetic peptide
  Seed: FVWLHYYSV (TYRP2_HUMAN)
FTWLHYYSK

SEQ ID NO: 196158 - protein, 10 aa, Artificial Sequence
  Description of Artificial Sequence: Synthetic peptide
  Seed: YNMVPFFPPV (TYRP2_HUMAN)
YTMVPFFPPL

SEQ ID NO: 196159 - protein, 10 aa, Artificial Sequence
  Description of Artificial Sequence: Synthetic peptide
  Seed: MGTLVALVGL (TYRP2_HUMAN)
MTTLVALVGV

SEQ ID NO: 196160 - protein, 10 aa, Artificial Sequence
  Description of Artificial Sequence: Synthetic peptide
  Seed: SDQLGYSYAI (TYRP2_HUMAN)
SNQLGYSYAY

SEQ ID NO: 196161 - protein, 10 aa, Artificial Sequence
  Description of Artificial Sequence: Synthetic peptide
  Seed: LVALVGLFVL (TYRP2_HUMAN)
LIALVGLFVV

SEQ ID NO: 196162 - protein, 9 aa, Artificial Sequence
  Description of Artificial Sequence: Synthetic peptide
  Seed: FFQNSTFSF (TYRP2_HUMAN)
FSQNSTFSI

SEQ ID NO: 196163 - protein, 10 aa, Artificial Sequence
  Description of Artificial Sequence: Synthetic peptide
  Seed: LTSDQLGYSY (TYRP2_HUMAN)
LSSDQLGYSY

SEQ ID NO: 196164 - protein, 9 aa, Artificial Sequence
  Description of Artificial Sequence: Synthetic peptide
  Seed: ANDPIFVVL (TYRP2_HUMAN)
APDPIFVVL

SEQ ID NO: 196165 - protein, 10 aa, Artificial Sequence
  Description of Artificial Sequence: Synthetic peptide
  Seed: RLIGNESFAL (TYRP2_HUMAN)
RVIGNESFAY

SEQ ID NO: 196166 - protein, 9 aa, Artificial Sequence
  Description of Artificial Sequence: Synthetic peptide
  Seed: VHPDYVITT (TYRP2_HUMAN)
VFPDYVITM

SEQ ID NO: 196167 - protein, 9 aa, Artificial Sequence
  Description of Artificial Sequence: Synthetic peptide
  Seed: FPPVTNEEL (TYRP2_HUMAN)
FPPVTNEEI

SEQ ID NO: 196168 - protein, 10 aa, Artificial Sequence
  Description of Artificial Sequence: Synthetic peptide
  Seed: GTLDSQVMSL (TYRP2_HUMAN)
GVLDSQVMSV

SEQ ID NO: 196169 - protein, 9 aa, Artificial Sequence
  Description of Artificial Sequence: Synthetic peptide
  Seed: HQGPAFVTW (TYRP2_HUMAN)
HDGPAFVTL

SEQ ID NO: 196170 - protein, 10 aa, Artificial Sequence
  Description of Artificial Sequence: Synthetic peptide
  Seed: PFFQNSTFSF (TYRP2_HUMAN)
PMFQNSTFSY

SEQ ID NO: 196171 - protein, 11 aa, Artificial Sequence
  Description of Artificial Sequence: Synthetic peptide
  Seed: SLDDYNHLVTL (TYRP2_HUMAN)
SLDDYNHLVTA

SEQ ID NO: 196172 - protein, 10 aa, Artificial Sequence
  Description of Artificial Sequence: Synthetic peptide
  Seed: LHYYSVRDTL (TYRP2_HUMAN)
LNYYSVRDTI

SEQ ID NO: 196173 - protein, 9 aa, Artificial Sequence
  Description of Artificial Sequence: Synthetic peptide
  Seed: VMGTLVALV (TYRP2_HUMAN)
VLGTLVALV

SEQ ID NO: 196174 - protein, 9 aa, Artificial Sequence
  Description of Artificial Sequence: Synthetic peptide
  Seed: DSLDDYNHL (TYRP2_HUMAN)
DVLDDYNHF

SEQ ID NO: 196175 - protein, 9 aa, Artificial Sequence
  Description of Artificial Sequence: Synthetic peptide
  Seed: SLHNLVHSF (TYRP2_HUMAN)
SEHNLVHSY

SEQ ID NO: 196176 - protein, 9 aa, Artificial Sequence
  Description of Artificial Sequence: Synthetic peptide
  Seed: APIGHNRMY (TYRP2_HUMAN)
AAIGHNRMM

SEQ ID NO: 196177 - protein, 10 aa, Artificial Sequence
  Description of Artificial Sequence: Synthetic peptide
  Seed: FGWTGPNCER (TYRP2_HUMAN)
FAWTGPNCER

SEQ ID NO: 196178 - protein, 10 aa, Artificial Sequence
  Description of Artificial Sequence: Synthetic peptide
  Seed: LAFLQYRRLR (TYRP2_HUMAN)
LQFLQYRRLR

SEQ ID NO: 196179 - protein, 9 aa, Artificial Sequence
  Description of Artificial Sequence: Synthetic peptide
  Seed: RVHPDYVIT (TYRP2_HUMAN)
RTHPDYVIV

SEQ ID NO: 196180 - protein, 8 aa, Artificial Sequence
  Description of Artificial Sequence: Synthetic peptide
  Seed: AIDLPVSV (TYRP2_HUMAN)
ALDLPVSF

SEQ ID NO: 196181 - protein, 10 aa, Artificial Sequence
  Description of Artificial Sequence: Synthetic peptide
  Seed: FFVWLHYYSV (TYRP2_HUMAN)
FLVWLHYYST

SEQ ID NO: 196182 - protein, 10 aa, Artificial Sequence
  Description of Artificial Sequence: Synthetic peptide
  Seed: FFQNSTFSFR (TYRP2_HUMAN)
FYQNSTFSFK

SEQ ID NO: 196183 - protein, 9 aa, Artificial Sequence
  Description of Artificial Sequence: Synthetic peptide
  Seed: RLRKGYTPL (TYRP2_HUMAN)
RSRKGYTPL

SEQ ID NO: 196184 - protein, 10 aa, Artificial Sequence
  Description of Artificial Sequence: Synthetic peptide
  Seed: SPLWWGFLLS (TYRP2_HUMAN)
SCLWWGFLLL

SEQ ID NO: 196185 - protein, 9 aa, Artificial Sequence
  Description of Artificial Sequence: Synthetic peptide
  Seed: TTLLVVMGT (TYRP2_HUMAN)
TALLVVMGV

SEQ ID NO: 196186 - protein, 10 aa, Artificial Sequence
  Description of Artificial Sequence: Synthetic peptide
  Seed: YDFFVWLHYY (TYRP2_HUMAN)
YMFFVWLHYD

SEQ ID NO: 196187 - protein, 9 aa, Artificial Sequence
  Description of Artificial Sequence: Synthetic peptide
  Seed: GTNALPHSA (TYRP2_HUMAN)
GMNALPHSL

SEQ ID NO: 196188 - protein, 10 aa, Artificial Sequence
  Description of Artificial Sequence: Synthetic peptide
  Seed: FGWTGPNCER (TYRP2_HUMAN)
FTWTGPNCEY

SEQ ID NO: 196189 - protein, 9 aa, Artificial Sequence
  Description of Artificial Sequence: Synthetic peptide
  Seed: SFALPYWNF (TYRP2_HUMAN)
SYALPYWNY

SEQ ID NO: 196190 - protein, 9 aa, Artificial Sequence
  Description of Artificial Sequence: Synthetic peptide
  Seed: NALEGFDKA (TYRP2_HUMAN)
NVLEGFDKA

SEQ ID NO: 196191 - protein, 9 aa, Artificial Sequence
  Description of Artificial Sequence: Synthetic peptide
  Seed: ELWPRKFFH (TYRP2_HUMAN)
ETWPRKFFK

SEQ ID NO: 196192 - protein, 10 aa, Artificial Sequence
  Description of Artificial Sequence: Synthetic peptide
  Seed: MGRNSMKLPT (TYRP2_HUMAN)
MMRNSMKLPA

SEQ ID NO: 196193 - protein, 11 aa, Artificial Sequence
  Description of Artificial Sequence: Synthetic peptide
  Seed: FVVLHSFTDAI (TYRP2_HUMAN)
FCVLHSFTDAV

SEQ ID NO: 196194 - protein, 9 aa, Artificial Sequence
  Description of Artificial Sequence: Synthetic peptide
  Seed: FFPPVTNEE (TYRP2_HUMAN)
FFPPVTNEY

SEQ ID NO: 196195 - protein, 9 aa, Artificial Sequence
  Description of Artificial Sequence: Synthetic peptide
  Seed: ANDPIFVVL (TYRP2_HUMAN)
ASDPIFVVM

SEQ ID NO: 196196 - protein, 9 aa, Artificial Sequence
  Description of Artificial Sequence: Synthetic peptide
  Seed: LHSFTDAIF (TYRP2_HUMAN)
LKSFTDAIL

SEQ ID NO: 196197 - protein, 9 aa, Artificial Sequence
  Description of Artificial Sequence: Synthetic peptide
  Seed: FSHQGPAFV (TYRP2_HUMAN)
FQHQGPAFY

SEQ ID NO: 196198 - protein, 10 aa, Artificial Sequence
  Description of Artificial Sequence: Synthetic peptide
  Seed: TVDSLVNKEC (TYRP2_HUMAN)
TADSLVNKEI

SEQ ID NO: 196199 - protein, 10 aa, Artificial Sequence
  Description of Artificial Sequence: Synthetic peptide
  Seed: LQKFDNPPFF (TYRP2_HUMAN)
LHKFDNPPFY

SEQ ID NO: 196200 - protein, 11 aa, Artificial Sequence
  Description of Artificial Sequence: Synthetic peptide
  Seed: FVVLHSFTDAI (TYRP2_HUMAN)
FHVLHSFTDAV

SEQ ID NO: 196201 - protein, 10 aa, Artificial Sequence
  Description of Artificial Sequence: Synthetic peptide
  Seed: RMYNMVPFFP (TYRP2_HUMAN)
RHYNMVPFFF

SEQ ID NO: 196202 - protein, 9 aa, Artificial Sequence
  Description of Artificial Sequence: Synthetic peptide
  Seed: DFFVWLHYY (TYRP2_HUMAN)
DNFVWLHYR

SEQ ID NO: 196203 - protein, 9 aa, Artificial Sequence
  Description of Artificial Sequence: Synthetic peptide
  Seed: RKFFHRTCK (TYRP2_HUMAN)
RVFFHRTCI

SEQ ID NO: 196204 - protein, 10 aa, Artificial Sequence
  Description of Artificial Sequence: Synthetic peptide
  Seed: SDQLGYSYAI (TYRP2_HUMAN)
SQQLGYSYAL

SEQ ID NO: 196205 - protein, 10 aa, Artificial Sequence
  Description of Artificial Sequence: Synthetic peptide
  Seed: QELAPIGHNR (TYRP2_HUMAN)
QILAPIGHNR

SEQ ID NO: 196206 - protein, 10 aa, Artificial Sequence
  Description of Artificial Sequence: Synthetic peptide
  Seed: RMYNMVPFFP (TYRP2_HUMAN)
RLYNMVPFFC

SEQ ID NO: 196207 - protein, 9 aa, Artificial Sequence
  Description of Artificial Sequence: Synthetic peptide
  Seed: WPQELAPIG (TYRP2_HUMAN)
WVQELAPIY

SEQ ID NO: 196208 - protein, 9 aa, Artificial Sequence
  Description of Artificial Sequence: Synthetic peptide
  Seed: GTNALPHSA (TYRP2_HUMAN)
GMNALPHSI

SEQ ID NO: 196209 - protein, 10 aa, Artificial Sequence
  Description of Artificial Sequence: Synthetic peptide
  Seed: RTCKCTGNFA (TYRP2_HUMAN)
RTCKCTGNFV

SEQ ID NO: 196210 - protein, 9 aa, Artificial Sequence
  Description of Artificial Sequence: Synthetic peptide
  Seed: SQVMSLHNL (TYRP2_HUMAN)
SLVMSLHNM

SEQ ID NO: 196211 - protein, 9 aa, Artificial Sequence
  Description of Artificial Sequence: Synthetic peptide
  Seed: DQLGYSYAI (TYRP2_HUMAN)
DVLGYSYAL

SEQ ID NO: 196212 - protein, 9 aa, Artificial Sequence
  Description of Artificial Sequence: Synthetic peptide
  Seed: SLDDYNHLV (TYRP2_HUMAN)
SQDDYNHLY

SEQ ID NO: 196213 - protein, 9 aa, Artificial Sequence
  Description of Artificial Sequence: Synthetic peptide
  Seed: VVMGTLVAL (TYRP2_HUMAN)
VPMGTLVAW

SEQ ID NO: 196214 - protein, 9 aa, Artificial Sequence
  Description of Artificial Sequence: Synthetic peptide
  Seed: LHSFTDAIF (TYRP2_HUMAN)
LHSFTDAII

SEQ ID NO: 196215 - protein, 9 aa, Artificial Sequence
  Description of Artificial Sequence: Synthetic peptide
  Seed: RLRKGYTPL (TYRP2_HUMAN)
RKRKGYTPF

SEQ ID NO: 196216 - protein, 9 aa, Artificial Sequence
  Description of Artificial Sequence: Synthetic peptide
  Seed: AWPQELAPI (TYRP2_HUMAN)
AYPQELAPW

SEQ ID NO: 196217 - protein, 10 aa, Artificial Sequence
  Description of Artificial Sequence: Synthetic peptide
  Seed: SLVNKECCPR (TYRP2_HUMAN)
SFVNKECCPR

SEQ ID NO: 196218 - protein, 9 aa, Artificial Sequence
  Description of Artificial Sequence: Synthetic peptide
  Seed: FFPPVTNEE (TYRP2_HUMAN)
FMPPVTNEF

SEQ ID NO: 196219 - protein, 9 aa, Artificial Sequence
  Description of Artificial Sequence: Synthetic peptide
  Seed: DFFVWLHYY (TYRP2_HUMAN)
DVFVWLHYR

SEQ ID NO: 196220 - protein, 10 aa, Artificial Sequence
  Description of Artificial Sequence: Synthetic peptide
  Seed: NLVHSFLNGT (TYRP2_HUMAN)
NMVHSFLNGL

SEQ ID NO: 196221 - protein, 9 aa, Artificial Sequence
  Description of Artificial Sequence: Synthetic peptide
  Seed: VMGTLVALV (TYRP2_HUMAN)
VLGTLVALM

SEQ ID NO: 196222 - protein, 10 aa, Artificial Sequence
  Description of Artificial Sequence: Synthetic peptide
  Seed: VVMGTLVALV (TYRP2_HUMAN)
VMMGTLVALR

SEQ ID NO: 196223 - protein, 9 aa, Artificial Sequence
  Description of Artificial Sequence: Synthetic peptide
  Seed: FSHQGPAFV (TYRP2_HUMAN)
FYHQGPAFF

SEQ ID NO: 196224 - protein, 11 aa, Artificial Sequence
  Description of Artificial Sequence: Synthetic peptide
  Seed: FFPPVTNEELF (TYRP2_HUMAN)
FRPPVTNEELY

SEQ ID NO: 196225 - protein, 10 aa, Artificial Sequence
  Description of Artificial Sequence: Synthetic peptide
  Seed: NSTFSFRNAL (TYRP2_HUMAN)
NFTFSFRNAL

SEQ ID NO: 196226 - protein, 11 aa, Artificial Sequence
  Description of Artificial Sequence: Synthetic peptide
  Seed: PFFQNSTFSFR (TYRP2_HUMAN)
PIFQNSTFSFR

SEQ ID NO: 196227 - protein, 10 aa, Artificial Sequence
  Description of Artificial Sequence: Synthetic peptide
  Seed: VVMGTLVALV (TYRP2_HUMAN)
VAMGTLVALV

SEQ ID NO: 196228 - protein, 9 aa, Artificial Sequence
  Description of Artificial Sequence: Synthetic peptide
  Seed: SLHNLVHSF (TYRP2_HUMAN)
SSHNLVHSI

SEQ ID NO: 196229 - protein, 9 aa, Artificial Sequence
  Description of Artificial Sequence: Synthetic peptide
  Seed: FTDAIFDEW (TYRP2_HUMAN)
FVDAIFDEF

SEQ ID NO: 196230 - protein, 10 aa, Artificial Sequence
  Description of Artificial Sequence: Synthetic peptide
  Seed: HSFLNGTNAL (TYRP2_HUMAN)
HRFLNGTNAF

SEQ ID NO: 196231 - protein, 10 aa, Artificial Sequence
  Description of Artificial Sequence: Synthetic peptide
  Seed: LVVMGTLVAL (TYRP2_HUMAN)
LKVMGTLVAL

SEQ ID NO: 196232 - protein, 9 aa, Artificial Sequence
  Description of Artificial Sequence: Synthetic peptide
  Seed: APIGHNRMY (TYRP2_HUMAN)
APIGHNRMA

SEQ ID NO: 196233 - protein, 8 aa, Artificial Sequence
  Description of Artificial Sequence: Synthetic peptide
  Seed: FQNSTFSF (TYRP2_HUMAN)
FANSTFSF

SEQ ID NO: 196234 - protein, 8 aa, Artificial Sequence
  Description of Artificial Sequence: Synthetic peptide
  Seed: RLIGNESF (TYRP2_HUMAN)
RMIGNESF

SEQ ID NO: 196235 - protein, 9 aa, Artificial Sequence
  Description of Artificial Sequence: Synthetic peptide
  Seed: VTWHRYHLL (TYRP2_HUMAN)
VTWHRYHLK

SEQ ID NO: 196236 - protein, 9 aa, Artificial Sequence
  Description of Artificial Sequence: Synthetic peptide
  Seed: MSPLWWGFL (TYRP2_HUMAN)
MFPLWWGFW

SEQ ID NO: 196237 - protein, 10 aa, Artificial Sequence
  Description of Artificial Sequence: Synthetic peptide
  Seed: MSPLWWGFLL (TYRP2_HUMAN)
MCPLWWGFLF

SEQ ID NO: 196238 - protein, 9 aa, Artificial Sequence
  Description of Artificial Sequence: Synthetic peptide
  Seed: STFSFRNAL (TYRP2_HUMAN)
SAFSFRNAF

SEQ ID NO: 196239 - protein, 10 aa, Artificial Sequence
  Description of Artificial Sequence: Synthetic peptide
  Seed: SQVMSLHNLV (TYRP2_HUMAN)
STVMSLHNLV

SEQ ID NO: 196240 - protein, 9 aa, Artificial Sequence
  Description of Artificial Sequence: Synthetic peptide
  Seed: DSLDDYNHL (TYRP2_HUMAN)
DTLDDYNHV

SEQ ID NO: 196241 - protein, 9 aa, Artificial Sequence
  Description of Artificial Sequence: Synthetic peptide
  Seed: GPNGTQPQF (TYRP2_HUMAN)
GQNGTQPQF

SEQ ID NO: 196242 - protein, 9 aa, Artificial Sequence
  Description of Artificial Sequence: Synthetic peptide
  Seed: ALPYWNFAT (TYRP2_HUMAN)
AIPYWNFAI

SEQ ID NO: 196243 - protein, 10 aa, Artificial Sequence
  Description of Artificial Sequence: Synthetic peptide
  Seed: SDQLGYSYAI (TYRP2_HUMAN)
SLQLGYSYAV

SEQ ID NO: 196244 - protein, 11 aa, Artificial Sequence
  Description of Artificial Sequence: Synthetic peptide
  Seed: YTPLMETHLSS (TYRP2_HUMAN)
YWPLMETHLSV

SEQ ID NO: 196245 - protein, 9 aa, Artificial Sequence
  Description of Artificial Sequence: Synthetic peptide
  Seed: SVYDFFVWL (TYRP2_HUMAN)
SGYDFFVWW

SEQ ID NO: 196246 - protein, 10 aa, Artificial Sequence
  Description of Artificial Sequence: Synthetic peptide
  Seed: SLDDYNHLVT (TYRP2_HUMAN)
SLDDYNHLVA

SEQ ID NO: 196247 - protein, 9 aa, Artificial Sequence
  Description of Artificial Sequence: Synthetic peptide
  Seed: LMETHLSSK (TYRP2_HUMAN)
LVETHLSSY

SEQ ID NO: 196248 - protein, 11 aa, Artificial Sequence
  Description of Artificial Sequence: Synthetic peptide
  Seed: LLAFLQYRRLR (TYRP2_HUMAN)
LFAFLQYRRLR

SEQ ID NO: 196249 - protein, 9 aa, Artificial Sequence
  Description of Artificial Sequence: Synthetic peptide
  Seed: EGLLRRNQM (TYRP2_HUMAN)
EALLRRNQL

SEQ ID NO: 196250 - protein, 11 aa, Artificial Sequence
  Description of Artificial Sequence: Synthetic peptide
  Seed: QRLIGNESFAL (TYRP2_HUMAN)
QYLIGNESFAL

SEQ ID NO: 196251 - protein, 10 aa, Artificial Sequence
  Description of Artificial Sequence: Synthetic peptide
  Seed: YNMVPFFPPV (TYRP2_HUMAN)
YRMVPFFPPM

SEQ ID NO: 196252 - protein, 9 aa, Artificial Sequence
  Description of Artificial Sequence: Synthetic peptide
  Seed: YTPLMETHL (TYRP2_HUMAN)
YYPLMETHM

SEQ ID NO: 196253 - protein, 10 aa, Artificial Sequence
  Description of Artificial Sequence: Synthetic peptide
  Seed: LHYYSVRDTL (TYRP2_HUMAN)
LEYYSVRDTY

SEQ ID NO: 196254 - protein, 9 aa, Artificial Sequence
  Description of Artificial Sequence: Synthetic peptide
  Seed: AANDPIFVV (TYRP2_HUMAN)
AGNDPIFVL

SEQ ID NO: 196255 - protein, 9 aa, Artificial Sequence
  Description of Artificial Sequence: Synthetic peptide
  Seed: TDQLFGAAR (TYRP2_HUMAN)
TFQLFGAAR

SEQ ID NO: 196256 - protein, 9 aa, Artificial Sequence
  Description of Artificial Sequence: Synthetic peptide
  Seed: SLHNLVHSF (TYRP2_HUMAN)
SAHNLVHSF

SEQ ID NO: 196257 - protein, 9 aa, Artificial Sequence
  Description of Artificial Sequence: Synthetic peptide
  Seed: GTYEGLLRR (TYRP2_HUMAN)
GMYEGLLRI

SEQ ID NO: 196258 - protein, 11 aa, Artificial Sequence
  Description of Artificial Sequence: Synthetic peptide
  Seed: YNMVPFFPPVT (TYRP2_HUMAN)
YQMVPFFPPVC

SEQ ID NO: 196259 - protein, 10 aa, Artificial Sequence
  Description of Artificial Sequence: Synthetic peptide
  Seed: AARPDDPTLI (TYRP2_HUMAN)
ASRPDDPTLY

SEQ ID NO: 196260 - protein, 9 aa, Artificial Sequence
  Description of Artificial Sequence: Synthetic peptide
  Seed: FVLLAFLQY (TYRP2_HUMAN)
FTLLAFLQK

SEQ ID NO: 196261 - protein, 9 aa, Artificial Sequence
  Description of Artificial Sequence: Synthetic peptide
  Seed: SPLWWGFLL (TYRP2_HUMAN)
SPLWWGFLA

SEQ ID NO: 196262 - protein, 9 aa, Artificial Sequence
  Description of Artificial Sequence: Synthetic peptide
  Seed: LLAFLQYRR (TYRP2_HUMAN)
LNAFLQYRR

SEQ ID NO: 196263 - protein, 9 aa, Artificial Sequence
  Description of Artificial Sequence: Synthetic peptide
  Seed: NRMYNMVPF (TYRP2_HUMAN)
NYMYNMVPI

SEQ ID NO: 196264 - protein, 10 aa, Artificial Sequence
  Description of Artificial Sequence: Synthetic peptide
  Seed: LHYYSVRDTL (TYRP2_HUMAN)
LLYYSVRDTI

SEQ ID NO: 196265 - protein, 9 aa, Artificial Sequence
  Description of Artificial Sequence: Synthetic peptide
  Seed: FTDAIFDEW (TYRP2_HUMAN)
FVDAIFDEI

SEQ ID NO: 196266 - protein, 11 aa, Artificial Sequence
  Description of Artificial Sequence: Synthetic peptide
  Seed: FFPPVTNEELF (TYRP2_HUMAN)
FTPPVTNEELY

SEQ ID NO: 196267 - protein, 10 aa, Artificial Sequence
  Description of Artificial Sequence: Synthetic peptide
  Seed: EETPGWPTTL (TYRP2_HUMAN)
EETPGWPTTA

SEQ ID NO: 196268 - protein, 10 aa, Artificial Sequence
  Description of Artificial Sequence: Synthetic peptide
  Seed: AARPDDPTLI (TYRP2_HUMAN)
ALRPDDPTLW

SEQ ID NO: 196269 - protein, 9 aa, Artificial Sequence
  Description of Artificial Sequence: Synthetic peptide
  Seed: LIGNESFAL (TYRP2_HUMAN)
LMGNESFAM

SEQ ID NO: 196270 - protein, 9 aa, Artificial Sequence
  Description of Artificial Sequence: Synthetic peptide
  Seed: IFDEWMKRF (TYRP2_HUMAN)
ITDEWMKRF

SEQ ID NO: 196271 - protein, 10 aa, Artificial Sequence
  Description of Artificial Sequence: Synthetic peptide
  Seed: KILPGAQGQF (TYRP2_HUMAN)
KILPGAQGQR

SEQ ID NO: 196272 - protein, 9 aa, Artificial Sequence
  Description of Artificial Sequence: Synthetic peptide
  Seed: EGLLRRNQM (TYRP2_HUMAN)
EILLRRNQL

SEQ ID NO: 196273 - protein, 10 aa, Artificial Sequence
  Description of Artificial Sequence: Synthetic peptide
  Seed: SLQKFDNPPF (TYRP2_HUMAN)
SKQKFDNPPF

SEQ ID NO: 196274 - protein, 11 aa, Artificial Sequence
  Description of Artificial Sequence: Synthetic peptide
  Seed: FVLLAFLQYRR (TYRP2_HUMAN)
FALLAFLQYRR

SEQ ID NO: 196275 - protein, 8 aa, Artificial Sequence
  Description of Artificial Sequence: Synthetic peptide
  Seed: RPDDPTLI (TYRP2_HUMAN)
RGDDPTLL

SEQ ID NO: 196276 - protein, 9 aa, Artificial Sequence
  Description of Artificial Sequence: Synthetic peptide
  Seed: SRFSSWETV (TYRP2_HUMAN)
SQFSSWETF

SEQ ID NO: 196277 - protein, 9 aa, Artificial Sequence
  Description of Artificial Sequence: Synthetic peptide
  Seed: YAIDLPVSV (TYRP2_HUMAN)
YEIDLPVSI

SEQ ID NO: 196278 - protein, 9 aa, Artificial Sequence
  Description of Artificial Sequence: Synthetic peptide
  Seed: ERKKPPVIR (TYRP2_HUMAN)
ELKKPPVIR

SEQ ID NO: 196279 - protein, 10 aa, Artificial Sequence
  Description of Artificial Sequence: Synthetic peptide
  Seed: VGLFVLLAFL (TYRP2_HUMAN)
VLLFVLLAFV

SEQ ID NO: 196280 - protein, 9 aa, Artificial Sequence
  Description of Artificial Sequence: Synthetic peptide
  Seed: SVYDFFVWL (TYRP2_HUMAN)
SYYDFFVWY

SEQ ID NO: 196281 - protein, 9 aa, Artificial Sequence
  Description of Artificial Sequence: Synthetic peptide
  Seed: RKFFHRTCK (TYRP2_HUMAN)
RVFFHRTCG

SEQ ID NO: 196282 - protein, 10 aa, Artificial Sequence
  Description of Artificial Sequence: Synthetic peptide
  Seed: GTLDSQVMSL (TYRP2_HUMAN)
GNLDSQVMSV

SEQ ID NO: 196283 - protein, 11 aa, Artificial Sequence
  Description of Artificial Sequence: Synthetic peptide
  Seed: YSYAIDLPVSV (TYRP2_HUMAN)
YLYAIDLPVSS

SEQ ID NO: 196284 - protein, 11 aa, Artificial Sequence
  Description of Artificial Sequence: Synthetic peptide
  Seed: RRLRKGYTPLM (TYRP2_HUMAN)
RRLRKGYTPLR

SEQ ID NO: 196285 - protein, 10 aa, Artificial Sequence
  Description of Artificial Sequence: Synthetic peptide
  Seed: MSLHNLVHSF (TYRP2_HUMAN)
MYLHNLVHSF

SEQ ID NO: 196286 - protein, 11 aa, Artificial Sequence
  Description of Artificial Sequence: Synthetic peptide
  Seed: RADTRPWSGPY (TYRP2_HUMAN)
RDDTRPWSGPF

SEQ ID NO: 196287 - protein, 10 aa, Artificial Sequence
  Description of Artificial Sequence: Synthetic peptide
  Seed: RLRKGYTPLM (TYRP2_HUMAN)
RGRKGYTPLK

SEQ ID NO: 196288 - protein, 9 aa, Artificial Sequence
  Description of Artificial Sequence: Synthetic peptide
  Seed: SFALPYWNF (TYRP2_HUMAN)
SWALPYWNL

SEQ ID NO: 196289 - protein, 9 aa, Artificial Sequence
  Description of Artificial Sequence: Synthetic peptide
  Seed: YAIDLPVSV (TYRP2_HUMAN)
YLIDLPVSC

SEQ ID NO: 196290 - protein, 9 aa, Artificial Sequence
  Description of Artificial Sequence: Synthetic peptide
  Seed: MTVDSLVNK (TYRP2_HUMAN)
MTVDSLVNL

SEQ ID NO: 196291 - protein, 9 aa, Artificial Sequence
  Description of Artificial Sequence: Synthetic peptide
  Seed: STFSFRNAL (TYRP2_HUMAN)
SCFSFRNAF

SEQ ID NO: 196292 - protein, 11 aa, Artificial Sequence
  Description of Artificial Sequence: Synthetic peptide
  Seed: RNSRFSSWETV (TYRP2_HUMAN)
RRSRFSSWETF

SEQ ID NO: 196293 - protein, 11 aa, Artificial Sequence
  Description of Artificial Sequence: Synthetic peptide
  Seed: TQPQFANCSVY (TYRP2_HUMAN)
TRPQFANCSVF

SEQ ID NO: 196294 - protein, 11 aa, Artificial Sequence
  Description of Artificial Sequence: Synthetic peptide
  Seed: YTPLMETHLSS (TYRP2_HUMAN)
YFPLMETHLSL

SEQ ID NO: 196295 - protein, 10 aa, Artificial Sequence
  Description of Artificial Sequence: Synthetic peptide
  Seed: LKDIRDCLSL (TYRP2_HUMAN)
LKDIRDCLSY

SEQ ID NO: 196296 - protein, 10 aa, Artificial Sequence
  Description of Artificial Sequence: Synthetic peptide
  Seed: NRMYNMVPFF (TYRP2_HUMAN)
NKMYNMVPFF

SEQ ID NO: 196297 - protein, 10 aa, Artificial Sequence
  Description of Artificial Sequence: Synthetic peptide
  Seed: IDFSHQGPAF (TYRP2_HUMAN)
ISFSHQGPAM

SEQ ID NO: 196298 - protein, 10 aa, Artificial Sequence
  Description of Artificial Sequence: Synthetic peptide
  Seed: SDQLGYSYAI (TYRP2_HUMAN)
SLQLGYSYAM

SEQ ID NO: 196299 - protein, 9 aa, Artificial Sequence
  Description of Artificial Sequence: Synthetic peptide
  Seed: DDYNHLVTL (TYRP2_HUMAN)
DGYNHLVTL

SEQ ID NO: 196300 - protein, 9 aa, Artificial Sequence
  Description of Artificial Sequence: Synthetic peptide
  Seed: KDIRDCLSL (TYRP2_HUMAN)
KMIRDCLSF

SEQ ID NO: 196301 - protein, 9 aa, Artificial Sequence
  Description of Artificial Sequence: Synthetic peptide
  Seed: RPWSGPYIL (TYRP2_HUMAN)
RRWSGPYIV

SEQ ID NO: 196302 - protein, 9 aa, Artificial Sequence
  Description of Artificial Sequence: Synthetic peptide
  Seed: ITTQHWLGL (TYRP2_HUMAN)
IVTQHWLGY

SEQ ID NO: 196303 - protein, 9 aa, Artificial Sequence
  Description of Artificial Sequence: Synthetic peptide
  Seed: YAIDLPVSV (TYRP2_HUMAN)
YFIDLPVSM

SEQ ID NO: 196304 - protein, 9 aa, Artificial Sequence
  Description of Artificial Sequence: Synthetic peptide
  Seed: NMVPFFPPV (TYRP2_HUMAN)
NIVPFFPPA

SEQ ID NO: 196305 - protein, 11 aa, Artificial Sequence
  Description of Artificial Sequence: Synthetic peptide
  Seed: YNMVPFFPPVT (TYRP2_HUMAN)
YMMVPFFPPVW

SEQ ID NO: 196306 - protein, 9 aa, Artificial Sequence
  Description of Artificial Sequence: Synthetic peptide
  Seed: YTPLMETHL (TYRP2_HUMAN)
YFPLMETHY

SEQ ID NO: 196307 - protein, 10 aa, Artificial Sequence
  Description of Artificial Sequence: Synthetic peptide
  Seed: RNSRFSSWET (TYRP2_HUMAN)
RESRFSSWEV

SEQ ID NO: 196308 - protein, 11 aa, Artificial Sequence
  Description of Artificial Sequence: Synthetic peptide
  Seed: RELWPRKFFHR (TYRP2_HUMAN)
RWLWPRKFFHK

SEQ ID NO: 196309 - protein, 9 aa, Artificial Sequence
  Description of Artificial Sequence: Synthetic peptide
  Seed: SLDDYNHLV (TYRP2_HUMAN)
SADDYNHLC

SEQ ID NO: 196310 - protein, 9 aa, Artificial Sequence
  Description of Artificial Sequence: Synthetic peptide
  Seed: NMVPFFPPV (TYRP2_HUMAN)
NWVPFFPPL

SEQ ID NO: 196311 - protein, 10 aa, Artificial Sequence
  Description of Artificial Sequence: Synthetic peptide
  Seed: ELWPRKFFHR (TYRP2_HUMAN)
EIWPRKFFHR

SEQ ID NO: 196312 - protein, 10 aa, Artificial Sequence
  Description of Artificial Sequence: Synthetic peptide
  Seed: TVDSLVNKEC (TYRP2_HUMAN)
TTDSLVNKEL

SEQ ID NO: 196313 - protein, 9 aa, Artificial Sequence
  Description of Artificial Sequence: Synthetic peptide
  Seed: FFQNSTFSF (TYRP2_HUMAN)
FYQNSTFSV

SEQ ID NO: 196314 - protein, 9 aa, Artificial Sequence
  Description of Artificial Sequence: Synthetic peptide
  Seed: YSYAIDLPV (TYRP2_HUMAN)
YPYAIDLPM

SEQ ID NO: 196315 - protein, 9 aa, Artificial Sequence
  Description of Artificial Sequence: Synthetic peptide
  Seed: FFQNSTFSF (TYRP2_HUMAN)
FMQNSTFSY

SEQ ID NO: 196316 - protein, 9 aa, Artificial Sequence
  Description of Artificial Sequence: Synthetic peptide
  Seed: LVTLCNGTY (TYRP2_HUMAN)
LTTLCNGTY

SEQ ID NO: 196317 - protein, 10 aa, Artificial Sequence
  Description of Artificial Sequence: Synthetic peptide
  Seed: LAFLQYRRLR (TYRP2_HUMAN)
LYFLQYRRLR

SEQ ID NO: 196318 - protein, 9 aa, Artificial Sequence
  Description of Artificial Sequence: Synthetic peptide
  Seed: MSPLWWGFL (TYRP2_HUMAN)
MYPLWWGFY

SEQ ID NO: 196319 - protein, 9 aa, Artificial Sequence
  Description of Artificial Sequence: Synthetic peptide
  Seed: SLHNLVHSF (TYRP2_HUMAN)
SHHNLVHSF

SEQ ID NO: 196320 - protein, 10 aa, Artificial Sequence
  Description of Artificial Sequence: Synthetic peptide
  Seed: VVLHSFTDAI (TYRP2_HUMAN)
VMLHSFTDAI

SEQ ID NO: 196321 - protein, 10 aa, Artificial Sequence
  Description of Artificial Sequence: Synthetic peptide
  Seed: YAIDLPVSVE (TYRP2_HUMAN)
YQIDLPVSVW

SEQ ID NO: 196322 - protein, 10 aa, Artificial Sequence
  Description of Artificial Sequence: Synthetic peptide
  Seed: GLFVLLAFLQ (TYRP2_HUMAN)
GMFVLLAFLV

SEQ ID NO: 196323 - protein, 10 aa, Artificial Sequence
  Description of Artificial Sequence: Synthetic peptide
  Seed: FPPVTNEELF (TYRP2_HUMAN)
FYPVTNEELY

SEQ ID NO: 196324 - protein, 10 aa, Artificial Sequence
  Description of Artificial Sequence: Synthetic peptide
  Seed: SHQGPAFVTW (TYRP2_HUMAN)
SQQGPAFVTM

SEQ ID NO: 196325 - protein, 10 aa, Artificial Sequence
  Description of Artificial Sequence: Synthetic peptide
  Seed: HNRMYNMVPF (TYRP2_HUMAN)
HPRMYNMVPF

SEQ ID NO: 196326 - protein, 9 aa, Artificial Sequence
  Description of Artificial Sequence: Synthetic peptide
  Seed: CERKKPPVI (TYRP2_HUMAN)
CVRKKPPVL

SEQ ID NO: 196327 - protein, 10 aa, Artificial Sequence
  Description of Artificial Sequence: Synthetic peptide
  Seed: VVMGTLVALV (TYRP2_HUMAN)
VTMGTLVALI

SEQ ID NO: 196328 - protein, 10 aa, Artificial Sequence
  Description of Artificial Sequence: Synthetic peptide
  Seed: ELWPRKFFHR (TYRP2_HUMAN)
EGWPRKFFHR

SEQ ID NO: 196329 - protein, 9 aa, Artificial Sequence
  Description of Artificial Sequence: Synthetic peptide
  Seed: VVMGTLVAL (TYRP2_HUMAN)
VRMGTLVAI

SEQ ID NO: 196330 - protein, 9 aa, Artificial Sequence
  Description of Artificial Sequence: Synthetic peptide
  Seed: HSAANDPIF (TYRP2_HUMAN)
HAAANDPIW

SEQ ID NO: 196331 - protein, 9 aa, Artificial Sequence
  Description of Artificial Sequence: Synthetic peptide
  Seed: FTDAIFDEW (TYRP2_HUMAN)
FTDAIFDEY

SEQ ID NO: 196332 - protein, 10 aa, Artificial Sequence
  Description of Artificial Sequence: Synthetic peptide
  Seed: RMYNMVPFFP (TYRP2_HUMAN)
RLYNMVPFFT

SEQ ID NO: 196333 - protein, 10 aa, Artificial Sequence
  Description of Artificial Sequence: Synthetic peptide
  Seed: RPWSGPYILR (TYRP2_HUMAN)
RMWSGPYILR

SEQ ID NO: 196334 - protein, 9 aa, Artificial Sequence
  Description of Artificial Sequence: Synthetic peptide
  Seed: QVMSLHNLV (TYRP2_HUMAN)
QMMSLHNLA

SEQ ID NO: 196335 - protein, 9 aa, Artificial Sequence
  Description of Artificial Sequence: Synthetic peptide
  Seed: WMKRFNPPA (TYRP2_HUMAN)
WQKRFNPPL

SEQ ID NO: 196336 - protein, 8 aa, Artificial Sequence
  Description of Artificial Sequence: Synthetic peptide
  Seed: NSMKLPTL (TYRP2_HUMAN)
NPMKLPTI

SEQ ID NO: 196337 - protein, 11 aa, Artificial Sequence
  Description of Artificial Sequence: Synthetic peptide
  Seed: HPDYVITTQHW (TYRP2_HUMAN)
HFDYVITTQHF

SEQ ID NO: 196338 - protein, 11 aa, Artificial Sequence
  Description of Artificial Sequence: Synthetic peptide
  Seed: YTPLMETHLSS (TYRP2_HUMAN)
YPPLMETHLSV

SEQ ID NO: 196339 - protein, 9 aa, Artificial Sequence
  Description of Artificial Sequence: Synthetic peptide
  Seed: ETPGWPTTL (TYRP2_HUMAN)
ESPGWPTTK

SEQ ID NO: 196340 - protein, 10 aa, Artificial Sequence
  Description of Artificial Sequence: Synthetic peptide
  Seed: RMYNMVPFFP (TYRP2_HUMAN)
RAYNMVPFFW

SEQ ID NO: 196341 - protein, 9 aa, Artificial Sequence
  Description of Artificial Sequence: Synthetic peptide
  Seed: FSHQGPAFV (TYRP2_HUMAN)
FTHQGPAFI

SEQ ID NO: 196342 - protein, 8 aa, Artificial Sequence
  Description of Artificial Sequence: Synthetic peptide
  Seed: YYSVRDTL (TYRP2_HUMAN)
YYSVRDTM

SEQ ID NO: 196343 - protein, 9 aa, Artificial Sequence
  Description of Artificial Sequence: Synthetic peptide
  Seed: FSHQGPAFV (TYRP2_HUMAN)
FTHQGPAFF

SEQ ID NO: 196344 - protein, 9 aa, Artificial Sequence
  Description of Artificial Sequence: Synthetic peptide
  Seed: NRMYNMVPF (TYRP2_HUMAN)
NMMYNMVPL

SEQ ID NO: 196345 - protein, 10 aa, Artificial Sequence
  Description of Artificial Sequence: Synthetic peptide
  Seed: SLQKFDNPPF (TYRP2_HUMAN)
SVQKFDNPPF

SEQ ID NO: 196346 - protein, 10 aa, Artificial Sequence
  Description of Artificial Sequence: Synthetic peptide
  Seed: NGTYEGLLRR (TYRP2_HUMAN)
NITYEGLLRK

SEQ ID NO: 196347 - protein, 9 aa, Artificial Sequence
  Description of Artificial Sequence: Synthetic peptide
  Seed: FVWLHYYSV (TYRP2_HUMAN)
FMWLHYYSF

SEQ ID NO: 196348 - protein, 9 aa, Artificial Sequence
  Description of Artificial Sequence: Synthetic peptide
  Seed: VMSLHNLVH (TYRP2_HUMAN)
VLSLHNLVK

SEQ ID NO: 196349 - protein, 10 aa, Artificial Sequence
  Description of Artificial Sequence: Synthetic peptide
  Seed: CSVYDFFVWL (TYRP2_HUMAN)
CAVYDFFVWW

SEQ ID NO: 196350 - protein, 10 aa, Artificial Sequence
  Description of Artificial Sequence: Synthetic peptide
  Seed: FLTSDQLGYS (TYRP2_HUMAN)
FLTSDQLGYI

SEQ ID NO: 196351 - protein, 10 aa, Artificial Sequence
  Description of Artificial Sequence: Synthetic peptide
  Seed: KILPGAQGQF (TYRP2_HUMAN)
KGLPGAQGQW

SEQ ID NO: 196352 - protein, 9 aa, Artificial Sequence
  Description of Artificial Sequence: Synthetic peptide
  Seed: YDFFVWLHY (TYRP2_HUMAN)
YLFFVWLHF

SEQ ID NO: 196353 - protein, 10 aa, Artificial Sequence
  Description of Artificial Sequence: Synthetic peptide
  Seed: ESANVCGSQQ (TYRP2_HUMAN)
EIANVCGSQK

SEQ ID NO: 196354 - protein, 9 aa, Artificial Sequence
  Description of Artificial Sequence: Synthetic peptide
  Seed: STFSFRNAL (TYRP2_HUMAN)
SIFSFRNAV

SEQ ID NO: 196355 - protein, 10 aa, Artificial Sequence
  Description of Artificial Sequence: Synthetic peptide
  Seed: SYAIDLPVSV (TYRP2_HUMAN)
SYAIDLPVSF

SEQ ID NO: 196356 - protein, 10 aa, Artificial Sequence
  Description of Artificial Sequence: Synthetic peptide
  Seed: FLTSDQLGYS (TYRP2_HUMAN)
FMTSDQLGYM

SEQ ID NO: 196357 - protein, 9 aa, Artificial Sequence
  Description of Artificial Sequence: Synthetic peptide
  Seed: YVITTQHWL (TYRP2_HUMAN)
YIITTQHWL

SEQ ID NO: 196358 - protein, 9 aa, Artificial Sequence
  Description of Artificial Sequence: Synthetic peptide
  Seed: RYHLLCLER (TYRP2_HUMAN)
RMHLLCLER

SEQ ID NO: 196359 - protein, 10 aa, Artificial Sequence
  Description of Artificial Sequence: Synthetic peptide
  Seed: TLLGPGRPYR (TYRP2_HUMAN)
TSLGPGRPYK

SEQ ID NO: 196360 - protein, 9 aa, Artificial Sequence
  Description of Artificial Sequence: Synthetic peptide
  Seed: TLDSQVMSL (TYRP2_HUMAN)
TGDSQVMSV

SEQ ID NO: 196361 - protein, 10 aa, Artificial Sequence
  Description of Artificial Sequence: Synthetic peptide
  Seed: RNQMGRNSMK (TYRP2_HUMAN)
RAQMGRNSMR

SEQ ID NO: 196362 - protein, 11 aa, Artificial Sequence
  Description of Artificial Sequence: Synthetic peptide
  Seed: RNSRFSSWETV (TYRP2_HUMAN)
RISRFSSWETL

SEQ ID NO: 196363 - protein, 11 aa, Artificial Sequence
  Description of Artificial Sequence: Synthetic peptide
  Seed: YSYAIDLPVSV (TYRP2_HUMAN)
YMYAIDLPVSM

SEQ ID NO: 196364 - protein, 9 aa, Artificial Sequence
  Description of Artificial Sequence: Synthetic peptide
  Seed: RMYNMVPFF (TYRP2_HUMAN)
RYYNMVPFK

SEQ ID NO: 196365 - protein, 10 aa, Artificial Sequence
  Description of Artificial Sequence: Synthetic peptide
  Seed: IGNESFALPY (TYRP2_HUMAN)
IENESFALPY

SEQ ID NO: 196366 - protein, 9 aa, Artificial Sequence
  Description of Artificial Sequence: Synthetic peptide
  Seed: NALEGFDKA (TYRP2_HUMAN)
NTLEGFDKL

SEQ ID NO: 196367 - protein, 10 aa, Artificial Sequence
  Description of Artificial Sequence: Synthetic peptide
  Seed: LQRLIGNESF (TYRP2_HUMAN)
LMRLIGNESY

SEQ ID NO: 196368 - protein, 10 aa, Artificial Sequence
  Description of Artificial Sequence: Synthetic peptide
  Seed: CMTVDSLVNK (TYRP2_HUMAN)
CKTVDSLVNR

SEQ ID NO: 196369 - protein, 10 aa, Artificial Sequence
  Description of Artificial Sequence: Synthetic peptide
  Seed: MSPLWWGFLL (TYRP2_HUMAN)
MAPLWWGFLY

SEQ ID NO: 196370 - protein, 9 aa, Artificial Sequence
  Description of Artificial Sequence: Synthetic peptide
  Seed: NALEGFDKA (TYRP2_HUMAN)
NILEGFDKV

SEQ ID NO: 196371 - protein, 10 aa, Artificial Sequence
  Description of Artificial Sequence: Synthetic peptide
  Seed: ELAPIGHNRM (TYRP2_HUMAN)
EVAPIGHNRR

SEQ ID NO: 196372 - protein, 10 aa, Artificial Sequence
  Description of Artificial Sequence: Synthetic peptide
  Seed: GQFPRVCMTV (TYRP2_HUMAN)
GMFPRVCMTT

SEQ ID NO: 196373 - protein, 9 aa, Artificial Sequence
  Description of Artificial Sequence: Synthetic peptide
  Seed: RRLRKGYTP (TYRP2_HUMAN)
RQLRKGYTM

SEQ ID NO: 196374 - protein, 9 aa, Artificial Sequence
  Description of Artificial Sequence: Synthetic peptide
  Seed: GQFPRVCMT (TYRP2_HUMAN)
GQFPRVCMI

SEQ ID NO: 196375 - protein, 9 aa, Artificial Sequence
  Description of Artificial Sequence: Synthetic peptide
  Seed: TLLVVMGTL (TYRP2_HUMAN)
TMLVVMGTV

SEQ ID NO: 196376 - protein, 9 aa, Artificial Sequence
  Description of Artificial Sequence: Synthetic peptide
  Seed: LHSFTDAIF (TYRP2_HUMAN)
LKSFTDAIM

SEQ ID NO: 196377 - protein, 10 aa, Artificial Sequence
  Description of Artificial Sequence: Synthetic peptide
  Seed: YDFFVWLHYY (TYRP2_HUMAN)
YSFFVWLHYF

SEQ ID NO: 196378 - protein, 9 aa, Artificial Sequence
  Description of Artificial Sequence: Synthetic peptide
  Seed: RAIDFSHQG (TYRP2_HUMAN)
RTIDFSHQY

SEQ ID NO: 196379 - protein, 9 aa, Artificial Sequence
  Description of Artificial Sequence: Synthetic peptide
  Seed: HYYSVRDTL (TYRP2_HUMAN)
HYYSVRDTM

SEQ ID NO: 196380 - protein, 10 aa, Artificial Sequence
  Description of Artificial Sequence: Synthetic peptide
  Seed: MSPLWWGFLL (TYRP2_HUMAN)
MRPLWWGFLY

SEQ ID NO: 196381 - protein, 10 aa, Artificial Sequence
  Description of Artificial Sequence: Synthetic peptide
  Seed: LVVMGTLVAL (TYRP2_HUMAN)
LCVMGTLVAV

SEQ ID NO: 196382 - protein, 9 aa, Artificial Sequence
  Description of Artificial Sequence: Synthetic peptide
  Seed: VIRQNIHSL (TYRP2_HUMAN)
VLRQNIHSY

SEQ ID NO: 196383 - protein, 9 aa, Artificial Sequence
  Description of Artificial Sequence: Synthetic peptide
  Seed: SLDDYNHLV (TYRP2_HUMAN)
SFDDYNHLV

SEQ ID NO: 196384 - protein, 9 aa, Artificial Sequence
  Description of Artificial Sequence: Synthetic peptide
  Seed: FFQNSTFSF (TYRP2_HUMAN)
FSQNSTFSW

SEQ ID NO: 196385 - protein, 9 aa, Artificial Sequence
  Description of Artificial Sequence: Synthetic peptide
  Seed: VVMGTLVAL (TYRP2_HUMAN)
VRMGTLVAL

SEQ ID NO: 196386 - protein, 10 aa, Artificial Sequence
  Description of Artificial Sequence: Synthetic peptide
  Seed: GTLDSQVMSL (TYRP2_HUMAN)
GSLDSQVMSV

SEQ ID NO: 196387 - protein, 9 aa, Artificial Sequence
  Description of Artificial Sequence: Synthetic peptide
  Seed: HQGPAFVTW (TYRP2_HUMAN)
HLGPAFVTV

SEQ ID NO: 196388 - protein, 9 aa, Artificial Sequence
  Description of Artificial Sequence: Synthetic peptide
  Seed: TLKDIRDCL (TYRP2_HUMAN)
TMKDIRDCY

SEQ ID NO: 196389 - protein, 9 aa, Artificial Sequence
  Description of Artificial Sequence: Synthetic peptide
  Seed: LVHSFLNGT (TYRP2_HUMAN)
LTHSFLNGI

SEQ ID NO: 196390 - protein, 11 aa, Artificial Sequence
  Description of Artificial Sequence: Synthetic peptide
  Seed: RLIGNESFALP (TYRP2_HUMAN)
RLIGNESFALI

SEQ ID NO: 196391 - protein, 9 aa, Artificial Sequence
  Description of Artificial Sequence: Synthetic peptide
  Seed: FVWLHYYSV (TYRP2_HUMAN)
FSWLHYYSF

SEQ ID NO: 196392 - protein, 9 aa, Artificial Sequence
  Description of Artificial Sequence: Synthetic peptide
  Seed: RQNIHSLSP (TYRP2_HUMAN)
RKNIHSLSW

SEQ ID NO: 196393 - protein, 9 aa, Artificial Sequence
  Description of Artificial Sequence: Synthetic peptide
  Seed: LLVVMGTLV (TYRP2_HUMAN)
LMVVMGTLV

SEQ ID NO: 196394 - protein, 10 aa, Artificial Sequence
  Description of Artificial Sequence: Synthetic peptide
  Seed: FLLSCLGCKI (TYRP2_HUMAN)
FMLSCLGCKV

SEQ ID NO: 196395 - protein, 9 aa, Artificial Sequence
  Description of Artificial Sequence: Synthetic peptide
  Seed: SLHNLVHSF (TYRP2_HUMAN)
SGHNLVHSL

SEQ ID NO: 196396 - protein, 10 aa, Artificial Sequence
  Description of Artificial Sequence: Synthetic peptide
  Seed: FAGYNCGDCK (TYRP2_HUMAN)
FTGYNCGDCR

SEQ ID NO: 196397 - protein, 10 aa, Artificial Sequence
  Description of Artificial Sequence: Synthetic peptide
  Seed: TLDSQVMSLH (TYRP2_HUMAN)
TTDSQVMSLY

SEQ ID NO: 196398 - protein, 9 aa, Artificial Sequence
  Description of Artificial Sequence: Synthetic peptide
  Seed: ETPGWPTTL (TYRP2_HUMAN)
EIPGWPTTL

SEQ ID NO: 196399 - protein, 10 aa, Artificial Sequence
  Description of Artificial Sequence: Synthetic peptide
  Seed: QPQFANCSVY (TYRP2_HUMAN)
QLQFANCSVF

SEQ ID NO: 196400 - protein, 9 aa, Artificial Sequence
  Description of Artificial Sequence: Synthetic peptide
  Seed: SLDDYNHLV (TYRP2_HUMAN)
SVDDYNHLM

SEQ ID NO: 196401 - protein, 9 aa, Artificial Sequence
  Description of Artificial Sequence: Synthetic peptide
  Seed: DFFVWLHYY (TYRP2_HUMAN)
DWFVWLHYK

SEQ ID NO: 196402 - protein, 10 aa, Artificial Sequence
  Description of Artificial Sequence: Synthetic peptide
  Seed: FGWTGPNCER (TYRP2_HUMAN)
FVWTGPNCER

SEQ ID NO: 196403 - protein, 11 aa, Artificial Sequence
  Description of Artificial Sequence: Synthetic peptide
  Seed: RMYNMVPFFPP (TYRP2_HUMAN)
RMYNMVPFFPT

SEQ ID NO: 196404 - protein, 10 aa, Artificial Sequence
  Description of Artificial Sequence: Synthetic peptide
  Seed: KADGTLDSQV (TYRP2_HUMAN)
KMDGTLDSQL

SEQ ID NO: 196405 - protein, 11 aa, Artificial Sequence
  Description of Artificial Sequence: Synthetic peptide
  Seed: KADGTLDSQVM (TYRP2_HUMAN)
KLDGTLDSQVW

SEQ ID NO: 196406 - protein, 9 aa, Artificial Sequence
  Description of Artificial Sequence: Synthetic peptide
  Seed: SLDDYNHLV (TYRP2_HUMAN)
SYDDYNHLY

SEQ ID NO: 196407 - protein, 10 aa, Artificial Sequence
  Description of Artificial Sequence: Synthetic peptide
  Seed: TQPQFANCSV (TYRP2_HUMAN)
TFPQFANCSL

SEQ ID NO: 196408 - protein, 9 aa, Artificial Sequence
  Description of Artificial Sequence: Synthetic peptide
  Seed: YAIDLPVSV (TYRP2_HUMAN)
YIIDLPVSW

SEQ ID NO: 196409 - protein, 9 aa, Artificial Sequence
  Description of Artificial Sequence: Synthetic peptide
  Seed: VVMGTLVAL (TYRP2_HUMAN)
VPMGTLVAP

SEQ ID NO: 196410 - protein, 9 aa, Artificial Sequence
  Description of Artificial Sequence: Synthetic peptide
  Seed: WPTTLLVVM (TYRP2_HUMAN)
WATTLLVVM

SEQ ID NO: 196411 - protein, 10 aa, Artificial Sequence
  Description of Artificial Sequence: Synthetic peptide
  Seed: FVWLHYYSVR (TYRP2_HUMAN)
FMWLHYYSVN

SEQ ID NO: 196412 - protein, 9 aa, Artificial Sequence
  Description of Artificial Sequence: Synthetic peptide
  Seed: SVYDFFVWL (TYRP2_HUMAN)
SVYDFFVWV

SEQ ID NO: 196413 - protein, 9 aa, Artificial Sequence
  Description of Artificial Sequence: Synthetic peptide
  Seed: ANDPIFVVL (TYRP2_HUMAN)
ATDPIFVVC

SEQ ID NO: 196414 - protein, 9 aa, Artificial Sequence
  Description of Artificial Sequence: Synthetic peptide
  Seed: REQFLGALD (TYRP2_HUMAN)
REQFLGALT

SEQ ID NO: 196415 - protein, 9 aa, Artificial Sequence
  Description of Artificial Sequence: Synthetic peptide
  Seed: ELWPRKFFH (TYRP2_HUMAN)
EAWPRKFFK

SEQ ID NO: 196416 - protein, 9 aa, Artificial Sequence
  Description of Artificial Sequence: Synthetic peptide
  Seed: VVMGTLVAL (TYRP2_HUMAN)
VLMGTLVAI

SEQ ID NO: 196417 - protein, 10 aa, Artificial Sequence
  Description of Artificial Sequence: Synthetic peptide
  Seed: RELWPRKFFH (TYRP2_HUMAN)
RVLWPRKFFY

SEQ ID NO: 196418 - protein, 10 aa, Artificial Sequence
  Description of Artificial Sequence: Synthetic peptide
  Seed: GQFPRVCMTV (TYRP2_HUMAN)
GMFPRVCMTI

SEQ ID NO: 196419 - protein, 10 aa, Artificial Sequence
  Description of Artificial Sequence: Synthetic peptide
  Seed: LHYYSVRDTL (TYRP2_HUMAN)
LMYYSVRDTF

SEQ ID NO: 196420 - protein, 10 aa, Artificial Sequence
  Description of Artificial Sequence: Synthetic peptide
  Seed: REQFLGALDL (TYRP2_HUMAN)
RRQFLGALDM

SEQ ID NO: 196421 - protein, 9 aa, Artificial Sequence
  Description of Artificial Sequence: Synthetic peptide
  Seed: SFLNGTNAL (TYRP2_HUMAN)
SSLNGTNAF

SEQ ID NO: 196422 - protein, 11 aa, Artificial Sequence
  Description of Artificial Sequence: Synthetic peptide
  Seed: FQNSTFSFRNA (TYRP2_HUMAN)
FLNSTFSFRNL

SEQ ID NO: 196423 - protein, 11 aa, Artificial Sequence
  Description of Artificial Sequence: Synthetic peptide
  Seed: VMSLHNLVHSF (TYRP2_HUMAN)
VTSLHNLVHSW

SEQ ID NO: 196424 - protein, 9 aa, Artificial Sequence
  Description of Artificial Sequence: Synthetic peptide
  Seed: YDFFVWLHY (TYRP2_HUMAN)
YLFFVWLHY

SEQ ID NO: 196425 - protein, 11 aa, Artificial Sequence
  Description of Artificial Sequence: Synthetic peptide
  Seed: AIDFSHQGPAF (TYRP2_HUMAN)
ASDFSHQGPAL

SEQ ID NO: 196426 - protein, 8 aa, Artificial Sequence
  Description of Artificial Sequence: Synthetic peptide
  Seed: LLGPGRPY (TYRP2_HUMAN)
LQGPGRPY

SEQ ID NO: 196427 - protein, 9 aa, Artificial Sequence
  Description of Artificial Sequence: Synthetic peptide
  Seed: ILPGAQGQF (TYRP2_HUMAN)
IAPGAQGQI

SEQ ID NO: 196428 - protein, 8 aa, Artificial Sequence
  Description of Artificial Sequence: Synthetic peptide
  Seed: LDSQVMSL (TYRP2_HUMAN)
LESQVMSL

SEQ ID NO: 196429 - protein, 8 aa, Artificial Sequence
  Description of Artificial Sequence: Synthetic peptide
  Seed: ADAWPQEL (TYRP2_HUMAN)
AEAWPQEV

SEQ ID NO: 196430 - protein, 9 aa, Artificial Sequence
  Description of Artificial Sequence: Synthetic peptide
  Seed: YAIDLPVSV (TYRP2_HUMAN)
YHIDLPVSP

SEQ ID NO: 196431 - protein, 9 aa, Artificial Sequence
  Description of Artificial Sequence: Synthetic peptide
  Seed: LLAFLQYRR (TYRP2_HUMAN)
LVAFLQYRK

SEQ ID NO: 196432 - protein, 9 aa, Artificial Sequence
  Description of Artificial Sequence: Synthetic peptide
  Seed: FQNSTFSFR (TYRP2_HUMAN)
FANSTFSFK

SEQ ID NO: 196433 - protein, 10 aa, Artificial Sequence
  Description of Artificial Sequence: Synthetic peptide
  Seed: RPWSGPYILR (TYRP2_HUMAN)
RWWSGPYILK

SEQ ID NO: 196434 - protein, 9 aa, Artificial Sequence
  Description of Artificial Sequence: Synthetic peptide
  Seed: GPNGTQPQF (TYRP2_HUMAN)
GANGTQPQY

SEQ ID NO: 196435 - protein, 10 aa, Artificial Sequence
  Description of Artificial Sequence: Synthetic peptide
  Seed: KILPGAQGQF (TYRP2_HUMAN)
KCLPGAQGQW

SEQ ID NO: 196436 - protein, 10 aa, Artificial Sequence
  Description of Artificial Sequence: Synthetic peptide
  Seed: MSPLWWGFLL (TYRP2_HUMAN)
MVPLWWGFLF

SEQ ID NO: 196437 - protein, 10 aa, Artificial Sequence
  Description of Artificial Sequence: Synthetic peptide
  Seed: VVMGTLVALV (TYRP2_HUMAN)
VLMGTLVALK

SEQ ID NO: 196438 - protein, 8 aa, Artificial Sequence
  Description of Artificial Sequence: Synthetic peptide
  Seed: QHWLGLLG (TYRP2_HUMAN)
QHWLGLLA

SEQ ID NO: 196439 - protein, 9 aa, Artificial Sequence
  Description of Artificial Sequence: Synthetic peptide
  Seed: STFSFRNAL (TYRP2_HUMAN)
SVFSFRNAW

SEQ ID NO: 196440 - protein, 9 aa, Artificial Sequence
  Description of Artificial Sequence: Synthetic peptide
  Seed: VVMGTLVAL (TYRP2_HUMAN)
VVMGTLVAT

SEQ ID NO: 196441 - protein, 10 aa, Artificial Sequence
  Description of Artificial Sequence: Synthetic peptide
  Seed: FFPPVTNEEL (TYRP2_HUMAN)
FMPPVTNEEL

SEQ ID NO: 196442 - protein, 10 aa, Homo sapiens
  Native (TYRP2_HUMAN)
LVALVGLFVL

SEQ ID NO: 196443 - protein, 8 aa, Homo sapiens
  Native (TYRP2_HUMAN)
FLNGTNAL

SEQ ID NO: 196444 - protein, 11 aa, Homo sapiens
  Native (TYRP2_HUMAN)
LMETHLSSKRY

SEQ ID NO: 196445 - protein, 9 aa, Homo sapiens
  Native (TYRP2_HUMAN)
TDQLFGAAR

SEQ ID NO: 196446 - protein, 8 aa, Homo sapiens
  Native (TYRP2_HUMAN)
REQFLGAL

SEQ ID NO: 196447 - protein, 10 aa, Homo sapiens
  Native (TYRP2_HUMAN)
DTRPWSGPYI

SEQ ID NO: 196448 - protein, 10 aa, Homo sapiens
  Native (TYRP2_HUMAN)
VLHSFTDAIF

SEQ ID NO: 196449 - protein, 9 aa, Homo sapiens
  Native (TYRP2_HUMAN)
LVTLCNGTY

SEQ ID NO: 196450 - protein, 9 aa, Homo sapiens
  Native (TYRP2_HUMAN)
PAFVTWHRY

SEQ ID NO: 196451 - protein, 9 aa, Homo sapiens
  Native (TYRP2_HUMAN)
TLISRNSRF

SEQ ID NO: 196452 - protein, 10 aa, Homo sapiens
  Native (TYRP2_HUMAN)
LVGLFVLLAF

SEQ ID NO: 196453 - protein, 10 aa, Homo sapiens
  Native (TYRP2_HUMAN)
QRLIGNESFA

SEQ ID NO: 196454 - protein, 11 aa, Homo sapiens
  Native (TYRP2_HUMAN)
FLTSDQLGYSY

SEQ ID NO: 196455 - protein, 10 aa, Homo sapiens
  Native (TYRP2_HUMAN)
QFLGALDLAK

SEQ ID NO: 196456 - protein, 11 aa, Homo sapiens
  Native (TYRP2_HUMAN)
GYNCGDCKFGW

SEQ ID NO: 196457 - protein, 8 aa, Homo sapiens
  Native (TYRP2_HUMAN)
QHWLGLLG

SEQ ID NO: 196458 - protein, 9 aa, Homo sapiens
  Native (TYRP2_HUMAN)
KLPTLKDIR

SEQ ID NO: 196459 - protein, 9 aa, Homo sapiens
  Native (TYRP2_HUMAN)
VMSLHNLVH

SEQ ID NO: 196460 - protein, 10 aa, Homo sapiens
  Native (TYRP2_HUMAN)
FLLSCLGCKI

SEQ ID NO: 196461 - protein, 10 aa, Homo sapiens
  Native (TYRP2_HUMAN)
DPIFVVLHSF

SEQ ID NO: 196462 - protein, 10 aa, Homo sapiens
  Native (TYRP2_HUMAN)
WPRKFFHRTC

SEQ ID NO: 196463 - protein, 8 aa, Homo sapiens
  Native (TYRP2_HUMAN)
FRNALEGF

SEQ ID NO: 196464 - protein, 10 aa, Homo sapiens
  Native (TYRP2_HUMAN)
RMYNMVPFFP

SEQ ID NO: 196465 - protein, 10 aa, Homo sapiens
  Native (TYRP2_HUMAN)
LLCLERDLQR

SEQ ID NO: 196466 - protein, 8 aa, Homo sapiens
  Native (TYRP2_HUMAN)
LDDYNHLV

SEQ ID NO: 196467 - protein, 9 aa, Homo sapiens
  Native (TYRP2_HUMAN)
GYTPLMETH

SEQ ID NO: 196468 - protein, 10 aa, Homo sapiens
  Native (TYRP2_HUMAN)
TLVALVGLFV

SEQ ID NO: 196469 - protein, 8 aa, Homo sapiens
  Native (TYRP2_HUMAN)
VTWHRYHL

SEQ ID NO: 196470 - protein, 9 aa, Homo sapiens
  Native (TYRP2_HUMAN)
DAIFDEWMK

SEQ ID NO: 196471 - protein, 10 aa, Homo sapiens
  Native (TYRP2_HUMAN)
KADGTLDSQV

SEQ ID NO: 196472 - protein, 10 aa, Homo sapiens
  Native (TYRP2_HUMAN)
RNQMGRNSMK

SEQ ID NO: 196473 - protein, 9 aa, Homo sapiens
  Native (TYRP2_HUMAN)
YILRNQDDR

SEQ ID NO: 196474 - protein, 8 aa, Homo sapiens
  Native (TYRP2_HUMAN)
HPDYVITT

SEQ ID NO: 196475 - protein, 9 aa, Homo sapiens
  Native (TYRP2_HUMAN)
LLGPGRPYR

SEQ ID NO: 196476 - protein, 8 aa, Homo sapiens
  Native (TYRP2_HUMAN)
LFLTSDQL

SEQ ID NO: 196477 - protein, 10 aa, Homo sapiens
  Native (TYRP2_HUMAN)
FAGYNCGDCK

SEQ ID NO: 196478 - protein, 10 aa, Homo sapiens
  Native (TYRP2_HUMAN)
RPWSGPYILR

SEQ ID NO: 196479 - protein, 8 aa, Homo sapiens
  Native (TYRP2_HUMAN)
RPWSGPYI

SEQ ID NO: 196480 - protein, 10 aa, Homo sapiens
  Native (TYRP2_HUMAN)
QLGYSYAIDL

SEQ ID NO: 196481 - protein, 10 aa, Homo sapiens
  Native (TYRP2_HUMAN)
IGNESFALPY

SEQ ID NO: 196482 - protein, 9 aa, Homo sapiens
  Native (TYRP2_HUMAN)
RKFFHRTCK

SEQ ID NO: 196483 - protein, 9 aa, Homo sapiens
  Native (TYRP2_HUMAN)
ANDPIFVVL

SEQ ID NO: 196484 - protein, 11 aa, Homo sapiens
  Native (TYRP2_HUMAN)
LSLQKFDNPPF

SEQ ID NO: 196485 - protein, 9 aa, Homo sapiens
  Native (TYRP2_HUMAN)
LPGAQGQFP

SEQ ID NO: 196486 - protein, 9 aa, Homo sapiens
  Native (TYRP2_HUMAN)
LVHSFLNGT

SEQ ID NO: 196487 - protein, 10 aa, Homo sapiens
  Native (TYRP2_HUMAN)
DTLLGPGRPY

SEQ ID NO: 196488 - protein, 10 aa, Homo sapiens
  Native (TYRP2_HUMAN)
GYTPLMETHL

SEQ ID NO: 196489 - protein, 8 aa, Homo sapiens
  Native (TYRP2_HUMAN)
VTNEELFL

SEQ ID NO: 196490 - protein, 10 aa, Homo sapiens
  Native (TYRP2_HUMAN)
CLGCKILPGA

SEQ ID NO: 196491 - protein, 11 aa, Homo sapiens
  Native (TYRP2_HUMAN)
DSQVMSLHNLV

SEQ ID NO: 196492 - protein, 10 aa, Homo sapiens
  Native (TYRP2_HUMAN)
FVTWHRYHLL

SEQ ID NO: 196493 - protein, 8 aa, Homo sapiens
  Native (TYRP2_HUMAN)
VMSLHNLV

SEQ ID NO: 196494 - protein, 11 aa, Homo sapiens
  Native (TYRP2_HUMAN)
VLLAFLQYRRL

SEQ ID NO: 196495 - protein, 11 aa, Homo sapiens
  Native (TYRP2_HUMAN)
GPGRPYRAIDF

SEQ ID NO: 196496 - protein, 8 aa, Homo sapiens
  Native (TYRP2_HUMAN)
FDKADGTL

SEQ ID NO: 196497 - protein, 9 aa, Homo sapiens
  Native (TYRP2_HUMAN)
ARPDDPTLI

SEQ ID NO: 196498 - protein, 9 aa, Homo sapiens
  Native (TYRP2_HUMAN)
LVGLFVLLA

SEQ ID NO: 196499 - protein, 10 aa, Homo sapiens
  Native (TYRP2_HUMAN)
LAPIGHNRMY

SEQ ID NO: 196500 - protein, 8 aa, Homo sapiens
  Native (TYRP2_HUMAN)
FQNSTFSF

SEQ ID NO: 196501 - protein, 9 aa, Homo sapiens
  Native (TYRP2_HUMAN)
SVYDFFVWL

SEQ ID NO: 196502 - protein, 10 aa, Homo sapiens
  Native (TYRP2_HUMAN)
LQYRRLRKGY

SEQ ID NO: 196503 - protein, 11 aa, Homo sapiens
  Native (TYRP2_HUMAN)
FLLSCLGCKIL

SEQ ID NO: 196504 - protein, 11 aa, Homo sapiens
  Native (TYRP2_HUMAN)
APIGHNRMYNM

SEQ ID NO: 196505 - protein, 10 aa, Homo sapiens
  Native (TYRP2_HUMAN)
HRTCKCTGNF

SEQ ID NO: 196506 - protein, 9 aa, Homo sapiens
  Native (TYRP2_HUMAN)
RRLRKGYTP

SEQ ID NO: 196507 - protein, 10 aa, Homo sapiens
  Native (TYRP2_HUMAN)
RRLRKGYTPL

SEQ ID NO: 196508 - protein, 8 aa, Homo sapiens
  Native (TYRP2_HUMAN)
GPGRPYRA

SEQ ID NO: 196509 - protein, 8 aa, Homo sapiens
  Native (TYRP2_HUMAN)
YWNFATGR

SEQ ID NO: 196510 - protein, 11 aa, Homo sapiens
  Native (TYRP2_HUMAN)
LLVVMGTLVAL

SEQ ID NO: 196511 - protein, 8 aa, Homo sapiens
  Native (TYRP2_HUMAN)
MSPLWWGF

SEQ ID NO: 196512 - protein, 8 aa, Homo sapiens
  Native (TYRP2_HUMAN)
IFVVLHSF

SEQ ID NO: 196513 - protein, 9 aa, Homo sapiens
  Native (TYRP2_HUMAN)
VALVGLFVL

SEQ ID NO: 196514 - protein, 8 aa, Homo sapiens
  Native (TYRP2_HUMAN)
THLSSKRY

SEQ ID NO: 196515 - protein, 8 aa, Homo sapiens
  Native (TYRP2_HUMAN)
LHNLVHSF

SEQ ID NO: 196516 - protein, 8 aa, Homo sapiens
  Native (TYRP2_HUMAN)
QFANCSVY

SEQ ID NO: 196517 - protein, 9 aa, Homo sapiens
  Native (TYRP2_HUMAN)
LSCLGCKIL

SEQ ID NO: 196518 - protein, 10 aa, Homo sapiens
  Native (TYRP2_HUMAN)
LTSDQLGYSY

SEQ ID NO: 196519 - protein, 9 aa, Homo sapiens
  Native (TYRP2_HUMAN)
SQVMSLHNL

SEQ ID NO: 196520 - protein, 9 aa, Homo sapiens
  Native (TYRP2_HUMAN)
RAIDFSHQG

SEQ ID NO: 196521 - protein, 9 aa, Homo sapiens
  Native (TYRP2_HUMAN)
KDIRDCLSL

SEQ ID NO: 196522 - protein, 10 aa, Homo sapiens
  Native (TYRP2_HUMAN)
LLGPGRPYRA

SEQ ID NO: 196523 - protein, 10 aa, Homo sapiens
  Native (TYRP2_HUMAN)
RLIGNESFAL

SEQ ID NO: 196524 - protein, 10 aa, Homo sapiens
  Native (TYRP2_HUMAN)
QEREQFLGAL

SEQ ID NO: 196525 - protein, 10 aa, Homo sapiens
  Native (TYRP2_HUMAN)
CCPRLGAESA

SEQ ID NO: 196526 - protein, 11 aa, Homo sapiens
  Native (TYRP2_HUMAN)
TSDQLGYSYAI

SEQ ID NO: 196527 - protein, 11 aa, Homo sapiens
  Native (TYRP2_HUMAN)
YSYAIDLPVSV

SEQ ID NO: 196528 - protein, 11 aa, Homo sapiens
  Native (TYRP2_HUMAN)
KRVHPDYVITT

SEQ ID NO: 196529 - protein, 9 aa, Homo sapiens
  Native (TYRP2_HUMAN)
METHLSSKR

SEQ ID NO: 196530 - protein, 11 aa, Homo sapiens
  Native (TYRP2_HUMAN)
DDPTLISRNSR

SEQ ID NO: 196531 - protein, 9 aa, Homo sapiens
  Native (TYRP2_HUMAN)
VWLHYYSVR

SEQ ID NO: 196532 - protein, 8 aa, Homo sapiens
  Native (TYRP2_HUMAN)
VTLCNGTY

SEQ ID NO: 196533 - protein, 8 aa, Homo sapiens
  Native (TYRP2_HUMAN)
AIDLPVSV

SEQ ID NO: 196534 - protein, 8 aa, Homo sapiens
  Native (TYRP2_HUMAN)
LAPIGHNR

SEQ ID NO: 196535 - protein, 11 aa, Homo sapiens
  Native (TYRP2_HUMAN)
NPPADAWPQEL

SEQ ID NO: 196536 - protein, 11 aa, Homo sapiens
  Native (TYRP2_HUMAN)
VTLCNGTYEGL

SEQ ID NO: 196537 - protein, 8 aa, Homo sapiens
  Native (TYRP2_HUMAN)
WPQELAPI

SEQ ID NO: 196538 - protein, 9 aa, Homo sapiens
  Native (TYRP2_HUMAN)
DFFVWLHYY

SEQ ID NO: 196539 - protein, 9 aa, Homo sapiens
  Native (TYRP2_HUMAN)
FTDAIFDEW

SEQ ID NO: 196540 - protein, 9 aa, Homo sapiens
  Native (TYRP2_HUMAN)
LIGNESFAL

SEQ ID NO: 196541 - protein, 9 aa, Homo sapiens
  Native (TYRP2_HUMAN)
VGLFVLLAF

SEQ ID NO: 196542 - protein, 11 aa, Homo sapiens
  Native (TYRP2_HUMAN)
TVCDSLDDYNH

SEQ ID NO: 196543 - protein, 10 aa, Homo sapiens
  Native (TYRP2_HUMAN)
YEGLLRRNQM

SEQ ID NO: 196544 - protein, 10 aa, Homo sapiens
  Native (TYRP2_HUMAN)
NSTFSFRNAL

SEQ ID NO: 196545 - protein, 10 aa, Homo sapiens
  Native (TYRP2_HUMAN)
NIHSLSPQER

SEQ ID NO: 196546 - protein, 11 aa, Homo sapiens
  Native (TYRP2_HUMAN)
YTPLMETHLSS

SEQ ID NO: 196547 - protein, 10 aa, Homo sapiens
  Native (TYRP2_HUMAN)
DVCTDQLFGA

SEQ ID NO: 196548 - protein, 11 aa, Homo sapiens
  Native (TYRP2_HUMAN)
FANCSVYDFFV

SEQ ID NO: 196549 - protein, 10 aa, Homo sapiens
  Native (TYRP2_HUMAN)
QGPAFVTWHR

SEQ ID NO: 196550 - protein, 10 aa, Homo sapiens
  Native (TYRP2_HUMAN)
NMVPFFPPVT

SEQ ID NO: 196551 - protein, 9 aa, Homo sapiens
  Native (TYRP2_HUMAN)
NQMGRNSMK

SEQ ID NO: 196552 - protein, 11 aa, Homo sapiens
  Native (TYRP2_HUMAN)
RRLRKGYTPLM

SEQ ID NO: 196553 - protein, 9 aa, Homo sapiens
  Native (TYRP2_HUMAN)
VTNEELFLT

SEQ ID NO: 196554 - protein, 9 aa, Homo sapiens
  Native (TYRP2_HUMAN)
REQFLGALD

SEQ ID NO: 196555 - protein, 11 aa, Homo sapiens
  Native (TYRP2_HUMAN)
REQFLGALDLA

SEQ ID NO: 196556 - protein, 10 aa, Homo sapiens
  Native (TYRP2_HUMAN)
LQKFDNPPFF

SEQ ID NO: 196557 - protein, 10 aa, Homo sapiens
  Native (TYRP2_HUMAN)
RNSRFSSWET

SEQ ID NO: 196558 - protein, 9 aa, Homo sapiens
  Native (TYRP2_HUMAN)
DSLDDYNHL

SEQ ID NO: 196559 - protein, 9 aa, Homo sapiens
  Native (TYRP2_HUMAN)
GPAFVTWHR

SEQ ID NO: 196560 - protein, 9 aa, Homo sapiens
  Native (TYRP2_HUMAN)
ETHLSSKRY

SEQ ID NO: 196561 - protein, 10 aa, Homo sapiens
  Native (TYRP2_HUMAN)
QELAPIGHNR

SEQ ID NO: 196562 - protein, 8 aa, Homo sapiens
  Native (TYRP2_HUMAN)
IGNESFAL

SEQ ID NO: 196563 - protein, 11 aa, Homo sapiens
  Native (TYRP2_HUMAN)
CDSLDDYNHLV

SEQ ID NO: 196564 - protein, 10 aa, Homo sapiens
  Native (TYRP2_HUMAN)
HLVTLCNGTY

SEQ ID NO: 196565 - protein, 11 aa, Homo sapiens
  Native (TYRP2_HUMAN)
SLQKFDNPPFF

SEQ ID NO: 196566 - protein, 10 aa, Homo sapiens
  Native (TYRP2_HUMAN)
FALPYWNFAT

SEQ ID NO: 196567 - protein, 10 aa, Homo sapiens
  Native (TYRP2_HUMAN)
SPLWWGFLLS

SEQ ID NO: 196568 - protein, 8 aa, Homo sapiens
  Native (TYRP2_HUMAN)
LVGLFVLL

SEQ ID NO: 196569 - protein, 9 aa, Homo sapiens
  Native (TYRP2_HUMAN)
RQNIHSLSP

SEQ ID NO: 196570 - protein, 10 aa, Homo sapiens
  Native (TYRP2_HUMAN)
TPGWPTTLLV

SEQ ID NO: 196571 - protein, 9 aa, Homo sapiens
  Native (TYRP2_HUMAN)
GPNGTQPQF

SEQ ID NO: 196572 - protein, 8 aa, Homo sapiens
  Native (TYRP2_HUMAN)
NEELFLTS

SEQ ID NO: 196573 - protein, 9 aa, Homo sapiens
  Native (TYRP2_HUMAN)
SVRDTLLGP

SEQ ID NO: 196574 - protein, 9 aa, Homo sapiens
  Native (TYRP2_HUMAN)
PYWNFATGR

SEQ ID NO: 196575 - protein, 10 aa, Homo sapiens
  Native (TYRP2_HUMAN)
FQNSTFSFRN

SEQ ID NO: 196576 - protein, 10 aa, Homo sapiens
  Native (TYRP2_HUMAN)
RLRKGYTPLM

SEQ ID NO: 196577 - protein, 8 aa, Homo sapiens
  Native (TYRP2_HUMAN)
SAANDPIF

SEQ ID NO: 196578 - protein, 9 aa, Homo sapiens
  Native (TYRP2_HUMAN)
TTQHWLGLL

SEQ ID NO: 196579 - protein, 9 aa, Homo sapiens
  Native (TYRP2_HUMAN)
PIFVVLHSF

SEQ ID NO: 196580 - protein, 10 aa, Homo sapiens
  Native (TYRP2_HUMAN)
FANCSVYDFF

SEQ ID NO: 196581 - protein, 9 aa, Homo sapiens
  Native (TYRP2_HUMAN)
GTLVALVGL

SEQ ID NO: 196582 - protein, 9 aa, Homo sapiens
  Native (TYRP2_HUMAN)
QKFDNPPFF

SEQ ID NO: 196583 - protein, 10 aa, Homo sapiens
  Native (TYRP2_HUMAN)
SQVMSLHNLV

SEQ ID NO: 196584 - protein, 10 aa, Homo sapiens
  Native (TYRP2_HUMAN)
TDAIFDEWMK

SEQ ID NO: 196585 - protein, 9 aa, Homo sapiens
  Native (TYRP2_HUMAN)
LLSCLGCKI

SEQ ID NO: 196586 - protein, 9 aa, Homo sapiens
  Native (TYRP2_HUMAN)
TTLLVVMGT

SEQ ID NO: 196587 - protein, 9 aa, Homo sapiens
  Native (TYRP2_HUMAN)
LGYSYAIDL

SEQ ID NO: 196588 - protein, 8 aa, Homo sapiens
  Native (TYRP2_HUMAN)
ANDPIFVV

SEQ ID NO: 196589 - protein, 11 aa, Homo sapiens
  Native (TYRP2_HUMAN)
VMGTLVALVGL

SEQ ID NO: 196590 - protein, 11 aa, Homo sapiens
  Native (TYRP2_HUMAN)
LPVSVEETPGW

SEQ ID NO: 196591 - protein, 11 aa, Homo sapiens
  Native (TYRP2_HUMAN)
RNQDDRELWPR

SEQ ID NO: 196592 - protein, 9 aa, Homo sapiens
  Native (TYRP2_HUMAN)
TLKDIRDCL

SEQ ID NO: 196593 - protein, 11 aa, Homo sapiens
  Native (TYRP2_HUMAN)
VEETPGWPTTL

SEQ ID NO: 196594 - protein, 10 aa, Homo sapiens
  Native (TYRP2_HUMAN)
NECDVCTDQL

SEQ ID NO: 196595 - protein, 10 aa, Homo sapiens
  Native (TYRP2_HUMAN)
ADGTLDSQVM

SEQ ID NO: 196596 - protein, 9 aa, Homo sapiens
  Native (TYRP2_HUMAN)
AGYNCGDCK

SEQ ID NO: 196597 - protein, 9 aa, Homo sapiens
  Native (TYRP2_HUMAN)
NVCGSQQGR

SEQ ID NO: 196598 - protein, 9 aa, Homo sapiens
  Native (TYRP2_HUMAN)
TLLVVMGTL

SEQ ID NO: 196599 - protein, 9 aa, Homo sapiens
  Native (TYRP2_HUMAN)
PWSGPYILR

SEQ ID NO: 196600 - protein, 10 aa, Homo sapiens
  Native (TYRP2_HUMAN)
SSWETVCDSL

SEQ ID NO: 196601 - protein, 10 aa, Homo sapiens
  Native (TYRP2_HUMAN)
VYDFFVWLHY

SEQ ID NO: 196602 - protein, 11 aa, Homo sapiens
  Native (TYRP2_HUMAN)
SFRNALEGFDK

SEQ ID NO: 196603 - protein, 8 aa, Homo sapiens
  Native (TYRP2_HUMAN)
QVMSLHNL

SEQ ID NO: 196604 - protein, 10 aa, Homo sapiens
  Native (TYRP2_HUMAN)
GWPTTLLVVM

SEQ ID NO: 196605 - protein, 11 aa, Homo sapiens
  Native (TYRP2_HUMAN)
AIDFSHQGPAF

SEQ ID NO: 196606 - protein, 9 aa, Homo sapiens
  Native (TYRP2_HUMAN)
LLRRNQMGR

SEQ ID NO: 196607 - protein, 10 aa, Homo sapiens
  Native (TYRP2_HUMAN)
SMKLPTLKDI

SEQ ID NO: 196608 - protein, 10 aa, Homo sapiens
  Native (TYRP2_HUMAN)
TTLLVVMGTL

SEQ ID NO: 196609 - protein, 8 aa, Homo sapiens
  Native (TYRP2_HUMAN)
QNSTFSFR

SEQ ID NO: 196610 - protein, 10 aa, Homo sapiens
  Native (TYRP2_HUMAN)
GFLLSCLGCK

SEQ ID NO: 196611 - protein, 8 aa, Homo sapiens
  Native (TYRP2_HUMAN)
LDSQVMSL

SEQ ID NO: 196612 - protein, 10 aa, Homo sapiens
  Native (TYRP2_HUMAN)
FLNGTNALPH

SEQ ID NO: 196613 - protein, 10 aa, Homo sapiens
  Native (TYRP2_HUMAN)
EETPGWPTTL

SEQ ID NO: 196614 - protein, 9 aa, Homo sapiens
  Native (TYRP2_HUMAN)
LHNLVHSFL

SEQ ID NO: 196615 - protein, 9 aa, Homo sapiens
  Native (TYRP2_HUMAN)
LPHSAANDP

SEQ ID NO: 196616 - protein, 11 aa, Homo sapiens
  Native (TYRP2_HUMAN)
ETPGWPTTLLV

SEQ ID NO: 196617 - protein, 11 aa, Homo sapiens
  Native (TYRP2_HUMAN)
VCDSLDDYNHL

SEQ ID NO: 196618 - protein, 9 aa, Homo sapiens
  Native (TYRP2_HUMAN)
RVHPDYVIT

SEQ ID NO: 196619 - protein, 11 aa, Homo sapiens
  Native (TYRP2_HUMAN)
LLGPNGTQPQF

SEQ ID NO: 196620 - protein, 9 aa, Homo sapiens
  Native (TYRP2_HUMAN)
SFRNALEGF

SEQ ID NO: 196621 - protein, 11 aa, Homo sapiens
  Native (TYRP2_HUMAN)
SLVNKECCPRL

SEQ ID NO: 196622 - protein, 11 aa, Homo sapiens
  Native (TYRP2_HUMAN)
SMKLPTLKDIR

SEQ ID NO: 196623 - protein, 11 aa, Homo sapiens
  Native (TYRP2_HUMAN)
TLVALVGLFVL

SEQ ID NO: 196624 - protein, 11 aa, Homo sapiens
  Native (TYRP2_HUMAN)
RYHLLCLERDL

SEQ ID NO: 196625 - protein, 10 aa, Homo sapiens
  Native (TYRP2_HUMAN)
METHLSSKRY

SEQ ID NO: 196626 - protein, 9 aa, Homo sapiens
  Native (TYRP2_HUMAN)
GHNRMYNMV

SEQ ID NO: 196627 - protein, 11 aa, Homo sapiens
  Native (TYRP2_HUMAN)
LPGAQGQFPRV

SEQ ID NO: 196628 - protein, 8 aa, Homo sapiens
  Native (TYRP2_HUMAN)
TPGWPTTL

SEQ ID NO: 196629 - protein, 11 aa, Homo sapiens
  Native (TYRP2_HUMAN)
LIGNESFALPY

SEQ ID NO: 196630 - protein, 8 aa, Homo sapiens
  Native (TYRP2_HUMAN)
ERKKPPVI

SEQ ID NO: 196631 - protein, 8 aa, Homo sapiens
  Native (TYRP2_HUMAN)
ADAWPQEL

SEQ ID NO: 196632 - protein, 9 aa, Homo sapiens
  Native (TYRP2_HUMAN)
VTWHRYHLL

SEQ ID NO: 196633 - protein, 8 aa, Homo sapiens
  Native (TYRP2_HUMAN)
MGTLVALV

SEQ ID NO: 196634 - protein, 11 aa, Homo sapiens
  Native (TYRP2_HUMAN)
FFPPVTNEELF

SEQ ID NO: 196635 - protein, 10 aa, Homo sapiens
  Native (TYRP2_HUMAN)
NRMYNMVPFF

SEQ ID NO: 196636 - protein, 8 aa, Homo sapiens
  Native (TYRP2_HUMAN)
RPYRAIDF

SEQ ID NO: 196637 - protein, 9 aa, Homo sapiens
  Native (TYRP2_HUMAN)
QRLIGNESF

SEQ ID NO: 196638 - protein, 11 aa, Homo sapiens
  Native (TYRP2_HUMAN)
CTEVRADTRPW

SEQ ID NO: 196639 - protein, 9 aa, Homo sapiens
  Native (TYRP2_HUMAN)
WPRKFFHRT

SEQ ID NO: 196640 - protein, 10 aa, Homo sapiens
  Native (TYRP2_HUMAN)
SVYDFFVWLH

SEQ ID NO: 196641 - protein, 10 aa, Homo sapiens
  Native (TYRP2_HUMAN)
TVDSLVNKEC

SEQ ID NO: 196642 - protein, 10 aa, Homo sapiens
  Native (TYRP2_HUMAN)
NPPFFQNSTF

SEQ ID NO: 196643 - protein, 9 aa, Homo sapiens
  Native (TYRP2_HUMAN)
YDFFVWLHY

SEQ ID NO: 196644 - protein, 9 aa, Homo sapiens
  Native (TYRP2_HUMAN)
TEVRADTRP

SEQ ID NO: 196645 - protein, 9 aa, Homo sapiens
  Native (TYRP2_HUMAN)
NGTYEGLLR

SEQ ID NO: 196646 - protein, 11 aa, Homo sapiens
  Native (TYRP2_HUMAN)
GHNRMYNMVPF

SEQ ID NO: 196647 - protein, 10 aa, Homo sapiens
  Native (TYRP2_HUMAN)
LSPQEREQFL

SEQ ID NO: 196648 - protein, 9 aa, Homo sapiens
  Native (TYRP2_HUMAN)
ANCSVYDFF

SEQ ID NO: 196649 - protein, 9 aa, Homo sapiens
  Native (TYRP2_HUMAN)
DAWPQELAP

SEQ ID NO: 196650 - protein, 9 aa, Homo sapiens
  Native (TYRP2_HUMAN)
HSAANDPIF

SEQ ID NO: 196651 - protein, 11 aa, Homo sapiens
  Native (TYRP2_HUMAN)
LPHSAANDPIF

SEQ ID NO: 196652 - protein, 9 aa, Homo sapiens
  Native (TYRP2_HUMAN)
AWPQELAPI

SEQ ID NO: 196653 - protein, 11 aa, Homo sapiens
  Native (TYRP2_HUMAN)
QFLGALDLAKK

SEQ ID NO: 196654 - protein, 8 aa, Homo sapiens
  Native (TYRP2_HUMAN)
FPRVCMTV

SEQ ID NO: 196655 - protein, 10 aa, Homo sapiens
  Native (TYRP2_HUMAN)
ETPGWPTTLL

SEQ ID NO: 196656 - protein, 10 aa, Homo sapiens
  Native (TYRP2_HUMAN)
YAIDLPVSVE

SEQ ID NO: 196657 - protein, 9 aa, Homo sapiens
  Native (TYRP2_HUMAN)
CPRLGAESA

SEQ ID NO: 196658 - protein, 9 aa, Homo sapiens
  Native (TYRP2_HUMAN)
DYVITTQHW

SEQ ID NO: 196659 - protein, 11 aa, Homo sapiens
  Native (TYRP2_HUMAN)
RRNQMGRNSMK

SEQ ID NO: 196660 - protein, 8 aa, Homo sapiens
  Native (TYRP2_HUMAN)
NALPHSAA

SEQ ID NO: 196661 - protein, 8 aa, Homo sapiens
  Native (TYRP2_HUMAN)
AFVTWHRY

SEQ ID NO: 196662 - protein, 8 aa, Homo sapiens
  Native (TYRP2_HUMAN)
HSLSPQER

SEQ ID NO: 196663 - protein, 10 aa, Homo sapiens
  Native (TYRP2_HUMAN)
AGYNCGDCKF

SEQ ID NO: 196664 - protein, 9 aa, Homo sapiens
  Native (TYRP2_HUMAN)
CLERDLQRL

SEQ ID NO: 196665 - protein, 9 aa, Homo sapiens
  Native (TYRP2_HUMAN)
QFPRVCMTV

SEQ ID NO: 196666 - protein, 9 aa, Homo sapiens
  Native (TYRP2_HUMAN)
EQFLGALDL

SEQ ID NO: 196667 - protein, 8 aa, Homo sapiens
  Native (TYRP2_HUMAN)
WPTTLLVV

SEQ ID NO: 196668 - protein, 8 aa, Homo sapiens
  Native (TYRP2_HUMAN)
ARPDDPTL

SEQ ID NO: 196669 - protein, 9 aa, Homo sapiens
  Native (TYRP2_HUMAN)
SAANDPIFV

SEQ ID NO: 196670 - protein, 10 aa, Homo sapiens
  Native (TYRP2_HUMAN)
FLTSDQLGYS

SEQ ID NO: 196671 - protein, 10 aa, Homo sapiens
  Native (TYRP2_HUMAN)
SLVNKECCPR

SEQ ID NO: 196672 - protein, 10 aa, Homo sapiens
  Native (TYRP2_HUMAN)
NGTYEGLLRR

SEQ ID NO: 196673 - protein, 11 aa, Homo sapiens
  Native (TYRP2_HUMAN)
TDAIFDEWMKR

SEQ ID NO: 196674 - protein, 8 aa, Homo sapiens
  Native (TYRP2_HUMAN)
ESFALPYW

SEQ ID NO: 196675 - protein, 9 aa, Homo sapiens
  Native (TYRP2_HUMAN)
GTNALPHSA

SEQ ID NO: 196676 - protein, 10 aa, Homo sapiens
  Native (TYRP2_HUMAN)
AFLQYRRLRK

SEQ ID NO: 196677 - protein, 9 aa, Homo sapiens
  Native (TYRP2_HUMAN)
LMETHLSSK

SEQ ID NO: 196678 - protein, 10 aa, Homo sapiens
  Native (TYRP2_HUMAN)
ELAPIGHNRM

SEQ ID NO: 196679 - protein, 10 aa, Homo sapiens
  Native (TYRP2_HUMAN)
LRNQDDRELW

SEQ ID NO: 196680 - protein, 8 aa, Homo sapiens
  Native (TYRP2_HUMAN)
AIFDEWMK

SEQ ID NO: 196681 - protein, 11 aa, Homo sapiens
  Native (TYRP2_HUMAN)
HPDYVITTQHW

SEQ ID NO: 196682 - protein, 10 aa, Homo sapiens
  Native (TYRP2_HUMAN)
HSFLNGTNAL

SEQ ID NO: 196683 - protein, 10 aa, Homo sapiens
  Native (TYRP2_HUMAN)
LISRNSRFSS

SEQ ID NO: 196684 - protein, 10 aa, Homo sapiens
  Native (TYRP2_HUMAN)
TWHRYHLLCL

SEQ ID NO: 196685 - protein, 9 aa, Homo sapiens
  Native (TYRP2_HUMAN)
ERKKPPVIR

SEQ ID NO: 196686 - protein, 11 aa, Homo sapiens
  Native (TYRP2_HUMAN)
AANDPIFVVLH

SEQ ID NO: 196687 - protein, 9 aa, Homo sapiens
  Native (TYRP2_HUMAN)
FLNGTNALP

SEQ ID NO: 196688 - protein, 10 aa, Homo sapiens
  Native (TYRP2_HUMAN)
DAIFDEWMKR

SEQ ID NO: 196689 - protein, 8 aa, Homo sapiens
  Native (TYRP2_HUMAN)
VMGTLVAL

SEQ ID NO: 196690 - protein, 9 aa, Homo sapiens
  Native (TYRP2_HUMAN)
NPPFFQNST

SEQ ID NO: 196691 - protein, 11 aa, Homo sapiens
  Native (TYRP2_HUMAN)
CNGTYEGLLRR

SEQ ID NO: 196692 - protein, 9 aa, Homo sapiens
  Native (TYRP2_HUMAN)
VNKECCPRL

SEQ ID NO: 196693 - protein, 11 aa, Homo sapiens
  Native (TYRP2_HUMAN)
FPRVCMTVDSL

SEQ ID NO: 196694 - protein, 8 aa, Homo sapiens
  Native (TYRP2_HUMAN)
SLDDYNHL

SEQ ID NO: 196695 - protein, 11 aa, Homo sapiens
  Native (TYRP2_HUMAN)
RNSRFSSWETV

SEQ ID NO: 196696 - protein, 10 aa, Homo sapiens
  Native (TYRP2_HUMAN)
FVVLHSFTDA

SEQ ID NO: 196697 - protein, 10 aa, Homo sapiens
  Native (TYRP2_HUMAN)
MGRNSMKLPT

SEQ ID NO: 196698 - protein, 11 aa, Homo sapiens
  Native (TYRP2_HUMAN)
QELAPIGHNRM

SEQ ID NO: 196699 - protein, 10 aa, Homo sapiens
  Native (TYRP2_HUMAN)
SFTDAIFDEW

SEQ ID NO: 196700 - protein, 10 aa, Homo sapiens
  Native (TYRP2_HUMAN)
TLCNGTYEGL

SEQ ID NO: 196701 - protein, 9 aa, Homo sapiens
  Native (TYRP2_HUMAN)
LAPIGHNRM

SEQ ID NO: 196702 - protein, 11 aa, Homo sapiens
  Native (TYRP2_HUMAN)
SVYDFFVWLHY

SEQ ID NO: 196703 - protein, 10 aa, Homo sapiens
  Native (TYRP2_HUMAN)
ESANVCGSQQ

SEQ ID NO: 196704 - protein, 8 aa, Homo sapiens
  Native (TYRP2_HUMAN)
GTYEGLLR

SEQ ID NO: 196705 - protein, 11 aa, Homo sapiens
  Native (TYRP2_HUMAN)
ELAPIGHNRMY

SEQ ID NO: 196706 - protein, 9 aa, Homo sapiens
  Native (TYRP2_HUMAN)
YTPLMETHL

SEQ ID NO: 196707 - protein, 10 aa, Homo sapiens
  Native (TYRP2_HUMAN)
PLMETHLSSK

SEQ ID NO: 196708 - protein, 11 aa, Homo sapiens
  Native (TYRP2_HUMAN)
ILRNQDDRELW

SEQ ID NO: 196709 - protein, 11 aa, Homo sapiens
  Native (TYRP2_HUMAN)
PPVIRQNIHSL

SEQ ID NO: 196710 - protein, 11 aa, Homo sapiens
  Native (TYRP2_HUMAN)
ESFALPYWNFA

SEQ ID NO: 196711 - protein, 11 aa, Homo sapiens
  Native (TYRP2_HUMAN)
FQNSTFSFRNA

SEQ ID NO: 196712 - protein, 11 aa, Homo sapiens
  Native (TYRP2_HUMAN)
MSLHNLVHSFL

SEQ ID NO: 196713 - protein, 9 aa, Homo sapiens
  Native (TYRP2_HUMAN)
VVLHSFTDA

SEQ ID NO: 196714 - protein, 9 aa, Homo sapiens
  Native (TYRP2_HUMAN)
FFPPVTNEE

SEQ ID NO: 196715 - protein, 11 aa, Homo sapiens
  Native (TYRP2_HUMAN)
FSSWETVCDSL

SEQ ID NO: 196716 - protein, 10 aa, Homo sapiens
  Native (TYRP2_HUMAN)
QQGRGQCTEV

SEQ ID NO: 196717 - protein, 11 aa, Homo sapiens
  Native (TYRP2_HUMAN)
CPRLGAESANV

SEQ ID NO: 196718 - protein, 8 aa, Homo sapiens
  Native (TYRP2_HUMAN)
APIGHNRM

SEQ ID NO: 196719 - protein, 9 aa, Homo sapiens
  Native (TYRP2_HUMAN)
AARPDDPTL

SEQ ID NO: 196720 - protein, 10 aa, Homo sapiens
  Native (TYRP2_HUMAN)
HRYHLLCLER

SEQ ID NO: 196721 - protein, 8 aa, Homo sapiens
  Native (TYRP2_HUMAN)
SVYDFFVW

SEQ ID NO: 196722 - protein, 9 aa, Homo sapiens
  Native (TYRP2_HUMAN)
KRFNPPADA

SEQ ID NO: 196723 - protein, 9 aa, Homo sapiens
  Native (TYRP2_HUMAN)
YVITTQHWL

SEQ ID NO: 196724 - protein, 10 aa, Homo sapiens
  Native (TYRP2_HUMAN)
ECDVCTDQLF

SEQ ID NO: 196725 - protein, 9 aa, Homo sapiens
  Native (TYRP2_HUMAN)
PADAWPQEL

SEQ ID NO: 196726 - protein, 11 aa, Homo sapiens
  Native (TYRP2_HUMAN)
QNIHSLSPQER

SEQ ID NO: 196727 - protein, 8 aa, Homo sapiens
  Native (TYRP2_HUMAN)
FALPYWNF

SEQ ID NO: 196728 - protein, 9 aa, Homo sapiens
  Native (TYRP2_HUMAN)
GLFVLLAFL

SEQ ID NO: 196729 - protein, 10 aa, Homo sapiens
  Native (TYRP2_HUMAN)
MTVDSLVNKE

SEQ ID NO: 196730 - protein, 8 aa, Homo sapiens
  Native (TYRP2_HUMAN)
TDAIFDEW

SEQ ID NO: 196731 - protein, 10 aa, Homo sapiens
  Native (TYRP2_HUMAN)
VHSFLNGTNA

SEQ ID NO: 196732 - protein, 10 aa, Homo sapiens
  Native (TYRP2_HUMAN)
PPADAWPQEL

SEQ ID NO: 196733 - protein, 9 aa, Homo sapiens
  Native (TYRP2_HUMAN)
SRFSSWETV

SEQ ID NO: 196734 - protein, 10 aa, Homo sapiens
  Native (TYRP2_HUMAN)
LLAFLQYRRL

SEQ ID NO: 196735 - protein, 10 aa, Homo sapiens
  Native (TYRP2_HUMAN)
TLLVVMGTLV

SEQ ID NO: 196736 - protein, 8 aa, Homo sapiens
  Native (TYRP2_HUMAN)
LRKGYTPL

SEQ ID NO: 196737 - protein, 11 aa, Homo sapiens
  Native (TYRP2_HUMAN)
FSHQGPAFVTW

SEQ ID NO: 196738 - protein, 9 aa, Homo sapiens
  Native (TYRP2_HUMAN)
FLQYRRLRK

SEQ ID NO: 196739 - protein, 10 aa, Homo sapiens
  Native (TYRP2_HUMAN)
QFANCSVYDF

SEQ ID NO: 196740 - protein, 9 aa, Homo sapiens
  Native (TYRP2_HUMAN)
DQLGYSYAI

SEQ ID NO: 196741 - protein, 9 aa, Homo sapiens
  Native (TYRP2_HUMAN)
FQNSTFSFR

SEQ ID NO: 196742 - protein, 10 aa, Homo sapiens
  Native (TYRP2_HUMAN)
GRNSMKLPTL

SEQ ID NO: 196743 - protein, 9 aa, Homo sapiens
  Native (TYRP2_HUMAN)
ITTQHWLGL

SEQ ID NO: 196744 - protein, 8 aa, Homo sapiens
  Native (TYRP2_HUMAN)
LERDLQRL

SEQ ID NO: 196745 - protein, 8 aa, Homo sapiens
  Native (TYRP2_HUMAN)
VPFFPPVT

SEQ ID NO: 196746 - protein, 11 aa, Homo sapiens
  Native (TYRP2_HUMAN)
TFSFRNALEGF

SEQ ID NO: 196747 - protein, 9 aa, Homo sapiens
  Native (TYRP2_HUMAN)
ELWPRKFFH

SEQ ID NO: 196748 - protein, 8 aa, Homo sapiens
  Native (TYRP2_HUMAN)
HNLVHSFL

SEQ ID NO: 196749 - protein, 11 aa, Homo sapiens
  Native (TYRP2_HUMAN)
SLSPQEREQFL

SEQ ID NO: 196750 - protein, 9 aa, Homo sapiens
  Native (TYRP2_HUMAN)
VDSLVNKEC

SEQ ID NO: 196751 - protein, 8 aa, Homo sapiens
  Native (TYRP2_HUMAN)
HRYHLLCL

SEQ ID NO: 196752 - protein, 8 aa, Homo sapiens
  Native (TYRP2_HUMAN)
TVDSLVNK

SEQ ID NO: 196753 - protein, 9 aa, Homo sapiens
  Native (TYRP2_HUMAN)
QHWLGLLGP

SEQ ID NO: 196754 - protein, 10 aa, Homo sapiens
  Native (TYRP2_HUMAN)
GTLDSQVMSL

SEQ ID NO: 196755 - protein, 10 aa, Homo sapiens
  Native (TYRP2_HUMAN)
RELWPRKFFH

SEQ ID NO: 196756 - protein, 9 aa, Homo sapiens
  Native (TYRP2_HUMAN)
IGHNRMYNM

SEQ ID NO: 196757 - protein, 9 aa, Homo sapiens
  Native (TYRP2_HUMAN)
NMVPFFPPV

SEQ ID NO: 196758 - protein, 8 aa, Homo sapiens
  Native (TYRP2_HUMAN)
LTSDQLGY

SEQ ID NO: 196759 - protein, 11 aa, Homo sapiens
  Native (TYRP2_HUMAN)
GTLDSQVMSLH

SEQ ID NO: 196760 - protein, 11 aa, Homo sapiens
  Native (TYRP2_HUMAN)
PFFQNSTFSFR

SEQ ID NO: 196761 - protein, 9 aa, Homo sapiens
  Native (TYRP2_HUMAN)
ADGTLDSQV

SEQ ID NO: 196762 - protein, 11 aa, Homo sapiens
  Native (TYRP2_HUMAN)
DTRPWSGPYIL

SEQ ID NO: 196763 - protein, 11 aa, Homo sapiens
  Native (TYRP2_HUMAN)
SVRDTLLGPGR

SEQ ID NO: 196764 - protein, 9 aa, Homo sapiens
  Native (TYRP2_HUMAN)
CDVCTDQLF

SEQ ID NO: 196765 - protein, 8 aa, Homo sapiens
  Native (TYRP2_HUMAN)
SPLWWGFL

SEQ ID NO: 196766 - protein, 10 aa, Homo sapiens
  Native (TYRP2_HUMAN)
LLVVMGTLVA

SEQ ID NO: 196767 - protein, 9 aa, Homo sapiens
  Native (TYRP2_HUMAN)
EETPGWPTT

SEQ ID NO: 196768 - protein, 11 aa, Homo sapiens
  Native (TYRP2_HUMAN)
RMYNMVPFFPP

SEQ ID NO: 196769 - protein, 9 aa, Homo sapiens
  Native (TYRP2_HUMAN)
ADAWPQELA

SEQ ID NO: 196770 - protein, 9 aa, Homo sapiens
  Native (TYRP2_HUMAN)
SWETVCDSL

SEQ ID NO: 196771 - protein, 10 aa, Homo sapiens
  Native (TYRP2_HUMAN)
YSYAIDLPVS

SEQ ID NO: 196772 - protein, 9 aa, Homo sapiens
  Native (TYRP2_HUMAN)
VVMGTLVAL

SEQ ID NO: 196773 - protein, 8 aa, Homo sapiens
  Native (TYRP2_HUMAN)
AANDPIFV

SEQ ID NO: 196774 - protein, 11 aa, Homo sapiens
  Native (TYRP2_HUMAN)
QFANCSVYDFF

SEQ ID NO: 196775 - protein, 10 aa, Homo sapiens
  Native (TYRP2_HUMAN)
VVLHSFTDAI

SEQ ID NO: 196776 - protein, 10 aa, Homo sapiens
  Native (TYRP2_HUMAN)
NESFALPYWN

SEQ ID NO: 196777 - protein, 11 aa, Homo sapiens
  Native (TYRP2_HUMAN)
TLCNGTYEGLL

SEQ ID NO: 196778 - protein, 8 aa, Homo sapiens
  Native (TYRP2_HUMAN)
NDPIFVVL

SEQ ID NO: 196779 - protein, 9 aa, Homo sapiens
  Native (TYRP2_HUMAN)
RELWPRKFF

SEQ ID NO: 196780 - protein, 8 aa, Homo sapiens
  Native (TYRP2_HUMAN)
NQMGRNSM

SEQ ID NO: 196781 - protein, 11 aa, Homo sapiens
  Native (TYRP2_HUMAN)
ILPGAQGQFPR

SEQ ID NO: 196782 - protein, 10 aa, Homo sapiens
  Native (TYRP2_HUMAN)
TLLGPGRPYR

SEQ ID NO: 196783 - protein, 8 aa, Homo sapiens
  Native (TYRP2_HUMAN)
DTLLGPGR

SEQ ID NO: 196784 - protein, 11 aa, Homo sapiens
  Native (TYRP2_HUMAN)
VHSFLNGTNAL

SEQ ID NO: 196785 - protein, 10 aa, Homo sapiens
  Native (TYRP2_HUMAN)
SRFSSWETVC

SEQ ID NO: 196786 - protein, 9 aa, Homo sapiens
  Native (TYRP2_HUMAN)
GALDLAKKR

SEQ ID NO: 196787 - protein, 8 aa, Homo sapiens
  Native (TYRP2_HUMAN)
DFFVWLHY

SEQ ID NO: 196788 - protein, 8 aa, Homo sapiens
  Native (TYRP2_HUMAN)
WETVCDSL

SEQ ID NO: 196789 - protein, 11 aa, Homo sapiens
  Native (TYRP2_HUMAN)
SQVMSLHNLVH

SEQ ID NO: 196790 - protein, 8 aa, Homo sapiens
  Native (TYRP2_HUMAN)
LHSFTDAI

SEQ ID NO: 196791 - protein, 9 aa, Homo sapiens
  Native (TYRP2_HUMAN)
QYRRLRKGY

SEQ ID NO: 196792 - protein, 9 aa, Homo sapiens
  Native (TYRP2_HUMAN)
HQGPAFVTW

SEQ ID NO: 196793 - protein, 11 aa, Homo sapiens
  Native (TYRP2_HUMAN)
LLAFLQYRRLR

SEQ ID NO: 196794 - protein, 10 aa, Homo sapiens
  Native (TYRP2_HUMAN)
VALVGLFVLL

SEQ ID NO: 196795 - protein, 10 aa, Homo sapiens
  Native (TYRP2_HUMAN)
PFFQNSTFSF

SEQ ID NO: 196796 - protein, 10 aa, Homo sapiens
  Native (TYRP2_HUMAN)
SHQGPAFVTW

SEQ ID NO: 196797 - protein, 8 aa, Homo sapiens
  Native (TYRP2_HUMAN)
FDEWMKRF

SEQ ID NO: 196798 - protein, 9 aa, Homo sapiens
  Native (TYRP2_HUMAN)
GYNCGDCKF

SEQ ID NO: 196799 - protein, 8 aa, Homo sapiens
  Native (TYRP2_HUMAN)
TFSFRNAL

SEQ ID NO: 196800 - protein, 9 aa, Homo sapiens
  Native (TYRP2_HUMAN)
ESANVCGSQ

SEQ ID NO: 196801 - protein, 10 aa, Homo sapiens
  Native (TYRP2_HUMAN)
KRFNPPADAW

SEQ ID NO: 196802 - protein, 10 aa, Homo sapiens
  Native (TYRP2_HUMAN)
LERDLQRLIG

SEQ ID NO: 196803 - protein, 10 aa, Homo sapiens
  Native (TYRP2_HUMAN)
AFVTWHRYHL

SEQ ID NO: 196804 - protein, 10 aa, Homo sapiens
  Native (TYRP2_HUMAN)
LMETHLSSKR

SEQ ID NO: 196805 - protein, 10 aa, Homo sapiens
  Native (TYRP2_HUMAN)
TQPQFANCSV

SEQ ID NO: 196806 - protein, 11 aa, Homo sapiens
  Native (TYRP2_HUMAN)
LRRNQMGRNSM

SEQ ID NO: 196807 - protein, 11 aa, Homo sapiens
  Native (TYRP2_HUMAN)
PPFFQNSTFSF

SEQ ID NO: 196808 - protein, 9 aa, Homo sapiens
  Native (TYRP2_HUMAN)
WHRYHLLCL

SEQ ID NO: 196809 - protein, 9 aa, Homo sapiens
  Native (TYRP2_HUMAN)
ALPYWNFAT

SEQ ID NO: 196810 - protein, 8 aa, Homo sapiens
  Native (TYRP2_HUMAN)
TRPWSGPY

SEQ ID NO: 196811 - protein, 11 aa, Homo sapiens
  Native (TYRP2_HUMAN)
WLHYYSVRDTL

SEQ ID NO: 196812 - protein, 10 aa, Homo sapiens
  Native (TYRP2_HUMAN)
FTDAIFDEWM

SEQ ID NO: 196813 - protein, 11 aa, Homo sapiens
  Native (TYRP2_HUMAN)
FVVLHSFTDAI

SEQ ID NO: 196814 - protein, 11 aa, Homo sapiens
  Native (TYRP2_HUMAN)
DIRDCLSLQKF

SEQ ID NO: 196815 - protein, 9 aa, Homo sapiens
  Native (TYRP2_HUMAN)
FLLSCLGCK

SEQ ID NO: 196816 - protein, 10 aa, Homo sapiens
  Native (TYRP2_HUMAN)
VLLAFLQYRR

SEQ ID NO: 196817 - protein, 8 aa, Homo sapiens
  Native (TYRP2_HUMAN)
LSCLGCKI

SEQ ID NO: 196818 - protein, 10 aa, Homo sapiens
  Native (TYRP2_HUMAN)
KILPGAQGQF

SEQ ID NO: 196819 - protein, 10 aa, Homo sapiens
  Native (TYRP2_HUMAN)
TRPWSGPYIL

SEQ ID NO: 196820 - protein, 11 aa, Homo sapiens
  Native (TYRP2_HUMAN)
YRRLRKGYTPL

SEQ ID NO: 196821 - protein, 11 aa, Homo sapiens
  Native (TYRP2_HUMAN)
FPPVTNEELFL

SEQ ID NO: 196822 - protein, 10 aa, Homo sapiens
  Native (TYRP2_HUMAN)
DSLDDYNHLV

SEQ ID NO: 196823 - protein, 10 aa, Homo sapiens
  Native (TYRP2_HUMAN)
GLLRRNQMGR

SEQ ID NO: 196824 - protein, 11 aa, Homo sapiens
  Native (TYRP2_HUMAN)
FGWTGPNCERK

SEQ ID NO: 196825 - protein, 9 aa, Homo sapiens
  Native (TYRP2_HUMAN)
GWPTTLLVV

SEQ ID NO: 196826 - protein, 11 aa, Homo sapiens
  Native (TYRP2_HUMAN)
LEGFDKADGTL

SEQ ID NO: 196827 - protein, 10 aa, Homo sapiens
  Native (TYRP2_HUMAN)
ITTQHWLGLL

SEQ ID NO: 196828 - protein, 11 aa, Homo sapiens
  Native (TYRP2_HUMAN)
NESFALPYWNF

SEQ ID NO: 196829 - protein, 10 aa, Homo sapiens
  Native (TYRP2_HUMAN)
HYYSVRDTLL

SEQ ID NO: 196830 - protein, 10 aa, Homo sapiens
  Native (TYRP2_HUMAN)
SLHNLVHSFL

SEQ ID NO: 196831 - protein, 11 aa, Homo sapiens
  Native (TYRP2_HUMAN)
VYDFFVWLHYY

SEQ ID NO: 196832 - protein, 9 aa, Homo sapiens
  Native (TYRP2_HUMAN)
NALEGFDKA

SEQ ID NO: 196833 - protein, 8 aa, Homo sapiens
  Native (TYRP2_HUMAN)
CERKKPPV

SEQ ID NO: 196834 - protein, 10 aa, Homo sapiens
  Native (TYRP2_HUMAN)
FGWTGPNCER

SEQ ID NO: 196835 - protein, 8 aa, Homo sapiens
  Native (TYRP2_HUMAN)
PPVTNEEL

SEQ ID NO: 196836 - protein, 9 aa, Homo sapiens
  Native (TYRP2_HUMAN)
EREQFLGAL

SEQ ID NO: 196837 - protein, 9 aa, Homo sapiens
  Native (TYRP2_HUMAN)
GQFPRVCMT

SEQ ID NO: 196838 - protein, 8 aa, Homo sapiens
  Native (TYRP2_HUMAN)
FSHQGPAF

SEQ ID NO: 196839 - protein, 11 aa, Homo sapiens
  Native (TYRP2_HUMAN)
DEWMKRFNPPA

SEQ ID NO: 196840 - protein, 9 aa, Homo sapiens
  Native (TYRP2_HUMAN)
QPQFANCSV

SEQ ID NO: 196841 - protein, 9 aa, Homo sapiens
  Native (TYRP2_HUMAN)
GRGQCTEVR

SEQ ID NO: 196842 - protein, 8 aa, Homo sapiens
  Native (TYRP2_HUMAN)
IFDEWMKR

SEQ ID NO: 196843 - protein, 8 aa, Homo sapiens
  Native (TYRP2_HUMAN)
SDQLGYSY

SEQ ID NO: 196844 - protein, 9 aa, Homo sapiens
  Native (TYRP2_HUMAN)
GRPYRAIDF

SEQ ID NO: 196845 - protein, 9 aa, Homo sapiens
  Native (TYRP2_HUMAN)
RTCKCTGNF

SEQ ID NO: 196846 - protein, 9 aa, Homo sapiens
  Native (TYRP2_HUMAN)
TLVALVGLF

SEQ ID NO: 196847 - protein, 11 aa, Homo sapiens
  Native (TYRP2_HUMAN)
SPLWWGFLLSC

SEQ ID NO: 196848 - protein, 9 aa, Homo sapiens
  Native (TYRP2_HUMAN)
RNQDDRELW

SEQ ID NO: 196849 - protein, 9 aa, Homo sapiens
  Native (TYRP2_HUMAN)
HLLCLERDL

SEQ ID NO: 196850 - protein, 10 aa, Homo sapiens
  Native (TYRP2_HUMAN)
LAFLQYRRLR

SEQ ID NO: 196851 - protein, 8 aa, Homo sapiens
  Native (TYRP2_HUMAN)
YVITTQHW

SEQ ID NO: 196852 - protein, 10 aa, Homo sapiens
  Native (TYRP2_HUMAN)
YNCGDCKFGW

SEQ ID NO: 196853 - protein, 11 aa, Homo sapiens
  Native (TYRP2_HUMAN)
FTDAIFDEWMK

SEQ ID NO: 196854 - protein, 11 aa, Homo sapiens
  Native (TYRP2_HUMAN)
KECCPRLGAES

SEQ ID NO: 196855 - protein, 9 aa, Homo sapiens
  Native (TYRP2_HUMAN)
IRDCLSLQK

SEQ ID NO: 196856 - protein, 9 aa, Homo sapiens
  Native (TYRP2_HUMAN)
GPGRPYRAI

SEQ ID NO: 196857 - protein, 8 aa, Homo sapiens
  Native (TYRP2_HUMAN)
NSMKLPTL

SEQ ID NO: 196858 - protein, 10 aa, Homo sapiens
  Native (TYRP2_HUMAN)
VGLFVLLAFL

SEQ ID NO: 196859 - protein, 10 aa, Homo sapiens
  Native (TYRP2_HUMAN)
CNGTYEGLLR

SEQ ID NO: 196860 - protein, 8 aa, Homo sapiens
  Native (TYRP2_HUMAN)
NESFALPY

SEQ ID NO: 196861 - protein, 11 aa, Homo sapiens
  Native (TYRP2_HUMAN)
RDTLLGPGRPY

SEQ ID NO: 196862 - protein, 9 aa, Homo sapiens
  Native (TYRP2_HUMAN)
RDCLSLQKF

SEQ ID NO: 196863 - protein, 10 aa, Homo sapiens
  Native (TYRP2_HUMAN)
NQDDRELWPR

SEQ ID NO: 196864 - protein, 11 aa, Homo sapiens
  Native (TYRP2_HUMAN)
GRNSMKLPTLK

SEQ ID NO: 196865 - protein, 11 aa, Homo sapiens
  Native (TYRP2_HUMAN)
HQGPAFVTWHR

SEQ ID NO: 196866 - protein, 10 aa, Homo sapiens
  Native (TYRP2_HUMAN)
VVMGTLVALV

SEQ ID NO: 196867 - protein, 11 aa, Homo sapiens
  Native (TYRP2_HUMAN)
CKILPGAQGQF

SEQ ID NO: 196868 - protein, 11 aa, Homo sapiens
  Native (TYRP2_HUMAN)
FFQNSTFSFRN

SEQ ID NO: 196869 - protein, 10 aa, Homo sapiens
  Native (TYRP2_HUMAN)
AIFDEWMKRF

SEQ ID NO: 196870 - protein, 11 aa, Homo sapiens
  Native (TYRP2_HUMAN)
NEELFLTSDQL

SEQ ID NO: 196871 - protein, 11 aa, Homo sapiens
  Native (TYRP2_HUMAN)
FFVWLHYYSVR

SEQ ID NO: 196872 - protein, 9 aa, Homo sapiens
  Native (TYRP2_HUMAN)
SDQLGYSYA

SEQ ID NO: 196873 - protein, 10 aa, Homo sapiens
  Native (TYRP2_HUMAN)
WTGPNCERKK

SEQ ID NO: 196874 - protein, 9 aa, Homo sapiens
  Native (TYRP2_HUMAN)
FVWLHYYSV

SEQ ID NO: 196875 - protein, 11 aa, Homo sapiens
  Native (TYRP2_HUMAN)
LISRNSRFSSW

SEQ ID NO: 196876 - protein, 10 aa, Homo sapiens
  Native (TYRP2_HUMAN)
QPQFANCSVY

SEQ ID NO: 196877 - protein, 11 aa, Homo sapiens
  Native (TYRP2_HUMAN)
HNRMYNMVPFF

SEQ ID NO: 196878 - protein, 11 aa, Homo sapiens
  Native (TYRP2_HUMAN)
TPGWPTTLLVV

SEQ ID NO: 196879 - protein, 8 aa, Homo sapiens
  Native (TYRP2_HUMAN)
AQGQFPRV

SEQ ID NO: 196880 - protein, 8 aa, Homo sapiens
  Native (TYRP2_HUMAN)
ETHLSSKR

SEQ ID NO: 196881 - protein, 11 aa, Homo sapiens
  Native (TYRP2_HUMAN)
DSLVNKECCPR

SEQ ID NO: 196882 - protein, 10 aa, Homo sapiens
  Native (TYRP2_HUMAN)
FVLLAFLQYR

SEQ ID NO: 196883 - protein, 9 aa, Homo sapiens
  Native (TYRP2_HUMAN)
AESANVCGS

SEQ ID NO: 196884 - protein, 11 aa, Homo sapiens
  Native (TYRP2_HUMAN)
MYNMVPFFPPV

SEQ ID NO: 196885 - protein, 9 aa, Homo sapiens
  Native (TYRP2_HUMAN)
APIGHNRMY

SEQ ID NO: 196886 - protein, 10 aa, Homo sapiens
  Native (TYRP2_HUMAN)
GAARPDDPTL

SEQ ID NO: 196887 - protein, 11 aa, Homo sapiens
  Native (TYRP2_HUMAN)
LPTLKDIRDCL

SEQ ID NO: 196888 - protein, 11 aa, Homo sapiens
  Native (TYRP2_HUMAN)
RELWPRKFFHR

SEQ ID NO: 196889 - protein, 8 aa, Homo sapiens
  Native (TYRP2_HUMAN)
LLAFLQYR

SEQ ID NO: 196890 - protein, 9 aa, Homo sapiens
  Native (TYRP2_HUMAN)
PTLISRNSR

SEQ ID NO: 196891 - protein, 10 aa, Homo sapiens
  Native (TYRP2_HUMAN)
SYAIDLPVSV

SEQ ID NO: 196892 - protein, 11 aa, Homo sapiens
  Native (TYRP2_HUMAN)
ANCSVYDFFVW

SEQ ID NO: 196893 - protein, 9 aa, Homo sapiens
  Native (TYRP2_HUMAN)
PPFFQNSTF

SEQ ID NO: 196894 - protein, 10 aa, Homo sapiens
  Native (TYRP2_HUMAN)
IDFSHQGPAF

SEQ ID NO: 196895 - protein, 8 aa, Homo sapiens
  Native (TYRP2_HUMAN)
IRQNIHSL

SEQ ID NO: 196896 - protein, 9 aa, Homo sapiens
  Native (TYRP2_HUMAN)
VLHSFTDAI

SEQ ID NO: 196897 - protein, 9 aa, Homo sapiens
  Native (TYRP2_HUMAN)
LQKFDNPPF

SEQ ID NO: 196898 - protein, 11 aa, Homo sapiens
  Native (TYRP2_HUMAN)
ALPYWNFATGR

SEQ ID NO: 196899 - protein, 9 aa, Homo sapiens
  Native (TYRP2_HUMAN)
KECCPRLGA

SEQ ID NO: 196900 - protein, 8 aa, Homo sapiens
  Native (TYRP2_HUMAN)
DQLFGAAR

SEQ ID NO: 196901 - protein, 11 aa, Homo sapiens
  Native (TYRP2_HUMAN)
EGLLRRNQMGR

SEQ ID NO: 196902 - protein, 8 aa, Homo sapiens
  Native (TYRP2_HUMAN)
SYAIDLPV

SEQ ID NO: 196903 - protein, 9 aa, Homo sapiens
  Native (TYRP2_HUMAN)
LPVSVEETP

SEQ ID NO: 196904 - protein, 10 aa, Homo sapiens
  Native (TYRP2_HUMAN)
LPHSAANDPI

SEQ ID NO: 196905 - protein, 10 aa, Homo sapiens
  Native (TYRP2_HUMAN)
YNMVPFFPPV

SEQ ID NO: 196906 - protein, 9 aa, Homo sapiens
  Native (TYRP2_HUMAN)
DFSHQGPAF

SEQ ID NO: 196907 - protein, 11 aa, Homo sapiens
  Native (TYRP2_HUMAN)
ARPDDPTLISR

SEQ ID NO: 196908 - protein, 9 aa, Homo sapiens
  Native (TYRP2_HUMAN)
IFDEWMKRF

SEQ ID NO: 196909 - protein, 10 aa, Homo sapiens
  Native (TYRP2_HUMAN)
NQMGRNSMKL

SEQ ID NO: 196910 - protein, 9 aa, Homo sapiens
  Native (TYRP2_HUMAN)
QVMSLHNLV

SEQ ID NO: 196911 - protein, 10 aa, Homo sapiens
  Native (TYRP2_HUMAN)
HPDYVITTQH

SEQ ID NO: 196912 - protein, 8 aa, Homo sapiens
  Native (TYRP2_HUMAN)
TQHWLGLL

SEQ ID NO: 196913 - protein, 11 aa, Homo sapiens
  Native (TYRP2_HUMAN)
LVVMGTLVALV

SEQ ID NO: 196914 - protein, 10 aa, Homo sapiens
  Native (TYRP2_HUMAN)
SDQLGYSYAI

SEQ ID NO: 196915 - protein, 11 aa, Homo sapiens
  Native (TYRP2_HUMAN)
HSAANDPIFVV

SEQ ID NO: 196916 - protein, 10 aa, Homo sapiens
  Native (TYRP2_HUMAN)
GNESFALPYW

SEQ ID NO: 196917 - protein, 8 aa, Homo sapiens
  Native (TYRP2_HUMAN)
KFFHRTCK

SEQ ID NO: 196918 - protein, 10 aa, Homo sapiens
  Native (TYRP2_HUMAN)
YHLLCLERDL

SEQ ID NO: 196919 - protein, 11 aa, Homo sapiens
  Native (TYRP2_HUMAN)
GPNCERKKPPV

SEQ ID NO: 196920 - protein, 10 aa, Homo sapiens
  Native (TYRP2_HUMAN)
NCSVYDFFVW

SEQ ID NO: 196921 - protein, 8 aa, Homo sapiens
  Native (TYRP2_HUMAN)
LGALDLAK

SEQ ID NO: 196922 - protein, 9 aa, Homo sapiens
  Native (TYRP2_HUMAN)
NCGDCKFGW

SEQ ID NO: 196923 - protein, 11 aa, Homo sapiens
  Native (TYRP2_HUMAN)
FGAARPDDPTL

SEQ ID NO: 196924 - protein, 8 aa, Homo sapiens
  Native (TYRP2_HUMAN)
RELWPRKF

SEQ ID NO: 196925 - protein, 9 aa, Homo sapiens
  Native (TYRP2_HUMAN)
VMGTLVALV

SEQ ID NO: 196926 - protein, 8 aa, Homo sapiens
  Native (TYRP2_HUMAN)
VALVGLFV

SEQ ID NO: 196927 - protein, 10 aa, Homo sapiens
  Native (TYRP2_HUMAN)
AQGQFPRVCM

SEQ ID NO: 196928 - protein, 11 aa, Homo sapiens
  Native (TYRP2_HUMAN)
KRFNPPADAWP

SEQ ID NO: 196929 - protein, 10 aa, Homo sapiens
  Native (TYRP2_HUMAN)
LPGAQGQFPR

SEQ ID NO: 196930 - protein, 9 aa, Homo sapiens
  Native (TYRP2_HUMAN)
AQGQFPRVC

SEQ ID NO: 196931 - protein, 10 aa, Homo sapiens
  Native (TYRP2_HUMAN)
AIDFSHQGPA

SEQ ID NO: 196932 - protein, 9 aa, Homo sapiens
  Native (TYRP2_HUMAN)
DIRDCLSLQ

SEQ ID NO: 196933 - protein, 10 aa, Homo sapiens
  Native (TYRP2_HUMAN)
AARPDDPTLI

SEQ ID NO: 196934 - protein, 8 aa, Homo sapiens
  Native (TYRP2_HUMAN)
GALDLAKK

SEQ ID NO: 196935 - protein, 8 aa, Homo sapiens
  Native (TYRP2_HUMAN)
RNSRFSSW

SEQ ID NO: 196936 - protein, 9 aa, Homo sapiens
  Native (TYRP2_HUMAN)
RPDDPTLIS

SEQ ID NO: 196937 - protein, 9 aa, Homo sapiens
  Native (TYRP2_HUMAN)
LAFLQYRRL

SEQ ID NO: 196938 - protein, 10 aa, Homo sapiens
  Native (TYRP2_HUMAN)
SVRDTLLGPG

SEQ ID NO: 196939 - protein, 10 aa, Homo sapiens
  Native (TYRP2_HUMAN)
FPRVCMTVDS

SEQ ID NO: 196940 - protein, 9 aa, Homo sapiens
  Native (TYRP2_HUMAN)
ILPGAQGQF

SEQ ID NO: 196941 - protein, 9 aa, Homo sapiens
  Native (TYRP2_HUMAN)
ECDVCTDQL

SEQ ID NO: 196942 - protein, 9 aa, Homo sapiens
  Native (TYRP2_HUMAN)
GNESFALPY

SEQ ID NO: 196943 - protein, 10 aa, Homo sapiens
  Native (TYRP2_HUMAN)
KKRVHPDYVI

SEQ ID NO: 196944 - protein, 10 aa, Homo sapiens
  Native (TYRP2_HUMAN)
QVMSLHNLVH

SEQ ID NO: 196945 - protein, 11 aa, Homo sapiens
  Native (TYRP2_HUMAN)
TLKDIRDCLSL

SEQ ID NO: 196946 - protein, 9 aa, Homo sapiens
  Native (TYRP2_HUMAN)
FLTSDQLGY

SEQ ID NO: 196947 - protein, 10 aa, Homo sapiens
  Native (TYRP2_HUMAN)
GPAFVTWHRY

SEQ ID NO: 196948 - protein, 10 aa, Homo sapiens
  Native (TYRP2_HUMAN)
VMGTLVALVG

SEQ ID NO: 196949 - protein, 10 aa, Homo sapiens
  Native (TYRP2_HUMAN)
LKDIRDCLSL

SEQ ID NO: 196950 - protein, 11 aa, Homo sapiens
  Native (TYRP2_HUMAN)
RLIGNESFALP

SEQ ID NO: 196951 - protein, 9 aa, Homo sapiens
  Native (TYRP2_HUMAN)
SHQGPAFVT

SEQ ID NO: 196952 - protein, 8 aa, Homo sapiens
  Native (TYRP2_HUMAN)
NALEGFDK

SEQ ID NO: 196953 - protein, 10 aa, Homo sapiens
  Native (TYRP2_HUMAN)
FSFRNALEGF

SEQ ID NO: 196954 - protein, 9 aa, Homo sapiens
  Native (TYRP2_HUMAN)
RLIGNESFA

SEQ ID NO: 196955 - protein, 9 aa, Homo sapiens
  Native (TYRP2_HUMAN)
ELFLTSDQL

SEQ ID NO: 196956 - protein, 8 aa, Homo sapiens
  Native (TYRP2_HUMAN)
DYNHLVTL

SEQ ID NO: 196957 - protein, 10 aa, Homo sapiens
  Native (TYRP2_HUMAN)
TPLMETHLSS

SEQ ID NO: 196958 - protein, 9 aa, Homo sapiens
  Native (TYRP2_HUMAN)
DEWMKRFNP

SEQ ID NO: 196959 - protein, 8 aa, Homo sapiens
  Native (TYRP2_HUMAN)
FFVWLHYY

SEQ ID NO: 196960 - protein, 10 aa, Homo sapiens
  Native (TYRP2_HUMAN)
PVSVEETPGW

SEQ ID NO: 196961 - protein, 10 aa, Homo sapiens
  Native (TYRP2_HUMAN)
ADTRPWSGPY

SEQ ID NO: 196962 - protein, 11 aa, Homo sapiens
  Native (TYRP2_HUMAN)
QPQFANCSVYD

SEQ ID NO: 196963 - protein, 10 aa, Homo sapiens
  Native (TYRP2_HUMAN)
LHYYSVRDTL

SEQ ID NO: 196964 - protein, 11 aa, Homo sapiens
  Native (TYRP2_HUMAN)
NECDVCTDQLF

SEQ ID NO: 196965 - protein, 10 aa, Homo sapiens
  Native (TYRP2_HUMAN)
HNRMYNMVPF

SEQ ID NO: 196966 - protein, 9 aa, Homo sapiens
  Native (TYRP2_HUMAN)
LHSFTDAIF

SEQ ID NO: 196967 - protein, 10 aa, Homo sapiens
  Native (TYRP2_HUMAN)
HSAANDPIFV

SEQ ID NO: 196968 - protein, 11 aa, Homo sapiens
  Native (TYRP2_HUMAN)
TRPWSGPYILR

SEQ ID NO: 196969 - protein, 10 aa, Homo sapiens
  Native (TYRP2_HUMAN)
FFVWLHYYSV

SEQ ID NO: 196970 - protein, 8 aa, Homo sapiens
  Native (TYRP2_HUMAN)
PFFQNSTF

SEQ ID NO: 196971 - protein, 8 aa, Homo sapiens
  Native (TYRP2_HUMAN)
VYDFFVWL

SEQ ID NO: 196972 - protein, 11 aa, Homo sapiens
  Native (TYRP2_HUMAN)
YNMVPFFPPVT

SEQ ID NO: 196973 - protein, 9 aa, Homo sapiens
  Native (TYRP2_HUMAN)
CERKKPPVI

SEQ ID NO: 196974 - protein, 9 aa, Homo sapiens
  Native (TYRP2_HUMAN)
GRNSMKLPT

SEQ ID NO: 196975 - protein, 11 aa, Homo sapiens
  Native (TYRP2_HUMAN)
QRLIGNESFAL

SEQ ID NO: 196976 - protein, 8 aa, Homo sapiens
  Native (TYRP2_HUMAN)
SMKLPTLK

SEQ ID NO: 196977 - protein, 8 aa, Homo sapiens
  Native (TYRP2_HUMAN)
RLIGNESF

SEQ ID NO: 196978 - protein, 11 aa, Homo sapiens
  Native (TYRP2_HUMAN)
TQPQFANCSVY

SEQ ID NO: 196979 - protein, 9 aa, Homo sapiens
  Native (TYRP2_HUMAN)
RRNQMGRNS

SEQ ID NO: 196980 - protein, 11 aa, Homo sapiens
  Native (TYRP2_HUMAN)
EETPGWPTTLL

SEQ ID NO: 196981 - protein, 10 aa, Homo sapiens
  Native (TYRP2_HUMAN)
GPNGTQPQFA

SEQ ID NO: 196982 - protein, 10 aa, Homo sapiens
  Native (TYRP2_HUMAN)
DIRDCLSLQK

SEQ ID NO: 196983 - protein, 8 aa, Homo sapiens
  Native (TYRP2_HUMAN)
MYNMVPFF

SEQ ID NO: 196984 - protein, 11 aa, Homo sapiens
  Native (TYRP2_HUMAN)
YVITTQHWLGL

SEQ ID NO: 196985 - protein, 11 aa, Homo sapiens
  Native (TYRP2_HUMAN)
NHLVTLCNGTY

SEQ ID NO: 196986 - protein, 9 aa, Homo sapiens
  Native (TYRP2_HUMAN)
VPFFPPVTN

SEQ ID NO: 196987 - protein, 9 aa, Homo sapiens
  Native (TYRP2_HUMAN)
TNALPHSAA

SEQ ID NO: 196988 - protein, 9 aa, Homo sapiens
  Native (TYRP2_HUMAN)
YSVRDTLLG

SEQ ID NO: 196989 - protein, 9 aa, Homo sapiens
  Native (TYRP2_HUMAN)
RPYRAIDFS

SEQ ID NO: 196990 - protein, 11 aa, Homo sapiens
  Native (TYRP2_HUMAN)
EQFLGALDLAK

SEQ ID NO: 196991 - protein, 10 aa, Homo sapiens
  Native (TYRP2_HUMAN)
LQRLIGNESF

SEQ ID NO: 196992 - protein, 9 aa, Homo sapiens
  Native (TYRP2_HUMAN)
RNSMKLPTL

SEQ ID NO: 196993 - protein, 10 aa, Homo sapiens
  Native (TYRP2_HUMAN)
GRGQCTEVRA

SEQ ID NO: 196994 - protein, 10 aa, Homo sapiens
  Native (TYRP2_HUMAN)
ESFALPYWNF

SEQ ID NO: 196995 - protein, 9 aa, Homo sapiens
  Native (TYRP2_HUMAN)
VYDFFVWLH

SEQ ID NO: 196996 - protein, 9 aa, Homo sapiens
  Native (TYRP2_HUMAN)
AKKRVHPDY

SEQ ID NO: 196997 - protein, 9 aa, Homo sapiens
  Native (TYRP2_HUMAN)
PGAQGQFPR

SEQ ID NO: 196998 - protein, 10 aa, Homo sapiens
  Native (TYRP2_HUMAN)
VRDTLLGPGR

SEQ ID NO: 196999 - protein, 11 aa, Homo sapiens
  Native (TYRP2_HUMAN)
LLGPGRPYRAI

SEQ ID NO: 197000 - protein, 10 aa, Homo sapiens
  Native (TYRP2_HUMAN)
SLSPQEREQF

SEQ ID NO: 197001 - protein, 9 aa, Homo sapiens
  Native (TYRP2_HUMAN)
KPPVIRQNI

SEQ ID NO: 197002 - protein, 10 aa, Homo sapiens
  Native (TYRP2_HUMAN)
RVCMTVDSLV

SEQ ID NO: 197003 - protein, 8 aa, Homo sapiens
  Native (TYRP2_HUMAN)
ALVGLFVL

SEQ ID NO: 197004 - protein, 9 aa, Homo sapiens
  Native (TYRP2_HUMAN)
EVRADTRPW

SEQ ID NO: 197005 - protein, 8 aa, Homo sapiens
  Native (TYRP2_HUMAN)
TPLMETHL

SEQ ID NO: 197006 - protein, 8 aa, Homo sapiens
  Native (TYRP2_HUMAN)
GQFPRVCM

SEQ ID NO: 197007 - protein, 10 aa, Homo sapiens
  Native (TYRP2_HUMAN)
LLSCLGCKIL

SEQ ID NO: 197008 - protein, 10 aa, Homo sapiens
  Native (TYRP2_HUMAN)
LWWGFLLSCL

SEQ ID NO: 197009 - protein, 11 aa, Homo sapiens
  Native (TYRP2_HUMAN)
SQQGRGQCTEV

SEQ ID NO: 197010 - protein, 10 aa, Homo sapiens
  Native (TYRP2_HUMAN)
FRNALEGFDK

SEQ ID NO: 197011 - protein, 9 aa, Homo sapiens
  Native (TYRP2_HUMAN)
GWTGPNCER

SEQ ID NO: 197012 - protein, 9 aa, Homo sapiens
  Native (TYRP2_HUMAN)
SSKRYTEEA

SEQ ID NO: 197013 - protein, 9 aa, Homo sapiens
  Native (TYRP2_HUMAN)
VLLAFLQYR

SEQ ID NO: 197014 - protein, 10 aa, Homo sapiens
  Native (TYRP2_HUMAN)
EELFLTSDQL

SEQ ID NO: 197015 - protein, 11 aa, Homo sapiens
  Native (TYRP2_HUMAN)
EREQFLGALDL

SEQ ID NO: 197016 - protein, 9 aa, Homo sapiens
  Native (TYRP2_HUMAN)
WPQELAPIG

SEQ ID NO: 197017 - protein, 10 aa, Homo sapiens
  Native (TYRP2_HUMAN)
FLGALDLAKK

SEQ ID NO: 197018 - protein, 10 aa, Homo sapiens
  Native (TYRP2_HUMAN)
IRDCLSLQKF

SEQ ID NO: 197019 - protein, 9 aa, Homo sapiens
  Native (TYRP2_HUMAN)
LWPRKFFHR

SEQ ID NO: 197020 - protein, 9 aa, Homo sapiens
  Native (TYRP2_HUMAN)
ETPGWPTTL

SEQ ID NO: 197021 - protein, 10 aa, Homo sapiens
  Native (TYRP2_HUMAN)
ALVGLFVLLA

SEQ ID NO: 197022 - protein, 9 aa, Homo sapiens
  Native (TYRP2_HUMAN)
GAQGQFPRV

SEQ ID NO: 197023 - protein, 9 aa, Homo sapiens
  Native (TYRP2_HUMAN)
NRMYNMVPF

SEQ ID NO: 197024 - protein, 11 aa, Homo sapiens
  Native (TYRP2_HUMAN)
VCMTVDSLVNK

SEQ ID NO: 197025 - protein, 9 aa, Homo sapiens
  Native (TYRP2_HUMAN)
VEETPGWPT

SEQ ID NO: 197026 - protein, 10 aa, Homo sapiens
  Native (TYRP2_HUMAN)
SLQKFDNPPF

SEQ ID NO: 197027 - protein, 10 aa, Homo sapiens
  Native (TYRP2_HUMAN)
RPDDPTLISR

SEQ ID NO: 197028 - protein, 10 aa, Homo sapiens
  Native (TYRP2_HUMAN)
MGTLVALVGL

SEQ ID NO: 197029 - protein, 8 aa, Homo sapiens
  Native (TYRP2_HUMAN)
EETPGWPT

SEQ ID NO: 197030 - protein, 8 aa, Homo sapiens
  Native (TYRP2_HUMAN)
YYSVRDTL

SEQ ID NO: 197031 - protein, 9 aa, Homo sapiens
  Native (TYRP2_HUMAN)
WTGPNCERK

SEQ ID NO: 197032 - protein, 9 aa, Homo sapiens
  Native (TYRP2_HUMAN)
YYSVRDTLL

SEQ ID NO: 197033 - protein, 11 aa, Homo sapiens
  Native (TYRP2_HUMAN)
ELFLTSDQLGY

SEQ ID NO: 197034 - protein, 9 aa, Homo sapiens
  Native (TYRP2_HUMAN)
NSMKLPTLK

SEQ ID NO: 197035 - protein, 9 aa, Homo sapiens
  Native (TYRP2_HUMAN)
FPPVTNEEL

SEQ ID NO: 197036 - protein, 9 aa, Homo sapiens
  Native (TYRP2_HUMAN)
LLVVMGTLV

SEQ ID NO: 197037 - protein, 11 aa, Homo sapiens
  Native (TYRP2_HUMAN)
DTLLGPGRPYR

SEQ ID NO: 197038 - protein, 10 aa, Homo sapiens
  Native (TYRP2_HUMAN)
CMTVDSLVNK

SEQ ID NO: 197039 - protein, 10 aa, Homo sapiens
  Native (TYRP2_HUMAN)
GLFVLLAFLQ

SEQ ID NO: 197040 - protein, 8 aa, Homo sapiens
  Native (TYRP2_HUMAN)
SHQGPAFV

SEQ ID NO: 197041 - protein, 9 aa, Homo sapiens
  Native (TYRP2_HUMAN)
TVCDSLDDY

SEQ ID NO: 197042 - protein, 11 aa, Homo sapiens
  Native (TYRP2_HUMAN)
NFAGYNCGDCK

SEQ ID NO: 197043 - protein, 9 aa, Homo sapiens
  Native (TYRP2_HUMAN)
HRYHLLCLE

SEQ ID NO: 197044 - protein, 8 aa, Homo sapiens
  Native (TYRP2_HUMAN)
YSVRDTLL

SEQ ID NO: 197045 - protein, 11 aa, Homo sapiens
  Native (TYRP2_HUMAN)
RADTRPWSGPY

SEQ ID NO: 197046 - protein, 11 aa, Homo sapiens
  Native (TYRP2_HUMAN)
VMSLHNLVHSF

SEQ ID NO: 197047 - protein, 9 aa, Homo sapiens
  Native (TYRP2_HUMAN)
VHPDYVITT

SEQ ID NO: 197048 - protein, 10 aa, Homo sapiens
  Native (TYRP2_HUMAN)
CKCTGNFAGY

SEQ ID NO: 197049 - protein, 11 aa, Homo sapiens
  Native (TYRP2_HUMAN)
KADGTLDSQVM

SEQ ID NO: 197050 - protein, 10 aa, Homo sapiens
  Native (TYRP2_HUMAN)
CTDQLFGAAR

SEQ ID NO: 197051 - protein, 11 aa, Homo sapiens
  Native (TYRP2_HUMAN)
IGNESFALPYW

SEQ ID NO: 197052 - protein, 9 aa, Homo sapiens
  Native (TYRP2_HUMAN)
RYHLLCLER

SEQ ID NO: 197053 - protein, 11 aa, Homo sapiens
  Native (TYRP2_HUMAN)
LFVLLAFLQYR

SEQ ID NO: 197054 - protein, 11 aa, Homo sapiens
  Native (TYRP2_HUMAN)
VVMGTLVALVG

SEQ ID NO: 197055 - protein, 9 aa, Homo sapiens
  Native (TYRP2_HUMAN)
SFLNGTNAL

SEQ ID NO: 197056 - protein, 10 aa, Homo sapiens
  Native (TYRP2_HUMAN)
GTLVALVGLF

SEQ ID NO: 197057 - protein, 11 aa, Homo sapiens
  Native (TYRP2_HUMAN)
FAGYNCGDCKF

SEQ ID NO: 197058 - protein, 8 aa, Homo sapiens
  Native (TYRP2_HUMAN)
QKFDNPPF

SEQ ID NO: 197059 - protein, 9 aa, Homo sapiens
  Native (TYRP2_HUMAN)
SPQEREQFL

SEQ ID NO: 197060 - protein, 9 aa, Homo sapiens
  Native (TYRP2_HUMAN)
FLGALDLAK

SEQ ID NO: 197061 - protein, 11 aa, Homo sapiens
  Native (TYRP2_HUMAN)
SAANDPIFVVL

SEQ ID NO: 197062 - protein, 9 aa, Homo sapiens
  Native (TYRP2_HUMAN)
ALVGLFVLL

SEQ ID NO: 197063 - protein, 9 aa, Homo sapiens
  Native (TYRP2_HUMAN)
MSPLWWGFL

SEQ ID NO: 197064 - protein, 9 aa, Homo sapiens
  Native (TYRP2_HUMAN)
PQFANCSVY

SEQ ID NO: 197065 - protein, 8 aa, Homo sapiens
  Native (TYRP2_HUMAN)
LLGPGRPY

SEQ ID NO: 197066 - protein, 10 aa, Homo sapiens
  Native (TYRP2_HUMAN)
NSRFSSWETV

SEQ ID NO: 197067 - protein, 9 aa, Homo sapiens
  Native (TYRP2_HUMAN)
HPDYVITTQ

SEQ ID NO: 197068 - protein, 9 aa, Homo sapiens
  Native (TYRP2_HUMAN)
DDRELWPRK

SEQ ID NO: 197069 - protein, 10 aa, Homo sapiens
  Native (TYRP2_HUMAN)
SLDDYNHLVT

SEQ ID NO: 197070 - protein, 9 aa, Homo sapiens
  Native (TYRP2_HUMAN)
DRELWPRKF

SEQ ID NO: 197071 - protein, 9 aa, Homo sapiens
  Native (TYRP2_HUMAN)
LVNKECCPR

SEQ ID NO: 197072 - protein, 9 aa, Homo sapiens
  Native (TYRP2_HUMAN)
LVALVGLFV

SEQ ID NO: 197073 - protein, 9 aa, Homo sapiens
  Native (TYRP2_HUMAN)
NEELFLTSD

SEQ ID NO: 197074 - protein, 9 aa, Homo sapiens
  Native (TYRP2_HUMAN)
FVLLAFLQY

SEQ ID NO: 197075 - protein, 9 aa, Homo sapiens
  Native (TYRP2_HUMAN)
MVPFFPPVT

SEQ ID NO: 197076 - protein, 9 aa, Homo sapiens
  Native (TYRP2_HUMAN)
TQHWLGLLG

SEQ ID NO: 197077 - protein, 11 aa, Homo sapiens
  Native (TYRP2_HUMAN)
SLDDYNHLVTL

SEQ ID NO: 197078 - protein, 10 aa, Homo sapiens
  Native (TYRP2_HUMAN)
WPTTLLVVMG

SEQ ID NO: 197079 - protein, 9 aa, Homo sapiens
  Native (TYRP2_HUMAN)
SPLWWGFLL

SEQ ID NO: 197080 - protein, 8 aa, Homo sapiens
  Native (TYRP2_HUMAN)
AFLQYRRL

SEQ ID NO: 197081 - protein, 10 aa, Homo sapiens
  Native (TYRP2_HUMAN)
LPVSVEETPG

SEQ ID NO: 197082 - protein, 11 aa, Homo sapiens
  Native (TYRP2_HUMAN)
PFFPPVTNEEL

SEQ ID NO: 197083 - protein, 10 aa, Homo sapiens
  Native (TYRP2_HUMAN)
FFQNSTFSFR

SEQ ID NO: 197084 - protein, 8 aa, Homo sapiens
  Native (TYRP2_HUMAN)
SPQEREQF

SEQ ID NO: 197085 - protein, 9 aa, Homo sapiens
  Native (TYRP2_HUMAN)
TPLMETHLS

SEQ ID NO: 197086 - protein, 10 aa, Homo sapiens
  Native (TYRP2_HUMAN)
TLDSQVMSLH

SEQ ID NO: 197087 - protein, 9 aa, Homo sapiens
  Native (TYRP2_HUMAN)
WMKRFNPPA

SEQ ID NO: 197088 - protein, 10 aa, Homo sapiens
  Native (TYRP2_HUMAN)
DPTLISRNSR

SEQ ID NO: 197089 - protein, 9 aa, Homo sapiens
  Native (TYRP2_HUMAN)
CTEVRADTR

SEQ ID NO: 197090 - protein, 8 aa, Homo sapiens
  Native (TYRP2_HUMAN)
LAFLQYRR

SEQ ID NO: 197091 - protein, 11 aa, Homo sapiens
  Native (TYRP2_HUMAN)
SANVCGSQQGR

SEQ ID NO: 197092 - protein, 11 aa, Homo sapiens
  Native (TYRP2_HUMAN)
FRNALEGFDKA

SEQ ID NO: 197093 - protein, 11 aa, Homo sapiens
  Native (TYRP2_HUMAN)
HSLSPQEREQF

SEQ ID NO: 197094 - protein, 10 aa, Homo sapiens
  Native (TYRP2_HUMAN)
NLVHSFLNGT

SEQ ID NO: 197095 - protein, 9 aa, Homo sapiens
  Native (TYRP2_HUMAN)
LSPQEREQF

SEQ ID NO: 197096 - protein, 10 aa, Homo sapiens
  Native (TYRP2_HUMAN)
LGPNGTQPQF

SEQ ID NO: 197097 - protein, 8 aa, Homo sapiens
  Native (TYRP2_HUMAN)
RPDDPTLI

SEQ ID NO: 197098 - protein, 8 aa, Homo sapiens
  Native (TYRP2_HUMAN)
LPVSVEET

SEQ ID NO: 197099 - protein, 10 aa, Homo sapiens
  Native (TYRP2_HUMAN)
VEETPGWPTT

SEQ ID NO: 197100 - protein, 9 aa, Homo sapiens
  Native (TYRP2_HUMAN)
IDFSHQGPA

SEQ ID NO: 197101 - protein, 10 aa, Homo sapiens
  Native (TYRP2_HUMAN)
GYSYAIDLPV

SEQ ID NO: 197102 - protein, 9 aa, Homo sapiens
  Native (TYRP2_HUMAN)
RVCMTVDSL

SEQ ID NO: 197103 - protein, 9 aa, Homo sapiens
  Native (TYRP2_HUMAN)
RFNPPADAW

SEQ ID NO: 197104 - protein, 9 aa, Homo sapiens
  Native (TYRP2_HUMAN)
LVVMGTLVA

SEQ ID NO: 197105 - protein, 10 aa, Homo sapiens
  Native (TYRP2_HUMAN)
KRVHPDYVIT

SEQ ID NO: 197106 - protein, 9 aa, Homo sapiens
  Native (TYRP2_HUMAN)
LRNQDDREL

SEQ ID NO: 197107 - protein, 10 aa, Homo sapiens
  Native (TYRP2_HUMAN)
TSDQLGYSYA

SEQ ID NO: 197108 - protein, 10 aa, Homo sapiens
  Native (TYRP2_HUMAN)
ANVCGSQQGR

SEQ ID NO: 197109 - protein, 9 aa, Homo sapiens
  Native (TYRP2_HUMAN)
AANDPIFVV

SEQ ID NO: 197110 - protein, 9 aa, Homo sapiens
  Native (TYRP2_HUMAN)
TRPWSGPYI

SEQ ID NO: 197111 - protein, 11 aa, Homo sapiens
  Native (TYRP2_HUMAN)
KFGWTGPNCER

SEQ ID NO: 197112 - protein, 10 aa, Homo sapiens
  Native (TYRP2_HUMAN)
CSVYDFFVWL

SEQ ID NO: 197113 - protein, 9 aa, Homo sapiens
  Native (TYRP2_HUMAN)
ALDLAKKRV

SEQ ID NO: 197114 - protein, 9 aa, Homo sapiens
  Native (TYRP2_HUMAN)
PPVTNEELF

SEQ ID NO: 197115 - protein, 10 aa, Homo sapiens
  Native (TYRP2_HUMAN)
MSPLWWGFLL

SEQ ID NO: 197116 - protein, 9 aa, Homo sapiens
  Native (TYRP2_HUMAN)
KCTGNFAGY

SEQ ID NO: 197117 - protein, 9 aa, Homo sapiens
  Native (TYRP2_HUMAN)
RNQMGRNSM

SEQ ID NO: 197118 - protein, 11 aa, Homo sapiens
  Native (TYRP2_HUMAN)
GAARPDDPTLI

SEQ ID NO: 197119 - protein, 9 aa, Homo sapiens
  Native (TYRP2_HUMAN)
SRNSRFSSW

SEQ ID NO: 197120 - protein, 9 aa, Homo sapiens
  Native (TYRP2_HUMAN)
RNALEGFDK

SEQ ID NO: 197121 - protein, 11 aa, Homo sapiens
  Native (TYRP2_HUMAN)
SPQEREQFLGA

SEQ ID NO: 197122 - protein, 10 aa, Homo sapiens
  Native (TYRP2_HUMAN)
LGPGRPYRAI

SEQ ID NO: 197123 - protein, 10 aa, Homo sapiens
  Native (TYRP2_HUMAN)
LVVMGTLVAL

SEQ ID NO: 197124 - protein, 9 aa, Homo sapiens
  Native (TYRP2_HUMAN)
KRVHPDYVI

SEQ ID NO: 197125 - protein, 9 aa, Homo sapiens
  Native (TYRP2_HUMAN)
RLGAESANV

SEQ ID NO: 197126 - protein, 9 aa, Homo sapiens
  Native (TYRP2_HUMAN)
LGALDLAKK

SEQ ID NO: 197127 - protein, 8 aa, Homo sapiens
  Native (TYRP2_HUMAN)
VLLAFLQY

SEQ ID NO: 197128 - protein, 10 aa, Homo sapiens
  Native (TYRP2_HUMAN)
ETVCDSLDDY

SEQ ID NO: 197129 - protein, 10 aa, Homo sapiens
  Native (TYRP2_HUMAN)
SAANDPIFVV

SEQ ID NO: 197130 - protein, 10 aa, Homo sapiens
  Native (TYRP2_HUMAN)
ISRNSRFSSW

SEQ ID NO: 197131 - protein, 8 aa, Homo sapiens
  Native (TYRP2_HUMAN)
MVPFFPPV

SEQ ID NO: 197132 - protein, 10 aa, Homo sapiens
  Native (TYRP2_HUMAN)
LDDYNHLVTL

SEQ ID NO: 197133 - protein, 11 aa, Homo sapiens
  Native (TYRP2_HUMAN)
FVLLAFLQYRR

SEQ ID NO: 197134 - protein, 11 aa, Homo sapiens
  Native (TYRP2_HUMAN)
HLLCLERDLQR

SEQ ID NO: 197135 - protein, 9 aa, Homo sapiens
  Native (TYRP2_HUMAN)
EGLLRRNQM

SEQ ID NO: 197136 - protein, 8 aa, Homo sapiens
  Native (TYRP2_HUMAN)
KFDNPPFF

SEQ ID NO: 197137 - protein, 10 aa, Homo sapiens
  Native (TYRP2_HUMAN)
DAWPQELAPI

SEQ ID NO: 197138 - protein, 8 aa, Homo sapiens
  Native (TYRP2_HUMAN)
FLGALDLA

SEQ ID NO: 197139 - protein, 9 aa, Homo sapiens
  Native (TYRP2_HUMAN)
LCLERDLQR

SEQ ID NO: 197140 - protein, 9 aa, Homo sapiens
  Native (TYRP2_HUMAN)
HSFLNGTNA

SEQ ID NO: 197141 - protein, 9 aa, Homo sapiens
  Native (TYRP2_HUMAN)
QMGRNSMKL

SEQ ID NO: 197142 - protein, 9 aa, Homo sapiens
  Native (TYRP2_HUMAN)
AFLQYRRLR

SEQ ID NO: 197143 - protein, 8 aa, Homo sapiens
  Native (TYRP2_HUMAN)
HSFTDAIF

SEQ ID NO: 197144 - protein, 8 aa, Artificial Sequence
  Description of Artificial Sequence: Synthetic peptide
  Seed: AANDPIFV (TYRP2_HUMAN)
  misc_feature (2)..(2): Xaa can be Ala, Ser, Val, Thr, Ile, Gly, Leu, Phe, Gln, Met, Asn, Pro, Asp, Glu, or Cys
  misc_feature (8)..(8): Xaa can be Lys, Arg, Leu, Tyr, Phe, Met, Ile, Val, His, or Trp
AXNDPIFX

SEQ ID NO: 197145 - protein, 9 aa, Artificial Sequence
  Description of Artificial Sequence: Synthetic peptide
  Seed: AANDPIFVV (TYRP2_HUMAN)
  misc_feature (2)..(2): Xaa can be Pro, Ala, Arg, Gln, Met, Leu, Ser, Val, Ile, Thr, His, Tyr, Gly, Glu, Phe, Cys, Asn, Asp, Trp, or Lys
  misc_feature (9)..(9): Xaa can be Ile, Val, Phe, Trp, Leu, Tyr, Met, Arg, Lys, His, Cys, Ala, Thr, Ser, Gly, Gln, Pro, Glu, or Asn
AXNDPIFVX

SEQ ID NO: 197146 - protein, 10 aa, Artificial Sequence
  Description of Artificial Sequence: Synthetic peptide
  Seed: AANDPIFVVL (TYRP2_HUMAN)
  misc_feature (2)..(2): Xaa can be Ala, Arg, Pro, Gln, Tyr, Ser, Met, Leu, Ile, Thr, Val, His, Gly, Phe, Glu, Asn, Cys, Trp, Lys, or Asp
  misc_feature (10)..(10): Xaa can be Met, Tyr, Trp, Leu, Lys, Phe, Arg, Val, Ile, His, Ala, Cys, Thr, Gln, Gly, Ser, Pro, Asn, or Glu
AXNDPIFVVX

SEQ ID NO: 197147 - protein, 11 aa, Artificial Sequence
  Description of Artificial Sequence: Synthetic peptide
  Seed: AANDPIFVVLH (TYRP2_HUMAN)
  misc_feature (2)..(2): Xaa can be Ala, Val, Ser, Thr, Ile, Gly, Met, Leu, Gln, Glu, or Cys
  misc_feature (11)..(11): Xaa can be Tyr, Phe, His, Lys, Met, Trp, Leu, Arg, Ile, or Val
AXNDPIFVVLX

SEQ ID NO: 197148 - protein, 9 aa, Artificial Sequence
  Description of Artificial Sequence: Synthetic peptide
  Seed: AARPDDPTL (TYRP2_HUMAN)
  misc_feature (2)..(2): Xaa can be Pro, Ala, Gln, Arg, Glu, Ser, Leu, Val, Thr, Met, Tyr, Asp, Gly, Ile, Phe, Lys, Asn, His, Trp, or Cys
  misc_feature (9)..(9): Xaa can be Leu, Met, Tyr, Phe, Trp, Ile, Val, Lys, His, Arg, Ala, Cys, Thr, Pro, Gln, Ser, Gly, Asn, or Glu
AXRPDDPTX

SEQ ID NO: 197149 - protein, 10 aa, Artificial Sequence
  Description of Artificial Sequence: Synthetic peptide
  Seed: AARPDDPTLI (TYRP2_HUMAN)
  misc_feature (2)..(2): Xaa can be Ala, Ser, Thr, Val, Gln, Met, Leu, Ile, Arg, Gly, Glu, Asn, Phe, Pro, Cys, Tyr, Asp, Lys, His, or Trp
  misc_feature (10)..(10): Xaa can be Leu, Trp, Met, Phe, Tyr, Lys, Arg, Ile, Val, His, Cys, Ala, Gln, or Thr
AXRPDDPTLX

SEQ ID NO: 197150 - protein, 8 aa, Artificial Sequence
  Description of Artificial Sequence: Synthetic peptide
  Seed: ADAWPQEL (TYRP2_HUMAN)
  misc_feature (2)..(2): Xaa can be Glu, Asp, Arg, Gln, Ala, Ile, His, Asn, Tyr, Gly, Thr, Ser, or Phe
  misc_feature (8)..(8): Xaa can be Leu, Met, Phe, Ile, Val, Ala, Tyr, Thr, Trp, Pro, Gly, Cys, or Ser
AXAWPQEX

SEQ ID NO: 197151 - protein, 9 aa, Artificial Sequence
  Description of Artificial Sequence: Synthetic peptide
  Seed: ADAWPQELA (TYRP2_HUMAN)
  misc_feature (2)..(2): Xaa can be Glu, Asp, or Gln
  misc_feature (9)..(9): Xaa can be Met, Leu, Val, Cys, Ala, Ile, Phe, Thr, Pro, Tyr, Lys, Arg, Asn, Asp, Gly, Ser, Trp, Gln, or Glu
AXAWPQELX

SEQ ID NO: 197152 - protein, 9 aa, Artificial Sequence
  Description of Artificial Sequence: Synthetic peptide
  Seed: ADGTLDSQV (TYRP2_HUMAN)
  misc_feature (2)..(2): Xaa can be Glu, Asp, or Gln
  misc_feature (9)..(9): Xaa can be Met, Leu, Phe, Ile, Val, Ala, Thr, Tyr, Ser, Trp, Cys, Gly, or Pro
AXGTLDSQX

SEQ ID NO: 197153 - protein, 10 aa, Artificial Sequence
  Description of Artificial Sequence: Synthetic peptide
  Seed: ADGTLDSQVM (TYRP2_HUMAN)
  misc_feature (2)..(2): Xaa can be Glu, Asp, or Gln
  misc_feature (10)..(10): Xaa can be Phe, Met, Leu, Trp, Lys, Tyr, Ile, or Val
AXGTLDSQVX

SEQ ID NO: 197154 - protein, 10 aa, Artificial Sequence
  Description of Artificial Sequence: Synthetic peptide
  Seed: ADTRPWSGPY (TYRP2_HUMAN)
  misc_feature (2)..(2): Xaa can be Arg, Tyr, Lys, Ser, Cys, Ala, His, Glu, Pro, Asn, Gln, Met, Phe, Ile, Gly, Asp, Leu, Val, Thr, or Trp
  misc_feature (10)..(10): Xaa can be Arg, Leu, Val, Ser, Tyr, Phe, Ile, Trp, Gly, Lys, Ala, Met, Thr, or Pro
AXTRPWSGPX

SEQ ID NO: 197155 - protein, 9 aa, Artificial Sequence
  Description of Artificial Sequence: Synthetic peptide
  Seed: AESANVCGS (TYRP2_HUMAN)
  misc_feature (2)..(2): Xaa can be Glu, Asp, or Gln
  misc_feature (9)..(9): Xaa can be Leu, Met, Val, Cys, Phe, Ile, Ala, Pro, Tyr, Thr, Ser, Gly, or Trp
AXSANVCGX

SEQ ID NO: 197156 - protein, 8 aa, Artificial Sequence
  Description of Artificial Sequence: Synthetic peptide
  Seed: AFLQYRRL (TYRP2_HUMAN)
  misc_feature (2)..(2): Xaa can be Tyr, or Phe
  misc_feature (8)..(8): Xaa can be Leu, Tyr, Phe, or Met
AXLQYRRX

SEQ ID NO: 197157 - protein, 9 aa, Artificial Sequence
  Description of Artificial Sequence: Synthetic peptide
  Seed: AFLQYRRLR (TYRP2_HUMAN)
  misc_feature (2)..(2): Xaa can be Ser, Trp, Val, Met, Phe, Gln, Asn, Tyr, Thr, Ile, Gly, Leu, Ala, Glu, Cys, Pro, or Asp
  misc_feature (9)..(9): Xaa can be Arg, or Lys
AXLQYRRLX

SEQ ID NO: 197158 - protein, 10 aa, Artificial Sequence
  Description of Artificial Sequence: Synthetic peptide
  Seed: AFLQYRRLRK (TYRP2_HUMAN)
  misc_feature (2)..(2): Xaa can be Met, Thr, Ser, Leu, Asp, Glu, Ala, Lys, Gly, Pro, Ile, Tyr, Arg, Val, Phe, Asn, Trp, Gln, Cys, or His
  misc_feature (10)..(10): Xaa can be Arg, Lys, Ala, Val, Tyr, Gln, Pro, Ile, Leu, Trp, Phe, Met, Asp, Ser, Thr, Asn, Cys, His, Glu, or Gly
AXLQYRRLRX

SEQ ID NO: 197159 - protein, 8 aa, Artificial Sequence
  Description of Artificial Sequence: Synthetic peptide
  Seed: AFVTWHRY (TYRP2_HUMAN)
  misc_feature (2)..(2): Xaa can be Tyr, Phe, Leu, Trp, Thr, Ile, Val, Gln, Ser, or Met
  misc_feature (8)..(8): Xaa can be Tyr, Leu, Met, Phe, or Ile
AXVTWHRX

SEQ ID NO: 197160 - protein, 10 aa, Artificial Sequence
  Description of Artificial Sequence: Synthetic peptide
  Seed: AFVTWHRYHL (TYRP2_HUMAN)
  misc_feature (2)..(2): Xaa can be Tyr, Trp, Phe, or Met
  misc_feature (10)..(10): Xaa can be Phe, Trp, Ile, Leu, Met, Tyr, or Val
AXVTWHRYHX

SEQ ID NO: 197161 - protein, 9 aa, Artificial Sequence
  Description of Artificial Sequence: Synthetic peptide
  Seed: AGYNCGDCK (TYRP2_HUMAN)
  misc_feature (2)..(2): Xaa can be Ala, Val, Thr, Ser, Ile, Met, Leu, Asp, Gly, Pro, Gln, or Asn
  misc_feature (9)..(9): Xaa can be Lys, Arg, Met, Tyr, Leu, Phe, His, Ile, or Val
AXYNCGDCX

SEQ ID NO: 197162 - protein, 10 aa, Artificial Sequence
  Description of Artificial Sequence: Synthetic peptide
  Seed: AGYNCGDCKF (TYRP2_HUMAN)
  misc_feature (2)..(2): Xaa can be Ala, Ser, Thr, Val, Tyr, Trp, Gly, Glu, Met, Ile, Leu, Gln, Pro, Cys, Asn, Asp, Phe, Arg, Lys, or His
  misc_feature (10)..(10): Xaa can be Phe, Trp, Tyr, Leu, Met, Ile, or His
AXYNCGDCKX

SEQ ID NO: 197163 - protein, 10 aa, Artificial Sequence
  Description of Artificial Sequence: Synthetic peptide
  Seed: AIDFSHQGPA (TYRP2_HUMAN)
  misc_feature (2)..(2): Xaa can be Leu, Met, Ile, Gln, Val, or Thr
  misc_feature (10)..(10): Xaa can be Val, Ile, Leu, Ala, Thr, or Met
AXDFSHQGPX

SEQ ID NO: 197164 - protein, 11 aa, Artificial Sequence
  Description of Artificial Sequence: Synthetic peptide
  Seed: AIDFSHQGPAF (TYRP2_HUMAN)
  misc_feature (2)..(2): Xaa can be Thr, Ala, Ser, Val, Leu, Met, Gly, Ile, Cys, Pro, Gln, Asn, Phe, Trp, Glu, Asp, or Tyr
  misc_feature (11)..(11): Xaa can be Tyr, Leu, Phe, Met, Ile, Val, Trp, Lys, Arg, Cys, His, or Ala
AXDFSHQGPAX

SEQ ID NO: 197165 - protein, 8 aa, Artificial Sequence
  Description of Artificial Sequence: Synthetic peptide
  Seed: AIDLPVSV (TYRP2_HUMAN)
  misc_feature (2)..(2): Xaa can be Ser, Tyr, Ile, Ala, Thr, Phe, Trp, Val, Leu, Gly, Met, Gln, Asn, Cys, Pro, Asp, Arg, Glu, His, or Lys
  misc_feature (8)..(8): Xaa can be Ile, Leu, Met, Phe, Val, Tyr, Trp, Cys, Ala, or Thr
AXDLPVSX

SEQ ID NO: 197166 - protein, 8 aa, Artificial Sequence
  Description of Artificial Sequence: Synthetic peptide
  Seed: AIFDEWMK (TYRP2_HUMAN)
  misc_feature (2)..(2): Xaa can be Thr, Val, or Ile
  misc_feature (8)..(8): Xaa can be , or Lys
AXFDEWMX

SEQ ID NO: 197167 - protein, 9 aa, Artificial Sequence
  Description of Artificial Sequence: Synthetic peptide
  Seed: AIFDEWMKR (TYRP2_HUMAN)
  misc_feature (2)..(2): Xaa can be Met, Ala, Val, Leu, Thr, Ser, Gln, Ile, Tyr, Gly, Cys, Phe, Trp, Asn, Pro, Glu, Asp, Lys, His, or Arg
  misc_feature (9)..(9): Xaa can be Tyr, Arg, Lys, Phe, Leu, Met, Trp, Ile, Val, His, Ala, Gln, or Cys
AXFDEWMKX

SEQ ID NO: 197168 - protein, 10 aa, Artificial Sequence
  Description of Artificial Sequence: Synthetic peptide
  Seed: AIFDEWMKRF (TYRP2_HUMAN)
  misc_feature (2)..(2): Xaa can be Met, Leu, Gln, Tyr, Ala, Glu, Ser, Val, Ile, Thr, Phe, Trp, Gly, Asn, Lys, Cys, Pro, His, Asp, or Arg
  misc_feature (10)..(10): Xaa can be Tyr, Trp, Phe, Arg, Lys, Leu, Met, Ile, Val, His, Cys, Gln, or Ala
AXFDEWMKRX

SEQ ID NO: 197169 - protein, 9 aa, Artificial Sequence
  Description of Artificial Sequence: Synthetic peptide
  Seed: AKKRVHPDY (TYRP2_HUMAN)
  misc_feature (2)..(2): Xaa can be Gln, Met, Val, Lys, Leu, Ala, Ile, Glu, Ser, His, Asn, Thr, Phe, Arg, Gly, Asp, Cys, Tyr, or Pro
  misc_feature (9)..(9): Xaa can be Tyr, Phe, Met, Leu, Trp, Ile, Val, or His
AXKRVHPDX

SEQ ID NO: 197170 - protein, 9 aa, Artificial Sequence
  Description of Artificial Sequence: Synthetic peptide
  Seed: ALDLAKKRV (TYRP2_HUMAN)
  misc_feature (2)..(2): Xaa can be Ala, Ser, Gln, Thr, Gly, Met, Asn, Phe, Val, Tyr, Ile, Leu, Cys, Pro, Asp, Trp, or Glu
  misc_feature (9)..(9): Xaa can be Met, Leu, Phe, Ile, Val, Cys, Ala, Tyr, or Trp
AXDLAKKRX

SEQ ID NO: 197171 - protein, 9 aa, Artificial Sequence
  Description of Artificial Sequence: Synthetic peptide
  Seed: ALPYWNFAT (TYRP2_HUMAN)
  misc_feature (2)..(2): Xaa can be Met, Leu, Gln, Ile, Val, Thr, Ala, Ser, Phe, or Gly
  misc_feature (9)..(9): Xaa can be Val, Ile, Leu, Ala, Met, Phe, Thr, Cys, Ser, or Pro
AXPYWNFAX

SEQ ID NO: 197172 - protein, 11 aa, Artificial Sequence
  Description of Artificial Sequence: Synthetic peptide
  Seed: ALPYWNFATGR (TYRP2_HUMAN)
  misc_feature (2)..(2): Xaa can be His, Arg, Asp, Tyr, Gly, Glu, Thr, Val, Lys, Pro, Ser, Trp, Ile, Ala, Asn, Phe, Cys, Leu, Met, or Gln
  misc_feature (11)..(11): Xaa can be Arg, or Lys
AXPYWNFATGX

SEQ ID NO: 197173 - protein, 8 aa, Artificial Sequence
  Description of Artificial Sequence: Synthetic peptide
  Seed: ALVGLFVL (TYRP2_HUMAN)
  misc_feature (2)..(2): Xaa can be Leu, or Met
  misc_feature (8)..(8): Xaa can be Leu, Val, or Ile
AXVGLFVX

SEQ ID NO: 197174 - protein, 9 aa, Artificial Sequence
  Description of Artificial Sequence: Synthetic peptide
  Seed: ALVGLFVLL (TYRP2_HUMAN)
  misc_feature (2)..(2): Xaa can be Gln, Met, Leu, Ile, Ala, Val, Thr, Ser, Glu, Arg, Asp, Cys, Asn, Gly, Pro, Lys, Phe, His, Tyr, or Trp
  misc_feature (9)..(9): Xaa can be Arg, Tyr, Met, Leu, Phe, Val, Ile, Lys, Trp, Ala, His, Thr, Cys, Ser, Gly, or Pro
AXVGLFVLX

SEQ ID NO: 197175 - protein, 10 aa, Artificial Sequence
  Description of Artificial Sequence: Synthetic peptide
  Seed: ALVGLFVLLA (TYRP2_HUMAN)
  misc_feature (2)..(2): Xaa can be Leu, Gln, Met, Val, Ile, Thr, Ser, or Ala
  misc_feature (10)..(10): Xaa can be Ala, Leu, Ile, Val, Met, Thr, Tyr, Gln, His, Gly, Pro, Asp, Glu, Ser, Phe, Asn, Arg, Lys, Trp, or Cys
AXVGLFVLLX

SEQ ID NO: 197176 - protein, 9 aa, Artificial Sequence
  Description of Artificial Sequence: Synthetic peptide
  Seed: ANCSVYDFF (TYRP2_HUMAN)
  misc_feature (2)..(2): Xaa can be Gln, Thr, Ser, Ala, Met, Leu, Ile, Val, Glu, Cys, Gly, Asn, Asp, Pro, Arg, or Phe
  misc_feature (9)..(9): Xaa can be Trp, Phe, Leu, Ile, Met, Val, or Tyr
AXCSVYDFX

SEQ ID NO: 197177 - protein, 11 aa, Artificial Sequence
  Description of Artificial Sequence: Synthetic peptide
  Seed: ANCSVYDFFVW (TYRP2_HUMAN)
  misc_feature (2)..(2): Xaa can be Thr, Ser, Cys, Ala, Gly, Val, Asp, Glu, Asn, Arg, Leu, Met, Phe, Tyr, Ile, Pro, Gln, Lys, Trp, or His
  misc_feature (11)..(11): Xaa can be Tyr, Trp, Phe, Leu, Met, or Ile
AXCSVYDFFVX

SEQ ID NO: 197178 - protein, 8 aa, Artificial Sequence
  Description of Artificial Sequence: Synthetic peptide
  Seed: ANDPIFVV (TYRP2_HUMAN)
  misc_feature (2)..(2): Xaa can be Ala, Ser, Thr, Val, Ile, Trp, Gln, Asn, Pro, Leu, Phe, Cys, Met, Tyr, Gly, Asp, His, or Gl u
  misc_feature (8)..(8): Xaa can be Leu, Ile, Met, Phe, Val, Tyr, Cys, Ala, Trp, or Thr
AXDPIFVX

SEQ ID NO: 197179 - protein, 9 aa, Artificial Sequence
  Description of Artificial Sequence: Synthetic peptide
  Seed: ANDPIFVVL (TYRP2_HUMAN)
  misc_feature (2)..(2): Xaa can be Ala, Glu, Phe, Tyr, Ser, Thr, Trp, Leu, Met, Ile, Arg, His, Gln, Val, Gly, Cys, Pro, Asn, Asp, or Lys
  misc_feature (9)..(9): Xaa can be Cys, Val, Ala, Trp, Leu, Phe, Ile, Arg, Lys, Met, Tyr, Thr, His, Ser, Pro, Gln, Gly, Glu, Asn, or Asp
AXDPIFVVX

SEQ ID NO: 197180 - protein, 10 aa, Artificial Sequence
  Description of Artificial Sequence: Synthetic peptide
  Seed: ANVCGSQQGR (TYRP2_HUMAN)
  misc_feature (2)..(2): Xaa can be Ala, Ser, Thr, Glu, Asn, Leu, Val, Gly, Gln, Asp, Met, Cys, Phe, Ile, Tyr, Arg, Pro, Trp, or His
  misc_feature (10)..(10): Xaa can be Arg, Lys, Tyr, Phe, Leu, or Met
AXVCGSQQGX

SEQ ID NO: 197181 - protein, 8 aa, Artificial Sequence
  Description of Artificial Sequence: Synthetic peptide
  Seed: APIGHNRM (TYRP2_HUMAN)
  misc_feature (2)..(2): Xaa can be , or Pro
  misc_feature (8)..(8): Xaa can be Phe, Met, Ile, Leu, or Val
AXIGHNRX

SEQ ID NO: 197182 - protein, 9 aa, Artificial Sequence
  Description of Artificial Sequence: Synthetic peptide
  Seed: APIGHNRMY (TYRP2_HUMAN)
  misc_feature (2)..(2): Xaa can be Ala, Pro, Ser, Val, Gly, Gln, Ile, His, Leu, Thr, Met, Lys, Cys, Glu, Phe, Arg, Asn, Tyr, Trp, or Asp
  misc_feature (9)..(9): Xaa can be Tyr, Phe, Met, Leu, Trp, Val, Ile, His, Lys, Ala, Arg, Thr, Cys, Gln, Pro, Gly, or Ser
AXIGHNRMX

SEQ ID NO: 197183 - protein, 11 aa, Artificial Sequence
  Description of Artificial Sequence: Synthetic peptide
  Seed: APIGHNRMYNM (TYRP2_HUMAN)
  misc_feature (2)..(2): Xaa can be , or Pro
  misc_feature (11)..(11): Xaa can be Val, Ile, Phe, Cys, Met, Ala, or Leu
AXIGHNRMYNX

SEQ ID NO: 197184 - protein, 8 aa, Artificial Sequence
  Description of Artificial Sequence: Synthetic peptide
  Seed: AQGQFPRV (TYRP2_HUMAN)
  misc_feature (2)..(2): Xaa can be Gln, Glu, Met, Leu, Gly, Ser, Ala, Ile, Val, or Pro
  misc_feature (8)..(8): Xaa can be Ile, Val, Leu, Phe, or Met
AXGQFPRX

SEQ ID NO: 197185 - protein, 9 aa, Artificial Sequence
  Description of Artificial Sequence: Synthetic peptide
  Seed: AQGQFPRVC (TYRP2_HUMAN)
  misc_feature (2)..(2): Xaa can be Glu, Asp, Gln, Met, Ala, Ile, Ser, Val, Leu, Asn, Gly, Thr, or Pro
  misc_feature (9)..(9): Xaa can be Val, Ile, Leu, Met, Ala, Phe, Cys, Thr, Pro, Trp, Gly, Asp, Gln, Ser, Glu, or Tyr
AXGQFPRVX

SEQ ID NO: 197186 - protein, 10 aa, Artificial Sequence
  Description of Artificial Sequence: Synthetic peptide
  Seed: AQGQFPRVCM (TYRP2_HUMAN)
  misc_feature (2)..(2): Xaa can be Gln, Ala, Leu, Arg, Met, Glu, His, Lys, Thr, Tyr, Ser, Ile, Val, Asn, Phe, Gly, or Pro
  misc_feature (10)..(10): Xaa can be Tyr, Phe, Leu, Met, Trp, Val, or Ile
AXGQFPRVCX

SEQ ID NO: 197187 - protein, 8 aa, Artificial Sequence
  Description of Artificial Sequence: Synthetic peptide
  Seed: ARPDDPTL (TYRP2_HUMAN)
  misc_feature (2)..(2): Xaa can be Arg, Tyr, Phe, Ala, His, Gly, Leu, Thr, Met, Ser, Val, Gln, or Ile
  misc_feature (8)..(8): Xaa can be Leu, Tyr, Met, Phe, or Ile
AXPDDPTX

SEQ ID NO: 197188 - protein, 9 aa, Artificial Sequence
  Description of Artificial Sequence: Synthetic peptide
  Seed: ARPDDPTLI (TYRP2_HUMAN)
  misc_feature (2)..(2): Xaa can be Arg, Tyr, Ala, His, Phe, Gln, Met, Ile, Gly, Ser, Trp, Val, Leu, Thr, Glu, Asn, Pro, Asp, Lys, or Cys
  misc_feature (9)..(9): Xaa can be Phe, Val, Leu, Met, Ile, Tyr, Arg, Lys, Cys, Ala, Trp, His, Thr, Gln, or Pro
AXPDDPTLX

SEQ ID NO: 197189 - protein, 11 aa, Artificial Sequence
  Description of Artificial Sequence: Synthetic peptide
  Seed: ARPDDPTLISR (TYRP2_HUMAN)
  misc_feature (2)..(2): Xaa can be Arg, Tyr, Phe, Ala, Gly, His, Gln, Met, Trp, Leu, Thr, Ile, Ser, Val, Asn, Glu, Lys, Pro, Asp, or Cys
  misc_feature (11)..(11): Xaa can be Met, Leu, Phe, Ile, Lys, Tyr, Arg, Val, Trp, Cys, His, Ala, Pro, Asn, Thr, Gly, or Gln
AXPDDPTLISX

SEQ ID NO: 197190 - protein, 9 aa, Artificial Sequence
  Description of Artificial Sequence: Synthetic peptide
  Seed: AWPQELAPI (TYRP2_HUMAN)
  misc_feature (2)..(2): Xaa can be Tyr, Phe, Trp, Met, Ala, Leu, Val, Ile, Gln, His, Thr, Ser, or Gly
  misc_feature (9)..(9): Xaa can be Phe, Leu, Met, Tyr, Trp, Val, Ile, His, Ala, Cys, Arg, or Lys
AXPQELAPX

SEQ ID NO: 197191 - protein, 10 aa, Artificial Sequence
  Description of Artificial Sequence: Synthetic peptide
  Seed: CCPRLGAESA (TYRP2_HUMAN)
  misc_feature (2)..(2): Xaa can be Leu, Lys, Phe, Asn, Tyr, Glu, Trp, Gly, Thr, Val, Met, Ile, Ser, His, Pro, Gln, Arg, Ala, Asp, or Cys
  misc_feature (10)..(10): Xaa can be Phe, Ala, Met, Ile, Leu, or Val
CXPRLGAESX

SEQ ID NO: 197192 - protein, 11 aa, Artificial Sequence
  Description of Artificial Sequence: Synthetic peptide
  Seed: CDSLDDYNHLV (TYRP2_HUMAN)
  misc_feature (2)..(2): Xaa can be Tyr, Phe, Leu, Met, Lys, Ile, Cys, Ala, Ser, Pro, Asp, Asn, Glu, Val, Gly, Arg, Thr, His, Gln, or Trp
  misc_feature (11)..(11): Xaa can be Met, Ile, Leu, Val, or Ala
CXSLDDYNHLX

SEQ ID NO: 197193 - protein, 9 aa, Artificial Sequence
  Description of Artificial Sequence: Synthetic peptide
  Seed: CDVCTDQLF (TYRP2_HUMAN)
  misc_feature (2)..(2): Xaa can be Glu, or Asp
  misc_feature (9)..(9): Xaa can be Leu, Phe, Met, Ile, or Val
CXVCTDQLX

SEQ ID NO: 197194 - protein, 8 aa, Artificial Sequence
  Description of Artificial Sequence: Synthetic peptide
  Seed: CERKKPPV (TYRP2_HUMAN)
  misc_feature (2)..(2): Xaa can be Glu, or Asp
  misc_feature (8)..(8): Xaa can be Phe, Leu, Ile, Val, Ala, or Met
CXRKKPPX

SEQ ID NO: 197195 - protein, 9 aa, Artificial Sequence
  Description of Artificial Sequence: Synthetic peptide
  Seed: CERKKPPVI (TYRP2_HUMAN)
  misc_feature (2)..(2): Xaa can be Glu, Gln, Arg, Leu, Asp, Pro, Ala, Met, Val, Ile, Phe, Gly, His, Ser, Asn, Cys, Tyr, Thr, Lys, or Trp
  misc_feature (9)..(9): Xaa can be Ile, Met, Leu, Val, Phe, Ala, Cys, Thr, Tyr, Lys, Trp, Arg, His, Gly, Pro, or Ser
CXRKKPPVX

SEQ ID NO: 197196 - protein, 10 aa, Artificial Sequence
  Description of Artificial Sequence: Synthetic peptide
  Seed: CKCTGNFAGY (TYRP2_HUMAN)
  misc_feature (2)..(2): Xaa can be Met, Gln, Lys, Arg, Leu, Ser, Thr, Val, Ala, Ile, Glu, Phe, Gly, Asn, Trp, Cys, Pro, or Ty r
  misc_feature (10)..(10): Xaa can be Tyr, Phe, Met, or Trp
CXCTGNFAGX

SEQ ID NO: 197197 - protein, 11 aa, Artificial Sequence
  Description of Artificial Sequence: Synthetic peptide
  Seed: CKILPGAQGQF (TYRP2_HUMAN)
  misc_feature (2)..(2): Xaa can be Gln, Arg, Met, Lys, Glu, or His
  misc_feature (11)..(11): Xaa can be Tyr, Phe, Trp, Leu, or Met
CXILPGAQGQX

SEQ ID NO: 197198 - protein, 9 aa, Artificial Sequence
  Description of Artificial Sequence: Synthetic peptide
  Seed: CLERDLQRL (TYRP2_HUMAN)
  misc_feature (2)..(2): Xaa can be Gln, Met, Leu, Ala, Ser, Val, Ile, or Thr
  misc_feature (9)..(9): Xaa can be Leu, Ile, Met, Phe, Trp, or Val
CXERDLQRX

SEQ ID NO: 197199 - protein, 10 aa, Artificial Sequence
  Description of Artificial Sequence: Synthetic peptide
  Seed: CLGCKILPGA (TYRP2_HUMAN)
  misc_feature (2)..(2): Xaa can be Leu, Met, Ile, Gln, Val, Thr, or Ala
  misc_feature (10)..(10): Xaa can be Val, Ile, Leu, Ala, or Met
CXGCKILPGX

SEQ ID NO: 197200 - protein, 10 aa, Artificial Sequence
  Description of Artificial Sequence: Synthetic peptide
  Seed: CMTVDSLVNK (TYRP2_HUMAN)
  misc_feature (2)..(2): Xaa can be Ser, Ala, Val, Met, Thr, Leu, Gln, Ile, Glu, Gly, Arg, Tyr, His, Phe, Lys, Trp, Asp, Pro, Asn, or Cys
  misc_feature (10)..(10): Xaa can be Arg, Lys, or Tyr
CXTVDSLVNX

SEQ ID NO: 197201 - protein, 10 aa, Artificial Sequence
  Description of Artificial Sequence: Synthetic peptide
  Seed: CNGTYEGLLR (TYRP2_HUMAN)
  misc_feature (2)..(2): Xaa can be Tyr, Thr, Ala, Ser, Trp, Leu, Met, Gly, Val, Asn, Phe, Ile, or Gln
  misc_feature (10)..(10): Xaa can be Arg, or Lys
CXGTYEGLLX

SEQ ID NO: 197202 - protein, 11 aa, Artificial Sequence
  Description of Artificial Sequence: Synthetic peptide
  Seed: CNGTYEGLLRR (TYRP2_HUMAN)
  misc_feature (2)..(2): Xaa can be Cys, Ile, Val, Lys, Gln, Thr, Pro, Asn, His, Leu, Phe, Met, Gly, Arg, Ser, Tyr, Ala, Glu, Trp, or Asp
  misc_feature (11)..(11): Xaa can be , or Arg
CXGTYEGLLRX

SEQ ID NO: 197203 - protein, 9 aa, Artificial Sequence
  Description of Artificial Sequence: Synthetic peptide
  Seed: CPRLGAESA (TYRP2_HUMAN)
  misc_feature (2)..(2): Xaa can be Pro, Ala, Val, Ile, Met, Gly, Leu, Ser, Thr, or Gln
  misc_feature (9)..(9): Xaa can be Leu, Ala, Met, Phe, Ile, Val, Cys, Lys, Arg, Tyr, His, Thr, Gly, Ser, Pro, or Trp
CXRLGAESX

SEQ ID NO: 197204 - protein, 11 aa, Artificial Sequence
  Description of Artificial Sequence: Synthetic peptide
  Seed: CPRLGAESANV (TYRP2_HUMAN)
  misc_feature (2)..(2): Xaa can be , or Pro
  misc_feature (11)..(11): Xaa can be Met, Leu, Pro, Val, Phe, Ile, Ala, Cys, or Thr
CXRLGAESANX

SEQ ID NO: 197205 - protein, 9 aa, Artificial Sequence
  Description of Artificial Sequence: Synthetic peptide
  Seed: CSVYDFFVW (TYRP2_HUMAN)
  misc_feature (2)..(2): Xaa can be Pro, Ser, Thr, Ala, Val, Met, Gly, Cys, Asn, Asp, Leu, Ile, Phe, or Gln
  misc_feature (9)..(9): Xaa can be Trp, Phe, Tyr, Met, Leu, Ile, or Val
CXVYDFFVX

SEQ ID NO: 197206 - protein, 10 aa, Artificial Sequence
  Description of Artificial Sequence: Synthetic peptide
  Seed: CSVYDFFVWL (TYRP2_HUMAN)
  misc_feature (2)..(2): Xaa can be Ser, Met, Gln, Leu, Ala, Thr, Lys, Tyr, Phe, Ile, Arg, Val, Gly, His, Asn, Cys, Trp, Glu, Asp, or Pro
  misc_feature (10)..(10): Xaa can be Val, Ala, Ile, Leu, Trp, Thr, Met, Phe, Glu, Gly, Tyr, Gln, Pro, His, Ser, Asp, Asn, Cys, Lys, or Arg
CXVYDFFVWX

SEQ ID NO: 197207 - protein, 10 aa, Artificial Sequence
  Description of Artificial Sequence: Synthetic peptide
  Seed: CTDQLFGAAR (TYRP2_HUMAN)
  misc_feature (2)..(2): Xaa can be Ser, Thr, Met, Ala, Val, Leu, Tyr, Phe, Ile, Asn, Asp, Gln, Gly, Glu, Trp, Cys, His, or Ly s
  misc_feature (10)..(10): Xaa can be Tyr, Lys, Arg, Phe, Leu, Met, Trp, or His
CXDQLFGAAX

SEQ ID NO: 197208 - protein, 9 aa, Artificial Sequence
  Description of Artificial Sequence: Synthetic peptide
  Seed: CTEVRADTR (TYRP2_HUMAN)
  misc_feature (2)..(2): Xaa can be Val, Tyr, Phe, or Thr
  misc_feature (9)..(9): Xaa can be , or Arg
CXEVRADTX

SEQ ID NO: 197209 - protein, 11 aa, Artificial Sequence
  Description of Artificial Sequence: Synthetic peptide
  Seed: CTEVRADTRPW (TYRP2_HUMAN)
  misc_feature (2)..(2): Xaa can be Ala, Ser, or Thr
  misc_feature (11)..(11): Xaa can be , or Trp
CXEVRADTRPX

SEQ ID NO: 197210 - protein, 9 aa, Artificial Sequence
  Description of Artificial Sequence: Synthetic peptide
  Seed: DAIFDEWMK (TYRP2_HUMAN)
  misc_feature (2)..(2): Xaa can be Thr, Ala, Met, Ser, Asn, Ile, Gln, Trp, Leu, Val, Phe, Tyr, Gly, Cys, or Arg
  misc_feature (9)..(9): Xaa can be Arg, Lys, His, or Tyr
DXIFDEWMX

SEQ ID NO: 197211 - protein, 10 aa, Artificial Sequence
  Description of Artificial Sequence: Synthetic peptide
  Seed: DAIFDEWMKR (TYRP2_HUMAN)
  misc_feature (2)..(2): Xaa can be Val, Thr, Ile, Met, Lys, Asp, Tyr, Phe, Ser, Pro, Trp, Ala, Gln, Arg, Leu, Gly, His, Cys, Asn, or Glu
  misc_feature (10)..(10): Xaa can be Lys, Arg, Tyr, or Leu
DXIFDEWMKX

SEQ ID NO: 197212 - protein, 9 aa, Artificial Sequence
  Description of Artificial Sequence: Synthetic peptide
  Seed: DAWPQELAP (TYRP2_HUMAN)
  misc_feature (2)..(2): Xaa can be Ala, Pro, Ser, Gly, Val, Thr, Ile, Met, Cys, Leu, Asn, Gln, or Asp
  misc_feature (9)..(9): Xaa can be Val, Ile, Leu, Met, Cys, Ala, Phe, Thr, Pro, Gly, or Ser
DXWPQELAX

SEQ ID NO: 197213 - protein, 10 aa, Artificial Sequence
  Description of Artificial Sequence: Synthetic peptide
  Seed: DAWPQELAPI (TYRP2_HUMAN)
  misc_feature (2)..(2): Xaa can be Val, Thr, Ala, Ile, Pro, Ser, or Leu
  misc_feature (10)..(10): Xaa can be Val, Leu, Ile, Met, or Ala
DXWPQELAPX

SEQ ID NO: 197214 - protein, 11 aa, Artificial Sequence
  Description of Artificial Sequence: Synthetic peptide
  Seed: DDPTLISRNSR (TYRP2_HUMAN)
  misc_feature (2)..(2): Xaa can be Cys, Leu, Ile, Gly, Lys, Tyr, Phe, Val, Trp, Gln, Asp, His, Pro, Met, Arg, Ser, Thr, Asn, Glu, or Ala
  misc_feature (11)..(11): Xaa can be , or Arg
DXPTLISRNSX

SEQ ID NO: 197215 - protein, 9 aa, Artificial Sequence
  Description of Artificial Sequence: Synthetic peptide
  Seed: DDRELWPRK (TYRP2_HUMAN)
  misc_feature (2)..(2): Xaa can be Val, Thr, Ile, Ala, Ser, Met, Leu, Asp, Gln, Phe, Glu, Asn, Gly, Pro, Cys, or Tyr
  misc_feature (9)..(9): Xaa can be Lys, Arg, Tyr, Leu, His, Met, Phe, or Val
DXRELWPRX

SEQ ID NO: 197216 - protein, 9 aa, Artificial Sequence
  Description of Artificial Sequence: Synthetic peptide
  Seed: DDYNHLVTL (TYRP2_HUMAN)
  misc_feature (2)..(2): Xaa can be Glu, Arg, His, Gln, Ala, Asp, Pro, Ser, Gly, Ile, Val, Lys, Leu, Met, Asn, Thr, Tyr, Phe, Cys, or Trp
  misc_feature (9)..(9): Xaa can be Leu, Phe, Val, Tyr, Met, Ile, Ala, Cys, Trp, His, Thr, Pro, Gly, Ser, Gln, Arg, Lys, Asn, Asp, or Glu
DXYNHLVTX

SEQ ID NO: 197217 - protein, 9 aa, Artificial Sequence
  Description of Artificial Sequence: Synthetic peptide
  Seed: DEWMKRFNP (TYRP2_HUMAN)
  misc_feature (2)..(2): Xaa can be Glu, or Asp
  misc_feature (9)..(9): Xaa can be Val, Pro, Met, Cys, Ser, Phe, Ala, Ile, Thr, or Leu
DXWMKRFNX

SEQ ID NO: 197218 - protein, 11 aa, Artificial Sequence
  Description of Artificial Sequence: Synthetic peptide
  Seed: DEWMKRFNPPA (TYRP2_HUMAN)
  misc_feature (2)..(2): Xaa can be Glu, or Gln
  misc_feature (11)..(11): Xaa can be Tyr, Phe, Leu, His, Trp, Val, Ala, Ile, or Met
DXWMKRFNPPX

SEQ ID NO: 197219 - protein, 8 aa, Artificial Sequence
  Description of Artificial Sequence: Synthetic peptide
  Seed: DFFVWLHY (TYRP2_HUMAN)
  misc_feature (2)..(2): Xaa can be Thr, Phe, Met, Tyr, Ser, or Gln
  misc_feature (8)..(8): Xaa can be , or Tyr
DXFVWLHX

SEQ ID NO: 197220 - protein, 9 aa, Artificial Sequence
  Description of Artificial Sequence: Synthetic peptide
  Seed: DFFVWLHYY (TYRP2_HUMAN)
  misc_feature (2)..(2): Xaa can be Tyr, Phe, Met, Trp, Thr, Gln, Val, Ala, Ser, Leu, Ile, Gly, Asn, His, Cys, Glu, Pro, Asp, Lys, or Arg
  misc_feature (9)..(9): Xaa can be Tyr, Arg, Lys, Phe, His, Val, Leu, Met, Gln, Glu, or Ala
DXFVWLHYX

SEQ ID NO: 197221 - protein, 9 aa, Artificial Sequence
  Description of Artificial Sequence: Synthetic peptide
  Seed: DFSHQGPAF (TYRP2_HUMAN)
  misc_feature (2)..(2): Xaa can be Tyr, Met, Gln, Leu, Arg, Val, Ile, Trp, Ala, Phe, Ser, Thr, Pro, Cys, Asn, Gly, Glu, Lys, His, or Asp
  misc_feature (9)..(9): Xaa can be Tyr, Phe, Met, Leu, Trp, or Ile
DXSHQGPAX

SEQ ID NO: 197222 - protein, 9 aa, Artificial Sequence
  Description of Artificial Sequence: Synthetic peptide
  Seed: DIRDCLSLQ (TYRP2_HUMAN)
  misc_feature (2)..(2): Xaa can be Val, Thr, Ile, Ala, Ser, Leu, Met, Gln, Tyr, Asp, Asn, Glu, Gly, Trp, Phe, Cys, Pro, Lys, or His
  misc_feature (9)..(9): Xaa can be Arg, Lys, Tyr, His, Met, Leu, Phe, Gln, Val, Ile, or Ala
DXRDCLSLX

SEQ ID NO: 197223 - protein, 10 aa, Artificial Sequence
  Description of Artificial Sequence: Synthetic peptide
  Seed: DIRDCLSLQK (TYRP2_HUMAN)
  misc_feature (2)..(2): Xaa can be Thr, Val, Ala, Ser, Ile, Met, Leu, Trp, Phe, Glu, Tyr, Cys, Asp, Gln, Gly, His, Asn, Pro, Arg, or Lys
  misc_feature (10)..(10): Xaa can be Arg, Lys, Tyr, Phe, Met, His, or Leu
DXRDCLSLQX

SEQ ID NO: 197224 - protein, 11 aa, Artificial Sequence
  Description of Artificial Sequence: Synthetic peptide
  Seed: DIRDCLSLQKF (TYRP2_HUMAN)
  misc_feature (2)..(2): Xaa can be Val, Thr, Ile, Ala, Ser, Met, or Leu
  misc_feature (11)..(11): Xaa can be Trp, Phe, or Tyr
DXRDCLSLQKX

SEQ ID NO: 197225 - protein, 10 aa, Artificial Sequence
  Description of Artificial Sequence: Synthetic peptide
  Seed: DPIFVVLHSF (TYRP2_HUMAN)
  misc_feature (2)..(2): Xaa can be Pro, Ala, Ser, or Thr
  misc_feature (10)..(10): Xaa can be Trp, Phe, Tyr, or Met
DXIFVVLHSX

SEQ ID NO: 197226 - protein, 10 aa, Artificial Sequence
  Description of Artificial Sequence: Synthetic peptide
  Seed: DPTLISRNSR (TYRP2_HUMAN)
  misc_feature (2)..(2): Xaa can be Asn, Arg, Gln, Ala, Leu, His, Phe, Gly, Val, Lys, Glu, Ser, Cys, Met, Ile, Pro, Asp, Tyr, Trp, or Thr
  misc_feature (10)..(10): Xaa can be Arg, or Lys
DXTLISRNSX

SEQ ID NO: 197227 - protein, 8 aa, Artificial Sequence
  Description of Artificial Sequence: Synthetic peptide
  Seed: DQLFGAAR (TYRP2_HUMAN)
  misc_feature (2)..(2): Xaa can be Val, Ser, Ile, Ala, Thr, Gln, Met, Leu, or Gly
  misc_feature (8)..(8): Xaa can be Arg, or Lys
DXLFGAAX

SEQ ID NO: 197228 - protein, 9 aa, Artificial Sequence
  Description of Artificial Sequence: Synthetic peptide
  Seed: DQLGYSYAI (TYRP2_HUMAN)
  misc_feature (2)..(2): Xaa can be Glu, Arg, His, Gln, Ile, Asp, Ala, Thr, Met, Leu, Val, Lys, Ser, Asn, Gly, Pro, Cys, Phe, Trp, or Tyr
  misc_feature (9)..(9): Xaa can be Tyr, Val, Phe, Leu, Ala, Ile, Met, Thr, Trp, Cys, Pro, Ser, Gly, His, Asn, Glu, Lys, or Gl n
DXLGYSYAX

SEQ ID NO: 197229 - protein, 9 aa, Artificial Sequence
  Description of Artificial Sequence: Synthetic peptide
  Seed: DRELWPRKF (TYRP2_HUMAN)
  misc_feature (2)..(2): Xaa can be His, Arg, Gln, Phe, Tyr, or Trp
  misc_feature (9)..(9): Xaa can be Phe, Leu, Tyr, Met, Ile, Val, or Trp
DXELWPRKX

SEQ ID NO: 197230 - protein, 9 aa, Artificial Sequence
  Description of Artificial Sequence: Synthetic peptide
  Seed: DSLDDYNHL (TYRP2_HUMAN)
  misc_feature (2)..(2): Xaa can be Thr, Ile, Val, Ala, Ser, Met, Leu, Gly, Gln, Pro, Asn, Phe, Tyr, Asp, Cys, or Glu
  misc_feature (9)..(9): Xaa can be Arg, Lys, Trp, Tyr, Val, Leu, Ile, Phe, Met, Ala, His, Cys, or Thr
DXLDDYNHX

SEQ ID NO: 197231 - protein, 10 aa, Artificial Sequence
  Description of Artificial Sequence: Synthetic peptide
  Seed: DSLDDYNHLV (TYRP2_HUMAN)
  misc_feature (2)..(2): Xaa can be Phe, Val, Thr, Tyr, Leu, Ala, Ile, Met, Ser, Arg, Trp, Lys, Asn, Gln, His, Cys, or Gly
  misc_feature (10)..(10): Xaa can be Ile, Leu, Val, Met, Ala, or Thr
DXLDDYNHLX

SEQ ID NO: 197232 - protein, 11 aa, Artificial Sequence
  Description of Artificial Sequence: Synthetic peptide
  Seed: DSLVNKECCPR (TYRP2_HUMAN)
  misc_feature (2)..(2): Xaa can be Asn, Met, Ser, Leu, Phe, Gly, Gln, Val, Tyr, Ala, Trp, Ile, Thr, or Cys
  misc_feature (11)..(11): Xaa can be Arg, or Lys
DXLVNKECCPX

SEQ ID NO: 197233 - protein, 11 aa, Artificial Sequence
  Description of Artificial Sequence: Synthetic peptide
  Seed: DSQVMSLHNLV (TYRP2_HUMAN)
  misc_feature (2)..(2): Xaa can be Met, Thr, or Ser
  misc_feature (11)..(11): Xaa can be , or Val
DXQVMSLHNLX

SEQ ID NO: 197234 - protein, 8 aa, Artificial Sequence
  Description of Artificial Sequence: Synthetic peptide
  Seed: DTLLGPGR (TYRP2_HUMAN)
  misc_feature (2)..(2): Xaa can be Thr, Val, Ile, Ser, Ala, Met, or Leu
  misc_feature (8)..(8): Xaa can be Arg, or Lys
DXLLGPGX

SEQ ID NO: 197235 - protein, 10 aa, Artificial Sequence
  Description of Artificial Sequence: Synthetic peptide
  Seed: DTLLGPGRPY (TYRP2_HUMAN)
  misc_feature (2)..(2): Xaa can be Thr, Val, Met, Ser, Ile, Leu, Ala, Tyr, Gln, Phe, Cys, Asn, Trp, Gly, Asp, Glu, Pro, His, Arg, or Lys
  misc_feature (10)..(10): Xaa can be Tyr, Lys, Arg, Phe, Trp, Met, Gln, His, or Leu
DXLLGPGRPX

SEQ ID NO: 197236 - protein, 11 aa, Artificial Sequence
  Description of Artificial Sequence: Synthetic peptide
  Seed: DTLLGPGRPYR (TYRP2_HUMAN)
  misc_feature (2)..(2): Xaa can be Tyr, Trp, Ala, Gly, Ser, Phe, Met, Leu, Arg, Thr, Val, Ile, His, Glu, Lys, Cys, Gln, or As n
  misc_feature (11)..(11): Xaa can be Arg, or Lys
DXLLGPGRPYX

SEQ ID NO: 197237 - protein, 9 aa, Artificial Sequence
  Description of Artificial Sequence: Synthetic peptide
  Seed: DTRPWSGPY (TYRP2_HUMAN)
  misc_feature (2)..(2): Xaa can be Thr, Val, Ile, Ala, Ser, Met, Leu, Gln, Pro, Phe, Glu, Gly, Asn, Cys, Trp, Asp, Tyr, His, Arg, or Lys
  misc_feature (9)..(9): Xaa can be Tyr, Arg, Lys, Phe, Met, Leu, Trp, His, Gln, Val, or Ile
DXRPWSGPX

SEQ ID NO: 197238 - protein, 10 aa, Artificial Sequence
  Description of Artificial Sequence: Synthetic peptide
  Seed: DTRPWSGPYI (TYRP2_HUMAN)
  misc_feature (2)..(2): Xaa can be Val, Thr, Ser, Ala, or Ile
  misc_feature (10)..(10): Xaa can be Val, Ile, or Leu
DXRPWSGPYX

SEQ ID NO: 197239 - protein, 11 aa, Artificial Sequence
  Description of Artificial Sequence: Synthetic peptide
  Seed: DTRPWSGPYIL (TYRP2_HUMAN)
  misc_feature (2)..(2): Xaa can be Arg, Met, Tyr, Trp, Lys, Ser, His, Ala, Gly, Phe, Gln, or Thr
  misc_feature (11)..(11): Xaa can be Leu, Met, Ile, Phe, or Val
DXRPWSGPYIX

SEQ ID NO: 197240 - protein, 10 aa, Artificial Sequence
  Description of Artificial Sequence: Synthetic peptide
  Seed: DVCTDQLFGA (TYRP2_HUMAN)
  misc_feature (2)..(2): Xaa can be Val, Thr, Ser, Ala, Ile, Leu, or Met
  misc_feature (10)..(10): Xaa can be Val, Leu, Ile, Ala, or Met
DXCTDQLFGX

SEQ ID NO: 197241 - protein, 8 aa, Artificial Sequence
  Description of Artificial Sequence: Synthetic peptide
  Seed: DYNHLVTL (TYRP2_HUMAN)
  misc_feature (2)..(2): Xaa can be Tyr, Phe, Arg, Ser, Gln, or Ala
  misc_feature (8)..(8): Xaa can be Leu, Tyr, Phe, or Met
DXNHLVTX

SEQ ID NO: 197242 - protein, 9 aa, Artificial Sequence
  Description of Artificial Sequence: Synthetic peptide
  Seed: DYVITTQHW (TYRP2_HUMAN)
  misc_feature (2)..(2): Xaa can be Tyr, Trp, or Phe
  misc_feature (9)..(9): Xaa can be Leu, Trp, Phe, Ile, Met, or Val
DXVITTQHX

SEQ ID NO: 197243 - protein, 9 aa, Artificial Sequence
  Description of Artificial Sequence: Synthetic peptide
  Seed: ECDVCTDQL (TYRP2_HUMAN)
  misc_feature (2)..(2): Xaa can be Tyr, Phe, Trp, Leu, Val, Thr, Ser, Ile, Ala, Cys, Asn, Met, Gly, Gln, His, Pro, Arg, Glu, or Asp
  misc_feature (9)..(9): Xaa can be Leu, Met, Ile, Phe, Val, Tyr, Cys, Trp, or Ala
EXDVCTDQX

SEQ ID NO: 197244 - protein, 10 aa, Artificial Sequence
  Description of Artificial Sequence: Synthetic peptide
  Seed: ECDVCTDQLF (TYRP2_HUMAN)
  misc_feature (2)..(2): Xaa can be Cys, Thr, Tyr, Ser, Ala, Val, Met, Phe, Trp, Asn, Leu, Ile, Gly, or Gln
  misc_feature (10)..(10): Xaa can be Trp, or Phe
EXDVCTDQLX

SEQ ID NO: 197245 - protein, 10 aa, Artificial Sequence
  Description of Artificial Sequence: Synthetic peptide
  Seed: EELFLTSDQL (TYRP2_HUMAN)
  misc_feature (2)..(2): Xaa can be Glu, or Gln
  misc_feature (10)..(10): Xaa can be Trp, Val, Phe, Thr, Ile, Met, Leu, Ala, Tyr, Cys, or Pro
EXLFLTSDQX

SEQ ID NO: 197246 - protein, 8 aa, Artificial Sequence
  Description of Artificial Sequence: Synthetic peptide
  Seed: EETPGWPT (TYRP2_HUMAN)
  misc_feature (2)..(2): Xaa can be Glu, or Asp
  misc_feature (8)..(8): Xaa can be Ala, Thr, Cys, Pro, Met, Leu, Ser, Ile, Val, or Phe
EXTPGWPX

SEQ ID NO: 197247 - protein, 9 aa, Artificial Sequence
  Description of Artificial Sequence: Synthetic peptide
  Seed: EETPGWPTT (TYRP2_HUMAN)
  misc_feature (2)..(2): Xaa can be Glu, Asp, Gln, or Ala
  misc_feature (9)..(9): Xaa can be Leu, Val, Tyr, Ile, Pro, Thr, Cys, Met, Phe, Ala, Gly, Asp, Lys, Ser, Gln, Arg, Trp, His, or Glu
EXTPGWPTX

SEQ ID NO: 197248 - protein, 10 aa, Artificial Sequence
  Description of Artificial Sequence: Synthetic peptide
  Seed: EETPGWPTTL (TYRP2_HUMAN)
  misc_feature (2)..(2): Xaa can be Glu, His, Gln, Arg, Asp, Thr, Ala, Lys, or Ser
  misc_feature (10)..(10): Xaa can be Trp, Phe, Leu, Ile, Tyr, Met, Ala, Val, Cys, Thr, Ser, Pro, or Gly
EXTPGWPTTX

SEQ ID NO: 197249 - protein, 11 aa, Artificial Sequence
  Description of Artificial Sequence: Synthetic peptide
  Seed: EETPGWPTTLL (TYRP2_HUMAN)
  misc_feature (2)..(2): Xaa can be Glu, or Gln
  misc_feature (11)..(11): Xaa can be Trp, Tyr, Phe, Thr, Val, Pro, Leu, Ile, Cys, Ala, or Met
EXTPGWPTTLX

SEQ ID NO: 197250 - protein, 9 aa, Artificial Sequence
  Description of Artificial Sequence: Synthetic peptide
  Seed: EGLLRRNQM (TYRP2_HUMAN)
  misc_feature (2)..(2): Xaa can be Met, Arg, Ala, Leu, Ile, Pro, His, Gln, Phe, Gly, Ser, Val, Asn, Lys, Thr, Glu, Cys, Asp, Tyr, or Trp
  misc_feature (9)..(9): Xaa can be Leu, Met, Ile, Val, Phe, Ala, Cys, or Thr
EXLLRRNQX

SEQ ID NO: 197251 - protein, 11 aa, Artificial Sequence
  Description of Artificial Sequence: Synthetic peptide
  Seed: EGLLRRNQMGR (TYRP2_HUMAN)
  misc_feature (2)..(2): Xaa can be Ser, Leu, Val, Thr, Trp, Met, Gly, Ala, Tyr, Phe, or Ile
  misc_feature (11)..(11): Xaa can be , or Arg
EXLLRRNQMGX

SEQ ID NO: 197252 - protein, 9 aa, Artificial Sequence
  Description of Artificial Sequence: Synthetic peptide
  Seed: ELAPIGHNR (TYRP2_HUMAN)
  misc_feature (2)..(2): Xaa can be Val, Thr, Ile, Ala, Ser, Leu, Met, Gln, Gly, Tyr, Phe, Cys, Asn, Glu, Trp, Lys, Arg, Asp, Pro, or His
  misc_feature (9)..(9): Xaa can be Lys, Arg, Tyr, Phe, Leu, Met, His, Trp, Ala, Val, Gln, Ile, Asn, Thr, Glu, Gly, Ser, Cys, or Pro
EXAPIGHNX

SEQ ID NO: 197253 - protein, 10 aa, Artificial Sequence
  Description of Artificial Sequence: Synthetic peptide
  Seed: ELAPIGHNRM (TYRP2_HUMAN)
  misc_feature (2)..(2): Xaa can be Ser, Ala, Thr, Leu, Ile, Met, Val, Gln, Gly, Asn, Cys, Glu, Tyr, Pro, Phe, Trp, or Asp
  misc_feature (10)..(10): Xaa can be Lys, Arg, Val, Tyr, Met, Leu, Asp, Gln, Glu, Cys, Phe, Ala, Trp, Asn, Gly, Ile, Pro, Thr, Ser, or His
EXAPIGHNRX

SEQ ID NO: 197254 - protein, 11 aa, Artificial Sequence
  Description of Artificial Sequence: Synthetic peptide
  Seed: ELAPIGHNRMY (TYRP2_HUMAN)
  misc_feature (2)..(2): Xaa can be Val, Thr, Ile, Ala, Ser, Leu, Gln, Met, Pro, Gly, Glu, Phe, Asn, Asp, Cys, Tyr, or Trp
  misc_feature (11)..(11): Xaa can be Tyr, Arg, Lys, Phe, Trp, His, Met, Leu, Gln, Asn, Val, Ile, Ala, or Glu
EXAPIGHNRMX

SEQ ID NO: 197255 - protein, 9 aa, Artificial Sequence
  Description of Artificial Sequence: Synthetic peptide
  Seed: ELFLTSDQL (TYRP2_HUMAN)
  misc_feature (2)..(2): Xaa can be Gln, Met, Leu, Ala, Ile, Ser, Glu, Val, Thr, or Gly
  misc_feature (9)..(9): Xaa can be Val, Ile, Leu, Trp, Phe, Met, Tyr, or Ala
EXFLTSDQX

SEQ ID NO: 197256 - protein, 11 aa, Artificial Sequence
  Description of Artificial Sequence: Synthetic peptide
  Seed: ELFLTSDQLGY (TYRP2_HUMAN)
  misc_feature (2)..(2): Xaa can be Ala, Val, Gln, Ile, Met, Leu, Thr, Ser, Glu, Asn, Gly, Phe, Trp, Tyr, Pro, or Asp
  misc_feature (11)..(11): Xaa can be Tyr, Lys, Phe, Trp, or Arg
EXFLTSDQLGX

SEQ ID NO: 197257 - protein, 9 aa, Artificial Sequence
  Description of Artificial Sequence: Synthetic peptide
  Seed: ELWPRKFFH (TYRP2_HUMAN)
  misc_feature (2)..(2): Xaa can be Phe, Met, Leu, Tyr, Thr, Val, Ile, Trp, Ala, Ser, Gln, Pro, Gly, His, Arg, Cys, Asn, Asp, Glu, or Lys
  misc_feature (9)..(9): Xaa can be Lys, Arg, Tyr, His, Met, Leu, Gln, Phe, Val, Ile, Glu, or Ala
EXWPRKFFX

SEQ ID NO: 197258 - protein, 10 aa, Artificial Sequence
  Description of Artificial Sequence: Synthetic peptide
  Seed: ELWPRKFFHR (TYRP2_HUMAN)
  misc_feature (2)..(2): Xaa can be Thr, Val, Ile, Met, Phe, Tyr, Leu, Ala, Ser, Cys, Trp, Gln, Asn, Glu, Asp, Gly, His, Arg, Pro, or Lys
  misc_feature (10)..(10): Xaa can be Arg, Lys, Tyr, His, Leu, Met, Phe, or Gln
EXWPRKFFHX

SEQ ID NO: 197259 - protein, 9 aa, Artificial Sequence
  Description of Artificial Sequence: Synthetic peptide
  Seed: EQFLGALDL (TYRP2_HUMAN)
  misc_feature (2)..(2): Xaa can be Glu, His, Gln, Arg, Asp, Leu, Met, Ser, Ala, Val, Gly, Lys, Pro, Tyr, Asn, Ile, Cys, Thr, Phe, or Trp
  misc_feature (9)..(9): Xaa can be Tyr, Phe, Leu, Val, Met, Ile, Ala, Trp, Pro, Thr, Cys, His, Ser, Gly, Glu, or Asp
EXFLGALDX

SEQ ID NO: 197260 - protein, 11 aa, Artificial Sequence
  Description of Artificial Sequence: Synthetic peptide
  Seed: EQFLGALDLAK (TYRP2_HUMAN)
  misc_feature (2)..(2): Xaa can be Thr, Leu, Ile, Ala, Ser, Met, Val, Gly, Cys, Gln, Phe, or Asn
  misc_feature (11)..(11): Xaa can be Lys, Arg, or His
EXFLGALDLAX

SEQ ID NO: 197261 - protein, 9 aa, Artificial Sequence
  Description of Artificial Sequence: Synthetic peptide
  Seed: EREQFLGAL (TYRP2_HUMAN)
  misc_feature (2)..(2): Xaa can be Arg, His, Tyr, Gln, Phe, or Ala
  misc_feature (9)..(9): Xaa can be Leu, Met, Phe, Ile, Ala, Val, Tyr, Trp, Pro, Thr, Cys, Lys, or Arg
EXEQFLGAX

SEQ ID NO: 197262 - protein, 11 aa, Artificial Sequence
  Description of Artificial Sequence: Synthetic peptide
  Seed: EREQFLGALDL (TYRP2_HUMAN)
  misc_feature (2)..(2): Xaa can be , or Arg
  misc_feature (11)..(11): Xaa can be , or Leu
EXEQFLGALDX

SEQ ID NO: 197263 - protein, 8 aa, Artificial Sequence
  Description of Artificial Sequence: Synthetic peptide
  Seed: ERKKPPVI (TYRP2_HUMAN)
  misc_feature (2)..(2): Xaa can be His, Arg, Gln, Pro, Lys, Glu, Ala, or Asn
  misc_feature (8)..(8): Xaa can be Leu, Met, Val, Ile, Phe, or Ala
EXKKPPVX

SEQ ID NO: 197264 - protein, 9 aa, Artificial Sequence
  Description of Artificial Sequence: Synthetic peptide
  Seed: ERKKPPVIR (TYRP2_HUMAN)
  misc_feature (2)..(2): Xaa can be Arg, Gln, Trp, Phe, Ala, Met, Tyr, His, Leu, Ile, Ser, Asp, Val, Gly, Thr, Pro, Asn, Lys, Cys, or Glu
  misc_feature (9)..(9): Xaa can be Arg, Lys, Leu, Phe, Met, Tyr, Val, His, Ile, or Trp
EXKKPPVIX

SEQ ID NO: 197265 - protein, 9 aa, Artificial Sequence
  Description of Artificial Sequence: Synthetic peptide
  Seed: ESANVCGSQ (TYRP2_HUMAN)
  misc_feature (2)..(2): Xaa can be Val, Thr, Ile, Ala, Ser, Met, Leu, Asn, Tyr, Cys, Glu, Pro, Asp, Gln, Trp, Phe, Gly, His, or Lys
  misc_feature (9)..(9): Xaa can be Arg, Lys, Leu, His, Met, Phe, Tyr, Val, Gln, Ile, Ala, or Trp
EXANVCGSX

SEQ ID NO: 197266 - protein, 10 aa, Artificial Sequence
  Description of Artificial Sequence: Synthetic peptide
  Seed: ESANVCGSQQ (TYRP2_HUMAN)
  misc_feature (2)..(2): Xaa can be Val, Thr, Ile, Ala, Ser, Leu, Met, Gln, Glu, Gly, Phe, Cys, Asn, Trp, Asp, Tyr, Pro, Lys, or His
  misc_feature (10)..(10): Xaa can be Arg, Lys, Tyr, Leu, Met, Phe, His, Gln, Ile, Val, Ala, Trp, Thr, Asn, or Glu
EXANVCGSQX

SEQ ID NO: 197267 - protein, 8 aa, Artificial Sequence
  Description of Artificial Sequence: Synthetic peptide
  Seed: ESFALPYW (TYRP2_HUMAN)
  misc_feature (2)..(2): Xaa can be Cys, Ser, Thr, or Ala
  misc_feature (8)..(8): Xaa can be , or Trp
EXFALPYX

SEQ ID NO: 197268 - protein, 10 aa, Artificial Sequence
  Description of Artificial Sequence: Synthetic peptide
  Seed: ESFALPYWNF (TYRP2_HUMAN)
  misc_feature (2)..(2): Xaa can be Tyr, Trp, Val, Ser, Met, Thr, Phe, Gln, Leu, Ile, Ala, Gly, His, Pro, Arg, Cys, Asn, or Ly s
  misc_feature (10)..(10): Xaa can be Phe, Trp, Ile, Leu, Val, or Met
EXFALPYWNX

SEQ ID NO: 197269 - protein, 11 aa, Artificial Sequence
  Description of Artificial Sequence: Synthetic peptide
  Seed: ESFALPYWNFA (TYRP2_HUMAN)
  misc_feature (2)..(2): Xaa can be Thr, Val, Ile, Ser, Ala, Met, or Leu
  misc_feature (11)..(11): Xaa can be Val, Ala, Ile, Leu, Met, or Thr
EXFALPYWNFX

SEQ ID NO: 197270 - protein, 8 aa, Artificial Sequence
  Description of Artificial Sequence: Synthetic peptide
  Seed: ETHLSSKR (TYRP2_HUMAN)
  misc_feature (2)..(2): Xaa can be Val, Leu, Ile, Thr, Met, Ala, Ser, Phe, or Tyr
  misc_feature (8)..(8): Xaa can be Arg, or Lys
EXHLSSKX

SEQ ID NO: 197271 - protein, 9 aa, Artificial Sequence
  Description of Artificial Sequence: Synthetic peptide
  Seed: ETHLSSKRY (TYRP2_HUMAN)
  misc_feature (2)..(2): Xaa can be Val, Thr, Ile, Ala, Met, Gln, Leu, Ser, Asn, Gly, Glu, Phe, Pro, Trp, Asp, or Tyr
  misc_feature (9)..(9): Xaa can be Tyr, Arg, Lys, Phe, Trp, Met, Leu, His, or Ile
EXHLSSKRX

SEQ ID NO: 197272 - protein, 9 aa, Artificial Sequence
  Description of Artificial Sequence: Synthetic peptide
  Seed: ETPGWPTTL (TYRP2_HUMAN)
  misc_feature (2)..(2): Xaa can be Ala, Val, Thr, Ile, Tyr, Ser, Met, Pro, Leu, Arg, Phe, Gln, Gly, Glu, Trp, Cys, Asn, Asp, Lys, or His
  misc_feature (9)..(9): Xaa can be Val, Leu, Met, Tyr, Phe, Ile, Arg, Lys, Trp, Ala, His, Cys, Thr, or Gln
EXPGWPTTX

SEQ ID NO: 197273 - protein, 10 aa, Artificial Sequence
  Description of Artificial Sequence: Synthetic peptide
  Seed: ETPGWPTTLL (TYRP2_HUMAN)
  misc_feature (2)..(2): Xaa can be Thr, Val, Ile, Ala, Ser, Met, Leu, Gln, Phe, Glu, Gly, Tyr, Cys, Trp, Lys, Asp, His, Asn, or Pro
  misc_feature (10)..(10): Xaa can be Arg, Lys, Leu, Trp, Tyr, Met, Phe, Val, Ala, Ile, His, Gln, or Thr
EXPGWPTTLX

SEQ ID NO: 197274 - protein, 11 aa, Artificial Sequence
  Description of Artificial Sequence: Synthetic peptide
  Seed: ETPGWPTTLLV (TYRP2_HUMAN)
  misc_feature (2)..(2): Xaa can be Thr, Val, Ser, Ile, or Ala
  misc_feature (11)..(11): Xaa can be Val, Leu, Ile, or Ala
EXPGWPTTLLX

SEQ ID NO: 197275 - protein, 10 aa, Artificial Sequence
  Description of Artificial Sequence: Synthetic peptide
  Seed: ETVCDSLDDY (TYRP2_HUMAN)
  misc_feature (2)..(2): Xaa can be Val, Thr, Ser, Met, or Ile
  misc_feature (10)..(10): Xaa can be Tyr, or Phe
EXVCDSLDDX

SEQ ID NO: 197276 - protein, 9 aa, Artificial Sequence
  Description of Artificial Sequence: Synthetic peptide
  Seed: EVRADTRPW (TYRP2_HUMAN)
  misc_feature (2)..(2): Xaa can be Val, Thr, Ala, Ser, Ile, Cys, Met, Gly, or Leu
  misc_feature (9)..(9): Xaa can be Trp, Phe, Tyr, Leu, or Met
EXRADTRPX

SEQ ID NO: 197277 - protein, 10 aa, Artificial Sequence
  Description of Artificial Sequence: Synthetic peptide
  Seed: FAGYNCGDCK (TYRP2_HUMAN)
  misc_feature (2)..(2): Xaa can be Ala, Ile, Met, Thr, Leu, Ser, Val, Gly, or Gln
  misc_feature (10)..(10): Xaa can be Lys, Arg, Tyr, or Leu
FXGYNCGDCX

SEQ ID NO: 197278 - protein, 11 aa, Artificial Sequence
  Description of Artificial Sequence: Synthetic peptide
  Seed: FAGYNCGDCKF (TYRP2_HUMAN)
  misc_feature (2)..(2): Xaa can be Ala, Gly, Thr, Ile, Val, Ser, Asn, Asp, Leu, Tyr, Cys, Pro, Met, Gln, Trp, Arg, His, Glu, Lys, or Phe
  misc_feature (11)..(11): Xaa can be Phe, Trp, Lys, or Tyr
FXGYNCGDCKX

SEQ ID NO: 197279 - protein, 8 aa, Artificial Sequence
  Description of Artificial Sequence: Synthetic peptide
  Seed: FALPYWNF (TYRP2_HUMAN)
  misc_feature (2)..(2): Xaa can be Ala, Ser, or Thr
  misc_feature (8)..(8): Xaa can be Leu, Tyr, Met, or Phe
FXLPYWNX

SEQ ID NO: 197280 - protein, 9 aa, Artificial Sequence
  Description of Artificial Sequence: Synthetic peptide
  Seed: FALPYWNFA (TYRP2_HUMAN)
  misc_feature (2)..(2): Xaa can be Met, Leu, Gln, Ala, Pro, Thr, Val, Ile, Ser, Gly, Phe, Cys, Asn, Tyr, Glu, Trp, Lys, or As p
  misc_feature (9)..(9): Xaa can be Val, Tyr, Leu, Ile, Phe, Met, Ala, Thr, Ser, Cys, Pro, His, Trp, Glu, Gly, Lys, Gln, or Ar g
FXLPYWNFX

SEQ ID NO: 197281 - protein, 9 aa, Artificial Sequence
  Description of Artificial Sequence: Synthetic peptide
  Seed: FANCSVYDF (TYRP2_HUMAN)
  misc_feature (2)..(2): Xaa can be Pro, Ala, Gln, Ser, Thr, Tyr, Val, Ile, Phe, Arg, Met, Gly, Leu, Trp, Lys, His, Asn, Glu, Asp, or Cys
  misc_feature (9)..(9): Xaa can be Tyr, Phe, Leu, Met, Trp, Ile, Val, His, Ala, Lys, Asn, Pro, Ser, Arg, Gly, Glu, Cys, Gln, or Thr
FXNCSVYDX

SEQ ID NO: 197282 - protein, 10 aa, Artificial Sequence
  Description of Artificial Sequence: Synthetic peptide
  Seed: FANCSVYDFF (TYRP2_HUMAN)
  misc_feature (2)..(2): Xaa can be Pro, Ser, Gln, Ala, Thr, Met, Lys, His, Val, Leu, Ile, Glu, Arg, Cys, Asn, Tyr, Asp, Phe, Trp, or Gly
  misc_feature (10)..(10): Xaa can be Trp, Phe, Tyr, Met, Leu, Ile, Cys, Glu, Thr, Pro, Asn, Gln, Arg, Val, His, Asp, Lys, Gly, Ser, or Ala
FXNCSVYDFX

SEQ ID NO: 197283 - protein, 11 aa, Artificial Sequence
  Description of Artificial Sequence: Synthetic peptide
  Seed: FANCSVYDFFV (TYRP2_HUMAN)
  misc_feature (2)..(2): Xaa can be Leu, Met, Ile, Gln, Val, Thr, Ala, Phe, or Ser
  misc_feature (11)..(11): Xaa can be Val, Leu, Ile, Ala, Met, Phe, Cys, Thr, or Ser
FXNCSVYDFFX

SEQ ID NO: 197284 - protein, 8 aa, Artificial Sequence
  Description of Artificial Sequence: Synthetic peptide
  Seed: FDEWMKRF (TYRP2_HUMAN)
  misc_feature (2)..(2): Xaa can be Glu, or Asp
  misc_feature (8)..(8): Xaa can be Leu, Phe, Met, Val, or Ile
FXEWMKRX

SEQ ID NO: 197285 - protein, 8 aa, Artificial Sequence
  Description of Artificial Sequence: Synthetic peptide
  Seed: FDKADGTL (TYRP2_HUMAN)
  misc_feature (2)..(2): Xaa can be Glu, or Asp
  misc_feature (8)..(8): Xaa can be Leu, Phe, Val, Met, or Ile
FXKADGTX

SEQ ID NO: 197286 - protein, 9 aa, Artificial Sequence
  Description of Artificial Sequence: Synthetic peptide
  Seed: FFPPVTNEE (TYRP2_HUMAN)
  misc_feature (2)..(2): Xaa can be Phe, Tyr, Trp, Met, Ala, Val, Ile, Leu, His, Gln, Ser, Gly, Arg, Thr, Lys, Glu, Pro, Asn, Cys, or Asp
  misc_feature (9)..(9): Xaa can be Leu, Phe, Met, Tyr, Ile, Val, Trp, Ala, His, Cys, Lys, Arg, Thr, Ser, Gln, Glu, Gly, Asn, or Pro
FXPPVTNEX

SEQ ID NO: 197287 - protein, 10 aa, Artificial Sequence
  Description of Artificial Sequence: Synthetic peptide
  Seed: FFPPVTNEEL (TYRP2_HUMAN)
  misc_feature (2)..(2): Xaa can be Ala, Tyr, Leu, Met, Arg, Phe, Ile, Val, Ser, Thr, Gln, Trp, Gly, Glu, Asn, Pro, His, Cys, Lys, or Asp
  misc_feature (10)..(10): Xaa can be Met, Phe, Tyr, Leu, Ile, Trp, Val, Lys, Arg, His, Ala, Cys, Thr, Ser, Gln, Pro, or Asn
FXPPVTNEEX

SEQ ID NO: 197288 - protein, 11 aa, Artificial Sequence
  Description of Artificial Sequence: Synthetic peptide
  Seed: FFPPVTNEELF (TYRP2_HUMAN)
  misc_feature (2)..(2): Xaa can be Arg, Tyr, Ala, Ser, Thr, Val, Gln, Leu, Asn, Ile, Phe, Met, Glu, Trp, Gly, Asp, Cys, His, Lys, or Pro
  misc_feature (11)..(11): Xaa can be Met, Trp, Phe, Tyr, Leu, Lys, Arg, Ile, Val, His, or Cys
FXPPVTNEELX

SEQ ID NO: 197289 - protein, 9 aa, Artificial Sequence
  Description of Artificial Sequence: Synthetic peptide
  Seed: FFQNSTFSF (TYRP2_HUMAN)
  misc_feature (2)..(2): Xaa can be Pro, Tyr, Gln, Ala, Phe, Arg, Thr, Ser, Val, Gly, Ile, Met, Lys, Trp, Asn, His, Leu, Glu, Cys, or Asp
  misc_feature (9)..(9): Xaa can be Phe, Met, Leu, Tyr, Trp, Ile, Val, His, Ala, Lys, Arg, Cys, Thr, Gly, Ser, Asn, Gln, Glu, Asp, or Pro
FXQNSTFSX

SEQ ID NO: 197290 - protein, 10 aa, Artificial Sequence
  Description of Artificial Sequence: Synthetic peptide
  Seed: FFQNSTFSFR (TYRP2_HUMAN)
  misc_feature (2)..(2): Xaa can be Trp, Tyr, Phe, Met, Leu, His, Gln, Val, Ala, Thr, Arg, Ser, Ile, Gly, Asn, Lys, Cys, Glu, Pro, or Asp
  misc_feature (10)..(10): Xaa can be Arg, Lys, Phe, Tyr, Met, Trp, His, Leu, Val, Pro, Glu, Gln, Cys, Ile, Asn, Thr, Ala, Gly, Ser, or Asp
FXQNSTFSFX

SEQ ID NO: 197291 - protein, 11 aa, Artificial Sequence
  Description of Artificial Sequence: Synthetic peptide
  Seed: FFQNSTFSFRN (TYRP2_HUMAN)
  misc_feature (2)..(2): Xaa can be Leu, Ser, Ile, Tyr, Thr, Phe, Met, Arg, Val, Trp, Gln, Ala, His, Cys, Gly, Lys, Glu, Asn, Asp, or Pro
  misc_feature (11)..(11): Xaa can be Arg, Lys, Tyr, His, Pro, Cys, Val, Gly, Thr, Ile, Ser, Asn, Gln, Glu, Leu, Ala, Trp, Phe, Asp, or Met
FXQNSTFSFRX

SEQ ID NO: 197292 - protein, 8 aa, Artificial Sequence
  Description of Artificial Sequence: Synthetic peptide
  Seed: FFVWLHYY (TYRP2_HUMAN)
  misc_feature (2)..(2): Xaa can be Phe, Tyr, Trp, Ile, Asn, Thr, Met, Ala, Ser, Leu, Gly, Gln, or Val
  misc_feature (8)..(8): Xaa can be Tyr, Leu, Met, or Phe
FXVWLHYX

SEQ ID NO: 197293 - protein, 10 aa, Artificial Sequence
  Description of Artificial Sequence: Synthetic peptide
  Seed: FFVWLHYYSV (TYRP2_HUMAN)
  misc_feature (2)..(2): Xaa can be Leu, Met, Gln, Thr, Ser, Val, Ile, Ala, Asn, Trp, Glu, His, Arg, Gly, Pro, Tyr, Phe, Asp, Lys, or Cys
  misc_feature (10)..(10): Xaa can be Ile, Ala, Val, Leu, Met, Thr, Ser, Phe, Cys, Pro, or Gly
FXVWLHYYSX

SEQ ID NO: 197294 - protein, 11 aa, Artificial Sequence
  Description of Artificial Sequence: Synthetic peptide
  Seed: FFVWLHYYSVR (TYRP2_HUMAN)
  misc_feature (2)..(2): Xaa can be His, Lys, Tyr, Gly, Ala, Met, Gln, Val, Phe, Thr, Asn, Ile, Ser, Leu, Trp, Arg, Asp, Pro, Glu, or Cys
  misc_feature (11)..(11): Xaa can be Arg, or Lys
FXVWLHYYSVX

SEQ ID NO: 197295 - protein, 11 aa, Artificial Sequence
  Description of Artificial Sequence: Synthetic peptide
  Seed: FGAARPDDPTL (TYRP2_HUMAN)
  misc_feature (2)..(2): Xaa can be Ala, Ser, Thr, Val, Gly, Ile, Arg, Met, Gln, Pro, Leu, Tyr, His, Cys, Glu, or Asn
  misc_feature (11)..(11): Xaa can be Leu, Met, Lys, Phe, Ile, Tyr, Arg, Val, Trp, Ala, or Cys
FXAARPDDPTX

SEQ ID NO: 197296 - protein, 10 aa, Artificial Sequence
  Description of Artificial Sequence: Synthetic peptide
  Seed: FGWTGPNCER (TYRP2_HUMAN)
  misc_feature (2)..(2): Xaa can be Ala, Ser, Thr, Gly, Met, Val, Leu, Ile, Gln, Pro, Cys, Tyr, Asn, Phe, Trp, Glu, Asp, His, or Lys
  misc_feature (10)..(10): Xaa can be Lys, Arg, Tyr, Phe, Met, Leu, His, Trp, Ile, Val, Cys, or Ala
FXWTGPNCEX

SEQ ID NO: 197297 - protein, 11 aa, Artificial Sequence
  Description of Artificial Sequence: Synthetic peptide
  Seed: FGWTGPNCERK (TYRP2_HUMAN)
  misc_feature (2)..(2): Xaa can be Ala, Ser, Thr, Val, Ile, Met, Leu, or Gly
  misc_feature (11)..(11): Xaa can be Lys, Arg, Tyr, Phe, Leu, Met, or Trp
FXWTGPNCERX

SEQ ID NO: 197298 - protein, 8 aa, Artificial Sequence
  Description of Artificial Sequence: Synthetic peptide
  Seed: FLGALDLA (TYRP2_HUMAN)
  misc_feature (2)..(2): Xaa can be Leu, Met, or Ile
  misc_feature (8)..(8): Xaa can be Val, Ala, Leu, Ile, or Met
FXGALDLX

SEQ ID NO: 197299 - protein, 9 aa, Artificial Sequence
  Description of Artificial Sequence: Synthetic peptide
  Seed: FLGALDLAK (TYRP2_HUMAN)
  misc_feature (2)..(2): Xaa can be Ala, Ser, Thr, Val, Met, Ile, Gly, Leu, Tyr, Phe, Gln, Asn, Cys, Asp, Pro, or Glu
  misc_feature (9)..(9): Xaa can be Lys, Leu, Tyr, Arg, Met, Phe, Val, Ile, His, Trp, Ala, or Cys
FXGALDLAX

SEQ ID NO: 197300 - protein, 10 aa, Artificial Sequence
  Description of Artificial Sequence: Synthetic peptide
  Seed: FLGALDLAKK (TYRP2_HUMAN)
  misc_feature (2)..(2): Xaa can be Met, Leu, Thr, Val, Ala, Gly, Ile, Ser, Phe, Gln, Tyr, Pro, or Asn
  misc_feature (10)..(10): Xaa can be Lys, Arg, Tyr, Leu, Met, or Val
FXGALDLAKX

SEQ ID NO: 197301 - protein, 9 aa, Artificial Sequence
  Description of Artificial Sequence: Synthetic peptide
  Seed: FLLSCLGCK (TYRP2_HUMAN)
  misc_feature (2)..(2): Xaa can be Met, Leu, Thr, Ile, Ser, Ala, Val, Phe, Glu, Asn, Gln, Gly, Cys, Tyr, Asp, Trp, Pro, Lys, His, or Arg
  misc_feature (9)..(9): Xaa can be Arg, Lys, Tyr, His, Leu, Met, Val, or Ile
FXLSCLGCX

SEQ ID NO: 197302 - protein, 10 aa, Artificial Sequence
  Description of Artificial Sequence: Synthetic peptide
  Seed: FLLSCLGCKI (TYRP2_HUMAN)
  misc_feature (2)..(2): Xaa can be Leu, Met, Val, Ile, Gln, Thr, Tyr, Phe, Ala, Ser, Asn, Gly, Trp, Lys, Glu, His, Arg, Cys, Asp, or Pro
  misc_feature (10)..(10): Xaa can be Ala, Val, Ile, Met, Leu, Arg, Lys, Thr, Tyr, Phe, Cys, or Ser
FXLSCLGCKX

SEQ ID NO: 197303 - protein, 11 aa, Artificial Sequence
  Description of Artificial Sequence: Synthetic peptide
  Seed: FLLSCLGCKIL (TYRP2_HUMAN)
  misc_feature (2)..(2): Xaa can be Met, Leu, or Ile
  misc_feature (11)..(11): Xaa can be Val, Ile, Ala, or Leu
FXLSCLGCKIX

SEQ ID NO: 197304 - protein, 8 aa, Artificial Sequence
  Description of Artificial Sequence: Synthetic peptide
  Seed: FLNGTNAL (TYRP2_HUMAN)
  misc_feature (2)..(2): Xaa can be Ala, Leu, Thr, Ser, Tyr, Ile, Val, Met, Phe, Gly, Trp, Asn, Gln, His, Pro, Arg, Cys, Asp, Lys, or Glu
  misc_feature (8)..(8): Xaa can be Leu, Met, Tyr, Phe, Ile, Val, Lys, His, Arg, Trp, or Ala
FXNGTNAX

SEQ ID NO: 197305 - protein, 9 aa, Artificial Sequence
  Description of Artificial Sequence: Synthetic peptide
  Seed: FLNGTNALP (TYRP2_HUMAN)
  misc_feature (2)..(2): Xaa can be Met, Leu, Ile, Gln, Val, Thr, Ala, Ser, Phe, Gly, Cys, or Trp
  misc_feature (9)..(9): Xaa can be Leu, Val, Ile, Met, Ala, Phe, Thr, Cys, Glu, Pro, Asp, Gly, Trp, Ser, or Tyr
FXNGTNALX

SEQ ID NO: 197306 - protein, 10 aa, Artificial Sequence
  Description of Artificial Sequence: Synthetic peptide
  Seed: FLNGTNALPH (TYRP2_HUMAN)
  misc_feature (2)..(2): Xaa can be Ala, Ser, Val, Ile, Gly, Thr, Met, Gln, Leu, Cys, Asn, Glu, Phe, Pro, Tyr, or Asp
  misc_feature (10)..(10): Xaa can be Tyr, Phe, Met, Leu, His, Lys, Arg, Trp, Val, Ala, Ile, Ser, Cys, Thr, or Gln
FXNGTNALPX

SEQ ID NO: 197307 - protein, 9 aa, Artificial Sequence
  Description of Artificial Sequence: Synthetic peptide
  Seed: FLQYRRLRK (TYRP2_HUMAN)
  misc_feature (2)..(2): Xaa can be Met, Leu, Val, Ile, Thr, Trp, Phe, Ser, Gln, Ala, Tyr, Gly, or Asn
  misc_feature (9)..(9): Xaa can be Arg, Lys, Tyr, or Leu
FXQYRRLRX

SEQ ID NO: 197308 - protein, 9 aa, Artificial Sequence
  Description of Artificial Sequence: Synthetic peptide
  Seed: FLTSDQLGY (TYRP2_HUMAN)
  misc_feature (2)..(2): Xaa can be Pro, Thr, Ser, Ala, Met, Gln, Ile, Val, Leu, Gly, Tyr, Phe, Asp, Lys, Glu, Asn, Arg, Cys, Trp, or His
  misc_feature (9)..(9): Xaa can be Tyr, Phe, Lys, Met, Arg, Leu, Ile, His, Trp, Val, Thr, Ser, Ala, Gln, or Gly
FXTSDQLGX

SEQ ID NO: 197309 - protein, 10 aa, Artificial Sequence
  Description of Artificial Sequence: Synthetic peptide
  Seed: FLTSDQLGYS (TYRP2_HUMAN)
  misc_feature (2)..(2): Xaa can be Met, Leu, Ile, Gln, Val, Tyr, Trp, Glu, Gly, Asn, Cys, Asp, Phe, Ser, Arg, Lys, Pro, Ala, Thr, or His
  misc_feature (10)..(10): Xaa can be Val, Ile, Ala, Leu, Met, Thr, Gly, Cys, Phe, Pro, or Ser
FXTSDQLGYX

SEQ ID NO: 197310 - protein, 11 aa, Artificial Sequence
  Description of Artificial Sequence: Synthetic peptide
  Seed: FLTSDQLGYSY (TYRP2_HUMAN)
  misc_feature (2)..(2): Xaa can be Thr, Leu, Gln, Ile, Ala, Met, Val, Glu, Gly, Ser, Pro, Asp, Arg, Tyr, Asn, His, Cys, Phe, Lys, or Trp
  misc_feature (11)..(11): Xaa can be Tyr, Phe, Lys, Met, His, or Arg
FXTSDQLGYSX

SEQ ID NO: 197311 - protein, 9 aa, Artificial Sequence
  Description of Artificial Sequence: Synthetic peptide
  Seed: FPPVTNEEL (TYRP2_HUMAN)
  misc_feature (2)..(2): Xaa can be Ala, Pro, Tyr, Arg, Ser, Phe, Val, Thr, Ile, Met, Leu, Gly, Gln, His, Glu, Asn, Trp, Asp, Cys, or Lys
  misc_feature (9)..(9): Xaa can be Leu, Tyr, Ile, Met, Phe, Val, Trp, Lys, Ala, Cys, Arg, His, Thr, Pro, Ser, Gln, or Gly
FXPVTNEEX

SEQ ID NO: 197312 - protein, 10 aa, Artificial Sequence
  Description of Artificial Sequence: Synthetic peptide
  Seed: FPPVTNEELF (TYRP2_HUMAN)
  misc_feature (2)..(2): Xaa can be Pro, Ala, Lys, Gln, Ser, Cys, Trp, Thr, Met, Phe, Ile, His, Val, Arg, Glu, Asn, Leu, Gly, Tyr, or Asp
  misc_feature (10)..(10): Xaa can be Trp, Leu, Tyr, Met, Phe, Ile, Ala, or Val
FXPVTNEELX

SEQ ID NO: 197313 - protein, 11 aa, Artificial Sequence
  Description of Artificial Sequence: Synthetic peptide
  Seed: FPPVTNEELFL (TYRP2_HUMAN)
  misc_feature (2)..(2): Xaa can be , or Pro
  misc_feature (11)..(11): Xaa can be Ala, Ile, Leu, Met, Val, or Phe
FXPVTNEELFX

SEQ ID NO: 197314 - protein, 8 aa, Artificial Sequence
  Description of Artificial Sequence: Synthetic peptide
  Seed: FPRVCMTV (TYRP2_HUMAN)
  misc_feature (2)..(2): Xaa can be Pro, Met, Leu, Ala, Phe, Val, Gln, Gly, or Ile
  misc_feature (8)..(8): Xaa can be Leu, Ile, Met, Val, Phe, Thr, Pro, Ser, Ala, or Cys
FXRVCMTX

SEQ ID NO: 197315 - protein, 10 aa, Artificial Sequence
  Description of Artificial Sequence: Synthetic peptide
  Seed: FPRVCMTVDS (TYRP2_HUMAN)
  misc_feature (2)..(2): Xaa can be , or Pro
  misc_feature (10)..(10): Xaa can be Leu, Met, Val, Ala, Cys, Pro, Phe, Ser, Thr, or Ile
FXRVCMTVDX

SEQ ID NO: 197316 - protein, 11 aa, Artificial Sequence
  Description of Artificial Sequence: Synthetic peptide
  Seed: FPRVCMTVDSL (TYRP2_HUMAN)
  misc_feature (2)..(2): Xaa can be , or Pro
  misc_feature (11)..(11): Xaa can be Ala, Val, Cys, Pro, Ile, Leu, Met, Phe, or Thr
FXRVCMTVDSX

SEQ ID NO: 197317 - protein, 8 aa, Artificial Sequence
  Description of Artificial Sequence: Synthetic peptide
  Seed: FQNSTFSF (TYRP2_HUMAN)
  misc_feature (2)..(2): Xaa can be Gln, Tyr, Ala, Met, Val, Lys, Thr, Ile, Trp, Ser, His, Phe, Glu, Leu, Asn, Gly, Arg, Pro, or Asp
  misc_feature (8)..(8): Xaa can be Phe, Tyr, Met, Leu, Trp, Ile, Val, Ala, or His
FXNSTFSX

SEQ ID NO: 197318 - protein, 9 aa, Artificial Sequence
  Description of Artificial Sequence: Synthetic peptide
  Seed: FQNSTFSFR (TYRP2_HUMAN)
  misc_feature (2)..(2): Xaa can be Thr, Val, Ile, Met, Leu, Ala, Tyr, Ser, Phe, Gln, Trp, Gly, His, Cys, Asn, Glu, Pro, Lys, Asp, or Arg
  misc_feature (9)..(9): Xaa can be Tyr, Arg, Lys, Phe, Leu, His, Met, Val, Ala, Ile, Trp, Gln, Glu, Thr, or Ser
FXNSTFSFX

SEQ ID NO: 197319 - protein, 10 aa, Artificial Sequence
  Description of Artificial Sequence: Synthetic peptide
  Seed: FQNSTFSFRN (TYRP2_HUMAN)
  misc_feature (2)..(2): Xaa can be Ser, Phe, Thr, Trp, Ala, Ile, Val, Leu, Gln, Tyr, Gly, Met, His, Lys, Cys, Asn, Arg, Glu, Asp, or Pro
  misc_feature (10)..(10): Xaa can be Arg, Lys, Cys, Val, Leu, Trp, Pro, Met, Ile, Glu, Gly, Asp, Asn, Ala, Tyr, Phe, Gln, His, Ser, or Thr
FXNSTFSFRX

SEQ ID NO: 197320 - protein, 11 aa, Artificial Sequence
  Description of Artificial Sequence: Synthetic peptide
  Seed: FQNSTFSFRNA (TYRP2_HUMAN)
  misc_feature (2)..(2): Xaa can be Met, Leu, Gln, Val, Ile, Thr, Ala, or Ser
  misc_feature (11)..(11): Xaa can be Val, Leu, Ile, Ala, Met, or Thr
FXNSTFSFRNX

SEQ ID NO: 197321 - protein, 8 aa, Artificial Sequence
  Description of Artificial Sequence: Synthetic peptide
  Seed: FRNALEGF (TYRP2_HUMAN)
  misc_feature (2)..(2): Xaa can be Arg, Tyr, or Phe
  misc_feature (8)..(8): Xaa can be Phe, Leu, Tyr, or Met
FXNALEGX

SEQ ID NO: 197322 - protein, 10 aa, Artificial Sequence
  Description of Artificial Sequence: Synthetic peptide
  Seed: FRNALEGFDK (TYRP2_HUMAN)
  misc_feature (2)..(2): Xaa can be , or Arg
  misc_feature (10)..(10): Xaa can be Val, Arg, Phe, Met, Leu, Lys, Tyr, or Ile
FXNALEGFDX

SEQ ID NO: 197323 - protein, 11 aa, Artificial Sequence
  Description of Artificial Sequence: Synthetic peptide
  Seed: FRNALEGFDKA (TYRP2_HUMAN)
  misc_feature (2)..(2): Xaa can be , or Arg
  misc_feature (11)..(11): Xaa can be Leu, Ala, or Cys
FXNALEGFDKX

SEQ ID NO: 197324 - protein, 10 aa, Artificial Sequence
  Description of Artificial Sequence: Synthetic peptide
  Seed: FSFRNALEGF (TYRP2_HUMAN)
  misc_feature (2)..(2): Xaa can be Pro, Gln, Tyr, Ser, Ala, Lys, Thr, Met, Phe, Val, Trp, Ile, Gly, Leu, Arg, Asn, Cys, Asp, Glu, or His
  misc_feature (10)..(10): Xaa can be Phe, Tyr, Met, Trp, Leu, Ile, His, Val, Ala, Lys, or Ser
FXFRNALEGX

SEQ ID NO: 197325 - protein, 8 aa, Artificial Sequence
  Description of Artificial Sequence: Synthetic peptide
  Seed: FSHQGPAF (TYRP2_HUMAN)
  misc_feature (2)..(2): Xaa can be Ala, Ser, Thr, Tyr, Phe, Val, Ile, Gly, Pro, Gln, Trp, Met, Leu, Asn, Arg, Glu, Cys, His, Asp, or Lys
  misc_feature (8)..(8): Xaa can be Tyr, Phe, Leu, Met, Ile, Val, Trp, His, Lys, Ala, Arg, Cys, Gln, Thr, Ser, Pro, Asn, Glu, or Gly
FXHQGPAX

SEQ ID NO: 197326 - protein, 9 aa, Artificial Sequence
  Description of Artificial Sequence: Synthetic peptide
  Seed: FSHQGPAFV (TYRP2_HUMAN)
  misc_feature (2)..(2): Xaa can be Ala, Met, Leu, Ser, Val, Thr, Pro, Arg, Ile, Gln, Tyr, Gly, Phe, Asn, Asp, Glu, Cys, Trp, Lys, or His
  misc_feature (9)..(9): Xaa can be Met, Ile, Leu, Tyr, Phe, Val, Trp, Lys, His, Arg, Ala, Cys, Thr, Pro, Ser, Glu, Gln, Gly, or Asn
FXHQGPAFX

SEQ ID NO: 197327 - protein, 11 aa, Artificial Sequence
  Description of Artificial Sequence: Synthetic peptide
  Seed: FSHQGPAFVTW (TYRP2_HUMAN)
  misc_feature (2)..(2): Xaa can be Ala, Thr, Ser, Val, Gly, Met, Ile, Leu, Pro, Cys, Gln, Asn, Glu, Phe, Asp, Trp, or Tyr
  misc_feature (11)..(11): Xaa can be Trp, Tyr, Lys, Phe, Met, His, Leu, Arg, Ile, Val, Cys, Thr, Gln, Ser, Ala, or Asn
FXHQGPAFVTX

SEQ ID NO: 197328 - protein, 11 aa, Artificial Sequence
  Description of Artificial Sequence: Synthetic peptide
  Seed: FSSWETVCDSL (TYRP2_HUMAN)
  misc_feature (2)..(2): Xaa can be Ala, Thr, Ser, Gly, Val, Cys, Leu, Pro, Asn, Met, Ile, or Gln
  misc_feature (11)..(11): Xaa can be Trp, Phe, Leu, Met, or Ile
FXSWETVCDSX

SEQ ID NO: 197329 - protein, 9 aa, Artificial Sequence
  Description of Artificial Sequence: Synthetic peptide
  Seed: FTDAIFDEW (TYRP2_HUMAN)
  misc_feature (2)..(2): Xaa can be Ala, Thr, Ser, Leu, Ile, Val, Met, Phe, Tyr, Gln, Cys, Gly, Trp, Asn, Pro, Asp, Lys, Glu, Arg, or His
  misc_feature (9)..(9): Xaa can be Trp, Met, Leu, Val, Arg, Phe, Ile, Lys, Tyr, Ala, Cys, His, Thr, Ser, Gln, Asn, Glu, Pro, or Gly
FXDAIFDEX

SEQ ID NO: 197330 - protein, 10 aa, Artificial Sequence
  Description of Artificial Sequence: Synthetic peptide
  Seed: FTDAIFDEWM (TYRP2_HUMAN)
  misc_feature (2)..(2): Xaa can be Met, Leu, Thr, Val, Ser, Ile, Gln, Ala, Gly, Phe, Asn, Cys, Tyr, Asp, Trp, Glu, Pro, His, or Lys
  misc_feature (10)..(10): Xaa can be Tyr, Lys, Leu, Met, Phe, Arg, Val, Ile, Ala, His, Thr, Trp, Cys, Ser, or Gln
FXDAIFDEWX

SEQ ID NO: 197331 - protein, 11 aa, Artificial Sequence
  Description of Artificial Sequence: Synthetic peptide
  Seed: FTDAIFDEWMK (TYRP2_HUMAN)
  misc_feature (2)..(2): Xaa can be Thr, Ser, Val, Met, Ala, Ile, Leu, Glu, Asp, Gln, Cys, Trp, Phe, Asn, Gly, Pro, Lys, Arg, Tyr, or His
  misc_feature (11)..(11): Xaa can be Arg, Lys, Tyr, His, Phe, Gln, Met, or Trp
FXDAIFDEWMX

SEQ ID NO: 197332 - protein, 9 aa, Artificial Sequence
  Description of Artificial Sequence: Synthetic peptide
  Seed: FVLLAFLQY (TYRP2_HUMAN)
  misc_feature (2)..(2): Xaa can be Pro, Gln, Ala, Met, Val, Ile, Leu, Ser, Thr, Gly, Lys, Cys, Asn, Phe, Glu, Arg, Asp, His, Tyr, or Trp
  misc_feature (9)..(9): Xaa can be Tyr, Phe, Met, Lys, Leu, Arg, Trp, His, Ile, Val, Ala, Thr, Gly, Gln, Ser, Asn, or Cys
FXLLAFLQX

SEQ ID NO: 197333 - protein, 10 aa, Artificial Sequence
  Description of Artificial Sequence: Synthetic peptide
  Seed: FVLLAFLQYR (TYRP2_HUMAN)
  misc_feature (2)..(2): Xaa can be Met, Thr, Leu, Asn, Lys, Glu, Ser, Phe, Gln, His, Ala, Cys, Asp, Gly, Pro, Arg, Ile, Trp, Tyr, or Val
  misc_feature (10)..(10): Xaa can be Arg, Lys, Tyr, Leu, or Val
FXLLAFLQYX

SEQ ID NO: 197334 - protein, 11 aa, Artificial Sequence
  Description of Artificial Sequence: Synthetic peptide
  Seed: FVLLAFLQYRR (TYRP2_HUMAN)
  misc_feature (2)..(2): Xaa can be Ala, Tyr, Met, Val, Thr, Ser, Ile, Arg, Lys, Trp, Gln, Phe, His, Gly, Glu, Pro, Asp, Cys, Asn, or Leu
  misc_feature (11)..(11): Xaa can be Arg, or Lys
FXLLAFLQYRX

SEQ ID NO: 197335 - protein, 9 aa, Artificial Sequence
  Description of Artificial Sequence: Synthetic peptide
  Seed: FVTWHRYHL (TYRP2_HUMAN)
  misc_feature (2)..(2): Xaa can be Leu, Met, Pro, Ala, Ser, Thr, Tyr, Phe, Ile, Gln, Val, Gly, Asn, Arg, Glu, Trp, Lys, His, Cys, or Asp
  misc_feature (9)..(9): Xaa can be Met, Leu, Tyr, Phe, Val, Ile, Ala, Lys, Arg, Trp, Thr, His, Ser, Pro, Cys, or Gly
FXTWHRYHX

SEQ ID NO: 197336 - protein, 10 aa, Artificial Sequence
  Description of Artificial Sequence: Synthetic peptide
  Seed: FVVLHSFTDA (TYRP2_HUMAN)
  misc_feature (2)..(2): Xaa can be Gln, Leu, Met, Val, Thr, Ser, Asn, Cys, Gly, Phe, Asp, Pro, Tyr, Arg, Lys, Ala, Trp, Glu, Ile, or His
  misc_feature (10)..(10): Xaa can be Val, Leu, Ala, Ile, Met, Thr, Ser, or Phe
FXVLHSFTDX

SEQ ID NO: 197337 - protein, 11 aa, Artificial Sequence
  Description of Artificial Sequence: Synthetic peptide
  Seed: FVVLHSFTDAI (TYRP2_HUMAN)
  misc_feature (2)..(2): Xaa can be Met, Leu, Ile, Trp, Phe, Lys, Ala, Val, Thr, Gln, Asp, Arg, Asn, Glu, Tyr, Pro, Ser, Gly, Cys, or His
  misc_feature (11)..(11): Xaa can be Ile, Val, Leu, Met, Ala, or Thr
FXVLHSFTDAX

SEQ ID NO: 197338 - protein, 9 aa, Artificial Sequence
  Description of Artificial Sequence: Synthetic peptide
  Seed: FVWLHYYSV (TYRP2_HUMAN)
  misc_feature (2)..(2): Xaa can be Met, Leu, Gln, Thr, Ala, Val, Ile, Pro, Ser, Phe, Asn, Gly, Trp, Cys, Tyr, Glu, Arg, Lys, Asp, or His
  misc_feature (9)..(9): Xaa can be Leu, Ile, Val, Phe, Met, Lys, Tyr, Arg, Ala, Thr, Cys, Ser, Trp, His, Gly, Pro, Gln, Glu, or Asp
FXWLHYYSX

SEQ ID NO: 197339 - protein, 10 aa, Artificial Sequence
  Description of Artificial Sequence: Synthetic peptide
  Seed: FVWLHYYSVR (TYRP2_HUMAN)
  misc_feature (2)..(2): Xaa can be Met, Gln, Thr, Leu, Ile, Val, Ala, Ser, Gly, Lys, Arg, Cys, Trp, Tyr, Phe, Glu, His, Asp, Asn, or Pro
  misc_feature (10)..(10): Xaa can be Arg, Lys, Ile, Val, Gly, Glu, Ala, Thr, Cys, Pro, Leu, His, Asp, Gln, Trp, Asn, Met, Ser, Phe, or Tyr
FXWLHYYSVX

SEQ ID NO: 197340 - protein, 10 aa, Artificial Sequence
  Description of Artificial Sequence: Synthetic peptide
  Seed: GAARPDDPTL (TYRP2_HUMAN)
  misc_feature (2)..(2): Xaa can be Ala, Thr, Ser, Val, Ile, Met, Gly, Leu, Gln, Asn, or Glu
  misc_feature (10)..(10): Xaa can be Tyr, Lys, Arg, Phe, Met, Leu, or His
GXARPDDPTX

SEQ ID NO: 197341 - protein, 11 aa, Artificial Sequence
  Description of Artificial Sequence: Synthetic peptide
  Seed: GAARPDDPTLI (TYRP2_HUMAN)
  misc_feature (2)..(2): Xaa can be Ala, Thr, Ser, Val, or Ile
  misc_feature (11)..(11): Xaa can be Leu, Met, Phe, Ile, or Val
GXARPDDPTLX

SEQ ID NO: 197342 - protein, 8 aa, Artificial Sequence
  Description of Artificial Sequence: Synthetic peptide
  Seed: GALDLAKK (TYRP2_HUMAN)
  misc_feature (2)..(2): Xaa can be Ala, Thr, Asp, Val, Ile, or Gly
  misc_feature (8)..(8): Xaa can be Lys, or Arg
GXLDLAKX

SEQ ID NO: 197343 - protein, 9 aa, Artificial Sequence
  Description of Artificial Sequence: Synthetic peptide
  Seed: GALDLAKKR (TYRP2_HUMAN)
  misc_feature (2)..(2): Xaa can be Met, Leu, Ala, Val, Thr, Ile, Ser, Gln, Asn, Gly, Asp, Tyr, Phe, Pro, Trp, His, or Glu
  misc_feature (9)..(9): Xaa can be Arg, Lys, Leu, Met, Tyr, Val, Phe, Ile, or His
GXLDLAKKX

SEQ ID NO: 197344 - protein, 9 aa, Artificial Sequence
  Description of Artificial Sequence: Synthetic peptide
  Seed: GAQGQFPRV (TYRP2_HUMAN)
  misc_feature (2)..(2): Xaa can be Gln, Ala, Leu, Val, Ile, Met, Ser, Thr, Glu, Pro, Gly, or Asn
  misc_feature (9)..(9): Xaa can be Leu, Val, Tyr, Ile, Met, Phe, Ala, Thr, Cys, Trp, or His
GXQGQFPRX

SEQ ID NO: 197345 - protein, 9 aa, Artificial Sequence
  Description of Artificial Sequence: Synthetic peptide
  Seed: GFDKADGTL (TYRP2_HUMAN)
  misc_feature (2)..(2): Xaa can be Phe, Ala, Arg, Tyr, Thr, Val, Ser, Ile, Gly, Leu, Asn, Gln, Met, Trp, Cys, Pro, His, or As p
  misc_feature (9)..(9): Xaa can be Met, Leu, Trp, Phe, Ile, Val, Lys, Tyr, Arg, Cys, Ala, or His
GXDKADGTX

SEQ ID NO: 197346 - protein, 10 aa, Artificial Sequence
  Description of Artificial Sequence: Synthetic peptide
  Seed: GFLLSCLGCK (TYRP2_HUMAN)
  misc_feature (2)..(2): Xaa can be Thr, Glu, Met, Pro, Tyr, Trp, His, Ile, Gly, Arg, Gln, Ser, Ala, Asn, Asp, Leu, Phe, Val, Lys, or Cys
  misc_feature (10)..(10): Xaa can be Lys, or Arg
GXLLSCLGCX

SEQ ID NO: 197347 - protein, 9 aa, Artificial Sequence
  Description of Artificial Sequence: Synthetic peptide
  Seed: GHNRMYNMV (TYRP2_HUMAN)
  misc_feature (2)..(2): Xaa can be , or His
  misc_feature (9)..(9): Xaa can be Ala, Ile, Met, Val, Leu, or Phe
GXNRMYNMX

SEQ ID NO: 197348 - protein, 11 aa, Artificial Sequence
  Description of Artificial Sequence: Synthetic peptide
  Seed: GHNRMYNMVPF (TYRP2_HUMAN)
  misc_feature (2)..(2): Xaa can be Met, Gln, Ala, His, Ser, Arg, Glu, Lys, Trp, Gly, Phe, Asp, Asn, Val, Tyr, Pro, Cys, Leu, Ile, or Thr
  misc_feature (11)..(11): Xaa can be Leu, Lys, Ile, Met, Arg, Val, Phe, or Tyr
GXNRMYNMVPX

SEQ ID NO: 197349 - protein, 9 aa, Artificial Sequence
  Description of Artificial Sequence: Synthetic peptide
  Seed: GLFVLLAFL (TYRP2_HUMAN)
  misc_feature (2)..(2): Xaa can be Met, Leu, Gln, Ile, Val, Thr, Ala, Ser, Asn, Gly, Phe, Cys, Trp, Tyr, Glu, or Asp
  misc_feature (9)..(9): Xaa can be Arg, Lys, Val, Ala, Ile, Leu, Met, Thr, Tyr, Phe, Cys, Ser, or Gly
GXFVLLAFX

SEQ ID NO: 197350 - protein, 10 aa, Artificial Sequence
  Description of Artificial Sequence: Synthetic peptide
  Seed: GLFVLLAFLQ (TYRP2_HUMAN)
  misc_feature (2)..(2): Xaa can be Leu, Met, Gln, Ile, Val, Thr, or Ser
  misc_feature (10)..(10): Xaa can be Val, Leu, Ile, Trp, His, Asp, Met, Thr, Pro, Cys, Ser, Tyr, Glu, Arg, Phe, Asn, Gln, Lys, Gly, or Ala
GXFVLLAFLX

SEQ ID NO: 197351 - protein, 10 aa, Artificial Sequence
  Description of Artificial Sequence: Synthetic peptide
  Seed: GLLRRNQMGR (TYRP2_HUMAN)
  misc_feature (2)..(2): Xaa can be Met, Thr, Ile, Val, Leu, Phe, Tyr, Ala, Trp, Ser, Asn, Gly, Arg, or Gln
  misc_feature (10)..(10): Xaa can be Arg, or Lys
GXLRRNQMGX

SEQ ID NO: 197352 - protein, 9 aa, Artificial Sequence
  Description of Artificial Sequence: Synthetic peptide
  Seed: GNESFALPY (TYRP2_HUMAN)
  misc_feature (2)..(2): Xaa can be Gln, Met, Lys, Val, Ser, Leu, Ala, Thr, Gly, Ile, Glu, His, Arg, Asn, Phe, Pro, Cys, Asp, Trp, or Tyr
  misc_feature (9)..(9): Xaa can be Tyr, Phe, Met, Lys, Arg, Leu, Ile, His, Trp, Val, or Ala
GXESFALPX

SEQ ID NO: 197353 - protein, 10 aa, Artificial Sequence
  Description of Artificial Sequence: Synthetic peptide
  Seed: GNESFALPYW (TYRP2_HUMAN)
  misc_feature (2)..(2): Xaa can be Glu, Lys, Leu, Arg, Met, His, Ile, Phe, Asn, Pro, Ala, Val, Trp, Ser, Gln, Asp, Gly, Thr, Tyr, or Cys
  misc_feature (10)..(10): Xaa can be Trp, Phe, Tyr, or Ile
GXESFALPYX

SEQ ID NO: 197354 - protein, 9 aa, Artificial Sequence
  Description of Artificial Sequence: Synthetic peptide
  Seed: GPAFVTWHR (TYRP2_HUMAN)
  misc_feature (2)..(2): Xaa can be Thr, Val, Ile, Ser, Ala, Met, Leu, Asn, Phe, Tyr, Gly, Cys, Pro, Trp, Glu, Gln, Asp, His, Arg, or Lys
  misc_feature (9)..(9): Xaa can be Arg, Lys, Tyr, or His
GXAFVTWHX

SEQ ID NO: 197355 - protein, 10 aa, Artificial Sequence
  Description of Artificial Sequence: Synthetic peptide
  Seed: GPAFVTWHRY (TYRP2_HUMAN)
  misc_feature (2)..(2): Xaa can be Trp, Met, Ser, Gln, Tyr, Phe, Thr, Cys, Asn, Asp, Val, His, Lys, Gly, Glu, Pro, Leu, Arg, Ile, or Ala
  misc_feature (10)..(10): Xaa can be Tyr, or Phe
GXAFVTWHRX

SEQ ID NO: 197356 - protein, 8 aa, Artificial Sequence
  Description of Artificial Sequence: Synthetic peptide
  Seed: GPGRPYRA (TYRP2_HUMAN)
  misc_feature (2)..(2): Xaa can be , or Pro
  misc_feature (8)..(8): Xaa can be Ala, Leu, or Val
GXGRPYRX

SEQ ID NO: 197357 - protein, 9 aa, Artificial Sequence
  Description of Artificial Sequence: Synthetic peptide
  Seed: GPGRPYRAI (TYRP2_HUMAN)
  misc_feature (2)..(2): Xaa can be Pro, Ala, or Val
  misc_feature (9)..(9): Xaa can be Leu, Met, Ala, Ile, Val, Tyr, Gly, Cys, Ser, Phe, Pro, or Thr
GXGRPYRAX

SEQ ID NO: 197358 - protein, 11 aa, Artificial Sequence
  Description of Artificial Sequence: Synthetic peptide
  Seed: GPGRPYRAIDF (TYRP2_HUMAN)
  misc_feature (2)..(2): Xaa can be , or Pro
  misc_feature (11)..(11): Xaa can be Leu, Phe, or Met
GXGRPYRAIDX

SEQ ID NO: 197359 - protein, 11 aa, Artificial Sequence
  Description of Artificial Sequence: Synthetic peptide
  Seed: GPNCERKKPPV (TYRP2_HUMAN)
  misc_feature (2)..(2): Xaa can be , or Pro
  misc_feature (11)..(11): Xaa can be Met, Cys, Ile, Phe, Ala, Leu, or Val
GXNCERKKPPX

SEQ ID NO: 197360 - protein, 9 aa, Artificial Sequence
  Description of Artificial Sequence: Synthetic peptide
  Seed: GPNGTQPQF (TYRP2_HUMAN)
  misc_feature (2)..(2): Xaa can be Pro, Gln, Met, Ala, Ser, Leu, Val, Ile, Phe, Glu, Thr, Trp, Lys, Asn, Gly, Tyr, Cys, Arg, Asp, or His
  misc_feature (9)..(9): Xaa can be Tyr, Phe, Met, Leu, Trp, Ile, Ala, Val, His, Thr, Gly, Ser, Cys, or Pro
GXNGTQPQX

SEQ ID NO: 197361 - protein, 10 aa, Artificial Sequence
  Description of Artificial Sequence: Synthetic peptide
  Seed: GPNGTQPQFA (TYRP2_HUMAN)
  misc_feature (2)..(2): Xaa can be , or Pro
  misc_feature (10)..(10): Xaa can be Phe, Leu, Ile, Cys, Met, Thr, Pro, Tyr, Val, or Ala
GXNGTQPQFX

SEQ ID NO: 197362 - protein, 8 aa, Artificial Sequence
  Description of Artificial Sequence: Synthetic peptide
  Seed: GQFPRVCM (TYRP2_HUMAN)
  misc_feature (2)..(2): Xaa can be Glu, Gln, Ser, Ala, His, Lys, Arg, Met, Leu, Gly, Asp, Val, Ile, Thr, or Asn
  misc_feature (8)..(8): Xaa can be Tyr, Leu, Val, Phe, Ile, or Met
GXFPRVCX

SEQ ID NO: 197363 - protein, 9 aa, Artificial Sequence
  Description of Artificial Sequence: Synthetic peptide
  Seed: GQFPRVCMT (TYRP2_HUMAN)
  misc_feature (2)..(2): Xaa can be Gln, Met, Glu, Val, Ile, Leu, Thr, Ser, Ala, Gly, Asn, Asp, His, Lys, Pro, or Phe
  misc_feature (9)..(9): Xaa can be Val, Ile, Leu, Met, Ala, Thr, Phe, Cys, Pro, Trp, or Ser
GXFPRVCMX

SEQ ID NO: 197364 - protein, 10 aa, Artificial Sequence
  Description of Artificial Sequence: Synthetic peptide
  Seed: GQFPRVCMTV (TYRP2_HUMAN)
  misc_feature (2)..(2): Xaa can be Arg, Met, Leu, Gln, Ile, Val, Ala, Glu, Thr, Ser, Lys, His, Phe, Pro, Tyr, Gly, Asn, Cys, Trp, or Asp
  misc_feature (10)..(10): Xaa can be Tyr, Phe, Met, Leu, Ile, Val, Trp, Ala, Thr, Cys, Gly, His, Ser, Pro, Gln, Lys, Asn, or Ar g
GXFPRVCMTX

SEQ ID NO: 197365 - protein, 9 aa, Artificial Sequence
  Description of Artificial Sequence: Synthetic peptide
  Seed: GRGQCTEVR (TYRP2_HUMAN)
  misc_feature (2)..(2): Xaa can be , or Arg
  misc_feature (9)..(9): Xaa can be Ile, Leu, Lys, Val, His, Arg, Phe, Trp, Tyr, or Met
GXGQCTEVX

SEQ ID NO: 197366 - protein, 10 aa, Artificial Sequence
  Description of Artificial Sequence: Synthetic peptide
  Seed: GRGQCTEVRA (TYRP2_HUMAN)
  misc_feature (2)..(2): Xaa can be Arg, or Gln
  misc_feature (10)..(10): Xaa can be Lys, His, Arg, Leu, Ala, Trp, Phe, Cys, Ile, Met, Tyr, Gln, or Val
GXGQCTEVRX

SEQ ID NO: 197367 - protein, 9 aa, Artificial Sequence
  Description of Artificial Sequence: Synthetic peptide
  Seed: GRNSMKLPT (TYRP2_HUMAN)
  misc_feature (2)..(2): Xaa can be Arg, Gln, Lys, Gly, His, Ala, Asn, or Glu
  misc_feature (9)..(9): Xaa can be Leu, Lys, Arg, Met, Phe, Tyr, Val, Ile, Ala, Glu, His, Gln, Pro, Asn, Cys, Gly, Trp, or Th r
GXNSMKLPX

SEQ ID NO: 197368 - protein, 10 aa, Artificial Sequence
  Description of Artificial Sequence: Synthetic peptide
  Seed: GRNSMKLPTL (TYRP2_HUMAN)
  misc_feature (2)..(2): Xaa can be Arg, Gln, His, Tyr, Lys, Gly, Ile, Leu, Ser, Met, Glu, Ala, Asn, Thr, or Phe
  misc_feature (10)..(10): Xaa can be Leu, Phe, Met, Tyr, Ile, Lys, Val, Arg, Ser, Trp, Ala, Cys, Asn, His, Gly, Thr, Glu, Pro, or Gln
GXNSMKLPTX

SEQ ID NO: 197369 - protein, 11 aa, Artificial Sequence
  Description of Artificial Sequence: Synthetic peptide
  Seed: GRNSMKLPTLK (TYRP2_HUMAN)
  misc_feature (2)..(2): Xaa can be Arg, Thr, Gln, Ile, Ala, Met, Pro, Cys, Asp, Phe, Leu, Trp, His, Glu, Tyr, Lys, Val, Asn, Ser, or Gly
  misc_feature (11)..(11): Xaa can be Lys, Phe, Arg, His, Val, Ala, Ile, Met, Leu, Cys, Tyr, Gln, or Trp
GXNSMKLPTLX

SEQ ID NO: 197370 - protein, 9 aa, Artificial Sequence
  Description of Artificial Sequence: Synthetic peptide
  Seed: GRPYRAIDF (TYRP2_HUMAN)
  misc_feature (2)..(2): Xaa can be Arg, Ala, Gln, Gly, Phe, His, Tyr, Ser, Met, Asn, Leu, Val, Ile, Thr, Glu, Lys, or Asp
  misc_feature (9)..(9): Xaa can be Leu, Met, Phe, Tyr, Ile, Val, Trp, Arg, or Lys
GXPYRAIDX

SEQ ID NO: 197371 - protein, 10 aa, Artificial Sequence
  Description of Artificial Sequence: Synthetic peptide
  Seed: GTLDSQVMSL (TYRP2_HUMAN)
  misc_feature (2)..(2): Xaa can be Met, Val, Gln, Leu, Ile, Thr, Ala, Ser, Gly, Tyr, Phe, Arg, Glu, Asn, Cys, Asp, Trp, Lys, His, or Pro
  misc_feature (10)..(10): Xaa can be Leu, Met, Trp, Ile, Val, Tyr, Phe, Arg, Lys, Ala, His, Cys, Thr, or Ser
GXLDSQVMSX

SEQ ID NO: 197372 - protein, 11 aa, Artificial Sequence
  Description of Artificial Sequence: Synthetic peptide
  Seed: GTLDSQVMSLH (TYRP2_HUMAN)
  misc_feature (2)..(2): Xaa can be Thr, Ile, Val, Met, Leu, Ala, Ser, Asp, Asn, Gln, Cys, Gly, Glu, or Pro
  misc_feature (11)..(11): Xaa can be Lys, Tyr, Arg, or His
GXLDSQVMSLX

SEQ ID NO: 197373 - protein, 9 aa, Artificial Sequence
  Description of Artificial Sequence: Synthetic peptide
  Seed: GTLVALVGL (TYRP2_HUMAN)
  misc_feature (2)..(2): Xaa can be Thr, Ser, Ala, Met, Leu, Gln, Val, Ile, Gly, or Asn
  misc_feature (9)..(9): Xaa can be Val, Leu, Ala, Ile, Met, Phe, Trp, Tyr, Thr, or Cys
GXLVALVGX

SEQ ID NO: 197374 - protein, 10 aa, Artificial Sequence
  Description of Artificial Sequence: Synthetic peptide
  Seed: GTLVALVGLF (TYRP2_HUMAN)
  misc_feature (2)..(2): Xaa can be Ala, Thr, Ser, Pro, Val, Gln, Ile, Cys, Gly, Leu, Asn, or Met
  misc_feature (10)..(10): Xaa can be Trp, Tyr, or Phe
GXLVALVGLX

SEQ ID NO: 197375 - protein, 9 aa, Artificial Sequence
  Description of Artificial Sequence: Synthetic peptide
  Seed: GTNALPHSA (TYRP2_HUMAN)
  misc_feature (2)..(2): Xaa can be Met, Leu, Ile, Val, Gln, Thr, Ser, or Ala
  misc_feature (9)..(9): Xaa can be Val, Ile, Leu, Ala, Met, or Thr
GXNALPHSX

SEQ ID NO: 197376 - protein, 8 aa, Artificial Sequence
  Description of Artificial Sequence: Synthetic peptide
  Seed: GTYEGLLR (TYRP2_HUMAN)
  misc_feature (2)..(2): Xaa can be Ile, Thr, Met, Ser, Val, Ala, or Leu
  misc_feature (8)..(8): Xaa can be Arg, or Lys
GXYEGLLX

SEQ ID NO: 197377 - protein, 9 aa, Artificial Sequence
  Description of Artificial Sequence: Synthetic peptide
  Seed: GTYEGLLRR (TYRP2_HUMAN)
  misc_feature (2)..(2): Xaa can be Leu, Met, Thr, Val, Ala, Ile, Gln, Tyr, Ser, Gly, Cys, Asn, Phe, Trp, Pro, Glu, Asp, Lys, His, or Arg
  misc_feature (9)..(9): Xaa can be Tyr, Arg, Lys, Phe, Met, Leu, Val, Ile, Trp, His, Ala, Gln, Cys, or Thr
GXYEGLLRX

SEQ ID NO: 197378 - protein, 9 aa, Artificial Sequence
  Description of Artificial Sequence: Synthetic peptide
  Seed: GWPTTLLVV (TYRP2_HUMAN)
  misc_feature (2)..(2): Xaa can be Tyr, Phe, Trp, Leu, Met, His, Ala, Val, Ile, Ser, Gln, or Thr
  misc_feature (9)..(9): Xaa can be Phe, Met, Leu, Tyr, Trp, Val, Ile, His, Cys, or Ala
GXPTTLLVX

SEQ ID NO: 197379 - protein, 10 aa, Artificial Sequence
  Description of Artificial Sequence: Synthetic peptide
  Seed: GWPTTLLVVM (TYRP2_HUMAN)
  misc_feature (2)..(2): Xaa can be Met, Tyr, Phe, Leu, His, Trp, Thr, Val, Asn, Cys, Gln, Glu, Ile, Asp, Ser, Lys, Gly, Ala, Pro, or Arg
  misc_feature (10)..(10): Xaa can be Leu, Met, Tyr, Phe, Val, or Ile
GXPTTLLVVX

SEQ ID NO: 197380 - protein, 9 aa, Artificial Sequence
  Description of Artificial Sequence: Synthetic peptide
  Seed: GWTGPNCER (TYRP2_HUMAN)
  misc_feature (2)..(2): Xaa can be Thr, Ile, Gln, Val, Pro, Tyr, Trp, Met, Leu, Asn, Ser, Ala, Phe, or Gly
  misc_feature (9)..(9): Xaa can be Arg, or Lys
GXTGPNCEX

SEQ ID NO: 197381 - protein, 9 aa, Artificial Sequence
  Description of Artificial Sequence: Synthetic peptide
  Seed: GYNCGDCKF (TYRP2_HUMAN)
  misc_feature (2)..(2): Xaa can be Tyr, Arg, Phe, or Trp
  misc_feature (9)..(9): Xaa can be Phe, Tyr, Met, Leu, Trp, or Ile
GXNCGDCKX

SEQ ID NO: 197382 - protein, 11 aa, Artificial Sequence
  Description of Artificial Sequence: Synthetic peptide
  Seed: GYNCGDCKFGW (TYRP2_HUMAN)
  misc_feature (2)..(2): Xaa can be Tyr, Trp, or Phe
  misc_feature (11)..(11): Xaa can be Phe, or Trp
GXNCGDCKFGX

SEQ ID NO: 197383 - protein, 10 aa, Artificial Sequence
  Description of Artificial Sequence: Synthetic peptide
  Seed: GYSYAIDLPV (TYRP2_HUMAN)
  misc_feature (2)..(2): Xaa can be Met, Leu, Gln, Ile, Val, Thr, Glu, Cys, Tyr, Trp, Arg, Lys, Phe, Ser, Gly, His, Asp, Asn, Ala, or Pro
  misc_feature (10)..(10): Xaa can be Val, Ile, Leu, Met, Ala, or Thr
GXSYAIDLPX

SEQ ID NO: 197384 - protein, 9 aa, Artificial Sequence
  Description of Artificial Sequence: Synthetic peptide
  Seed: GYTPLMETH (TYRP2_HUMAN)
  misc_feature (2)..(2): Xaa can be Tyr, Phe, or Trp
  misc_feature (9)..(9): Xaa can be Met, Tyr, Leu, Phe, Ile, Val, Trp, or His
GXTPLMETX

SEQ ID NO: 197385 - protein, 10 aa, Artificial Sequence
  Description of Artificial Sequence: Synthetic peptide
  Seed: GYTPLMETHL (TYRP2_HUMAN)
  misc_feature (2)..(2): Xaa can be Tyr, Trp, or Phe
  misc_feature (10)..(10): Xaa can be Trp, Phe, Leu, Ile, Met, or Tyr
GXTPLMETHX

SEQ ID NO: 197386 - protein, 9 aa, Artificial Sequence
  Description of Artificial Sequence: Synthetic peptide
  Seed: HLLCLERDL (TYRP2_HUMAN)
  misc_feature (2)..(2): Xaa can be Gln, Met, or Leu
  misc_feature (9)..(9): Xaa can be Leu, Trp, Phe, Val, Ile, or Met
HXLCLERDX

SEQ ID NO: 197387 - protein, 11 aa, Artificial Sequence
  Description of Artificial Sequence: Synthetic peptide
  Seed: HLLCLERDLQR (TYRP2_HUMAN)
  misc_feature (2)..(2): Xaa can be Ile, Val, Met, Leu, Thr, Tyr, Phe, Ser, Gly, Trp, Arg, Gln, or Ala
  misc_feature (11)..(11): Xaa can be Arg, or Lys
HXLCLERDLQX

SEQ ID NO: 197388 - protein, 10 aa, Artificial Sequence
  Description of Artificial Sequence: Synthetic peptide
  Seed: HLVTLCNGTY (TYRP2_HUMAN)
  misc_feature (2)..(2): Xaa can be Ala, Met, Leu, Gln, Thr, Ser, Val, Ile, Lys, Gly, His, Asn, Glu, Pro, Cys, Arg, Tyr, Phe, Asp, or Trp
  misc_feature (10)..(10): Xaa can be Tyr, Phe, Met, Lys, Leu, Trp, or His
HXVTLCNGTX

SEQ ID NO: 197389 - protein, 8 aa, Artificial Sequence
  Description of Artificial Sequence: Synthetic peptide
  Seed: HNLVHSFL (TYRP2_HUMAN)
  misc_feature (2)..(2): Xaa can be His, Gln, Arg, Glu, Pro, Ser, Asn, Tyr, Gly, Ala, Asp, or Lys
  misc_feature (8)..(8): Xaa can be Leu, Met, Ile, Phe, or Val
HXLVHSFX

SEQ ID NO: 197390 - protein, 10 aa, Artificial Sequence
  Description of Artificial Sequence: Synthetic peptide
  Seed: HNRMYNMVPF (TYRP2_HUMAN)
  misc_feature (2)..(2): Xaa can be Gln, Lys, His, Met, Arg, Ala, Ser, Glu, Leu, Tyr, Trp, Pro, Val, Thr, Phe, Ile, Asn, Asp, Cys, or Gly
  misc_feature (10)..(10): Xaa can be Lys, Met, Trp, Arg, Ile, Phe, Tyr, Ala, Val, Leu, His, or Cys
HXRMYNMVPX

SEQ ID NO: 197391 - protein, 11 aa, Artificial Sequence
  Description of Artificial Sequence: Synthetic peptide
  Seed: HNRMYNMVPFF (TYRP2_HUMAN)
  misc_feature (2)..(2): Xaa can be Met, Gln, Lys, Glu, Leu, His, Arg, Cys, Ser, Tyr, Asp, Ile, Val, Gly, Trp, Ala, Thr, Pro, Asn, or Phe
  misc_feature (11)..(11): Xaa can be Phe, Tyr, Met, Leu, Pro, Gly, His, Thr, Glu, Ser, Val, Gln, Cys, Ile, Arg, Asp, Lys, Asn, Ala, or Trp
HXRMYNMVPFX

SEQ ID NO: 197392 - protein, 8 aa, Artificial Sequence
  Description of Artificial Sequence: Synthetic peptide
  Seed: HPDYVITT (TYRP2_HUMAN)
  misc_feature (2)..(2): Xaa can be , or Pro
  misc_feature (8)..(8): Xaa can be Ile, Ala, Leu, Thr, Val, or Met
HXDYVITX

SEQ ID NO: 197393 - protein, 9 aa, Artificial Sequence
  Description of Artificial Sequence: Synthetic peptide
  Seed: HPDYVITTQ (TYRP2_HUMAN)
  misc_feature (2)..(2): Xaa can be Pro, Ala, Ser, Val, Tyr, Thr, Ile, Phe, Met, Gly, Leu, Gln, Trp, Cys, Asn, Glu, Asp, or Hi s
  misc_feature (9)..(9): Xaa can be Tyr, Phe, Met, Leu, Trp, Ile, Val, His, Ser, Gly, Arg, Ala, Pro, Cys, Lys, Gln, or Thr
HXDYVITTX

SEQ ID NO: 197394 - protein, 10 aa, Artificial Sequence
  Description of Artificial Sequence: Synthetic peptide
  Seed: HPDYVITTQH (TYRP2_HUMAN)
  misc_feature (2)..(2): Xaa can be Pro, Ser, Val, Ala, Ile, Met, or Thr
  misc_feature (10)..(10): Xaa can be Tyr, Phe, His, Met, Ile, Leu, Val, or Trp
HXDYVITTQX

SEQ ID NO: 197395 - protein, 11 aa, Artificial Sequence
  Description of Artificial Sequence: Synthetic peptide
  Seed: HPDYVITTQHW (TYRP2_HUMAN)
  misc_feature (2)..(2): Xaa can be Pro, Ile, Gly, Asp, Asn, His, Cys, Met, Lys, Phe, Tyr, Arg, Gln, Val, Leu, Ser, Thr, Glu, Ala, or Trp
  misc_feature (11)..(11): Xaa can be Phe, Leu, Ile, Trp, Met, or Tyr
HXDYVITTQHX

SEQ ID NO: 197396 - protein, 9 aa, Artificial Sequence
  Description of Artificial Sequence: Synthetic peptide
  Seed: HQGPAFVTW (TYRP2_HUMAN)
  misc_feature (2)..(2): Xaa can be Ala, Glu, His, Arg, Gln, Ser, Tyr, Val, Thr, Met, Asp, Ile, Leu, Phe, Pro, Gly, Cys, Asn, Lys, or Trp
  misc_feature (9)..(9): Xaa can be Ile, Leu, Phe, Tyr, Trp, Val, Met, Lys, His, Arg, Ala, Cys, Thr, Gln, Pro, Ser, Gly, Glu, or Asn
HXGPAFVTX

SEQ ID NO: 197397 - protein, 11 aa, Artificial Sequence
  Description of Artificial Sequence: Synthetic peptide
  Seed: HQGPAFVTWHR (TYRP2_HUMAN)
  misc_feature (2)..(2): Xaa can be Cys, Ala, Val, Trp, Ile, Asn, Glu, Thr, Phe, Asp, Tyr, His, Gly, Leu, Ser, Met, Gln, Lys, Arg, or Pro
  misc_feature (11)..(11): Xaa can be Arg, or Lys
HXGPAFVTWHX

SEQ ID NO: 197398 - protein, 10 aa, Artificial Sequence
  Description of Artificial Sequence: Synthetic peptide
  Seed: HRTCKCTGNF (TYRP2_HUMAN)
  misc_feature (2)..(2): Xaa can be , or Arg
  misc_feature (10)..(10): Xaa can be Lys, Leu, Phe, or Tyr
HXTCKCTGNX

SEQ ID NO: 197399 - protein, 8 aa, Artificial Sequence
  Description of Artificial Sequence: Synthetic peptide
  Seed: HRYHLLCL (TYRP2_HUMAN)
  misc_feature (2)..(2): Xaa can be His, Arg, Gln, Tyr, Pro, Lys, or Glu
  misc_feature (8)..(8): Xaa can be Leu, Val, Ile, Tyr, Ala, Cys, Phe, Met, Arg, Gly, Lys, Thr, Ser, or Pro
HXYHLLCX

SEQ ID NO: 197400 - protein, 9 aa, Artificial Sequence
  Description of Artificial Sequence: Synthetic peptide
  Seed: HRYHLLCLE (TYRP2_HUMAN)
  misc_feature (2)..(2): Xaa can be Arg, Gln, or Lys
  misc_feature (9)..(9): Xaa can be Lys, Arg, Leu, Cys, His, Phe, Thr, Tyr, Glu, Ala, Gly, Ile, Ser, Asn, Met, Gln, Trp, Val, or Pro
HXYHLLCLX

SEQ ID NO: 197401 - protein, 10 aa, Artificial Sequence
  Description of Artificial Sequence: Synthetic peptide
  Seed: HRYHLLCLER (TYRP2_HUMAN)
  misc_feature (2)..(2): Xaa can be Arg, Tyr, Gln, Met, His, Leu, Glu, Ala, Gly, Ser, Phe, Asn, Trp, Val, Cys, Lys, Thr, Ile, Asp, or Pro
  misc_feature (10)..(10): Xaa can be Arg, Lys, Tyr, Phe, Met, Trp, Thr, Glu, Val, His, Cys, Ala, Asn, Leu, Gln, Ser, Gly, or Il e
HXYHLLCLEX

SEQ ID NO: 197402 - protein, 9 aa, Artificial Sequence
  Description of Artificial Sequence: Synthetic peptide
  Seed: HSAANDPIF (TYRP2_HUMAN)
  misc_feature (2)..(2): Xaa can be Pro, Ala, Met, Ile, Ser, Val, Gln, Thr, Leu, Gly, His, Lys, Glu, Phe, Asp, Asn, Arg, Cys, Tyr, or Trp
  misc_feature (9)..(9): Xaa can be Tyr, Phe, Trp, Lys, Met, Leu, Arg, Ile, His, Val, Ala, Ser, Thr, or Gln
HXAANDPIX

SEQ ID NO: 197403 - protein, 10 aa, Artificial Sequence
  Description of Artificial Sequence: Synthetic peptide
  Seed: HSAANDPIFV (TYRP2_HUMAN)
  misc_feature (2)..(2): Xaa can be Leu, Thr, Met, Ile, Ser, Ala, Val, Gln, Gly, Pro, Asn, Glu, Phe, or Tyr
  misc_feature (10)..(10): Xaa can be Val, Leu, Ile, Met, Ala, Phe, or Thr
HXAANDPIFX

SEQ ID NO: 197404 - protein, 11 aa, Artificial Sequence
  Description of Artificial Sequence: Synthetic peptide
  Seed: HSAANDPIFVV (TYRP2_HUMAN)
  misc_feature (2)..(2): Xaa can be Thr, Ser, Ala, Val, Ile, or Gly
  misc_feature (11)..(11): Xaa can be Leu, Val, Met, Ile, Phe, or Ala
HXAANDPIFVX

SEQ ID NO: 197405 - protein, 9 aa, Artificial Sequence
  Description of Artificial Sequence: Synthetic peptide
  Seed: HSFLNGTNA (TYRP2_HUMAN)
  misc_feature (2)..(2): Xaa can be Gln, Ala, His, Arg, Ser, Val, Thr, Ile, Glu, Pro, Gly, Met, Asn, Lys, Leu, Asp, Cys, Phe, or Tyr
  misc_feature (9)..(9): Xaa can be Phe, Tyr, Met, Leu, Val, Ala, Lys, Ile, His, Cys, Trp, Thr, Arg, Pro, Gly, Ser, or Gln
HXFLNGTNX

SEQ ID NO: 197406 - protein, 10 aa, Artificial Sequence
  Description of Artificial Sequence: Synthetic peptide
  Seed: HSFLNGTNAL (TYRP2_HUMAN)
  misc_feature (2)..(2): Xaa can be Gln, Thr, Ala, Arg, Met, Ser, Val, Leu, Gly, Ile, His, Tyr, Glu, Phe, Lys, Asp, Trp, Asn, Cys, or Pro
  misc_feature (10)..(10): Xaa can be Trp, Phe, Leu, Tyr, Met, Ile, Val, Lys, His, Arg, Ala, Cys, Thr, or Gly
HXFLNGTNAX

SEQ ID NO: 197407 - protein, 8 aa, Artificial Sequence
  Description of Artificial Sequence: Synthetic peptide
  Seed: HSFTDAIF (TYRP2_HUMAN)
  misc_feature (2)..(2): Xaa can be Ala, Gln, Ser, Thr, Met, Val, Lys, Leu, or His
  misc_feature (8)..(8): Xaa can be Tyr, Phe, Trp, Met, Leu, Lys, His, or Ile
HXFTDAIX

SEQ ID NO: 197408 - protein, 11 aa, Artificial Sequence
  Description of Artificial Sequence: Synthetic peptide
  Seed: HSFTDAIFDEW (TYRP2_HUMAN)
  misc_feature (2)..(2): Xaa can be Met, Gln, Pro, Ser, Thr, Leu, Ala, Glu, Ile, Val, Gly, Arg, Cys, Tyr, Phe, Asn, Trp, Lys, His, or Asp
  misc_feature (11)..(11): Xaa can be Trp, Phe, Leu, Tyr, Met, Ile, or Val
HXFTDAIFDEX

SEQ ID NO: 197409 - protein, 8 aa, Artificial Sequence
  Description of Artificial Sequence: Synthetic peptide
  Seed: HSLSPQER (TYRP2_HUMAN)
  misc_feature (2)..(2): Xaa can be Ala, Thr, Ser, Ile, Val, Phe, Gly, Met, Leu, Gln, Asn, Asp, Trp, Tyr, Glu, or Cys
  misc_feature (8)..(8): Xaa can be Lys, Arg, Leu, Tyr, Phe, Met, Ile, Val, or Trp
HXLSPQEX

SEQ ID NO: 197410 - protein, 11 aa, Artificial Sequence
  Description of Artificial Sequence: Synthetic peptide
  Seed: HSLSPQEREQF (TYRP2_HUMAN)
  misc_feature (2)..(2): Xaa can be Ala, Gln, Met, Leu, Glu, Thr, Val, Ser, Ile, Gly, Cys, Trp, Asp, Lys, Pro, Tyr, Phe, Asn, or Arg
  misc_feature (11)..(11): Xaa can be Tyr, Trp, Phe, Met, Leu, Ile, Val, Lys, His, or Cys
HXLSPQEREQX

SEQ ID NO: 197411 - protein, 9 aa, Artificial Sequence
  Description of Artificial Sequence: Synthetic peptide
  Seed: HYYSVRDTL (TYRP2_HUMAN)
  misc_feature (2)..(2): Xaa can be Arg, His, Tyr, Ala, Gln, Thr, Met, Ser, Val, Phe, Gly, Trp, Pro, Lys, Ile, Glu, Leu, Asn, Asp, or Cys
  misc_feature (9)..(9): Xaa can be Leu, Tyr, Met, Phe, Ile, Val, Trp, Lys, His, Ala, Arg, Cys, Thr, Pro, Gln, Ser, or Gly
HXYSVRDTX

SEQ ID NO: 197412 - protein, 10 aa, Artificial Sequence
  Description of Artificial Sequence: Synthetic peptide
  Seed: HYYSVRDTLL (TYRP2_HUMAN)
  misc_feature (2)..(2): Xaa can be Arg, Tyr, Trp, Phe, Gln, His, Lys, Ala, Met, Glu, Leu, Gly, Ser, Cys, Asp, Pro, Ile, Thr, Asn, or Val
  misc_feature (10)..(10): Xaa can be Phe, Trp, Tyr, Leu, Met, Ile, Val, His, Lys, Gln, Arg, Ala, Thr, or Cys
HXYSVRDTLX

SEQ ID NO: 197413 - protein, 9 aa, Artificial Sequence
  Description of Artificial Sequence: Synthetic peptide
  Seed: IDFSHQGPA (TYRP2_HUMAN)
  misc_feature (2)..(2): Xaa can be Glu, Asp, or Gln
  misc_feature (9)..(9): Xaa can be Ala, Val, Ile, Leu, Pro, Cys, Tyr, Gly, Met, Ser, Phe, or Thr
IXFSHQGPX

SEQ ID NO: 197414 - protein, 10 aa, Artificial Sequence
  Description of Artificial Sequence: Synthetic peptide
  Seed: IDFSHQGPAF (TYRP2_HUMAN)
  misc_feature (2)..(2): Xaa can be Ala, Glu, Val, Ser, Thr, Ile, Tyr, Gln, Gly, Met, Phe, Asp, Leu, Pro, Asn, Trp, His, Cys, Arg, or Lys
  misc_feature (10)..(10): Xaa can be Phe, Tyr, Leu, Met, Trp, Val, Ile, His, Ala, Lys, Cys, Arg, Thr, Ser, Gly, Gln, or Pro
IXFSHQGPAX

SEQ ID NO: 197415 - protein, 8 aa, Artificial Sequence
  Description of Artificial Sequence: Synthetic peptide
  Seed: IFDEWMKR (TYRP2_HUMAN)
  misc_feature (2)..(2): Xaa can be Thr, Val, Ser, Ile, Ala, Phe, Met, Tyr, Leu, Gly, Cys, Asn, Gln, Trp, Glu, Asp, Pro, or Ly s
  misc_feature (8)..(8): Xaa can be Tyr, Lys, Leu, Met, Phe, Arg, Ile, His, Val, Trp, or Gln
IXDEWMKX

SEQ ID NO: 197416 - protein, 9 aa, Artificial Sequence
  Description of Artificial Sequence: Synthetic peptide
  Seed: IFDEWMKRF (TYRP2_HUMAN)
  misc_feature (2)..(2): Xaa can be Ala, Ser, Thr, Tyr, Met, Phe, Ile, Leu, Val, Gly, Arg, Gln, Trp, Asp, Asn, Glu, Cys, Pro, His, or Lys
  misc_feature (9)..(9): Xaa can be Met, Leu, Tyr, Phe, Trp, Ile, Val, Arg, Lys, Cys, Ala, His, Thr, or Gln
IXDEWMKRX

SEQ ID NO: 197417 - protein, 8 aa, Artificial Sequence
  Description of Artificial Sequence: Synthetic peptide
  Seed: IFVVLHSF (TYRP2_HUMAN)
  misc_feature (2)..(2): Xaa can be Tyr, Trp, Ser, Phe, Ala, Thr, Arg, Val, Gly, His, Ile, Met, Leu, Gln, Asn, or Cys
  misc_feature (8)..(8): Xaa can be Leu, Tyr, Met, Phe, Ile, Val, Trp, or His
IXVVLHSX

SEQ ID NO: 197418 - protein, 9 aa, Artificial Sequence
  Description of Artificial Sequence: Synthetic peptide
  Seed: IGHNRMYNM (TYRP2_HUMAN)
  misc_feature (2)..(2): Xaa can be Arg, Pro, Ala, Ser, Thr, Val, Tyr, Leu, Gly, Gln, Ile, His, Met, Phe, Asn, Glu, Lys, Cys, Trp, or Asp
  misc_feature (9)..(9): Xaa can be Met, Leu, Phe, Tyr, Ile, Val, Trp, Ala, Lys, Cys, or His
IXHNRMYNX

SEQ ID NO: 197419 - protein, 8 aa, Artificial Sequence
  Description of Artificial Sequence: Synthetic peptide
  Seed: IGNESFAL (TYRP2_HUMAN)
  misc_feature (2)..(2): Xaa can be Ala, Ser, Thr, Ile, Gly, Val, Phe, Tyr, Met, Asp, Asn, His, Glu, Gln, Leu, or Arg
  misc_feature (8)..(8): Xaa can be Leu, Tyr, Phe, Met, Lys, Ile, Val, Arg, or Trp
IXNESFAX

SEQ ID NO: 197420 - protein, 10 aa, Artificial Sequence
  Description of Artificial Sequence: Synthetic peptide
  Seed: IGNESFALPY (TYRP2_HUMAN)
  misc_feature (2)..(2): Xaa can be Gln, Lys, Met, Val, Ala, Leu, Ser, His, Glu, Arg, Ile, Tyr, Asn, Thr, Gly, Pro, Trp, Phe, Cys, or Asp
  misc_feature (10)..(10): Xaa can be Tyr, Phe, Met, Leu, His, Trp, Val, Ile, Lys, or Ala
IXNESFALPX

SEQ ID NO: 197421 - protein, 11 aa, Artificial Sequence
  Description of Artificial Sequence: Synthetic peptide
  Seed: IGNESFALPYW (TYRP2_HUMAN)
  misc_feature (2)..(2): Xaa can be Thr, Ser, Ala, Cys, Val, Phe, Gly, Leu, Glu, Asn, Pro, Asp, Met, Gln, Ile, or Trp
  misc_feature (11)..(11): Xaa can be Trp, Phe, Leu, Met, or Tyr
IXNESFALPYX

SEQ ID NO: 197422 - protein, 9 aa, Artificial Sequence
  Description of Artificial Sequence: Synthetic peptide
  Seed: ILPGAQGQF (TYRP2_HUMAN)
  misc_feature (2)..(2): Xaa can be Ala, Tyr, Ser, Met, Leu, Ile, Phe, Val, Thr, Gln, Gly, Asn, Pro, Cys, Arg, Trp, Glu, Asp, His, or Lys
  misc_feature (9)..(9): Xaa can be Tyr, Met, Leu, Phe, Ile, Val, Trp, Lys, Arg, His, Cys, Ala, or Thr
IXPGAQGQX

SEQ ID NO: 197423 - protein, 11 aa, Artificial Sequence
  Description of Artificial Sequence: Synthetic peptide
  Seed: ILPGAQGQFPR (TYRP2_HUMAN)
  misc_feature (2)..(2): Xaa can be Ala, Leu, Met, Tyr, Gln, Thr, Phe, Gly, Val, Ser, Asn, Ile, Trp, Glu, or Asp
  misc_feature (11)..(11): Xaa can be Lys, Arg, Leu, Phe, or Met
IXPGAQGQFPX

SEQ ID NO: 197424 - protein, 11 aa, Artificial Sequence
  Description of Artificial Sequence: Synthetic peptide
  Seed: ILRNQDDRELW (TYRP2_HUMAN)
  misc_feature (2)..(2): Xaa can be Gln, Thr, Ser, Met, Leu, Ala, Gly, Cys, Val, Ile, Phe, Glu, Asn, Pro, Asp, or Trp
  misc_feature (11)..(11): Xaa can be Trp, Phe, Tyr, Leu, Ile, Met, or Val
IXRNQDDRELX

SEQ ID NO: 197425 - protein, 9 aa, Artificial Sequence
  Description of Artificial Sequence: Synthetic peptide
  Seed: IRDCLSLQK (TYRP2_HUMAN)
  misc_feature (2)..(2): Xaa can be Arg, Phe, Tyr, Trp, Met, Lys, Ala, Pro, Gln, Val, Asn, Leu, Thr, Ile, or Gly
  misc_feature (9)..(9): Xaa can be Leu, Ile, Phe, Val, Met, Tyr, His, Arg, Trp, or Lys
IXDCLSLQX

SEQ ID NO: 197426 - protein, 10 aa, Artificial Sequence
  Description of Artificial Sequence: Synthetic peptide
  Seed: IRDCLSLQKF (TYRP2_HUMAN)
  misc_feature (2)..(2): Xaa can be Arg, Tyr, Phe, His, Trp, Leu, Met, Ala, or Gln
  misc_feature (10)..(10): Xaa can be Leu, Phe, Tyr, Met, Ile, Val, Arg, Trp, or Lys
IXDCLSLQKX

SEQ ID NO: 197427 - protein, 8 aa, Artificial Sequence
  Description of Artificial Sequence: Synthetic peptide
  Seed: IRQNIHSL (TYRP2_HUMAN)
  misc_feature (2)..(2): Xaa can be His, Arg, Gln, Tyr, Ala, Phe, Glu, Trp, Gly, Ser, Asn, Asp, Met, Ile, Thr, Pro, Val, Leu, Cys, or Lys
  misc_feature (8)..(8): Xaa can be Leu, Met, Ile, Phe, Tyr, Val, Ala, Thr, Pro, or Cys
IXQNIHSX

SEQ ID NO: 197428 - protein, 9 aa, Artificial Sequence
  Description of Artificial Sequence: Synthetic peptide
  Seed: ISRNSRFSS (TYRP2_HUMAN)
  misc_feature (2)..(2): Xaa can be Thr, Met, Val, Ile, Tyr, Ser, Phe, Ala, Gln, Leu, Trp, Gly, Asn, Cys, His, Arg, or Lys
  misc_feature (9)..(9): Xaa can be Lys, Ala, Met, Tyr, Ser, Val, Leu, Ile, Gly, Thr, Arg, Pro, Phe, Asn, Gln, Cys, His, Glu, Trp, or Asp
IXRNSRFSX

SEQ ID NO: 197429 - protein, 10 aa, Artificial Sequence
  Description of Artificial Sequence: Synthetic peptide
  Seed: ISRNSRFSSW (TYRP2_HUMAN)
  misc_feature (2)..(2): Xaa can be Ser, Thr, Ala, Gln, Val, Met, Ile, Leu, Glu, Pro, Gly, Cys, Asp, or Asn
  misc_feature (10)..(10): Xaa can be Trp, Phe, Tyr, Met, Leu, or Ile
IXRNSRFSSX

SEQ ID NO: 197430 - protein, 9 aa, Artificial Sequence
  Description of Artificial Sequence: Synthetic peptide
  Seed: ITTQHWLGL (TYRP2_HUMAN)
  misc_feature (2)..(2): Xaa can be Arg, Ala, Ile, Gln, Gly, Val, Ser, Met, Leu, Thr, Phe, Asn, Cys, Tyr, Glu, Asp, Trp, Pro, or His
  misc_feature (9)..(9): Xaa can be Leu, Trp, Tyr, Phe, Met, Val, Ile, Lys, Ala, His, or Arg
IXTQHWLGX

SEQ ID NO: 197431 - protein, 10 aa, Artificial Sequence
  Description of Artificial Sequence: Synthetic peptide
  Seed: ITTQHWLGLL (TYRP2_HUMAN)
  misc_feature (2)..(2): Xaa can be Thr, Ser, Ala, Pro, Trp, Asn, Leu, Asp, Met, Phe, Gln, Lys, Cys, Tyr, Arg, Ile, Val, Gly, Glu, or His
  misc_feature (10)..(10): Xaa can be Phe, Tyr, Trp, Leu, Met, or Ile
IXTQHWLGLX

SEQ ID NO: 197432 - protein, 10 aa, Artificial Sequence
  Description of Artificial Sequence: Synthetic peptide
  Seed: KADGTLDSQV (TYRP2_HUMAN)
  misc_feature (2)..(2): Xaa can be Ala, Ser, Leu, Ile, Met, Thr, Val, Cys, Phe, Gln, Gly, Tyr, Asn, Trp, Pro, or Glu
  misc_feature (10)..(10): Xaa can be Leu, Phe, Met, Ile, Val, Tyr, Cys, Trp, or Ala
KXDGTLDSQX

SEQ ID NO: 197433 - protein, 11 aa, Artificial Sequence
  Description of Artificial Sequence: Synthetic peptide
  Seed: KADGTLDSQVM (TYRP2_HUMAN)
  misc_feature (2)..(2): Xaa can be Ala, Gln, Ser, Val, Ile, Met, Thr, Phe, Gly, Tyr, Leu, Cys, Trp, Arg, Asn, Pro, Glu, His, Asp, or Lys
  misc_feature (11)..(11): Xaa can be Trp, Phe, Leu, Lys, Met, Ile, Arg, Val, Tyr, Cys, or His
KXDGTLDSQVX

SEQ ID NO: 197434 - protein, 9 aa, Artificial Sequence
  Description of Artificial Sequence: Synthetic peptide
  Seed: KCTGNFAGY (TYRP2_HUMAN)
  misc_feature (2)..(2): Xaa can be Met, Thr, Val, Ala, Gln, Tyr, Ser, Ile, Leu, Gly, Phe, Pro, Asn, Glu, Lys, Cys, Trp, Asp, Arg, or His
  misc_feature (9)..(9): Xaa can be Tyr, Phe, Met, Leu, His, Trp, Ile, Val, Arg, Lys, or Ala
KXTGNFAGX

SEQ ID NO: 197435 - protein, 9 aa, Artificial Sequence
  Description of Artificial Sequence: Synthetic peptide
  Seed: KDIRDCLSL (TYRP2_HUMAN)
  misc_feature (2)..(2): Xaa can be Glu, Arg, Asp, Met, Gln, Leu, Ile, Gly, Ser, Thr, Ala, Asn, Val, Lys, Cys, His, Tyr, Trp, Phe, or Pro
  misc_feature (9)..(9): Xaa can be Leu, Ile, Phe, Lys, Met, Trp, Val, Arg, Tyr, Cys, Ala, Pro, Ser, His, Thr, Gln, or Gly
KXIRDCLSX

SEQ ID NO: 197436 - protein, 9 aa, Artificial Sequence
  Description of Artificial Sequence: Synthetic peptide
  Seed: KECCPRLGA (TYRP2_HUMAN)
  misc_feature (2)..(2): Xaa can be Glu, Asp, or Gln
  misc_feature (9)..(9): Xaa can be Leu, Ile, Ala, Met, Val, Cys, Tyr, Ser, Gly, Pro, Thr, or Phe
KXCCPRLGX

SEQ ID NO: 197437 - protein, 11 aa, Artificial Sequence
  Description of Artificial Sequence: Synthetic peptide
  Seed: KECCPRLGAES (TYRP2_HUMAN)
  misc_feature (2)..(2): Xaa can be , or Glu
  misc_feature (11)..(11): Xaa can be Leu, Gly, Pro, Phe, Ile, Met, Ser, Ala, Thr, Cys, or Val
KXCCPRLGAEX

SEQ ID NO: 197438 - protein, 8 aa, Artificial Sequence
  Description of Artificial Sequence: Synthetic peptide
  Seed: KFDNPPFF (TYRP2_HUMAN)
  misc_feature (2)..(2): Xaa can be Ala, Tyr, Phe, Ile, Val, Ser, Thr, Gln, Gly, Leu, Met, His, Trp, Cys, Pro, Asn, Arg, Asp, Lys, or Glu
  misc_feature (8)..(8): Xaa can be Leu, Met, Ile, Phe, Val, Tyr, Trp, Cys, or Ala
KXDNPPFX

SEQ ID NO: 197439 - protein, 8 aa, Artificial Sequence
  Description of Artificial Sequence: Synthetic peptide
  Seed: KFFHRTCK (TYRP2_HUMAN)
  misc_feature (2)..(2): Xaa can be Thr, Val, Leu, Tyr, Phe, Ser, Ile, Ala, Trp, Gln, Met, or Gly
  misc_feature (8)..(8): Xaa can be Arg, Lys, Val, Tyr, or Ala
KXFHRTCX

SEQ ID NO: 197440 - protein, 11 aa, Artificial Sequence
  Description of Artificial Sequence: Synthetic peptide
  Seed: KFGWTGPNCER (TYRP2_HUMAN)
  misc_feature (2)..(2): Xaa can be Phe, Tyr, Met, Gln, Leu, Val, Ile, Thr, Trp, Ala, or Ser
  misc_feature (11)..(11): Xaa can be Arg, or Lys
KXGWTGPNCEX

SEQ ID NO: 197441 - protein, 10 aa, Artificial Sequence
  Description of Artificial Sequence: Synthetic peptide
  Seed: KILPGAQGQF (TYRP2_HUMAN)
  misc_feature (2)..(2): Xaa can be Gln, Ala, Met, Thr, Ser, Leu, Val, Ile, Tyr, Glu, Trp, Phe, Gly, Asn, Lys, Cys, Arg, Pro, His, or Asp
  misc_feature (10)..(10): Xaa can be Trp, Tyr, Phe, Leu, Arg, Met, Lys, Ile, Val, His, Cys, Ala, or Thr
KXLPGAQGQX

SEQ ID NO: 197442 - protein, 10 aa, Artificial Sequence
  Description of Artificial Sequence: Synthetic peptide
  Seed: KKRVHPDYVI (TYRP2_HUMAN)
  misc_feature (2)..(2): Xaa can be Gln, Ser, His, Asp, Phe, Glu, Val, Tyr, Gly, Trp, Lys, Asn, Pro, Ile, Cys, Thr, Leu, Met, Ala, or Arg
  misc_feature (10)..(10): Xaa can be Phe, Val, Met, Leu, or Ile
KXRVHPDYVX

SEQ ID NO: 197443 - protein, 9 aa, Artificial Sequence
  Description of Artificial Sequence: Synthetic peptide
  Seed: KLPTLKDIR (TYRP2_HUMAN)
  misc_feature (2)..(2): Xaa can be Val, Met, Thr, Ile, Leu, Phe, Ala, Tyr, Gln, or Ser
  misc_feature (9)..(9): Xaa can be Arg, or Lys
KXPTLKDIX

SEQ ID NO: 197444 - protein, 9 aa, Artificial Sequence
  Description of Artificial Sequence: Synthetic peptide
  Seed: KPPVIRQNI (TYRP2_HUMAN)
  misc_feature (2)..(2): Xaa can be Pro, or Ala
  misc_feature (9)..(9): Xaa can be Val, Leu, Ile, Ala, Met, Pro, Phe, Thr, or Cys
KXPVIRQNX

SEQ ID NO: 197445 - protein, 9 aa, Artificial Sequence
  Description of Artificial Sequence: Synthetic peptide
  Seed: KRFNPPADA (TYRP2_HUMAN)
  misc_feature (2)..(2): Xaa can be Arg, His, Gln, Tyr, Pro, Ile, Thr, Val, Met, Phe, Ser, Gly, Ala, Lys, Glu, Asn, Leu, Trp, Asp, or Cys
  misc_feature (9)..(9): Xaa can be Leu, Met, Phe, Tyr, Ile, Val, Ala, Cys, Lys, Arg, Pro, His, Trp, Thr, Asn, Ser, Glu, Gln, or Gly
KXFNPPADX

SEQ ID NO: 197446 - protein, 10 aa, Artificial Sequence
  Description of Artificial Sequence: Synthetic peptide
  Seed: KRFNPPADAW (TYRP2_HUMAN)
  misc_feature (2)..(2): Xaa can be Arg, Glu, Gln, Leu, His, Lys, Thr, Met, Ser, Ile, Tyr, Ala, Val, Trp, Pro, Phe, Asn, Gly, Asp, or Cys
  misc_feature (10)..(10): Xaa can be Phe, Trp, Tyr, Leu, Met, Ile, Val, Cys, His, Lys, Ala, Arg, Gln, Thr, Gly, Glu, Pro, Asn, or Ser
KXFNPPADAX

SEQ ID NO: 197447 - protein, 11 aa, Artificial Sequence
  Description of Artificial Sequence: Synthetic peptide
  Seed: KRFNPPADAWP (TYRP2_HUMAN)
  misc_feature (2)..(2): Xaa can be Arg, or Gln
  misc_feature (11)..(11): Xaa can be Tyr, Leu, Phe, Trp, Lys, Ala, Gly, Pro, Met, Arg, Asn, Ser, Gln, Val, Ile, Thr, Glu, His, or Cys
KXFNPPADAWX

SEQ ID NO: 197448 - protein, 9 aa, Artificial Sequence
  Description of Artificial Sequence: Synthetic peptide
  Seed: KRVHPDYVI (TYRP2_HUMAN)
  misc_feature (2)..(2): Xaa can be Arg, His, Gln, Ala, Tyr, Lys, Phe, Met, Asn, Ser, Trp, Thr, Glu, Gly, Val, Asp, Leu, or Il e
  misc_feature (9)..(9): Xaa can be Leu, Tyr, Met, Phe, Ile, Val, Ala, Thr, Pro, Arg, Cys, Lys, Trp, Gln, or His
KXVHPDYVX

SEQ ID NO: 197449 - protein, 10 aa, Artificial Sequence
  Description of Artificial Sequence: Synthetic peptide
  Seed: KRVHPDYVIT (TYRP2_HUMAN)
  misc_feature (2)..(2): Xaa can be , or Arg
  misc_feature (10)..(10): Xaa can be Ser, Val, Gln, Cys, Phe, Arg, Lys, Tyr, Ile, Trp, His, Gly, Thr, Leu, Ala, or Met
KXVHPDYVIX

SEQ ID NO: 197450 - protein, 11 aa, Artificial Sequence
  Description of Artificial Sequence: Synthetic peptide
  Seed: KRVHPDYVITT (TYRP2_HUMAN)
  misc_feature (2)..(2): Xaa can be Arg, Gln, Lys, or His
  misc_feature (11)..(11): Xaa can be Leu, Lys, Phe, Met, Tyr, Trp, Arg, Val, Ala, Cys, His, Glu, Gly, Asn, Gln, Thr, Pro, Ser, or Ile
KXVHPDYVITX

SEQ ID NO: 197451 - protein, 8 aa, Artificial Sequence
  Description of Artificial Sequence: Synthetic peptide
  Seed: LAFLQYRR (TYRP2_HUMAN)
  misc_feature (2)..(2): Xaa can be Tyr, Met, Phe, Trp, Ile, Gln, Ser, Thr, Ala, Val, Asn, or Leu
  misc_feature (8)..(8): Xaa can be Arg, or Lys
LXFLQYRX

SEQ ID NO: 197452 - protein, 9 aa, Artificial Sequence
  Description of Artificial Sequence: Synthetic peptide
  Seed: LAFLQYRRL (TYRP2_HUMAN)
  misc_feature (2)..(2): Xaa can be Gln, Thr, Ala, Ser, Val, Glu, Asp, Met, Ile, Gly, Cys, Leu, Asn, or Pro
  misc_feature (9)..(9): Xaa can be Trp, Phe, Met, Ile, Val, Leu, Tyr, Cys, or Ala
LXFLQYRRX

SEQ ID NO: 197453 - protein, 10 aa, Artificial Sequence
  Description of Artificial Sequence: Synthetic peptide
  Seed: LAFLQYRRLR (TYRP2_HUMAN)
  misc_feature (2)..(2): Xaa can be Met, Phe, Glu, Ser, Trp, Cys, Pro, Arg, Asp, Lys, His, Ile, Leu, Thr, Val, Asn, Gly, Ala, Gln, or Tyr
  misc_feature (10)..(10): Xaa can be Lys, or Arg
LXFLQYRRLX

SEQ ID NO: 197454 - protein, 8 aa, Artificial Sequence
  Description of Artificial Sequence: Synthetic peptide
  Seed: LAPIGHNR (TYRP2_HUMAN)
  misc_feature (2)..(2): Xaa can be Ala, Val, Thr, Ile, Ser, Gly, Gln, Pro, Tyr, Leu, Asn, Phe, Met, or Cys
  misc_feature (8)..(8): Xaa can be Leu, Met, Phe, Ile, Lys, Val, Arg, or Tyr
LXPIGHNX

SEQ ID NO: 197455 - protein, 9 aa, Artificial Sequence
  Description of Artificial Sequence: Synthetic peptide
  Seed: LAPIGHNRM (TYRP2_HUMAN)
  misc_feature (2)..(2): Xaa can be Ala, Tyr, Pro, Leu, Met, Thr, Val, Ile, Ser, Phe, Cys, Glu, Gln, Arg, Gly, Trp, Asn, Asp, His, or Lys
  misc_feature (9)..(9): Xaa can be Leu, Tyr, Met, Phe, Trp, Val, Ile, Arg, Lys, Cys, Ala, or His
LXPIGHNRX

SEQ ID NO: 197456 - protein, 10 aa, Artificial Sequence
  Description of Artificial Sequence: Synthetic peptide
  Seed: LAPIGHNRMY (TYRP2_HUMAN)
  misc_feature (2)..(2): Xaa can be Ala, Thr, Ser, Val, Met, Gln, Leu, Glu, Cys, Ile, Asn, His, Trp, Arg, Pro, Gly, Lys, Asp, Phe, or Tyr
  misc_feature (10)..(10): Xaa can be Tyr, Phe, Met, Trp, Leu, Lys, Val, or Ile
LXPIGHNRMX

SEQ ID NO: 197457 - protein, 9 aa, Artificial Sequence
  Description of Artificial Sequence: Synthetic peptide
  Seed: LCLERDLQR (TYRP2_HUMAN)
  misc_feature (2)..(2): Xaa can be Thr, Phe, Tyr, Val, Gln, Trp, Glu, Cys, Pro, Gly, Leu, His, Ala, Asp, Asn, Ser, Ile, or Me t
  misc_feature (9)..(9): Xaa can be Arg, or Lys
LXLERDLQX

SEQ ID NO: 197458 - protein, 8 aa, Artificial Sequence
  Description of Artificial Sequence: Synthetic peptide
  Seed: LDDYNHLV (TYRP2_HUMAN)
  misc_feature (2)..(2): Xaa can be Ala, Met, Gly, Ile, Phe, Thr, Ser, Tyr, Asp, Cys, Val, Asn, Leu, Trp, Gln, Pro, Glu, or Hi s
  misc_feature (8)..(8): Xaa can be Leu, Ile, Met, Phe, Val, Tyr, Ala, Trp, or Cys
LXDYNHLX

SEQ ID NO: 197459 - protein, 10 aa, Artificial Sequence
  Description of Artificial Sequence: Synthetic peptide
  Seed: LDDYNHLVTL (TYRP2_HUMAN)
  misc_feature (2)..(2): Xaa can be Glu, Ala, Ile, Val, Ser, Thr, Met, Leu, Asp, Pro, Gly, Gln, Phe, Cys, Asn, or Tyr
  misc_feature (10)..(10): Xaa can be Leu, Met, Phe, Val, Ile, Tyr, Cys, Ala, Trp, Gly, Pro, Ser, or Thr
LXDYNHLVTX

SEQ ID NO: 197460 - protein, 8 aa, Artificial Sequence
  Description of Artificial Sequence: Synthetic peptide
  Seed: LDSQVMSL (TYRP2_HUMAN)
  misc_feature (2)..(2): Xaa can be Glu, or Asp
  misc_feature (8)..(8): Xaa can be Ile, Ala, Leu, Met, Phe, Val, Thr, Cys, or Pro
LXSQVMSX

SEQ ID NO: 197461 - protein, 11 aa, Artificial Sequence
  Description of Artificial Sequence: Synthetic peptide
  Seed: LEGFDKADGTL (TYRP2_HUMAN)
  misc_feature (2)..(2): Xaa can be , or Glu
  misc_feature (11)..(11): Xaa can be Cys, Met, Leu, Phe, Ile, Ala, or Val
LXGFDKADGTX

SEQ ID NO: 197462 - protein, 8 aa, Artificial Sequence
  Description of Artificial Sequence: Synthetic peptide
  Seed: LERDLQRL (TYRP2_HUMAN)
  misc_feature (2)..(2): Xaa can be Glu, Gln, Asp, Ala, Ser, Met, or Leu
  misc_feature (8)..(8): Xaa can be Ile, Val, Leu, Trp, Phe, Met, Tyr, Thr, Pro, Ala, or Cys
LXRDLQRX

SEQ ID NO: 197463 - protein, 9 aa, Artificial Sequence
  Description of Artificial Sequence: Synthetic peptide
  Seed: LERDLQRLI (TYRP2_HUMAN)
  misc_feature (2)..(2): Xaa can be Glu, Gln, Asp, Leu, Arg, Met, Ala, Ser, Ile, Val, Phe, Tyr, His, Gly, Thr, or Asn
  misc_feature (9)..(9): Xaa can be Leu, Val, Ile, Met, Phe, Trp, Tyr, Ala, Cys, Lys, Pro, Thr, Arg, His, Gly, or Ser
LXRDLQRLX

SEQ ID NO: 197464 - protein, 10 aa, Artificial Sequence
  Description of Artificial Sequence: Synthetic peptide
  Seed: LERDLQRLIG (TYRP2_HUMAN)
  misc_feature (2)..(2): Xaa can be , or Glu
  misc_feature (10)..(10): Xaa can be Gly, Met, Thr, Ser, Pro, Ala, Phe, Cys, Ile, Val, or Leu
LXRDLQRLIX

SEQ ID NO: 197465 - protein, 8 aa, Artificial Sequence
  Description of Artificial Sequence: Synthetic peptide
  Seed: LFLTSDQL (TYRP2_HUMAN)
  misc_feature (2)..(2): Xaa can be Tyr, or Phe
  misc_feature (8)..(8): Xaa can be Phe, Leu, Met, or Tyr
LXLTSDQX

SEQ ID NO: 197466 - protein, 10 aa, Artificial Sequence
  Description of Artificial Sequence: Synthetic peptide
  Seed: LFLTSDQLGY (TYRP2_HUMAN)
  misc_feature (2)..(2): Xaa can be Phe, Ile, Asn, Ala, Met, Gly, Arg, Trp, Glu, His, Ser, Thr, Val, Leu, Gln, or Tyr
  misc_feature (10)..(10): Xaa can be Tyr, or Phe
LXLTSDQLGX

SEQ ID NO: 197467 - protein, 10 aa, Artificial Sequence
  Description of Artificial Sequence: Synthetic peptide
  Seed: LFVLLAFLQY (TYRP2_HUMAN)
  misc_feature (2)..(2): Xaa can be Thr, Ser, Cys, Gln, Arg, Val, Phe, Gly, Met, Tyr, Leu, Ala, His, Ile, Lys, Trp, Pro, Asp, Asn, or Glu
  misc_feature (10)..(10): Xaa can be , or Tyr
LXVLLAFLQX

SEQ ID NO: 197468 - protein, 11 aa, Artificial Sequence
  Description of Artificial Sequence: Synthetic peptide
  Seed: LFVLLAFLQYR (TYRP2_HUMAN)
  misc_feature (2)..(2): Xaa can be Ala, Met, Phe, Trp, Gln, Val, Lys, Ser, Asn, Tyr, His, Gly, Thr, Ile, Arg, Pro, Leu, Asp, Glu, or Cys
  misc_feature (11)..(11): Xaa can be Arg, or Lys
LXVLLAFLQYX

SEQ ID NO: 197469 - protein, 8 aa, Artificial Sequence
  Description of Artificial Sequence: Synthetic peptide
  Seed: LGALDLAK (TYRP2_HUMAN)
  misc_feature (2)..(2): Xaa can be Ala, Ser, Gly, Val, or Ile
  misc_feature (8)..(8): Xaa can be Lys, Leu, Arg, or Met
LXALDLAX

SEQ ID NO: 197470 - protein, 9 aa, Artificial Sequence
  Description of Artificial Sequence: Synthetic peptide
  Seed: LGALDLAKK (TYRP2_HUMAN)
  misc_feature (2)..(2): Xaa can be Ala, Thr, Ser, Val, Met, Gly, Ile, Asn, Asp, Leu, Gln, Pro, Cys, or Glu
  misc_feature (9)..(9): Xaa can be Lys, Tyr, Arg, Leu, Met, His, Phe, Ile, or Val
LXALDLAKX

SEQ ID NO: 197471 - protein, 10 aa, Artificial Sequence
  Description of Artificial Sequence: Synthetic peptide
  Seed: LGPGRPYRAI (TYRP2_HUMAN)
  misc_feature (2)..(2): Xaa can be Pro, Glu, Thr, Gly, Ile, Ala, Trp, Arg, Ser, Gln, Tyr, Leu, Met, Phe, Cys, His, Lys, Asn, Asp, or Val
  misc_feature (10)..(10): Xaa can be Phe, Val, Ile, Met, Leu, or Ala
LXPGRPYRAX

SEQ ID NO: 197472 - protein, 10 aa, Artificial Sequence
  Description of Artificial Sequence: Synthetic peptide
  Seed: LGPNGTQPQF (TYRP2_HUMAN)
  misc_feature (2)..(2): Xaa can be Ala, Ser, Val, Gly, Thr, Ile, Arg, Met, Leu, Cys, Tyr, Gln, Phe, Lys, Pro, Trp, Asn, His, Asp, or Glu
  misc_feature (10)..(10): Xaa can be Tyr, Met, Phe, Trp, Leu, Ile, Val, Lys, Arg, His, Ala, or Cys
LXPNGTQPQX

SEQ ID NO: 197473 - protein, 9 aa, Artificial Sequence
  Description of Artificial Sequence: Synthetic peptide
  Seed: LGYSYAIDL (TYRP2_HUMAN)
  misc_feature (2)..(2): Xaa can be Ala, Thr, Ser, Gln, Gly, Val, Met, Asn, Ile, Leu, Glu, Arg, Cys, Pro, Tyr, Asp, Phe, or Hi s
  misc_feature (9)..(9): Xaa can be Leu, Tyr, Met, Val, Phe, Ile, His, Trp, Ala, or Cys
LXYSYAIDX

SEQ ID NO: 197474 - protein, 8 aa, Artificial Sequence
  Description of Artificial Sequence: Synthetic peptide
  Seed: LHNLVHSF (TYRP2_HUMAN)
  misc_feature (2)..(2): Xaa can be His, Gln, Arg, Ala, Tyr, Glu, Asp, Phe, Lys, Met, Ser, Gly, Asn, Trp, Pro, Leu, Thr, Ile, Cys, or Val
  misc_feature (8)..(8): Xaa can be Leu, Met, Phe, Ile, Tyr, Val, Ala, Ser, Pro, Thr, Trp, or Cys
LXNLVHSX

SEQ ID NO: 197475 - protein, 9 aa, Artificial Sequence
  Description of Artificial Sequence: Synthetic peptide
  Seed: LHNLVHSFL (TYRP2_HUMAN)
  misc_feature (2)..(2): Xaa can be His, Gln, Arg, Met, Ala, Lys, Tyr, Ser, Thr, Ile, Phe, Leu, Asn, Val, Glu, Trp, Gly, Pro, or Asp
  misc_feature (9)..(9): Xaa can be Phe, Leu, Tyr, Met, Ile, Trp, Val, Ala, Cys, His, Thr, or Pro
LXNLVHSFX

SEQ ID NO: 197476 - protein, 8 aa, Artificial Sequence
  Description of Artificial Sequence: Synthetic peptide
  Seed: LHSFTDAI (TYRP2_HUMAN)
  misc_feature (2)..(2): Xaa can be , or His
  misc_feature (8)..(8): Xaa can be Ala, Phe, Ile, Leu, or Val
LXSFTDAX

SEQ ID NO: 197477 - protein, 9 aa, Artificial Sequence
  Description of Artificial Sequence: Synthetic peptide
  Seed: LHSFTDAIF (TYRP2_HUMAN)
  misc_feature (2)..(2): Xaa can be Gln, Met, Lys, His, Arg, Glu, Leu, Ala, Val, Ser, Phe, Ile, Tyr, Thr, Gly, Pro, Asn, or Tr p
  misc_feature (9)..(9): Xaa can be Phe, Tyr, Met, Leu, Trp, Ile, Val, His, or Ala
LXSFTDAIX

SEQ ID NO: 197478 - protein, 10 aa, Artificial Sequence
  Description of Artificial Sequence: Synthetic peptide
  Seed: LHYYSVRDTL (TYRP2_HUMAN)
  misc_feature (2)..(2): Xaa can be His, Gln, Met, Lys, Thr, Val, Trp, Cys, Glu, Ala, Asp, Ser, Ile, Pro, Gly, Leu, Asn, Phe, Arg, or Tyr
  misc_feature (10)..(10): Xaa can be Phe, Ile, Tyr, Val, Leu, Trp, Met, His, Ala, or Cys
LXYYSVRDTX

SEQ ID NO: 197479 - protein, 9 aa, Artificial Sequence
  Description of Artificial Sequence: Synthetic peptide
  Seed: LIGNESFAL (TYRP2_HUMAN)
  misc_feature (2)..(2): Xaa can be Met, Leu, Gln, Val, Ile, Ala, Thr, Ser, or Gly
  misc_feature (9)..(9): Xaa can be Leu, Val, Met, Ile, Phe, Trp, Ala, Thr, Cys, or Tyr
LXGNESFAX

SEQ ID NO: 197480 - protein, 11 aa, Artificial Sequence
  Description of Artificial Sequence: Synthetic peptide
  Seed: LIGNESFALPY (TYRP2_HUMAN)
  misc_feature (2)..(2): Xaa can be Ile, Trp, Leu, Tyr, Val, Met, Thr, or Phe
  misc_feature (11)..(11): Xaa can be , or Tyr
LXGNESFALPX

SEQ ID NO: 197481 - protein, 10 aa, Artificial Sequence
  Description of Artificial Sequence: Synthetic peptide
  Seed: LISRNSRFSS (TYRP2_HUMAN)
  misc_feature (2)..(2): Xaa can be Arg, Tyr, Thr, Lys, Met, Ser, His, Ala, Phe, Gln, Val, Trp, Gly, Cys, Leu, Ile, Asp, Pro, Asn, or Glu
  misc_feature (10)..(10): Xaa can be Tyr, Leu, Ala, Val, Ser, Ile, Thr, Lys, Met, Gly, Arg, Phe, Pro, or Cys
LXSRNSRFSX

SEQ ID NO: 197482 - protein, 11 aa, Artificial Sequence
  Description of Artificial Sequence: Synthetic peptide
  Seed: LISRNSRFSSW (TYRP2_HUMAN)
  misc_feature (2)..(2): Xaa can be Thr, Ser, Ala, Met, Val, Tyr, Arg, Gln, Asp, Gly, His, Pro, Asn, Trp, Leu, Glu, Phe, Cys, Ile, or Lys
  misc_feature (11)..(11): Xaa can be Trp, Phe, Tyr, Met, Leu, or Ile
LXSRNSRFSSX

SEQ ID NO: 197483 - protein, 10 aa, Artificial Sequence
  Description of Artificial Sequence: Synthetic peptide
  Seed: LKDIRDCLSL (TYRP2_HUMAN)
  misc_feature (2)..(2): Xaa can be Gln, Lys, Met, His, Arg, Glu, Leu, Ala, or Ser
  misc_feature (10)..(10): Xaa can be Phe, Tyr, Met, Leu, Trp, or Ile
LXDIRDCLSX

SEQ ID NO: 197484 - protein, 8 aa, Artificial Sequence
  Description of Artificial Sequence: Synthetic peptide
  Seed: LLAFLQYR (TYRP2_HUMAN)
  misc_feature (2)..(2): Xaa can be Phe, Tyr, Met, Trp, Lys, Thr, Val, Ala, His, Ser, Arg, Asn, Gly, Leu, Gln, or Ile
  misc_feature (8)..(8): Xaa can be Arg, or Lys
LXAFLQYX

SEQ ID NO: 197485 - protein, 9 aa, Artificial Sequence
  Description of Artificial Sequence: Synthetic peptide
  Seed: LLAFLQYRR (TYRP2_HUMAN)
  misc_feature (2)..(2): Xaa can be Met, Leu, Thr, Phe, Ala, Val, Ile, Ser, Trp, Gly, Asp, Pro, Tyr, Asn, Gln, Cys, His, Glu, Lys, or Arg
  misc_feature (9)..(9): Xaa can be Arg, Lys, Tyr, His, Leu, Val, Met, Phe, Gln, or Ile
LXAFLQYRX

SEQ ID NO: 197486 - protein, 10 aa, Artificial Sequence
  Description of Artificial Sequence: Synthetic peptide
  Seed: LLAFLQYRRL (TYRP2_HUMAN)
  misc_feature (2)..(2): Xaa can be Met, Leu, Val, Ile, Gln, or Thr
  misc_feature (10)..(10): Xaa can be Val, Ile, Leu, Ala, Met, or Thr
LXAFLQYRRX

SEQ ID NO: 197487 - protein, 11 aa, Artificial Sequence
  Description of Artificial Sequence: Synthetic peptide
  Seed: LLAFLQYRRLR (TYRP2_HUMAN)
  misc_feature (2)..(2): Xaa can be Tyr, Phe, Val, Ala, Leu, Met, Ser, Thr, Trp, Gln, Ile, Lys, Glu, His, Gly, Cys, Arg, Asp, Pro, or Asn
  misc_feature (11)..(11): Xaa can be Arg, or Lys
LXAFLQYRRLX

SEQ ID NO: 197488 - protein, 10 aa, Artificial Sequence
  Description of Artificial Sequence: Synthetic peptide
  Seed: LLCLERDLQR (TYRP2_HUMAN)
  misc_feature (2)..(2): Xaa can be Val, Ile, Thr, Leu, Tyr, Met, Phe, Trp, Gln, or Ser
  misc_feature (10)..(10): Xaa can be Arg, or Lys
LXCLERDLQX

SEQ ID NO: 197489 - protein, 8 aa, Artificial Sequence
  Description of Artificial Sequence: Synthetic peptide
  Seed: LLGPGRPY (TYRP2_HUMAN)
  misc_feature (2)..(2): Xaa can be Ala, Ser, Val, Thr, Gly, Ile, Gln, Met, Leu, Phe, Asn, Cys, Glu, Pro, Tyr, Lys, or Asp
  misc_feature (8)..(8): Xaa can be Tyr, Phe, Leu, Met, His, Ile, Lys, Val, Trp, Arg, Ala, Pro, Gln, Cys, or Thr
LXGPGRPX

SEQ ID NO: 197490 - protein, 9 aa, Artificial Sequence
  Description of Artificial Sequence: Synthetic peptide
  Seed: LLGPGRPYR (TYRP2_HUMAN)
  misc_feature (2)..(2): Xaa can be Leu, Met, Ile, Val, Thr, Ala, Glu, Gly, Gln, Tyr, Ser, Phe, Pro, Asn, Asp, Trp, His, or Cy s
  misc_feature (9)..(9): Xaa can be Arg, Lys, Leu, Met, Tyr, Val, Phe, Ile, His, or Ala
LXGPGRPYX

SEQ ID NO: 197491 - protein, 10 aa, Artificial Sequence
  Description of Artificial Sequence: Synthetic peptide
  Seed: LLGPGRPYRA (TYRP2_HUMAN)
  misc_feature (2)..(2): Xaa can be Met, Leu, Ile, Val, or Gln
  misc_feature (10)..(10): Xaa can be Val, Leu, Ile, Ala, or Met
LXGPGRPYRX

SEQ ID NO: 197492 - protein, 11 aa, Artificial Sequence
  Description of Artificial Sequence: Synthetic peptide
  Seed: LLGPGRPYRAI (TYRP2_HUMAN)
  misc_feature (2)..(2): Xaa can be Leu, or Met
  misc_feature (11)..(11): Xaa can be Val, or Ile
LXGPGRPYRAX

SEQ ID NO: 197493 - protein, 11 aa, Artificial Sequence
  Description of Artificial Sequence: Synthetic peptide
  Seed: LLGPNGTQPQF (TYRP2_HUMAN)
  misc_feature (2)..(2): Xaa can be Ala, Thr, Ser, Val, Gln, Gly, Met, Leu, Ile, Cys, Glu, Pro, Asn, Phe, Tyr, Trp, Arg, Lys, or Asp
  misc_feature (11)..(11): Xaa can be Tyr, Trp, Phe, Leu, Met, Ile, His, Lys, Val, Cys, or Ala
LXGPNGTQPQX

SEQ ID NO: 197494 - protein, 9 aa, Artificial Sequence
  Description of Artificial Sequence: Synthetic peptide
  Seed: LLRRNQMGR (TYRP2_HUMAN)
  misc_feature (2)..(2): Xaa can be Met, Leu, Ile, Gln, Ser, Thr, Val, Ala, Tyr, Phe, Trp, Gly, or Asn
  misc_feature (9)..(9): Xaa can be Arg, Lys, or Tyr
LXRRNQMGX

SEQ ID NO: 197495 - protein, 9 aa, Artificial Sequence
  Description of Artificial Sequence: Synthetic peptide
  Seed: LLSCLGCKI (TYRP2_HUMAN)
  misc_feature (2)..(2): Xaa can be Met, Leu, Gln, Ile, Val, Thr, Ala, Ser, or Glu
  misc_feature (9)..(9): Xaa can be Leu, Ile, Val, Ala, Trp, Phe, Met, Thr, or Tyr
LXSCLGCKX

SEQ ID NO: 197496 - protein, 10 aa, Artificial Sequence
  Description of Artificial Sequence: Synthetic peptide
  Seed: LLSCLGCKIL (TYRP2_HUMAN)
  misc_feature (2)..(2): Xaa can be Leu, Met, Val, or Ile
  misc_feature (10)..(10): Xaa can be Val, Leu, Ile, or Ala
LXSCLGCKIX

SEQ ID NO: 197497 - protein, 9 aa, Artificial Sequence
  Description of Artificial Sequence: Synthetic peptide
  Seed: LLVVMGTLV (TYRP2_HUMAN)
  misc_feature (2)..(2): Xaa can be Gln, Leu, Met, Glu, Ala, Gly, Ser, Ile, Thr, Val, Asn, Pro, or Asp
  misc_feature (9)..(9): Xaa can be Val, Ile, Leu, Met, Ala, Phe, or Cys
LXVVMGTLX

SEQ ID NO: 197498 - protein, 10 aa, Artificial Sequence
  Description of Artificial Sequence: Synthetic peptide
  Seed: LLVVMGTLVA (TYRP2_HUMAN)
  misc_feature (2)..(2): Xaa can be Met, Leu, Gln, or Ile
  misc_feature (10)..(10): Xaa can be Val, Leu, Ile, Ala, Thr, or Met
LXVVMGTLVX

SEQ ID NO: 197499 - protein, 11 aa, Artificial Sequence
  Description of Artificial Sequence: Synthetic peptide
  Seed: LLVVMGTLVAL (TYRP2_HUMAN)
  misc_feature (2)..(2): Xaa can be Gln, Met, Leu, Glu, Lys, His, Tyr, Val, Trp, Pro, Ile, Gly, Thr, Ala, Asn, Cys, Phe, Asp, Arg, or Ser
  misc_feature (11)..(11): Xaa can be Met, Ala, Val, Leu, Ile, or Thr
LXVVMGTLVAX

SEQ ID NO: 197500 - protein, 9 aa, Artificial Sequence
  Description of Artificial Sequence: Synthetic peptide
  Seed: LMETHLSSK (TYRP2_HUMAN)
  misc_feature (2)..(2): Xaa can be Thr, Leu, Met, Ser, Ile, Ala, Val, Gly, Tyr, Phe, Gln, Trp, Glu, Asn, Asp, Cys, or Pro
  misc_feature (9)..(9): Xaa can be Tyr, Lys, Arg, Phe, Met, Leu, His, Val, or Trp
LXETHLSSX

SEQ ID NO: 197501 - protein, 10 aa, Artificial Sequence
  Description of Artificial Sequence: Synthetic peptide
  Seed: LMETHLSSKR (TYRP2_HUMAN)
  misc_feature (2)..(2): Xaa can be Thr, Met, Leu, Ile, Tyr, Val, Phe, or Ser
  misc_feature (10)..(10): Xaa can be , or Arg
LXETHLSSKX

SEQ ID NO: 197502 - protein, 11 aa, Artificial Sequence
  Description of Artificial Sequence: Synthetic peptide
  Seed: LMETHLSSKRY (TYRP2_HUMAN)
  misc_feature (2)..(2): Xaa can be Met, Gln, Ile, Thr, Val, Ala, Asn, Leu, or Ser
  misc_feature (11)..(11): Xaa can be Tyr, or Phe
LXETHLSSKRX

SEQ ID NO: 197503 - protein, 9 aa, Artificial Sequence
  Description of Artificial Sequence: Synthetic peptide
  Seed: LPGAQGQFP (TYRP2_HUMAN)
  misc_feature (2)..(2): Xaa can be , or Pro
  misc_feature (9)..(9): Xaa can be Ala, Ser, Val, Cys, Ile, Pro, Leu, Met, Phe, or Thr
LXGAQGQFX

SEQ ID NO: 197504 - protein, 10 aa, Artificial Sequence
  Description of Artificial Sequence: Synthetic peptide
  Seed: LPGAQGQFPR (TYRP2_HUMAN)
  misc_feature (2)..(2): Xaa can be Met, Leu, Tyr, Phe, Ile, Val, Trp, Thr, Ala, Ser, Gln, Asn, Glu, Gly, His, Asp, Arg, Cys, Pro, or Lys
  misc_feature (10)..(10): Xaa can be Arg, or Lys
LXGAQGQFPX

SEQ ID NO: 197505 - protein, 11 aa, Artificial Sequence
  Description of Artificial Sequence: Synthetic peptide
  Seed: LPGAQGQFPRV (TYRP2_HUMAN)
  misc_feature (2)..(2): Xaa can be , or Pro
  misc_feature (11)..(11): Xaa can be Leu, Ile, Thr, Phe, Cys, Gly, Val, Ala, Pro, Met, or Ser
LXGAQGQFPRX

SEQ ID NO: 197506 - protein, 9 aa, Artificial Sequence
  Description of Artificial Sequence: Synthetic peptide
  Seed: LPHSAANDP (TYRP2_HUMAN)
  misc_feature (2)..(2): Xaa can be Pro, or Ala
  misc_feature (9)..(9): Xaa can be Ala, Ser, Leu, Gly, Cys, Thr, Met, Val, Tyr, Ile, Pro, or Phe
LXHSAANDX

SEQ ID NO: 197507 - protein, 10 aa, Artificial Sequence
  Description of Artificial Sequence: Synthetic peptide
  Seed: LPHSAANDPI (TYRP2_HUMAN)
  misc_feature (2)..(2): Xaa can be , or Pro
  misc_feature (10)..(10): Xaa can be Pro, Trp, Thr, Met, Ala, Leu, Gly, Cys, Ile, Val, Tyr, Arg, Ser, or Phe
LXHSAANDPX

SEQ ID NO: 197508 - protein, 11 aa, Artificial Sequence
  Description of Artificial Sequence: Synthetic peptide
  Seed: LPHSAANDPIF (TYRP2_HUMAN)
  misc_feature (2)..(2): Xaa can be Pro, Ser, Thr, Met, Gln, Val, Ala, Lys, Leu, Phe, Tyr, Trp, Asp, Ile, Asn, Glu, Arg, Gly, His, or Cys
  misc_feature (11)..(11): Xaa can be Phe, Trp, Tyr, Met, Ser, Ile, Ala, Gly, Pro, Val, Leu, Cys, or Thr
LXHSAANDPIX

SEQ ID NO: 197509 - protein, 11 aa, Artificial Sequence
  Description of Artificial Sequence: Synthetic peptide
  Seed: LPTLKDIRDCL (TYRP2_HUMAN)
  misc_feature (2)..(2): Xaa can be , or Pro
  misc_feature (11)..(11): Xaa can be Leu, or Met
LXTLKDIRDCX

SEQ ID NO: 197510 - protein, 8 aa, Artificial Sequence
  Description of Artificial Sequence: Synthetic peptide
  Seed: LPVSVEET (TYRP2_HUMAN)
  misc_feature (2)..(2): Xaa can be , or Pro
  misc_feature (8)..(8): Xaa can be Met, Val, Ala, Thr, Leu, or Ile
LXVSVEEX

SEQ ID NO: 197511 - protein, 9 aa, Artificial Sequence
  Description of Artificial Sequence: Synthetic peptide
  Seed: LPVSVEETP (TYRP2_HUMAN)
  misc_feature (2)..(2): Xaa can be Pro, Ala, or Val
  misc_feature (9)..(9): Xaa can be Met, Leu, Phe, Ala, Val, Ile, His, Trp, Lys, Gly, Pro, Arg, Ser, Tyr, Thr, Cys, or Gln
LXVSVEETX

SEQ ID NO: 197512 - protein, 10 aa, Artificial Sequence
  Description of Artificial Sequence: Synthetic peptide
  Seed: LPVSVEETPG (TYRP2_HUMAN)
  misc_feature (2)..(2): Xaa can be , or Pro
  misc_feature (10)..(10): Xaa can be Ile, Pro, Met, Ala, Phe, Ser, Gly, Cys, Val, Thr, Leu, or Tyr
LXVSVEETPX

SEQ ID NO: 197513 - protein, 11 aa, Artificial Sequence
  Description of Artificial Sequence: Synthetic peptide
  Seed: LPVSVEETPGW (TYRP2_HUMAN)
  misc_feature (2)..(2): Xaa can be Pro, Thr, Ser, Gly, Gln, Ile, Cys, Asn, Arg, Trp, Leu, Tyr, His, Glu, Asp, Val, Phe, Ala, Met, or Lys
  misc_feature (11)..(11): Xaa can be Trp, Tyr, Phe, Met, or Leu
LXVSVEETPGX

SEQ ID NO: 197514 - protein, 9 aa, Artificial Sequence
  Description of Artificial Sequence: Synthetic peptide
  Seed: LQKFDNPPF (TYRP2_HUMAN)
  misc_feature (2)..(2): Xaa can be Met, Ala, Gln, Ser, Lys, Leu, Thr, Gly, Ile, Val, Glu, Pro, Arg, His, Phe, Tyr, Cys, Trp, Asn, or Asp
  misc_feature (9)..(9): Xaa can be Phe, Tyr, Met, Leu, His, Ile, Trp, Val, or Ala
LXKFDNPPX

SEQ ID NO: 197515 - protein, 10 aa, Artificial Sequence
  Description of Artificial Sequence: Synthetic peptide
  Seed: LQKFDNPPFF (TYRP2_HUMAN)
  misc_feature (2)..(2): Xaa can be Met, Gln, Leu, Val, Cys, Tyr, Trp, Arg, Asp, Ile, His, Ser, Glu, Asn, Ala, Lys, Phe, Gly, Pro, or Thr
  misc_feature (10)..(10): Xaa can be Met, Phe, Tyr, Trp, Asp, Leu, Thr, Asn, Val, Ile, Cys, Ala, Glu, Arg, Gly, His, Ser, Lys, Pro, or Gln
LXKFDNPPFX

SEQ ID NO: 197516 - protein, 10 aa, Artificial Sequence
  Description of Artificial Sequence: Synthetic peptide
  Seed: LQRLIGNESF (TYRP2_HUMAN)
  misc_feature (2)..(2): Xaa can be Arg, Gln, Leu, Met, Ser, Thr, Lys, Ala, Glu, His, Pro, Asn, Phe, Cys, Gly, Trp, Tyr, Ile, Val, or Asp
  misc_feature (10)..(10): Xaa can be Leu, Met, Ile, Phe, Tyr, Trp, Lys, Val, or Arg
LXRLIGNESX

SEQ ID NO: 197517 - protein, 10 aa, Artificial Sequence
  Description of Artificial Sequence: Synthetic peptide
  Seed: LQYRRLRKGY (TYRP2_HUMAN)
  misc_feature (2)..(2): Xaa can be Gln, Leu, Met, Lys, Ser, Val, Thr, or His
  misc_feature (10)..(10): Xaa can be Tyr, Phe, or Met
LXYRRLRKGX

SEQ ID NO: 197518 - protein, 8 aa, Artificial Sequence
  Description of Artificial Sequence: Synthetic peptide
  Seed: LRKGYTPL (TYRP2_HUMAN)
  misc_feature (2)..(2): Xaa can be Arg, or His
  misc_feature (8)..(8): Xaa can be Leu, Tyr, or Phe
LXKGYTPX

SEQ ID NO: 197519 - protein, 9 aa, Artificial Sequence
  Description of Artificial Sequence: Synthetic peptide
  Seed: LRKGYTPLM (TYRP2_HUMAN)
  misc_feature (2)..(2): Xaa can be Arg, Gln, His, Met, Ala, Tyr, Thr, Ser, Phe, Gly, Glu, Trp, Asp, Ile, Pro, Val, Asn, Lys, or Leu
  misc_feature (9)..(9): Xaa can be Tyr, Phe, Met, Leu, Ile, Val, Trp, Ala, His, Lys, Arg, Thr, Gln, or Cys
LXKGYTPLX

SEQ ID NO: 197520 - protein, 9 aa, Artificial Sequence
  Description of Artificial Sequence: Synthetic peptide
  Seed: LRNQDDREL (TYRP2_HUMAN)
  misc_feature (2)..(2): Xaa can be Arg, Gln, His, Phe, Tyr, Ala, Ser, Val, Met, Trp, Thr, Gly, Glu, Asn, Leu, Ile, or Asp
  misc_feature (9)..(9): Xaa can be Leu, Met, Phe, Tyr, Ile, Val, Lys, Trp, or Arg
LXNQDDREX

SEQ ID NO: 197521 - protein, 10 aa, Artificial Sequence
  Description of Artificial Sequence: Synthetic peptide
  Seed: LRNQDDRELW (TYRP2_HUMAN)
  misc_feature (2)..(2): Xaa can be Arg, Ser, Thr, Gly, Met, Val, Ala, Gln, Glu, Cys, Ile, Leu, Phe, Asp, Tyr, Pro, Trp, His, Lys, or Asn
  misc_feature (10)..(10): Xaa can be Trp, Leu, Phe, Tyr, Lys, Met, Ile, Val, or Arg
LXNQDDRELX

SEQ ID NO: 197522 - protein, 11 aa, Artificial Sequence
  Description of Artificial Sequence: Synthetic peptide
  Seed: LRRNQMGRNSM (TYRP2_HUMAN)
  misc_feature (2)..(2): Xaa can be , or Arg
  misc_feature (11)..(11): Xaa can be Val, Ile, Met, Trp, Lys, Arg, Leu, Phe, or Tyr
LXRNQMGRNSX

SEQ ID NO: 197523 - protein, 8 aa, Artificial Sequence
  Description of Artificial Sequence: Synthetic peptide
  Seed: LSCLGCKI (TYRP2_HUMAN)
  misc_feature (2)..(2): Xaa can be Ala, Ser, Thr, Leu, Cys, Gly, Gln, Met, Ile, Asn, or Val
  misc_feature (8)..(8): Xaa can be Trp, Ile, Leu, Phe, Val, or Met
LXCLGCKX

SEQ ID NO: 197524 - protein, 9 aa, Artificial Sequence
  Description of Artificial Sequence: Synthetic peptide
  Seed: LSCLGCKIL (TYRP2_HUMAN)
  misc_feature (2)..(2): Xaa can be Ala, Arg, Thr, Ser, Val, Leu, Ile, Gly, Met, Gln, Asn, Tyr, Cys, Pro, Glu, Asp, Phe, Lys, or Trp
  misc_feature (9)..(9): Xaa can be Trp, Leu, Phe, Tyr, Met, Ile, Val, Arg, Lys, or His
LXCLGCKIX

SEQ ID NO: 197525 - protein, 11 aa, Artificial Sequence
  Description of Artificial Sequence: Synthetic peptide
  Seed: LSLQKFDNPPF (TYRP2_HUMAN)
  misc_feature (2)..(2): Xaa can be Met, Ala, Gly, Val, Gln, Thr, Ser, Arg, Tyr, Lys, Trp, Leu, Ile, His, Phe, Asn, Pro, Asp, Cys, or Glu
  misc_feature (11)..(11): Xaa can be Met, Tyr, Phe, Trp, or Leu
LXLQKFDNPPX

SEQ ID NO: 197526 - protein, 9 aa, Artificial Sequence
  Description of Artificial Sequence: Synthetic peptide
  Seed: LSPQEREQF (TYRP2_HUMAN)
  misc_feature (2)..(2): Xaa can be Ala, Val, Tyr, Ser, Gly, Phe, Ile, Met, Trp, Gln, Thr, Leu, Cys, Arg, Glu, Asn, His, Pro, Asp, or Lys
  misc_feature (9)..(9): Xaa can be Tyr, Leu, Met, Phe, Trp, Ile, Val, Lys, His, Ala, Cys, or Arg
LXPQEREQX

SEQ ID NO: 197527 - protein, 10 aa, Artificial Sequence
  Description of Artificial Sequence: Synthetic peptide
  Seed: LSPQEREQFL (TYRP2_HUMAN)
  misc_feature (2)..(2): Xaa can be Val, Ala, Thr, Met, Ile, Ser, Leu, Cys, Asn, Gln, Asp, Gly, Phe, Glu, Lys, His, Arg, Tyr, Trp, or Pro
  misc_feature (10)..(10): Xaa can be Leu, Trp, Phe, Met, or Tyr
LXPQEREQFX

SEQ ID NO: 197528 - protein, 8 aa, Artificial Sequence
  Description of Artificial Sequence: Synthetic peptide
  Seed: LTSDQLGY (TYRP2_HUMAN)
  misc_feature (2)..(2): Xaa can be Ile, Ser, Thr, Val, or Ala
  misc_feature (8)..(8): Xaa can be Lys, or Tyr
LXSDQLGX

SEQ ID NO: 197529 - protein, 10 aa, Artificial Sequence
  Description of Artificial Sequence: Synthetic peptide
  Seed: LTSDQLGYSY (TYRP2_HUMAN)
  misc_feature (2)..(2): Xaa can be Ser, Thr, Pro, Ala, Val, Ile, Leu, Met, Gln, Phe, Gly, Glu, Cys, Tyr, Asn, His, Trp, Asp, Arg, or Lys
  misc_feature (10)..(10): Xaa can be Tyr, Trp, Phe, Lys, Met, Leu, Arg, His, Val, Ile, Cys, or Ala
LXSDQLGYSX

SEQ ID NO: 197530 - protein, 9 aa, Artificial Sequence
  Description of Artificial Sequence: Synthetic peptide
  Seed: LVALVGLFV (TYRP2_HUMAN)
  misc_feature (2)..(2): Xaa can be Met, Thr, Gln, Leu, Ala, Ile, Val, Ser, Gly, Asn, Glu, or Cys
  misc_feature (9)..(9): Xaa can be Leu, Val, Ile, Met, Ala, Phe, Thr, or Ser
LXALVGLFX

SEQ ID NO: 197531 - protein, 10 aa, Artificial Sequence
  Description of Artificial Sequence: Synthetic peptide
  Seed: LVALVGLFVL (TYRP2_HUMAN)
  misc_feature (2)..(2): Xaa can be Met, Leu, Ile, Gln, Val, Thr, Ala, or Ser
  misc_feature (10)..(10): Xaa can be Val, Ile, Leu, Ala, Met, Ser, Thr, Pro, Gly, Tyr, Cys, Arg, Trp, Lys, Phe, Gln, His, Asn, Asp, or Glu
LXALVGLFVX

SEQ ID NO: 197532 - protein, 8 aa, Artificial Sequence
  Description of Artificial Sequence: Synthetic peptide
  Seed: LVGLFVLL (TYRP2_HUMAN)
  misc_feature (2)..(2): Xaa can be Ala, Ser, Thr, Val, Ile, or Gly
  misc_feature (8)..(8): Xaa can be Leu, Val, Ile, or Met
LXGLFVLX

SEQ ID NO: 197533 - protein, 9 aa, Artificial Sequence
  Description of Artificial Sequence: Synthetic peptide
  Seed: LVGLFVLLA (TYRP2_HUMAN)
  misc_feature (2)..(2): Xaa can be Met, Leu, Ile, Val, Gln, Thr, Ala, or Ser
  misc_feature (9)..(9): Xaa can be Val, Leu, Ile, Met, Ala, Thr, or Cys
LXGLFVLLX

SEQ ID NO: 197534 - protein, 10 aa, Artificial Sequence
  Description of Artificial Sequence: Synthetic peptide
  Seed: LVGLFVLLAF (TYRP2_HUMAN)
  misc_feature (2)..(2): Xaa can be Gln, Met, Val, Ala, Ser, Leu, Ile, or Thr
  misc_feature (10)..(10): Xaa can be Tyr, Phe, Met, or Leu
LXGLFVLLAX

SEQ ID NO: 197535 - protein, 9 aa, Artificial Sequence
  Description of Artificial Sequence: Synthetic peptide
  Seed: LVHSFLNGT (TYRP2_HUMAN)
  misc_feature (2)..(2): Xaa can be Met, Leu, Gln, Ile, Val, Thr, Ala, Ser, Asn, Glu, Gly, or Cys
  misc_feature (9)..(9): Xaa can be Val, Ala, Ile, Leu, Met, Thr, Cys, or Phe
LXHSFLNGX

SEQ ID NO: 197536 - protein, 9 aa, Artificial Sequence
  Description of Artificial Sequence: Synthetic peptide
  Seed: LVNKECCPR (TYRP2_HUMAN)
  misc_feature (2)..(2): Xaa can be Tyr, Trp, Gln, Ala, Gly, Ser, Asn, Leu, Met, Ile, Thr, Phe, Val, or Pro
  misc_feature (9)..(9): Xaa can be Arg, or Lys
LXNKECCPX

SEQ ID NO: 197537 - protein, 9 aa, Artificial Sequence
  Description of Artificial Sequence: Synthetic peptide
  Seed: LVTLCNGTY (TYRP2_HUMAN)
  misc_feature (2)..(2): Xaa can be Pro, Ala, Gln, Ser, Thr, Val, Met, Leu, Lys, Ile, Arg, Gly, His, Glu, Asn, Tyr, Phe, Asp, Trp, or Cys
  misc_feature (9)..(9): Xaa can be Tyr, Phe, Met, Trp, Leu, Ile, Val, His, Lys, or Ala
LXTLCNGTX

SEQ ID NO: 197538 - protein, 9 aa, Artificial Sequence
  Description of Artificial Sequence: Synthetic peptide
  Seed: LVVMGTLVA (TYRP2_HUMAN)
  misc_feature (2)..(2): Xaa can be Pro, Val, or Ala
  misc_feature (9)..(9): Xaa can be Ala, Tyr, His, Gly, Lys, Glu, Leu, Cys, Pro, Ser, Gln, Val, Phe, Thr, Arg, Ile, or Met
LXVMGTLVX

SEQ ID NO: 197539 - protein, 10 aa, Artificial Sequence
  Description of Artificial Sequence: Synthetic peptide
  Seed: LVVMGTLVAL (TYRP2_HUMAN)
  misc_feature (2)..(2): Xaa can be Leu, Met, Ala, Gln, Gly, Ser, Thr, Glu, Ile, Tyr, Lys, Trp, Cys, Asn, Val, Asp, Arg, Pro, His, or Phe
  misc_feature (10)..(10): Xaa can be Phe, Ala, Tyr, Met, Leu, Thr, Val, Ile, Ser, His, Trp, Cys, Lys, Pro, Gly, or Arg
LXVMGTLVAX

SEQ ID NO: 197540 - protein, 11 aa, Artificial Sequence
  Description of Artificial Sequence: Synthetic peptide
  Seed: LVVMGTLVALV (TYRP2_HUMAN)
  misc_feature (2)..(2): Xaa can be Gln, Met, Leu, Phe, Tyr, Ser, Arg, Ile, Lys, Ala, His, Glu, Trp, Cys, Val, Thr, Pro, Asn, Gly, or Asp
  misc_feature (11)..(11): Xaa can be Leu, Val, Ile, Ala, Met, Ser, Arg, Gly, Trp, Pro, Cys, His, Asn, Glu, Lys, Tyr, Phe, Thr, Asp, or Gln
LXVMGTLVALX

SEQ ID NO: 197541 - protein, 9 aa, Artificial Sequence
  Description of Artificial Sequence: Synthetic peptide
  Seed: LWPRKFFHR (TYRP2_HUMAN)
  misc_feature (2)..(2): Xaa can be Ala, Phe, Gln, Gly, Thr, Ser, Trp, Leu, Tyr, Ile, Met, Val, His, Cys, Asp, Asn, Pro, or Gl u
  misc_feature (9)..(9): Xaa can be Arg, or Lys
LXPRKFFHX

SEQ ID NO: 197542 - protein, 10 aa, Artificial Sequence
  Description of Artificial Sequence: Synthetic peptide
  Seed: LWWGFLLSCL (TYRP2_HUMAN)
  misc_feature (2)..(2): Xaa can be Tyr, Trp, or Phe
  misc_feature (10)..(10): Xaa can be Phe, Trp, Leu, Tyr, Met, or Ile
LXWGFLLSCX

SEQ ID NO: 197543 - protein, 9 aa, Artificial Sequence
  Description of Artificial Sequence: Synthetic peptide
  Seed: METHLSSKR (TYRP2_HUMAN)
  misc_feature (2)..(2): Xaa can be Val, Thr, Tyr, Ala, Phe, Ser, Pro, Ile, Cys, Gln, Leu, Gly, Glu, Trp, Asp, Met, His, or As n
  misc_feature (9)..(9): Xaa can be Arg, Lys, Met, Tyr, or Leu
MXTHLSSKX

SEQ ID NO: 197544 - protein, 10 aa, Artificial Sequence
  Description of Artificial Sequence: Synthetic peptide
  Seed: METHLSSKRY (TYRP2_HUMAN)
  misc_feature (2)..(2): Xaa can be Glu, Ser, Thr, Gln, Ala, Lys, Met, Leu, Val, Tyr, Ile, Pro, Arg, His, Cys, Asp, Gly, Phe, Trp, or Asn
  misc_feature (10)..(10): Xaa can be Trp, Phe, Tyr, Met, Leu, or Ile
MXTHLSSKRX

SEQ ID NO: 197545 - protein, 10 aa, Artificial Sequence
  Description of Artificial Sequence: Synthetic peptide
  Seed: MGRNSMKLPT (TYRP2_HUMAN)
  misc_feature (2)..(2): Xaa can be Ser, Thr, Val, Tyr, Met, Ala, Ile, Phe, Gln, Gly, Leu, Trp, Asn, Cys, Lys, Arg, or His
  misc_feature (10)..(10): Xaa can be Lys, Ala, Leu, Val, Met, Ile, Ser, Gly, Tyr, Thr, Arg, Pro, Phe, Asn, Gln, Cys, Glu, or Hi s
MXRNSMKLPX

SEQ ID NO: 197546 - protein, 8 aa, Artificial Sequence
  Description of Artificial Sequence: Synthetic peptide
  Seed: MGTLVALV (TYRP2_HUMAN)
  misc_feature (2)..(2): Xaa can be Gln, Ala, Asp, Glu, Ser, Asn, Gly, or Met
  misc_feature (8)..(8): Xaa can be Ile, Val, Leu, Met, or Phe
MXTLVALX

SEQ ID NO: 197547 - protein, 10 aa, Artificial Sequence
  Description of Artificial Sequence: Synthetic peptide
  Seed: MGTLVALVGL (TYRP2_HUMAN)
  misc_feature (2)..(2): Xaa can be Arg, Gln, Leu, Met, Val, Thr, Ile, Ala, Asn, Ser, Gly, Pro, Asp, His, Glu, Phe, Lys, Tyr, Cys, or Trp
  misc_feature (10)..(10): Xaa can be Val, Leu, Ile, Ala, Met, Thr, Phe, His, Trp, Arg, Tyr, or Lys
MXTLVALVGX

SEQ ID NO: 197548 - protein, 10 aa, Artificial Sequence
  Description of Artificial Sequence: Synthetic peptide
  Seed: MSLHNLVHSF (TYRP2_HUMAN)
  misc_feature (2)..(2): Xaa can be Pro, Gln, Thr, Ala, Ser, Tyr, Trp, Met, Val, Lys, Phe, Leu, Ile, Cys, His, Asn, Arg, Gly, Asp, or Glu
  misc_feature (10)..(10): Xaa can be Met, Phe, Trp, Tyr, Leu, Ile, Val, His, Ala, or Cys
MXLHNLVHSX

SEQ ID NO: 197549 - protein, 11 aa, Artificial Sequence
  Description of Artificial Sequence: Synthetic peptide
  Seed: MSLHNLVHSFL (TYRP2_HUMAN)
  misc_feature (2)..(2): Xaa can be Leu, Met, Ser, Thr, Val, Ala, Phe, Ile, Gln, Tyr, Gly, Lys, Trp, Arg, Cys, Pro, or Asn
  misc_feature (11)..(11): Xaa can be Val, Trp, Leu, Ile, Met, Ala, Phe, Tyr, or Thr
MXLHNLVHSFX

SEQ ID NO: 197550 - protein, 8 aa, Artificial Sequence
  Description of Artificial Sequence: Synthetic peptide
  Seed: MSPLWWGF (TYRP2_HUMAN)
  misc_feature (2)..(2): Xaa can be Ser, Thr, Ala, Gly, Met, or Val
  misc_feature (8)..(8): Xaa can be Trp, or Phe
MXPLWWGX

SEQ ID NO: 197551 - protein, 9 aa, Artificial Sequence
  Description of Artificial Sequence: Synthetic peptide
  Seed: MSPLWWGFL (TYRP2_HUMAN)
  misc_feature (2)..(2): Xaa can be Tyr, Val, Thr, Ser, Ala, Trp, Phe, Met, Leu, Gly, Ile, Gln, His, Asn, Cys, Arg, or Pro
  misc_feature (9)..(9): Xaa can be Phe, Trp, Leu, Val, Ile, Met, Tyr, Ala, Thr, or Gly
MXPLWWGFX

SEQ ID NO: 197552 - protein, 10 aa, Artificial Sequence
  Description of Artificial Sequence: Synthetic peptide
  Seed: MSPLWWGFLL (TYRP2_HUMAN)
  misc_feature (2)..(2): Xaa can be Tyr, Trp, Met, Leu, Val, Gln, Gly, His, Cys, Glu, Arg, Asn, Asp, Phe, Thr, Pro, Ser, Lys, Ile, or Ala
  misc_feature (10)..(10): Xaa can be Cys, Trp, Ala, Pro, Val, Thr, Ile, Ser, Met, Tyr, Phe, His, Leu, Gly, Glu, Asn, Asp, Lys, or Arg
MXPLWWGFLX

SEQ ID NO: 197553 - protein, 9 aa, Artificial Sequence
  Description of Artificial Sequence: Synthetic peptide
  Seed: MTVDSLVNK (TYRP2_HUMAN)
  misc_feature (2)..(2): Xaa can be Thr, Ala, Val, Ser, Met, Leu, Ile, Gln, Gly, Asn, Phe, Tyr, Cys, Pro, Glu, Trp, Lys, Arg, Asp, or His
  misc_feature (9)..(9): Xaa can be Tyr, Arg, Lys, Phe, Met, Leu, Val, Ile, Trp, His, Ala, Thr, Ser, Gln, Cys, or Glu
MXVDSLVNX

SEQ ID NO: 197554 - protein, 10 aa, Artificial Sequence
  Description of Artificial Sequence: Synthetic peptide
  Seed: MTVDSLVNKE (TYRP2_HUMAN)
  misc_feature (2)..(2): Xaa can be Val, Thr, Ala, Ile, Ser, Met, His, Asn, Glu, Trp, Pro, Tyr, Lys, Leu, Arg, Gln, Phe, Asp, Cys, or Gly
  misc_feature (10)..(10): Xaa can be Lys, Arg, Tyr, His, Met, Phe, Ala, Gly, Gln, Pro, Asn, Cys, Val, Asp, Thr, Leu, Trp, Ser, Glu, or Ile
MXVDSLVNKX

SEQ ID NO: 197555 - protein, 8 aa, Artificial Sequence
  Description of Artificial Sequence: Synthetic peptide
  Seed: MVPFFPPV (TYRP2_HUMAN)
  misc_feature (2)..(2): Xaa can be Leu, Gln, Met, Trp, Glu, Tyr, Ile, Ala, Val, Phe, Asn, Pro, Thr, Asp, His, Gly, or Ser
  misc_feature (8)..(8): Xaa can be Val, Ile, Leu, Ala, Met, Thr, or Phe
MXPFFPPX

SEQ ID NO: 197556 - protein, 9 aa, Artificial Sequence
  Description of Artificial Sequence: Synthetic peptide
  Seed: MVPFFPPVT (TYRP2_HUMAN)
  misc_feature (2)..(2): Xaa can be Val, Thr, Ala, Ile, Met, Leu, Ser, Pro, or Phe
  misc_feature (9)..(9): Xaa can be Val, Ile, Ala, Leu, Met, or Thr
MXPFFPPVX

SEQ ID NO: 197557 - protein, 8 aa, Artificial Sequence
  Description of Artificial Sequence: Synthetic peptide
  Seed: MYNMVPFF (TYRP2_HUMAN)
  misc_feature (2)..(2): Xaa can be Tyr, Trp, Phe, or Arg
  misc_feature (8)..(8): Xaa can be Leu, Phe, Met, Trp, Tyr, Ile, or Val
MXNMVPFX

SEQ ID NO: 197558 - protein, 11 aa, Artificial Sequence
  Description of Artificial Sequence: Synthetic peptide
  Seed: MYNMVPFFPPV (TYRP2_HUMAN)
  misc_feature (2)..(2): Xaa can be Phe, Met, Tyr, Trp, Leu, Gln, Ser, Thr, Gly, His, Ala, Asn, Ile, Pro, Asp, Lys, Val, Arg, Glu, or Cys
  misc_feature (11)..(11): Xaa can be Ile, Val, Ala, Leu, Met, Thr, Phe, Trp, Tyr, or Cys
MXNMVPFFPPX

SEQ ID NO: 197559 - protein, 8 aa, Artificial Sequence
  Description of Artificial Sequence: Synthetic peptide
  Seed: NALEGFDK (TYRP2_HUMAN)
  misc_feature (2)..(2): Xaa can be Ala, Val, Ile, Ser, Gly, Leu, or Thr
  misc_feature (8)..(8): Xaa can be Lys, Arg, or Leu
NXLEGFDX

SEQ ID NO: 197560 - protein, 9 aa, Artificial Sequence
  Description of Artificial Sequence: Synthetic peptide
  Seed: NALEGFDKA (TYRP2_HUMAN)
  misc_feature (2)..(2): Xaa can be Pro, Leu, Met, Ala, Thr, Gln, Val, Ser, Ile, Gly, Phe, Glu, Cys, or Asn
  misc_feature (9)..(9): Xaa can be Val, Leu, Ile, Met, Ala, Thr, Phe, Cys, Tyr, Gly, Ser, or Pro
NXLEGFDKX

SEQ ID NO: 197561 - protein, 8 aa, Artificial Sequence
  Description of Artificial Sequence: Synthetic peptide
  Seed: NALPHSAA (TYRP2_HUMAN)
  misc_feature (2)..(2): Xaa can be Pro, or Ala
  misc_feature (8)..(8): Xaa can be Ala, Ser, Cys, Phe, Pro, Thr, Gly, Tyr, Met, Val, Ile, or Leu
NXLPHSAX

SEQ ID NO: 197562 - protein, 9 aa, Artificial Sequence
  Description of Artificial Sequence: Synthetic peptide
  Seed: NCGDCKFGW (TYRP2_HUMAN)
  misc_feature (2)..(2): Xaa can be Ala, Ser, Thr, Ile, Gln, Met, Cys, Val, Pro, Trp, Phe, Leu, Asn, or Gly
  misc_feature (9)..(9): Xaa can be Trp, or Phe
NXGDCKFGX

SEQ ID NO: 197563 - protein, 10 aa, Artificial Sequence
  Description of Artificial Sequence: Synthetic peptide
  Seed: NCSVYDFFVW (TYRP2_HUMAN)
  misc_feature (2)..(2): Xaa can be Tyr, Arg, Met, Lys, Ala, Leu, Thr, Ile, His, Val, Ser, Glu, Asp, Asn, Trp, Gly, Gln, Cys, Phe, or Pro
  misc_feature (10)..(10): Xaa can be Trp, Phe, or Tyr
NXSVYDFFVX

SEQ ID NO: 197564 - protein, 8 aa, Artificial Sequence
  Description of Artificial Sequence: Synthetic peptide
  Seed: NDPIFVVL (TYRP2_HUMAN)
  misc_feature (2)..(2): Xaa can be Glu, Asp, Ala, Arg, Gln, Thr, Tyr, Ser, Gly, His, Phe, Asn, Met, Val, or Ile
  misc_feature (8)..(8): Xaa can be Leu, Met, Ile, Phe, Val, or Ala
NXPIFVVX

SEQ ID NO: 197565 - protein, 10 aa, Artificial Sequence
  Description of Artificial Sequence: Synthetic peptide
  Seed: NECDVCTDQL (TYRP2_HUMAN)
  misc_feature (2)..(2): Xaa can be Glu, His, Gln, Arg, Lys, Met, Thr, Tyr, Asp, Ser, Ala, Val, or Leu
  misc_feature (10)..(10): Xaa can be Trp, Leu, Phe, Val, Ile, Met, Tyr, Cys, Pro, Thr, Gly, Ser, or Ala
NXCDVCTDQX

SEQ ID NO: 197566 - protein, 11 aa, Artificial Sequence
  Description of Artificial Sequence: Synthetic peptide
  Seed: NECDVCTDQLF (TYRP2_HUMAN)
  misc_feature (2)..(2): Xaa can be Glu, Leu, Gln, Met, Val, Ile, Ala, Pro, Lys, Thr, Asp, or Ser
  misc_feature (11)..(11): Xaa can be Tyr, Phe, Trp, Cys, Ala, Met, Leu, Ile, Val, Pro, Lys, or Thr
NXCDVCTDQLX

SEQ ID NO: 197567 - protein, 8 aa, Artificial Sequence
  Description of Artificial Sequence: Synthetic peptide
  Seed: NEELFLTS (TYRP2_HUMAN)
  misc_feature (2)..(2): Xaa can be Glu, or Asp
  misc_feature (8)..(8): Xaa can be Ile, Leu, Ala, Val, Pro, Gly, Ser, Thr, Phe, Cys, or Met
NXELFLTX

SEQ ID NO: 197568 - protein, 9 aa, Artificial Sequence
  Description of Artificial Sequence: Synthetic peptide
  Seed: NEELFLTSD (TYRP2_HUMAN)
  misc_feature (2)..(2): Xaa can be Glu, Asp, or Gln
  misc_feature (9)..(9): Xaa can be Cys, Val, Leu, Ala, Ile, Pro, Met, Thr, Glu, Phe, Gly, Tyr, Asp, or Ser
NXELFLTSX

SEQ ID NO: 197569 - protein, 11 aa, Artificial Sequence
  Description of Artificial Sequence: Synthetic peptide
  Seed: NEELFLTSDQL (TYRP2_HUMAN)
  misc_feature (2)..(2): Xaa can be , or Glu
  misc_feature (11)..(11): Xaa can be Met, Ile, Phe, Val, Ala, Leu, or Cys
NXELFLTSDQX

SEQ ID NO: 197570 - protein, 8 aa, Artificial Sequence
  Description of Artificial Sequence: Synthetic peptide
  Seed: NESFALPY (TYRP2_HUMAN)
  misc_feature (2)..(2): Xaa can be , or Glu
  misc_feature (8)..(8): Xaa can be Ala, Ile, Phe, Trp, His, Leu, Met, Val, or Tyr
NXSFALPX

SEQ ID NO: 197571 - protein, 9 aa, Artificial Sequence
  Description of Artificial Sequence: Synthetic peptide
  Seed: NESFALPYW (TYRP2_HUMAN)
  misc_feature (2)..(2): Xaa can be Glu, Ser, Thr, Gln, Ala, Lys, Met, Leu, Val, Cys, Pro, Gly, Trp, Ile, Asp, Tyr, Phe, or As n
  misc_feature (9)..(9): Xaa can be Trp, Tyr, Phe, Val, Ile, Met, Leu, or His
NXSFALPYX

SEQ ID NO: 197572 - protein, 10 aa, Artificial Sequence
  Description of Artificial Sequence: Synthetic peptide
  Seed: NESFALPYWN (TYRP2_HUMAN)
  misc_feature (2)..(2): Xaa can be , or Glu
  misc_feature (10)..(10): Xaa can be Gly, Ala, Phe, Val, Lys, Asp, Glu, Pro, Met, Ser, Ile, Asn, His, Cys, Thr, Arg, Leu, Tyr, Gln, or Trp
NXSFALPYWX

SEQ ID NO: 197573 - protein, 11 aa, Artificial Sequence
  Description of Artificial Sequence: Synthetic peptide
  Seed: NESFALPYWNF (TYRP2_HUMAN)
  misc_feature (2)..(2): Xaa can be , or Glu
  misc_feature (11)..(11): Xaa can be Phe, Trp, or Tyr
NXSFALPYWNX

SEQ ID NO: 197574 - protein, 11 aa, Artificial Sequence
  Description of Artificial Sequence: Synthetic peptide
  Seed: NFAGYNCGDCK (TYRP2_HUMAN)
  misc_feature (2)..(2): Xaa can be Thr, Ala, Asn, Gly, Gln, Ile, Met, Ser, Val, Leu, Phe, Glu, Asp, Trp, or Cys
  misc_feature (11)..(11): Xaa can be Lys, or Arg
NXAGYNCGDCX

SEQ ID NO: 197575 - protein, 9 aa, Artificial Sequence
  Description of Artificial Sequence: Synthetic peptide
  Seed: NGTYEGLLR (TYRP2_HUMAN)
  misc_feature (2)..(2): Xaa can be Ala, Thr, Val, Ile, Asn, Asp, Gln, Pro, Tyr, Met, Gly, Ser, Phe, Leu, Glu, or Trp
  misc_feature (9)..(9): Xaa can be Lys, Arg, Tyr, His, Met, Phe, or Leu
NXTYEGLLX

SEQ ID NO: 197576 - protein, 10 aa, Artificial Sequence
  Description of Artificial Sequence: Synthetic peptide
  Seed: NGTYEGLLRR (TYRP2_HUMAN)
  misc_feature (2)..(2): Xaa can be Val, Ser, Leu, Cys, Ile, Lys, Glu, Met, Arg, Gln, Asn, Ala, Trp, Asp, Pro, Tyr, Phe, His, Thr, or Gly
  misc_feature (10)..(10): Xaa can be Tyr, Arg, Lys, or His
NXTYEGLLRX

SEQ ID NO: 197577 - protein, 11 aa, Artificial Sequence
  Description of Artificial Sequence: Synthetic peptide
  Seed: NHLVTLCNGTY (TYRP2_HUMAN)
  misc_feature (2)..(2): Xaa can be , or His
  misc_feature (11)..(11): Xaa can be Phe, or Tyr
NXLVTLCNGTX

SEQ ID NO: 197578 - protein, 10 aa, Artificial Sequence
  Description of Artificial Sequence: Synthetic peptide
  Seed: NIHSLSPQER (TYRP2_HUMAN)
  misc_feature (2)..(2): Xaa can be Ala, Val, Ser, Thr, Leu, Tyr, Gly, Glu, Asn, Trp, Ile, Gln, Phe, Met, Asp, Cys, or Pro
  misc_feature (10)..(10): Xaa can be Arg, Lys, Leu, Tyr, Phe, or Met
NXHSLSPQEX

SEQ ID NO: 197579 - protein, 10 aa, Artificial Sequence
  Description of Artificial Sequence: Synthetic peptide
  Seed: NLVHSFLNGT (TYRP2_HUMAN)
  misc_feature (2)..(2): Xaa can be Met, Leu, Ile, Val, Gln, Tyr, Phe, Thr, Asp, Glu, His, Asn, Ser, Gly, Pro, Cys, Arg, Trp, Ala, or Lys
  misc_feature (10)..(10): Xaa can be Val, Ile, Ala, Leu, Thr, or Met
NXVHSFLNGX

SEQ ID NO: 197580 - protein, 9 aa, Artificial Sequence
  Description of Artificial Sequence: Synthetic peptide
  Seed: NMVPFFPPV (TYRP2_HUMAN)
  misc_feature (2)..(2): Xaa can be Leu, Met, Thr, Gln, Tyr, Ile, Val, Ser, Ala, Phe, Glu, Pro, Gly, Asn, Trp, Lys, Cys, Arg, Asp, or His
  misc_feature (9)..(9): Xaa can be Phe, Leu, Met, Val, Tyr, Ile, Arg, Lys, Ala, His, Cys, Trp, Thr, Ser, Gly, or Pro
NXVPFFPPX

SEQ ID NO: 197581 - protein, 10 aa, Artificial Sequence
  Description of Artificial Sequence: Synthetic peptide
  Seed: NMVPFFPPVT (TYRP2_HUMAN)
  misc_feature (2)..(2): Xaa can be Ile, Leu, Thr, Val, Gln, Met, Ser, Phe, or Ala
  misc_feature (10)..(10): Xaa can be Val, Ile, Ala, Arg, Met, Asn, Ser, Lys, Phe, Glu, Pro, Trp, His, Gln, Asp, Tyr, Cys, Thr, Gly, or Leu
NXVPFFPPVX

SEQ ID NO: 197582 - protein, 11 aa, Artificial Sequence
  Description of Artificial Sequence: Synthetic peptide
  Seed: NPPADAWPQEL (TYRP2_HUMAN)
  misc_feature (2)..(2): Xaa can be Pro, or Ala
  misc_feature (11)..(11): Xaa can be Tyr, Phe, Val, Ala, Met, Trp, Leu, or Ile
NXPADAWPQEX

SEQ ID NO: 197583 - protein, 9 aa, Artificial Sequence
  Description of Artificial Sequence: Synthetic peptide
  Seed: NPPFFQNST (TYRP2_HUMAN)
  misc_feature (2)..(2): Xaa can be Pro, or Ala
  misc_feature (9)..(9): Xaa can be Ala, Phe, Val, Thr, Pro, Gly, Ser, Leu, Ile, Cys, or Met
NXPFFQNSX

SEQ ID NO: 197584 - protein, 10 aa, Artificial Sequence
  Description of Artificial Sequence: Synthetic peptide
  Seed: NPPFFQNSTF (TYRP2_HUMAN)
  misc_feature (2)..(2): Xaa can be Pro, Tyr, Met, Phe, Val, Lys, Leu, His, Cys, Glu, Ile, Trp, Ala, Ser, Gln, Arg, Asp, Thr, Asn, or Gly
  misc_feature (10)..(10): Xaa can be Met, Val, Ile, Tyr, Leu, Trp, Phe, or Ala
NXPFFQNSTX

SEQ ID NO: 197585 - protein, 10 aa, Artificial Sequence
  Description of Artificial Sequence: Synthetic peptide
  Seed: NQDDRELWPR (TYRP2_HUMAN)
  misc_feature (2)..(2): Xaa can be Thr, Ser, Met, Val, Ile, Leu, Ala, Gln, Asn, Trp, Tyr, Phe, Gly, Glu, Lys, Asp, or Cys
  misc_feature (10)..(10): Xaa can be Tyr, Lys, Arg, Phe, His, Trp, or Met
NXDDRELWPX

SEQ ID NO: 197586 - protein, 8 aa, Artificial Sequence
  Description of Artificial Sequence: Synthetic peptide
  Seed: NQMGRNSM (TYRP2_HUMAN)
  misc_feature (2)..(2): Xaa can be Met, Gln, His, Arg, Leu, Pro, Ala, Ile, Val, Glu, Ser, Phe, Lys, Gly, Thr, Asp, or Asn
  misc_feature (8)..(8): Xaa can be Leu, Ile, Met, Phe, Val, Tyr, or Ala
NXMGRNSX

SEQ ID NO: 197587 - protein, 9 aa, Artificial Sequence
  Description of Artificial Sequence: Synthetic peptide
  Seed: NQMGRNSMK (TYRP2_HUMAN)
  misc_feature (2)..(2): Xaa can be Arg, Val, Thr, Ser, Gly, Ala, Gln, Ile, Met, Leu, Asn, Cys, Phe, Trp, Tyr, Asp, or Pro
  misc_feature (9)..(9): Xaa can be Lys, Arg, Leu, Tyr, His, Phe, Ile, Trp, Met, or Val
NXMGRNSMX

SEQ ID NO: 197588 - protein, 10 aa, Artificial Sequence
  Description of Artificial Sequence: Synthetic peptide
  Seed: NQMGRNSMKL (TYRP2_HUMAN)
  misc_feature (2)..(2): Xaa can be Arg, Gln, Met, His, Glu, or Lys
  misc_feature (10)..(10): Xaa can be Tyr, Phe, Leu, Trp, Met, Ile, Lys, Val, Gln, Arg, Ala, or His
NXMGRNSMKX

SEQ ID NO: 197589 - protein, 9 aa, Artificial Sequence
  Description of Artificial Sequence: Synthetic peptide
  Seed: NRMYNMVPF (TYRP2_HUMAN)
  misc_feature (2)..(2): Xaa can be Arg, His, Gln, Tyr, Phe, Lys, Met, Glu, Pro, Trp, Ser, Ala, Val, Thr, Asn, Leu, Ile, Gly, or Cys
  misc_feature (9)..(9): Xaa can be Tyr, Phe, Leu, Met, Ile, Val, Trp, Ala, His, Thr, Cys, Gly, Pro, Ser, Arg, or Lys
NXMYNMVPX

SEQ ID NO: 197590 - protein, 10 aa, Artificial Sequence
  Description of Artificial Sequence: Synthetic peptide
  Seed: NRMYNMVPFF (TYRP2_HUMAN)
  misc_feature (2)..(2): Xaa can be Gln, Arg, His, Lys, Met, Val, Ser, Leu, Tyr, Ala, Ile, Thr, Glu, Trp, Gly, Cys, Asp, Phe, Asn, or Pro
  misc_feature (10)..(10): Xaa can be Tyr, Phe, Met, Trp, Leu, His, Arg, Ile, Ala, Lys, Val, Cys, Thr, Gln, Pro, Gly, Asp, Asn, Ser, or Glu
NXMYNMVPFX

SEQ ID NO: 197591 - protein, 8 aa, Artificial Sequence
  Description of Artificial Sequence: Synthetic peptide
  Seed: NSMKLPTL (TYRP2_HUMAN)
  misc_feature (2)..(2): Xaa can be Gln, Ala, Pro, Thr, Ser, Arg, Met, Val, His, Leu, Glu, Ile, Gly, Asn, Lys, Asp, Cys, Tyr, Phe, or Trp
  misc_feature (8)..(8): Xaa can be Ile, Val, Leu, Met, Trp, Phe, Cys, Ala, Tyr, or Thr
NXMKLPTX

SEQ ID NO: 197592 - protein, 9 aa, Artificial Sequence
  Description of Artificial Sequence: Synthetic peptide
  Seed: NSMKLPTLK (TYRP2_HUMAN)
  misc_feature (2)..(2): Xaa can be Arg, Ser, Met, Ala, Thr, Leu, Ile, Val, Gly, Gln, Phe, Cys, Asn, Tyr, Asp, Lys, Pro, Trp, Glu, or His
  misc_feature (9)..(9): Xaa can be Lys, Arg, Leu, Tyr, Phe, Met, Ile, Val, His, Trp, Ala, Cys, Pro, Glu, Thr, Asn, or Gln
NXMKLPTLX

SEQ ID NO: 197593 - protein, 10 aa, Artificial Sequence
  Description of Artificial Sequence: Synthetic peptide
  Seed: NSRFSSWETV (TYRP2_HUMAN)
  misc_feature (2)..(2): Xaa can be Val, Ser, Thr, Tyr, Gly, Phe, Ala, Met, Gln, Ile, Leu, His, Pro, Lys, Asn, Asp, Arg, Trp, Cys, or Glu
  misc_feature (10)..(10): Xaa can be Val, Leu, Ile, Phe, Met, Lys, or Ala
NXRFSSWETX

SEQ ID NO: 197594 - protein, 10 aa, Artificial Sequence
  Description of Artificial Sequence: Synthetic peptide
  Seed: NSTFSFRNAL (TYRP2_HUMAN)
  misc_feature (2)..(2): Xaa can be Phe, Thr, Met, Tyr, Ser, Ala, Arg, Ile, Leu, Asp, Lys, Glu, Gly, Asn, Pro, Val, His, Cys, Gln, or Trp
  misc_feature (10)..(10): Xaa can be Met, Ile, Val, Leu, Ala, Thr, Phe, or Tyr
NXTFSFRNAX

SEQ ID NO: 197595 - protein, 9 aa, Artificial Sequence
  Description of Artificial Sequence: Synthetic peptide
  Seed: NVCGSQQGR (TYRP2_HUMAN)
  misc_feature (2)..(2): Xaa can be Ala, Val, Thr, Ile, Ser, Tyr, Met, Asn, Leu, Gly, Glu, Asp, Phe, Gln, Pro, or Trp
  misc_feature (9)..(9): Xaa can be Arg, Lys, Tyr, His, Leu, Met, or Phe
NXCGSQQGX

SEQ ID NO: 197596 - protein, 9 aa, Artificial Sequence
  Description of Artificial Sequence: Synthetic peptide
  Seed: PADAWPQEL (TYRP2_HUMAN)
  misc_feature (2)..(2): Xaa can be Tyr, Trp, Phe, Ala, Ile, Val, Thr, Ser, Gly, Leu, Cys, His, Asn, Arg, Met, Gln, Pro, Asp, Glu, or Lys
  misc_feature (9)..(9): Xaa can be Leu, Met, Phe, Ile, Val, Trp, Tyr, Ala, Cys, Lys, or Thr
PXDAWPQEX

SEQ ID NO: 197597 - protein, 9 aa, Artificial Sequence
  Description of Artificial Sequence: Synthetic peptide
  Seed: PAFVTWHRY (TYRP2_HUMAN)
  misc_feature (2)..(2): Xaa can be Phe, Gln, Ala, Gly, Thr, Tyr, Asn, Leu, Ser, Val, Glu, Met, Ile, Asp, or Trp
  misc_feature (9)..(9): Xaa can be Tyr, or Phe
PXFVTWHRX

SEQ ID NO: 197598 - protein, 11 aa, Artificial Sequence
  Description of Artificial Sequence: Synthetic peptide
  Seed: PFFPPVTNEEL (TYRP2_HUMAN)
  misc_feature (2)..(2): Xaa can be Tyr, Trp, or Phe
  misc_feature (11)..(11): Xaa can be Tyr, Leu, Trp, Phe, Met, or Ile
PXFPPVTNEEX

SEQ ID NO: 197599 - protein, 8 aa, Artificial Sequence
  Description of Artificial Sequence: Synthetic peptide
  Seed: PFFQNSTF (TYRP2_HUMAN)
  misc_feature (2)..(2): Xaa can be Tyr, or Phe
  misc_feature (8)..(8): Xaa can be Met, Tyr, Leu, or Phe
PXFQNSTX

SEQ ID NO: 197600 - protein, 10 aa, Artificial Sequence
  Description of Artificial Sequence: Synthetic peptide
  Seed: PFFQNSTFSF (TYRP2_HUMAN)
  misc_feature (2)..(2): Xaa can be Tyr, Trp, Phe, Met, Arg, Val, Ile, Ser, Thr, Gly, Cys, Leu, Gln, Ala, Asn, His, Lys, Pro, Asp, or Glu
  misc_feature (10)..(10): Xaa can be Tyr, Phe, Trp, Met, Leu, Ile, or Val
PXFQNSTFSX

SEQ ID NO: 197601 - protein, 11 aa, Artificial Sequence
  Description of Artificial Sequence: Synthetic peptide
  Seed: PFFQNSTFSFR (TYRP2_HUMAN)
  misc_feature (2)..(2): Xaa can be His, Ala, Val, Asn, Cys, Met, Leu, Ser, Phe, Ile, Arg, Thr, Gly, Tyr, Lys, Gln, Trp, Glu, Pro, or Asp
  misc_feature (11)..(11): Xaa can be Arg, or Lys
PXFQNSTFSFX

SEQ ID NO: 197602 - protein, 9 aa, Artificial Sequence
  Description of Artificial Sequence: Synthetic peptide
  Seed: PGAQGQFPR (TYRP2_HUMAN)
  misc_feature (2)..(2): Xaa can be Gln, Trp, Tyr, Ile, Ser, Val, Asn, Leu, Thr, Phe, Ala, Gly, or Met
  misc_feature (9)..(9): Xaa can be , or Arg
PXAQGQFPX

SEQ ID NO: 197603 - protein, 9 aa, Artificial Sequence
  Description of Artificial Sequence: Synthetic peptide
  Seed: PIFVVLHSF (TYRP2_HUMAN)
  misc_feature (2)..(2): Xaa can be Tyr, Phe, Trp, Gln, Met, Ala, His, Thr, Ser, Asp, Val, Gly, Ile, Glu, Leu, Pro, Asn, Lys, Arg, or Cys
  misc_feature (9)..(9): Xaa can be Tyr, Phe, Met, Leu, Trp, Ile, or Val
PXFVVLHSX

SEQ ID NO: 197604 - protein, 10 aa, Artificial Sequence
  Description of Artificial Sequence: Synthetic peptide
  Seed: PLMETHLSSK (TYRP2_HUMAN)
  misc_feature (2)..(2): Xaa can be Thr, Val, Arg, Leu, Ile, Lys, Met, Ala, or Ser
  misc_feature (10)..(10): Xaa can be Lys, or Arg
PXMETHLSSX

SEQ ID NO: 197605 - protein, 10 aa, Artificial Sequence
  Description of Artificial Sequence: Synthetic peptide
  Seed: PPADAWPQEL (TYRP2_HUMAN)
  misc_feature (2)..(2): Xaa can be , or Pro
  misc_feature (10)..(10): Xaa can be Phe, Met, Leu, Val, Ala, or Ile
PXADAWPQEX

SEQ ID NO: 197606 - protein, 9 aa, Artificial Sequence
  Description of Artificial Sequence: Synthetic peptide
  Seed: PPFFQNSTF (TYRP2_HUMAN)
  misc_feature (2)..(2): Xaa can be Pro, Ala, Gln, Gly, Val, Ser, Met, Thr, Ile, Asn, Leu, Phe, Glu, Trp, His, Asp, Tyr, or Cy s
  misc_feature (9)..(9): Xaa can be Tyr, Phe, Trp, Met, Leu, Ile, Ala, or Val
PXFFQNSTX

SEQ ID NO: 197607 - protein, 11 aa, Artificial Sequence
  Description of Artificial Sequence: Synthetic peptide
  Seed: PPFFQNSTFSF (TYRP2_HUMAN)
  misc_feature (2)..(2): Xaa can be Tyr, Trp, Arg, Ile, Phe, His, Leu, Ala, Met, Thr, Gln, Ser, Val, Lys, Asp, Glu, Pro, Asn, Gly, or Cys
  misc_feature (11)..(11): Xaa can be Phe, Trp, Leu, Ile, or Met
PXFFQNSTFSX

SEQ ID NO: 197608 - protein, 11 aa, Artificial Sequence
  Description of Artificial Sequence: Synthetic peptide
  Seed: PPVIRQNIHSL (TYRP2_HUMAN)
  misc_feature (2)..(2): Xaa can be , or Pro
  misc_feature (11)..(11): Xaa can be , or Leu
PXVIRQNIHSX

SEQ ID NO: 197609 - protein, 8 aa, Artificial Sequence
  Description of Artificial Sequence: Synthetic peptide
  Seed: PPVTNEEL (TYRP2_HUMAN)
  misc_feature (2)..(2): Xaa can be , or Pro
  misc_feature (8)..(8): Xaa can be , or Leu
PXVTNEEX

SEQ ID NO: 197610 - protein, 9 aa, Artificial Sequence
  Description of Artificial Sequence: Synthetic peptide
  Seed: PPVTNEELF (TYRP2_HUMAN)
  misc_feature (2)..(2): Xaa can be Pro, or Ala
  misc_feature (9)..(9): Xaa can be Tyr, or Phe
PXVTNEELX

SEQ ID NO: 197611 - protein, 9 aa, Artificial Sequence
  Description of Artificial Sequence: Synthetic peptide
  Seed: PQFANCSVY (TYRP2_HUMAN)
  misc_feature (2)..(2): Xaa can be Gln, Met, Ile, Lys, Val, Ala, Leu, Ser, His, Gly, Phe, Thr, Pro, Arg, Glu, Tyr, Asn, Trp, or Cys
  misc_feature (9)..(9): Xaa can be Tyr, Phe, Met, Leu, or Trp
PXFANCSVX

SEQ ID NO: 197612 - protein, 9 aa, Artificial Sequence
  Description of Artificial Sequence: Synthetic peptide
  Seed: PTLISRNSR (TYRP2_HUMAN)
  misc_feature (2)..(2): Xaa can be Ala, Leu, Ser, Val, Tyr, Phe, Ile, Met, or Thr
  misc_feature (9)..(9): Xaa can be , or Arg
PXLISRNSX

SEQ ID NO: 197613 - protein, 10 aa, Artificial Sequence
  Description of Artificial Sequence: Synthetic peptide
  Seed: PVSVEETPGW (TYRP2_HUMAN)
  misc_feature (2)..(2): Xaa can be Trp, Cys, Tyr, His, Ser, Leu, Met, Thr, Ile, Arg, Lys, Val, Ala, or Phe
  misc_feature (10)..(10): Xaa can be , or Trp
PXSVEETPGX

SEQ ID NO: 197614 - protein, 9 aa, Artificial Sequence
  Description of Artificial Sequence: Synthetic peptide
  Seed: PWSGPYILR (TYRP2_HUMAN)
  misc_feature (2)..(2): Xaa can be Tyr, Trp, His, Leu, Asn, Met, Gly, Asp, Val, Phe, Thr, Ala, Glu, Pro, Ile, Gln, or Ser
  misc_feature (9)..(9): Xaa can be Arg, or Lys
PXSGPYILX

SEQ ID NO: 197615 - protein, 9 aa, Artificial Sequence
  Description of Artificial Sequence: Synthetic peptide
  Seed: PYWNFATGR (TYRP2_HUMAN)
  misc_feature (2)..(2): Xaa can be Tyr, Thr, Met, Trp, Phe, Ile, Asn, Ser, Gly, Pro, Ala, Leu, Val, or Gln
  misc_feature (9)..(9): Xaa can be Arg, or Lys
PXWNFATGX

SEQ ID NO: 197616 - protein, 10 aa, Artificial Sequence
  Description of Artificial Sequence: Synthetic peptide
  Seed: QELAPIGHNR (TYRP2_HUMAN)
  misc_feature (2)..(2): Xaa can be Glu, Thr, Val, Ile, Ala, Gln, Ser, Asp, Leu, Met, Asn, Arg, Pro, Phe, His, Tyr, Cys, Trp, Lys, or Gly
  misc_feature (10)..(10): Xaa can be Arg, Lys, Trp, Tyr, Phe, His, Met, Leu, Gln, Val, Cys, Ala, Thr, or Ile
QXLAPIGHNX

SEQ ID NO: 197617 - protein, 11 aa, Artificial Sequence
  Description of Artificial Sequence: Synthetic peptide
  Seed: QELAPIGHNRM (TYRP2_HUMAN)
  misc_feature (2)..(2): Xaa can be Glu, Asp, or Gln
  misc_feature (11)..(11): Xaa can be Trp, Tyr, Phe, Leu, Val, Pro, Ser, Ala, Cys, Ile, Thr, His, or Met
QXLAPIGHNRX

SEQ ID NO: 197618 - protein, 9 aa, Artificial Sequence
  Description of Artificial Sequence: Synthetic peptide
  Seed: QEREQFLGA (TYRP2_HUMAN)
  misc_feature (2)..(2): Xaa can be Glu, Asp, or Gln
  misc_feature (9)..(9): Xaa can be Ala, Ile, Val, Leu, Cys, Phe, Met, Tyr, Pro, Thr, Ser, Lys, Trp, Gln, Asp, Glu, or Gly
QXREQFLGX

SEQ ID NO: 197619 - protein, 10 aa, Artificial Sequence
  Description of Artificial Sequence: Synthetic peptide
  Seed: QEREQFLGAL (TYRP2_HUMAN)
  misc_feature (2)..(2): Xaa can be Glu, Asp, or Gln
  misc_feature (10)..(10): Xaa can be Trp, Tyr, Leu, Gly, Val, Thr, Ser, Cys, Pro, Met, Phe, Ile, or Ala
QXREQFLGAX

SEQ ID NO: 197620 - protein, 8 aa, Artificial Sequence
  Description of Artificial Sequence: Synthetic peptide
  Seed: QFANCSVY (TYRP2_HUMAN)
  misc_feature (2)..(2): Xaa can be Gln, Phe, Tyr, Met, Trp, Ser, Lys, Asn, His, Val, Ile, Ala, Arg, or Leu
  misc_feature (8)..(8): Xaa can be Tyr, Phe, Met, or Leu
QXANCSVX

SEQ ID NO: 197621 - protein, 10 aa, Artificial Sequence
  Description of Artificial Sequence: Synthetic peptide
  Seed: QFANCSVYDF (TYRP2_HUMAN)
  misc_feature (2)..(2): Xaa can be Tyr, Trp, Phe, Val, Ser, Ala, Met, Ile, Thr, Leu, or Gln
  misc_feature (10)..(10): Xaa can be Tyr, Phe, Trp, Ile, Leu, Val, or Met
QXANCSVYDX

SEQ ID NO: 197622 - protein, 11 aa, Artificial Sequence
  Description of Artificial Sequence: Synthetic peptide
  Seed: QFANCSVYDFF (TYRP2_HUMAN)
  misc_feature (2)..(2): Xaa can be Tyr, Trp, or Phe
  misc_feature (11)..(11): Xaa can be Trp, Phe, Leu, Ile, Tyr, Val, or Met
QXANCSVYDFX

SEQ ID NO: 197623 - protein, 10 aa, Artificial Sequence
  Description of Artificial Sequence: Synthetic peptide
  Seed: QFLGALDLAK (TYRP2_HUMAN)
  misc_feature (2)..(2): Xaa can be Thr, Ile, Val, Met, Leu, Tyr, Ser, Gly, Asn, Cys, Ala, Phe, Trp, Gln, Glu, Pro, His, Arg, or Asp
  misc_feature (10)..(10): Xaa can be Arg, Lys, Tyr, or His
QXLGALDLAX

SEQ ID NO: 197624 - protein, 11 aa, Artificial Sequence
  Description of Artificial Sequence: Synthetic peptide
  Seed: QFLGALDLAKK (TYRP2_HUMAN)
  misc_feature (2)..(2): Xaa can be Val, Thr, Met, Phe, Gly, Ala, Leu, Ile, Ser, Gln, Tyr, Trp, Cys, Glu, Asn, Asp, or Pro
  misc_feature (11)..(11): Xaa can be Lys, Arg, Tyr, or His
QXLGALDLAKX

SEQ ID NO: 197625 - protein, 9 aa, Artificial Sequence
  Description of Artificial Sequence: Synthetic peptide
  Seed: QFPRVCMTV (TYRP2_HUMAN)
  misc_feature (2)..(2): Xaa can be Tyr, Phe, Trp, Met, Leu, Ile, Ala, Gln, Val, Ser, Thr, His, Arg, Gly, Cys, or Asn
  misc_feature (9)..(9): Xaa can be Phe, Trp, Leu, Met, Ile, Tyr, Val, Ala, His, Cys, or Gly
QXPRVCMTX

SEQ ID NO: 197626 - protein, 10 aa, Artificial Sequence
  Description of Artificial Sequence: Synthetic peptide
  Seed: QGPAFVTWHR (TYRP2_HUMAN)
  misc_feature (2)..(2): Xaa can be Thr, Val, Ile, Ser, Ala, Leu, Asn, Arg, Gly, Trp, Cys, Gln, Asp, Tyr, Phe, Lys, His, Pro, Glu, or Met
  misc_feature (10)..(10): Xaa can be Lys, Arg, Tyr, His, or Gln
QXPAFVTWHX

SEQ ID NO: 197627 - protein, 8 aa, Artificial Sequence
  Description of Artificial Sequence: Synthetic peptide
  Seed: QHWLGLLG (TYRP2_HUMAN)
  misc_feature (2)..(2): Xaa can be His, Arg, or Gln
  misc_feature (8)..(8): Xaa can be Val, Ala, Leu, Ile, Cys, Ser, Met, Pro, Thr, Gly, or Phe
QXWLGLLX

SEQ ID NO: 197628 - protein, 9 aa, Artificial Sequence
  Description of Artificial Sequence: Synthetic peptide
  Seed: QHWLGLLGP (TYRP2_HUMAN)
  misc_feature (2)..(2): Xaa can be His, Arg, Gln, Glu, Pro, or Lys
  misc_feature (9)..(9): Xaa can be Ala, Val, Cys, Leu, Ile, Pro, Met, Thr, Ser, Gly, or Phe
QXWLGLLGX

SEQ ID NO: 197629 - protein, 8 aa, Artificial Sequence
  Description of Artificial Sequence: Synthetic peptide
  Seed: QKFDNPPF (TYRP2_HUMAN)
  misc_feature (2)..(2): Xaa can be Gln, Met, Tyr, Val, Lys, Ser, Ala, Arg, His, Phe, Leu, or Ile
  misc_feature (8)..(8): Xaa can be Tyr, Phe, Met, Leu, or Ile
QXFDNPPX

SEQ ID NO: 197630 - protein, 9 aa, Artificial Sequence
  Description of Artificial Sequence: Synthetic peptide
  Seed: QKFDNPPFF (TYRP2_HUMAN)
  misc_feature (2)..(2): Xaa can be Arg, His, Gln, Tyr, Met, Gly, Val, Lys, Asn, Leu, Thr, Ser, Ile, Glu, Ala, Phe, Asp, Trp, Pro, or Cys
  misc_feature (9)..(9): Xaa can be Leu, Met, Phe, Tyr, Ile, Val, Trp, His, Cys, Ala, Thr, Arg, Gln, or Lys
QXFDNPPFX

SEQ ID NO: 197631 - protein, 10 aa, Artificial Sequence
  Description of Artificial Sequence: Synthetic peptide
  Seed: QLGYSYAIDL (TYRP2_HUMAN)
  misc_feature (2)..(2): Xaa can be Leu, Met, or Ile
  misc_feature (10)..(10): Xaa can be Val, Ala, Leu, or Ile
QXGYSYAIDX

SEQ ID NO: 197632 - protein, 9 aa, Artificial Sequence
  Description of Artificial Sequence: Synthetic peptide
  Seed: QMGRNSMKL (TYRP2_HUMAN)
  misc_feature (2)..(2): Xaa can be Gln, Leu, Met, or Ile
  misc_feature (9)..(9): Xaa can be Leu, Phe, Val, Trp, Ile, Met, or Tyr
QXGRNSMKX

SEQ ID NO: 197633 - protein, 11 aa, Artificial Sequence
  Description of Artificial Sequence: Synthetic peptide
  Seed: QNIHSLSPQER (TYRP2_HUMAN)
  misc_feature (2)..(2): Xaa can be Tyr, Phe, Met, Thr, Gly, Ser, Asn, Ala, Leu, Val, Trp, or Ile
  misc_feature (11)..(11): Xaa can be Arg, or Lys
QXIHSLSPQEX

SEQ ID NO: 197634 - protein, 8 aa, Artificial Sequence
  Description of Artificial Sequence: Synthetic peptide
  Seed: QNSTFSFR (TYRP2_HUMAN)
  misc_feature (2)..(2): Xaa can be Met, Phe, Tyr, Trp, Lys, Ser, Leu, Asn, Gly, Thr, Arg, Val, His, Ala, Ile, Gln, or Cys
  misc_feature (8)..(8): Xaa can be Arg, or Lys
QXSTFSFX

SEQ ID NO: 197635 - protein, 9 aa, Artificial Sequence
  Description of Artificial Sequence: Synthetic peptide
  Seed: QPQFANCSV (TYRP2_HUMAN)
  misc_feature (2)..(2): Xaa can be Pro, Ala, or Val
  misc_feature (9)..(9): Xaa can be Leu, Ile, Ala, Met, Val, Cys, Thr, Pro, Phe, Ser, or Tyr
QXQFANCSX

SEQ ID NO: 197636 - protein, 10 aa, Artificial Sequence
  Description of Artificial Sequence: Synthetic peptide
  Seed: QPQFANCSVY (TYRP2_HUMAN)
  misc_feature (2)..(2): Xaa can be Trp, His, Gln, Leu, Phe, Ile, Arg, Tyr, Met, Lys, Pro, Asp, Ser, Thr, Ala, Cys, Val, Asn, Glu, or Gly
  misc_feature (10)..(10): Xaa can be His, Met, Phe, Tyr, Trp, Leu, Val, Ile, or Ala
QXQFANCSVX

SEQ ID NO: 197637 - protein, 11 aa, Artificial Sequence
  Description of Artificial Sequence: Synthetic peptide
  Seed: QPQFANCSVYD (TYRP2_HUMAN)
  misc_feature (2)..(2): Xaa can be Ala, Asp, Pro, Ser, Gly, Phe, Thr, Lys, His, Glu, Leu, Met, Tyr, Asn, Trp, Ile, Arg, Val, Gln, or Cys
  misc_feature (11)..(11): Xaa can be Ile, Lys, Leu, Ala, His, Trp, Met, Cys, Gln, Arg, Asp, Gly, Asn, Glu, Pro, Val, Thr, Ser, Tyr, or Phe
QXQFANCSVYX

SEQ ID NO: 197638 - protein, 10 aa, Artificial Sequence
  Description of Artificial Sequence: Synthetic peptide
  Seed: QQGRGQCTEV (TYRP2_HUMAN)
  misc_feature (2)..(2): Xaa can be , or Gln
  misc_feature (10)..(10): Xaa can be , or Val
QXGRGQCTEX

SEQ ID NO: 197639 - protein, 9 aa, Artificial Sequence
  Description of Artificial Sequence: Synthetic peptide
  Seed: QRLIGNESF (TYRP2_HUMAN)
  misc_feature (2)..(2): Xaa can be Arg, Gln, His, Glu, Met, Lys, Leu, Pro, Ala, Val, Asn, Phe, Tyr, Ser, Thr, Ile, Gly, Asp, Trp, or Cys
  misc_feature (9)..(9): Xaa can be Tyr, Phe, Leu, Met, Ile, Trp, His, Ala, Lys, Val, Arg, Thr, Cys, Gly, Ser, or Pro
QXLIGNESX

SEQ ID NO: 197640 - protein, 10 aa, Artificial Sequence
  Description of Artificial Sequence: Synthetic peptide
  Seed: QRLIGNESFA (TYRP2_HUMAN)
  misc_feature (2)..(2): Xaa can be , or Arg
  misc_feature (10)..(10): Xaa can be , or Ala
QXLIGNESFX

SEQ ID NO: 197641 - protein, 11 aa, Artificial Sequence
  Description of Artificial Sequence: Synthetic peptide
  Seed: QRLIGNESFAL (TYRP2_HUMAN)
  misc_feature (2)..(2): Xaa can be Arg, His, Tyr, Phe, Met, Trp, Ala, Lys, Leu, Ile, Val, Gly, Ser, Gln, Thr, Cys, or Asn
  misc_feature (11)..(11): Xaa can be Val, Ile, Leu, Met, Ala, Phe, Cys, Trp, Tyr, Lys, Arg, Pro, or His
QXLIGNESFAX

SEQ ID NO: 197642 - protein, 8 aa, Artificial Sequence
  Description of Artificial Sequence: Synthetic peptide
  Seed: QVMSLHNL (TYRP2_HUMAN)
  misc_feature (2)..(2): Xaa can be Gln, Met, Leu, Asn, Ile, Val, Glu, Ala, Ser, Gly, or Thr
  misc_feature (8)..(8): Xaa can be Val, Ile, Leu, Phe, or Met
QXMSLHNX

SEQ ID NO: 197643 - protein, 9 aa, Artificial Sequence
  Description of Artificial Sequence: Synthetic peptide
  Seed: QVMSLHNLV (TYRP2_HUMAN)
  misc_feature (2)..(2): Xaa can be Gln, Thr, Val, Ala, Ile, Met, Ser, Leu, Glu, Asn, Gly, Pro, Asp, Cys, Tyr, or Phe
  misc_feature (9)..(9): Xaa can be Arg, Val, Lys, Ile, Leu, Met, Ala, Phe, Tyr, His, Thr, Trp, or Cys
QXMSLHNLX

SEQ ID NO: 197644 - protein, 10 aa, Artificial Sequence
  Description of Artificial Sequence: Synthetic peptide
  Seed: QVMSLHNLVH (TYRP2_HUMAN)
  misc_feature (2)..(2): Xaa can be Thr, Val, Ile, Ser, Ala, Leu, Gln, Met, Gly, Asn, Glu, Cys, Trp, Tyr, Phe, or Asp
  misc_feature (10)..(10): Xaa can be Lys, Arg, Tyr, or His
QXMSLHNLVX

SEQ ID NO: 197645 - protein, 9 aa, Artificial Sequence
  Description of Artificial Sequence: Synthetic peptide
  Seed: QYRRLRKGY (TYRP2_HUMAN)
  misc_feature (2)..(2): Xaa can be Met, Leu, Ser, Ala, Thr, Gln, Trp, Val, Tyr, Phe, or Ile
  misc_feature (9)..(9): Xaa can be , or Tyr
QXRRLRKGX

SEQ ID NO: 197646 - protein, 11 aa, Artificial Sequence
  Description of Artificial Sequence: Synthetic peptide
  Seed: RADTRPWSGPY (TYRP2_HUMAN)
  misc_feature (2)..(2): Xaa can be Tyr, Val, Gln, Pro, Leu, Asp, Ser, Lys, Phe, His, Met, Ile, Gly, Cys, Trp, Asn, Ala, Glu, Thr, or Arg
  misc_feature (11)..(11): Xaa can be Val, Thr, Phe, Arg, Gly, Trp, Lys, Ala, Ser, Leu, Ile, Tyr, Pro, Met, or Cys
RXDTRPWSGPX

SEQ ID NO: 197647 - protein, 9 aa, Artificial Sequence
  Description of Artificial Sequence: Synthetic peptide
  Seed: RAIDFSHQG (TYRP2_HUMAN)
  misc_feature (2)..(2): Xaa can be Ala, Val, Thr, Ser, Ile, Gln, Met, Gly, Leu, Glu, Cys, Asn, Pro, Asp, Phe, Lys, Tyr, Arg, His, or Trp
  misc_feature (9)..(9): Xaa can be Tyr, Phe, Met, Leu, His, Trp, Val, Ile, Lys, Arg, Ala, Cys, Pro, Gln, Thr, Ser, Gly, or As n
RXIDFSHQX

SEQ ID NO: 197648 - protein, 9 aa, Artificial Sequence
  Description of Artificial Sequence: Synthetic peptide
  Seed: RDCLSLQKF (TYRP2_HUMAN)
  misc_feature (2)..(2): Xaa can be Glu, Gln, Asp, Met, Thr, Ser, Ala, Leu, Ile, Asn, Val, Gly, Cys, Lys, Arg, Pro, His, Tyr, Phe, or Trp
  misc_feature (9)..(9): Xaa can be Trp, Tyr, Phe, Met, Leu, Ile, Val, Cys, Ala, His, Lys, Arg, Thr, Ser, Pro, or Gly
RXCLSLQKX

SEQ ID NO: 197649 - protein, 11 aa, Artificial Sequence
  Description of Artificial Sequence: Synthetic peptide
  Seed: RDTLLGPGRPY (TYRP2_HUMAN)
  misc_feature (2)..(2): Xaa can be Gln, Glu, Met, Asp, Tyr, Phe, Gly, Leu, Arg, Ile, Ala, Pro, Trp, Cys, Ser, Thr, Asn, His, Lys, or Val
  misc_feature (11)..(11): Xaa can be Tyr, Met, Phe, Leu, Trp, Ile, or His
RXTLLGPGRPX

SEQ ID NO: 197650 - protein, 8 aa, Artificial Sequence
  Description of Artificial Sequence: Synthetic peptide
  Seed: RELWPRKF (TYRP2_HUMAN)
  misc_feature (2)..(2): Xaa can be Glu, Asp, Gln, Lys, Arg, Met, or His
  misc_feature (8)..(8): Xaa can be Tyr, Phe, Met, Leu, Trp, Ile, Ala, Val, Cys, Thr, His, or Pro
RXLWPRKX

SEQ ID NO: 197651 - protein, 9 aa, Artificial Sequence
  Description of Artificial Sequence: Synthetic peptide
  Seed: RELWPRKFF (TYRP2_HUMAN)
  misc_feature (2)..(2): Xaa can be Glu, Asp, Gln, Met, Lys, His, Leu, Ser, Ala, Thr, Val, Arg, Ile, Gly, Asn, or Pro
  misc_feature (9)..(9): Xaa can be Tyr, Phe, Met, Leu, Val, Trp, Ile, His, Ala, Cys, Gly, Thr, Ser, or Pro
RXLWPRKFX

SEQ ID NO: 197652 - protein, 10 aa, Artificial Sequence
  Description of Artificial Sequence: Synthetic peptide
  Seed: RELWPRKFFH (TYRP2_HUMAN)
  misc_feature (2)..(2): Xaa can be Met, Gln, Tyr, Thr, Ser, Phe, Ile, Trp, Val, Leu, Glu, Ala, Asp, Gly, Asn, Cys, Arg, Pro, Lys, or His
  misc_feature (10)..(10): Xaa can be Tyr, Ile, Gln, His, Leu, Arg, Val, Phe, Lys, Met, Ala, Glu, Ser, Trp, Thr, Cys, or Gly
RXLWPRKFFX

SEQ ID NO: 197653 - protein, 11 aa, Artificial Sequence
  Description of Artificial Sequence: Synthetic peptide
  Seed: RELWPRKFFHR (TYRP2_HUMAN)
  misc_feature (2)..(2): Xaa can be Phe, Met, Tyr, Thr, Trp, Val, Leu, Ser, Gln, Ile, Arg, Ala, Lys, His, Gly, Glu, Pro, Cys, Asp, or Asn
  misc_feature (11)..(11): Xaa can be Arg, Lys, His, Tyr, Leu, Met, Val, Phe, Gln, Ala, Ile, Ser, Glu, Thr, Trp, Asn, Pro, Asp, Gly, or Cys
RXLWPRKFFHX

SEQ ID NO: 197654 - protein, 8 aa, Artificial Sequence
  Description of Artificial Sequence: Synthetic peptide
  Seed: REQFLGAL (TYRP2_HUMAN)
  misc_feature (2)..(2): Xaa can be Glu, Asp, or Gln
  misc_feature (8)..(8): Xaa can be Leu, Val, Phe, Ile, Met, Pro, Cys, Ala, or Thr
RXQFLGAX

SEQ ID NO: 197655 - protein, 9 aa, Artificial Sequence
  Description of Artificial Sequence: Synthetic peptide
  Seed: REQFLGALD (TYRP2_HUMAN)
  misc_feature (2)..(2): Xaa can be Glu, Asp, or Gln
  misc_feature (9)..(9): Xaa can be Cys, Ala, Val, Met, Pro, Leu, Thr, Ile, Gln, Trp, Tyr, Asp, Gly, Glu, Phe, or Ser
RXQFLGALX

SEQ ID NO: 197656 - protein, 10 aa, Artificial Sequence
  Description of Artificial Sequence: Synthetic peptide
  Seed: REQFLGALDL (TYRP2_HUMAN)
  misc_feature (2)..(2): Xaa can be Glu, Arg, Lys, Tyr, Asp, Met, Gln, His, Trp, Gly, Cys, Val, Ser, Pro, Ile, Asn, Phe, Leu, Ala, or Thr
  misc_feature (10)..(10): Xaa can be His, Val, Trp, Ile, Met, Phe, Tyr, Leu, Ala, Cys, Thr, Gly, Ser, or Pro
RXQFLGALDX

SEQ ID NO: 197657 - protein, 11 aa, Artificial Sequence
  Description of Artificial Sequence: Synthetic peptide
  Seed: REQFLGALDLA (TYRP2_HUMAN)
  misc_feature (2)..(2): Xaa can be , or Glu
  misc_feature (11)..(11): Xaa can be Pro, Leu, Trp, Tyr, Val, Thr, Cys, Phe, Gly, Ile, Ser, Ala, or Met
RXQFLGALDLX

SEQ ID NO: 197658 - protein, 9 aa, Artificial Sequence
  Description of Artificial Sequence: Synthetic peptide
  Seed: RFNPPADAW (TYRP2_HUMAN)
  misc_feature (2)..(2): Xaa can be Arg, Gln, Tyr, Met, Thr, Phe, Val, His, Leu, Ser, Trp, Ala, Lys, Ile, Asn, Glu, Asp, Gly, Cys, or Pro
  misc_feature (9)..(9): Xaa can be Met, Trp, Leu, Phe, Tyr, Ile, Val, His, Cys, Arg, Lys, Ala, Thr, Pro, Gln, Ser, or Gly
RXNPPADAX

SEQ ID NO: 197659 - protein, 9 aa, Artificial Sequence
  Description of Artificial Sequence: Synthetic peptide
  Seed: RKFFHRTCK (TYRP2_HUMAN)
  misc_feature (2)..(2): Xaa can be Val, Thr, Ile, Arg, Ser, Met, Tyr, Phe, Ala, Gln, Leu, Trp, Gly, Asn, Cys, Lys, His, Glu, Pro, or Asp
  misc_feature (9)..(9): Xaa can be Lys, Arg, Tyr, Leu, Met, Val, Ala, Ile, Phe, Thr, Gly, Ser, His, Pro, Asn, Cys, Gln, Glu, Trp, or Asp
RXFFHRTCX

SEQ ID NO: 197660 - protein, 9 aa, Artificial Sequence
  Description of Artificial Sequence: Synthetic peptide
  Seed: RLGAESANV (TYRP2_HUMAN)
  misc_feature (2)..(2): Xaa can be Met, Gln, Leu, Val, Ile, Glu, Ser, Ala, or Thr
  misc_feature (9)..(9): Xaa can be Phe, Leu, Val, Trp, Ile, Met, Ala, or Tyr
RXGAESANX

SEQ ID NO: 197661 - protein, 8 aa, Artificial Sequence
  Description of Artificial Sequence: Synthetic peptide
  Seed: RLIGNESF (TYRP2_HUMAN)
  misc_feature (2)..(2): Xaa can be Gln, Met, Lys, Ser, Leu, Ala, Val, Arg, Thr, Ile, or His
  misc_feature (8)..(8): Xaa can be Tyr, Phe, Met, Leu, or Ile
RXIGNESX

SEQ ID NO: 197662 - protein, 9 aa, Artificial Sequence
  Description of Artificial Sequence: Synthetic peptide
  Seed: RLIGNESFA (TYRP2_HUMAN)
  misc_feature (2)..(2): Xaa can be Met, Leu, Gln, Val, Thr, Ile, Ser, or Ala
  misc_feature (9)..(9): Xaa can be Val, Leu, Ile, Met, Ala, Thr, Cys, or Phe
RXIGNESFX

SEQ ID NO: 197663 - protein, 10 aa, Artificial Sequence
  Description of Artificial Sequence: Synthetic peptide
  Seed: RLIGNESFAL (TYRP2_HUMAN)
  misc_feature (2)..(2): Xaa can be Gln, Met, Leu, Val, Ile, Thr, Ala, Ser, Glu, Asn, Phe, Lys, Tyr, Gly, His, Arg, Trp, Cys, Asp, or Pro
  misc_feature (10)..(10): Xaa can be Val, Tyr, Phe, Trp, Met, Arg, Leu, Lys, Ile, Ala, His, Thr, Cys, or Gly
RXIGNESFAX

SEQ ID NO: 197664 - protein, 11 aa, Artificial Sequence
  Description of Artificial Sequence: Synthetic peptide
  Seed: RLIGNESFALP (TYRP2_HUMAN)
  misc_feature (2)..(2): Xaa can be Met, Leu, Ile, Gln, Val, Tyr, Phe, or Thr
  misc_feature (11)..(11): Xaa can be Val, Leu, Ile, Ala, Met, Tyr, Glu, Pro, Gln, Cys, Arg, Thr, Asn, Asp, Trp, Lys, Phe, His, Ser, or Gly
RXIGNESFALX

SEQ ID NO: 197665 - protein, 9 aa, Artificial Sequence
  Description of Artificial Sequence: Synthetic peptide
  Seed: RLRKGYTPL (TYRP2_HUMAN)
  misc_feature (2)..(2): Xaa can be Val, Met, Phe, Pro, Ser, Thr, Ile, Ala, Gln, Tyr, Leu, Trp, Asn, Gly, Cys, Arg, Glu, His, Lys, or Asp
  misc_feature (9)..(9): Xaa can be Arg, Met, Phe, Leu, Tyr, Lys, Val, Trp, Ala, His, Ile, Thr, Gly, Ser, Pro, Gln, Cys, Glu, Asn, or Asp
RXRKGYTPX

SEQ ID NO: 197666 - protein, 10 aa, Artificial Sequence
  Description of Artificial Sequence: Synthetic peptide
  Seed: RLRKGYTPLM (TYRP2_HUMAN)
  misc_feature (2)..(2): Xaa can be Ala, Thr, Gln, Met, Val, Ile, Pro, Phe, Ser, Tyr, Trp, Leu, Arg, Gly, Asn, His, Cys, Glu, Lys, or Asp
  misc_feature (10)..(10): Xaa can be Lys, Leu, Phe, Ala, Met, Trp, Tyr, Ile, Arg, Val, Ser, His, Gly, Thr, Cys, Gln, Pro, Glu, Asn, or Asp
RXRKGYTPLX

SEQ ID NO: 197667 - protein, 8 aa, Artificial Sequence
  Description of Artificial Sequence: Synthetic peptide
  Seed: RMYNMVPF (TYRP2_HUMAN)
  misc_feature (2)..(2): Xaa can be Gln, Met, Tyr, Phe, Leu, Val, Lys, Ser, Thr, Glu, Trp, His, Ile, Ala, Asn, Gly, Arg, Cys, or Pro
  misc_feature (8)..(8): Xaa can be Tyr, Phe, Met, Leu, Ile, Trp, Val, His, Ala, Ser, Thr, Gly, Cys, or Pro
RXYNMVPX

SEQ ID NO: 197668 - protein, 9 aa, Artificial Sequence
  Description of Artificial Sequence: Synthetic peptide
  Seed: RMYNMVPFF (TYRP2_HUMAN)
  misc_feature (2)..(2): Xaa can be Ser, Arg, Val, Thr, Met, Trp, Ile, Phe, Leu, Tyr, Ala, Gln, Gly, Asn, Lys, Glu, His, Cys, Pro, or Asp
  misc_feature (9)..(9): Xaa can be Val, Tyr, Ile, Phe, Met, Arg, Lys, Trp, Leu, Ala, His, Thr, Ser, Gly, Cys, Gln, Pro, Asn, Glu, or Asp
RXYNMVPFX

SEQ ID NO: 197669 - protein, 10 aa, Artificial Sequence
  Description of Artificial Sequence: Synthetic peptide
  Seed: RMYNMVPFFP (TYRP2_HUMAN)
  misc_feature (2)..(2): Xaa can be Gln, Met, Ser, Thr, Val, Tyr, Leu, Ile, Phe, Ala, Trp, Gly, Lys, Asn, His, Glu, Arg, Cys, Pro, or Asp
  misc_feature (10)..(10): Xaa can be Val, Ala, Lys, Tyr, Met, Phe, Leu, Ile, Trp, Arg, His, Ser, Thr, Gly, Cys, Gln, Asn, Pro, Glu, or Asp
RXYNMVPFFX

SEQ ID NO: 197670 - protein, 11 aa, Artificial Sequence
  Description of Artificial Sequence: Synthetic peptide
  Seed: RMYNMVPFFPP (TYRP2_HUMAN)
  misc_feature (2)..(2): Xaa can be Met, Leu, Ile, Gln, Val, Thr, Ser, Ala, or Phe
  misc_feature (11)..(11): Xaa can be Val, Ile, Leu, Ala, Met, Thr, Cys, Phe, Ser, or Pro
RXYNMVPFFPX

SEQ ID NO: 197671 - protein, 9 aa, Artificial Sequence
  Description of Artificial Sequence: Synthetic peptide
  Seed: RNALEGFDK (TYRP2_HUMAN)
  misc_feature (2)..(2): Xaa can be Arg, Gln, Lys, Gly, or Asn
  misc_feature (9)..(9): Xaa can be Lys, Arg, Leu, Phe, Tyr, Met, Ala, Gln, Ile, Trp, Val, or His
RXALEGFDX

SEQ ID NO: 197672 - protein, 9 aa, Artificial Sequence
  Description of Artificial Sequence: Synthetic peptide
  Seed: RNQDDRELW (TYRP2_HUMAN)
  misc_feature (2)..(2): Xaa can be Glu, Gln, Met, Ser, Ala, Thr, Leu, Val, Ile, Gly, Asn, Asp, Cys, Phe, His, Lys, Pro, Trp, Arg, or Tyr
  misc_feature (9)..(9): Xaa can be Trp, Phe, Leu, Tyr, Ile, Met, Val, Cys, Ala, Thr, Lys, Arg, Gln, or His
RXQDDRELX

SEQ ID NO: 197673 - protein, 11 aa, Artificial Sequence
  Description of Artificial Sequence: Synthetic peptide
  Seed: RNQDDRELWPR (TYRP2_HUMAN)
  misc_feature (2)..(2): Xaa can be Gln, Met, Val, Ser, Ala, Ile, Trp, Tyr, Leu, Phe, Thr, Glu, Cys, Arg, Gly, or Asn
  misc_feature (11)..(11): Xaa can be Arg, or Lys
RXQDDRELWPX

SEQ ID NO: 197674 - protein, 9 aa, Artificial Sequence
  Description of Artificial Sequence: Synthetic peptide
  Seed: RNQMGRNSM (TYRP2_HUMAN)
  misc_feature (2)..(2): Xaa can be Arg, Gln, Met, Lys, His, Ala, Glu, Gly, Ser, Asn, Leu, Asp, Ile, Thr, Val, Tyr, Cys, Phe, Trp, or Pro
  misc_feature (9)..(9): Xaa can be Leu, Phe, Ile, Met, Tyr, Lys, Val, Arg, His, Trp, Ala, Cys, Gly, Thr, Ser, Gln, Pro, Asn, or Glu
RXQMGRNSX

SEQ ID NO: 197675 - protein, 10 aa, Artificial Sequence
  Description of Artificial Sequence: Synthetic peptide
  Seed: RNQMGRNSMK (TYRP2_HUMAN)
  misc_feature (2)..(2): Xaa can be Arg, Thr, Val, Ser, Tyr, Met, Phe, Ile, Ala, Trp, Leu, Gly, Gln, Asn, Asp, Cys, Lys, Glu, His, or Pro
  misc_feature (10)..(10): Xaa can be Lys, Arg, Ala, Ile, Val, Tyr, Met, Leu, Ser, Gly, Phe, Thr, His, Asn, Pro, Glu, Cys, Gln, or Trp
RXQMGRNSMX

SEQ ID NO: 197676 - protein, 9 aa, Artificial Sequence
  Description of Artificial Sequence: Synthetic peptide
  Seed: RNSMKLPTL (TYRP2_HUMAN)
  misc_feature (2)..(2): Xaa can be Arg, Ala, Gln, Thr, Ser, Met, Ile, Glu, Leu, Pro, His, Gly, Val, Lys, Asn, Asp, Tyr, Cys, Trp, or Phe
  misc_feature (9)..(9): Xaa can be Met, Phe, Ile, Leu, Tyr, Val, Lys, Arg, Trp, Cys, Ala, His, Thr, Pro, Gln, Glu, Asn, Ser, or Gly
RXSMKLPTX

SEQ ID NO: 197677 - protein, 10 aa, Artificial Sequence
  Description of Artificial Sequence: Synthetic peptide
  Seed: RNSMKLPTLK (TYRP2_HUMAN)
  misc_feature (2)..(2): Xaa can be Arg, Thr, Tyr, Val, Trp, Met, Phe, Ser, Ile, Gln, Ala, Leu, Gly, Asn, His, Glu, Cys, Asp, Pro, or Lys
  misc_feature (10)..(10): Xaa can be Val, Ala, Arg, Lys, Tyr, Leu, Met, Ile, His, Ser, Gly, Phe, Thr, Gln, Cys, Glu, Trp, or As n
RXSMKLPTLX

SEQ ID NO: 197678 - protein, 8 aa, Artificial Sequence
  Description of Artificial Sequence: Synthetic peptide
  Seed: RNSRFSSW (TYRP2_HUMAN)
  misc_feature (2)..(2): Xaa can be Cys, Gly, Ser, Met, Ala, Ile, Asn, Val, Leu, or Thr
  misc_feature (8)..(8): Xaa can be , or Trp
RXSRFSSX

SEQ ID NO: 197679 - protein, 10 aa, Artificial Sequence
  Description of Artificial Sequence: Synthetic peptide
  Seed: RNSRFSSWET (TYRP2_HUMAN)
  misc_feature (2)..(2): Xaa can be Ser, Phe, Gly, Glu, Pro, Ile, Gln, Ala, Met, Leu, Lys, Arg, Asn, Trp, Val, Tyr, Thr, Cys, Asp, or His
  misc_feature (10)..(10): Xaa can be Gln, Leu, Tyr, Lys, Gly, Asn, Val, Ala, Arg, His, Thr, Cys, Met, Ile, Ser, Glu, Pro, or Ph e
RXSRFSSWEX

SEQ ID NO: 197680 - protein, 11 aa, Artificial Sequence
  Description of Artificial Sequence: Synthetic peptide
  Seed: RNSRFSSWETV (TYRP2_HUMAN)
  misc_feature (2)..(2): Xaa can be Arg, Ala, Ile, Met, Phe, Trp, Val, Glu, Asp, Gly, Tyr, Gln, Lys, Asn, Leu, Ser, His, Thr, Pro, or Cys
  misc_feature (11)..(11): Xaa can be Phe, Thr, Ala, Lys, Cys, Leu, Tyr, Val, Arg, Met, Ile, His, or Trp
RXSRFSSWETX

SEQ ID NO: 197681 - protein, 8 aa, Artificial Sequence
  Description of Artificial Sequence: Synthetic peptide
  Seed: RPDDPTLI (TYRP2_HUMAN)
  misc_feature (2)..(2): Xaa can be Ala, Ser, Val, Phe, Ile, Tyr, Thr, Gly, Pro, Trp, Leu, Asn, Asp, Cys, Gln, Met, His, Glu, or Arg
  misc_feature (8)..(8): Xaa can be Leu, Phe, Ile, Met, Val, Tyr, Ala, Cys, Trp, or Thr
RXDDPTLX

SEQ ID NO: 197682 - protein, 9 aa, Artificial Sequence
  Description of Artificial Sequence: Synthetic peptide
  Seed: RPDDPTLIS (TYRP2_HUMAN)
  misc_feature (2)..(2): Xaa can be Pro, Ala, Phe, Tyr, Val, Trp, Ile, Leu, Ser, or Met
  misc_feature (9)..(9): Xaa can be Leu, Met, Phe, Ile, Ala, Val, Lys, Tyr, Trp, Thr, Ser, Arg, Gly, Pro, or Cys
RXDDPTLIX

SEQ ID NO: 197683 - protein, 10 aa, Artificial Sequence
  Description of Artificial Sequence: Synthetic peptide
  Seed: RPDDPTLISR (TYRP2_HUMAN)
  misc_feature (2)..(2): Xaa can be Pro, Thr, Ala, Ser, Val, Met, Tyr, Ile, Phe, Leu, Gln, Gly, Trp, Cys, Asn, Glu, Lys, His, Asp, or Arg
  misc_feature (10)..(10): Xaa can be Met, Phe, Tyr, Leu, Lys, Arg, Trp, Val, Ile, Cys, Ala, His, Gln, Thr, Gly, Asp, Glu, Asn, Ser, or Pro
RXDDPTLISX

SEQ ID NO: 197684 - protein, 8 aa, Artificial Sequence
  Description of Artificial Sequence: Synthetic peptide
  Seed: RPWSGPYI (TYRP2_HUMAN)
  misc_feature (2)..(2): Xaa can be , or Pro
  misc_feature (8)..(8): Xaa can be Ile, Met, Thr, Phe, Val, Ala, Pro, Tyr, Gly, Leu, Ser, or Cys
RXWSGPYX

SEQ ID NO: 197685 - protein, 9 aa, Artificial Sequence
  Description of Artificial Sequence: Synthetic peptide
  Seed: RPWSGPYIL (TYRP2_HUMAN)
  misc_feature (2)..(2): Xaa can be Pro, Arg, His, Gln, Ser, Ala, Thr, Val, Tyr, Glu, Met, Gly, Ile, Lys, Leu, Phe, Asn, Cys, Asp, or Trp
  misc_feature (9)..(9): Xaa can be Leu, Met, Phe, Ile, Val, Tyr, Trp, Ala, Cys, His, Lys, Thr, Ser, Gly, Pro, Arg, Asn, Glu, Gln, or Asp
RXWSGPYIX

SEQ ID NO: 197686 - protein, 10 aa, Artificial Sequence
  Description of Artificial Sequence: Synthetic peptide
  Seed: RPWSGPYILR (TYRP2_HUMAN)
  misc_feature (2)..(2): Xaa can be Pro, Met, Trp, Val, Thr, Tyr, Phe, Leu, Gln, Ser, Ile, Ala, Gly, Asn, Cys, Arg, Asp, Lys, His, or Glu
  misc_feature (10)..(10): Xaa can be Lys, Arg, His, Tyr, Leu, Met, Phe, Gln, Val, Ala, Glu, Ile, Ser, Asp, Cys, Thr, Trp, Asn, Gly, or Pro
RXWSGPYILX

SEQ ID NO: 197687 - protein, 8 aa, Artificial Sequence
  Description of Artificial Sequence: Synthetic peptide
  Seed: RPYRAIDF (TYRP2_HUMAN)
  misc_feature (2)..(2): Xaa can be , or Pro
  misc_feature (8)..(8): Xaa can be Ala, Leu, Thr, Pro, Cys, Val, Met, Phe, Ile, or Ser
RXYRAIDX

SEQ ID NO: 197688 - protein, 9 aa, Artificial Sequence
  Description of Artificial Sequence: Synthetic peptide
  Seed: RPYRAIDFS (TYRP2_HUMAN)
  misc_feature (2)..(2): Xaa can be , or Pro
  misc_feature (9)..(9): Xaa can be Phe, Thr, Ile, Gly, Leu, Met, Pro, Val, Cys, Ser, or Ala
RXYRAIDFX

SEQ ID NO: 197689 - protein, 9 aa, Artificial Sequence
  Description of Artificial Sequence: Synthetic peptide
  Seed: RQNIHSLSP (TYRP2_HUMAN)
  misc_feature (2)..(2): Xaa can be Gln, Met, Lys, Ala, His, Glu, Leu, Arg, Val, Ser, Thr, Ile, Asn, Phe, Tyr, Gly, Cys, Trp, Pro, or Asp
  misc_feature (9)..(9): Xaa can be Tyr, Phe, Met, Leu, Ile, Trp, His, Val, Ala, Thr, Gly, Cys, Asn, Gln, Ser, Pro, or Glu
RXNIHSLSX

SEQ ID NO: 197690 - protein, 9 aa, Artificial Sequence
  Description of Artificial Sequence: Synthetic peptide
  Seed: RRLRKGYTP (TYRP2_HUMAN)
  misc_feature (2)..(2): Xaa can be Arg, Gln, Lys, Gly, His, Asn, Met, Glu, Ser, Ala, Leu, Thr, Asp, Ile, Val, Cys, Pro, Phe, Trp, or Tyr
  misc_feature (9)..(9): Xaa can be Leu, Ile, Phe, Lys, Met, Arg, Val, Tyr, His, Trp, Ala, Cys, Thr, Ser, Gln, Pro, Gly, Glu, or Asn
RXLRKGYTX

SEQ ID NO: 197691 - protein, 10 aa, Artificial Sequence
  Description of Artificial Sequence: Synthetic peptide
  Seed: RRLRKGYTPL (TYRP2_HUMAN)
  misc_feature (2)..(2): Xaa can be Thr, Pro, Met, Val, Arg, Ser, Phe, Gln, Tyr, Ala, Ile, Trp, Gly, Cys, Leu, His, Asn, Lys, Glu, or Asp
  misc_feature (10)..(10): Xaa can be Pro, Gly, Ser, Arg, Lys, Val, Asn, Ile, Thr, Tyr, Ala, Phe, Met, Leu, Gln, Cys, His, Glu, Trp, or Asp
RXLRKGYTPX

SEQ ID NO: 197692 - protein, 11 aa, Artificial Sequence
  Description of Artificial Sequence: Synthetic peptide
  Seed: RRLRKGYTPLM (TYRP2_HUMAN)
  misc_feature (2)..(2): Xaa can be Arg, Gln, Trp, Met, Glu, Leu, Ala, Ser, Asn, Lys, Thr, Tyr, His, Val, Pro, Ile, Gly, Asp, Cys, or Phe
  misc_feature (11)..(11): Xaa can be Arg, Tyr, Met, Phe, Leu, Lys, Ile, Val, Ala, Ser, Gln, Asn, Pro, Thr, Trp, Glu, Gly, His, Cys, or Asp
RXLRKGYTPLX

SEQ ID NO: 197693 - protein, 9 aa, Artificial Sequence
  Description of Artificial Sequence: Synthetic peptide
  Seed: RRNQMGRNS (TYRP2_HUMAN)
  misc_feature (2)..(2): Xaa can be Arg, Gln, Gly, Ala, Lys, Leu, Asn, Met, Glu, Ser, Val, Thr, Ile, Asp, His, Trp, Cys, or Ph e
  misc_feature (9)..(9): Xaa can be Leu, Phe, Lys, Ile, Arg, Tyr, Met, Val, His, Gly, Asn, Glu, Ser, Gln, Pro, Cys, Ala, Trp, or Thr
RXNQMGRNX

SEQ ID NO: 197694 - protein, 10 aa, Artificial Sequence
  Description of Artificial Sequence: Synthetic peptide
  Seed: RRNQMGRNSM (TYRP2_HUMAN)
  misc_feature (2)..(2): Xaa can be Arg, Gln, Met, Lys, Gly, His, Asn, Leu, Glu, Ser, Ala, Tyr, Phe, Val, Thr, Ile, Asp, Trp, or Cys
  misc_feature (10)..(10): Xaa can be Leu, Phe, Tyr, Lys, Met, Ile, Arg, Trp, His, Ala, Val, Gln, Ser, Cys, Gly, Thr, Glu, Pro, or Asn
RXNQMGRNSX

SEQ ID NO: 197695 - protein, 11 aa, Artificial Sequence
  Description of Artificial Sequence: Synthetic peptide
  Seed: RRNQMGRNSMK (TYRP2_HUMAN)
  misc_feature (2)..(2): Xaa can be Arg, Gln, Lys, Met, Leu, Tyr, Ile, Phe, His, Ala, Trp, Val, Cys, Pro, Gly, Thr, Asn, Glu, Asp, or Ser
  misc_feature (11)..(11): Xaa can be Lys, Arg, Phe, Tyr, Trp, Leu, Met, Pro, Ile, Val, Cys, Gly, Asn, Gln, Thr, His, Glu, Ser, or Ala
RXNQMGRNSMX

SEQ ID NO: 197696 - protein, 9 aa, Artificial Sequence
  Description of Artificial Sequence: Synthetic peptide
  Seed: RTCKCTGNF (TYRP2_HUMAN)
  misc_feature (2)..(2): Xaa can be Ala, Met, Thr, Gln, Val, Leu, Ile, Ser, Tyr, Glu, Asn, Trp, Lys, Gly, Phe, Pro, Cys, Arg, Asp, or His
  misc_feature (9)..(9): Xaa can be Tyr, Phe, Trp, Lys, Met, Leu, Arg, Ile, Val, His, or Ala
RXCKCTGNX

SEQ ID NO: 197697 - protein, 10 aa, Artificial Sequence
  Description of Artificial Sequence: Synthetic peptide
  Seed: RTCKCTGNFA (TYRP2_HUMAN)
  misc_feature (2)..(2): Xaa can be Val, Thr, Ser, Ile, Met, Ala, Phe, Tyr, Gln, Leu, Trp, Asn, Gly, Asp, His, Pro, Cys, Glu, Lys, or Arg
  misc_feature (10)..(10): Xaa can be Lys, Val, Ala, Leu, Met, Ile, Arg, Tyr, Ser, Thr, Phe, Gly, Gln, Glu, Cys, His, Pro, or As n
RXCKCTGNFX

SEQ ID NO: 197698 - protein, 9 aa, Artificial Sequence
  Description of Artificial Sequence: Synthetic peptide
  Seed: RVCMTVDSL (TYRP2_HUMAN)
  misc_feature (2)..(2): Xaa can be Arg, Gln, Met, Gly, Ala, Ser, Val, Asn, Leu, Thr, Ile, Glu, Asp, Lys, Tyr, Trp, Cys, Phe, Pro, or His
  misc_feature (9)..(9): Xaa can be Tyr, Leu, Phe, Trp, Met, Val, Ile, Lys, Ala, His, Cys, Arg, Thr, or Gln
RXCMTVDSX

SEQ ID NO: 197699 - protein, 10 aa, Artificial Sequence
  Description of Artificial Sequence: Synthetic peptide
  Seed: RVCMTVDSLV (TYRP2_HUMAN)
  misc_feature (2)..(2): Xaa can be Met, Gln, Leu, Ile, Val, Thr, or Glu
  misc_feature (10)..(10): Xaa can be Leu, Val, Ile, Met, Ala, Phe, Thr, or Trp
RXCMTVDSLX

SEQ ID NO: 197700 - protein, 9 aa, Artificial Sequence
  Description of Artificial Sequence: Synthetic peptide
  Seed: RVHPDYVIT (TYRP2_HUMAN)
  misc_feature (2)..(2): Xaa can be Thr, Val, Ser, Ile, Met, Ala, Leu, Tyr, Phe, Gly, Trp, Gln, Asn, or Cys
  misc_feature (9)..(9): Xaa can be Lys, Ala, Val, Ile, Tyr, Arg, Leu, Met, Ser, Gly, Thr, His, Gln, Cys, or Phe
RXHPDYVIX

SEQ ID NO: 197701 - protein, 9 aa, Artificial Sequence
  Description of Artificial Sequence: Synthetic peptide
  Seed: RYHLLCLER (TYRP2_HUMAN)
  misc_feature (2)..(2): Xaa can be Val, Thr, Met, Ser, Ala, Ile, Leu, Gln, Asn, Phe, Trp, Tyr, Gly, Cys, Pro, Asp, His, or Gl u
  misc_feature (9)..(9): Xaa can be Arg, Lys, Tyr, Met, Leu, Val, His, Ile, Ala, or Phe
RXHLLCLEX

SEQ ID NO: 197702 - protein, 11 aa, Artificial Sequence
  Description of Artificial Sequence: Synthetic peptide
  Seed: RYHLLCLERDL (TYRP2_HUMAN)
  misc_feature (2)..(2): Xaa can be Tyr, Trp, or Phe
  misc_feature (11)..(11): Xaa can be Phe, Trp, Leu, or Ile
RXHLLCLERDX

SEQ ID NO: 197703 - protein, 8 aa, Artificial Sequence
  Description of Artificial Sequence: Synthetic peptide
  Seed: SAANDPIF (TYRP2_HUMAN)
  misc_feature (2)..(2): Xaa can be , or Ala
  misc_feature (8)..(8): Xaa can be Phe, Met, Leu, or Tyr
SXANDPIX

SEQ ID NO: 197704 - protein, 9 aa, Artificial Sequence
  Description of Artificial Sequence: Synthetic peptide
  Seed: SAANDPIFV (TYRP2_HUMAN)
  misc_feature (2)..(2): Xaa can be Leu, Met, Ala, Thr, Ile, Val, Gln, Ser, Arg, Gly, Tyr, Phe, Asn, Glu, Pro, Cys, His, Trp, Asp, or Lys
  misc_feature (9)..(9): Xaa can be Leu, Met, Lys, Arg, Tyr, Phe, Ile, Val, Ala, His, Thr, Trp, Cys, or Ser
SXANDPIFX

SEQ ID NO: 197705 - protein, 10 aa, Artificial Sequence
  Description of Artificial Sequence: Synthetic peptide
  Seed: SAANDPIFVV (TYRP2_HUMAN)
  misc_feature (2)..(2): Xaa can be Met, Leu, Thr, Ala, Val, Ile, Ser, Gln, Gly, Asn, Tyr, Phe, Glu, or Asp
  misc_feature (10)..(10): Xaa can be Lys, Val, Arg, Leu, Tyr, Ile, Met, Ala, Phe, Thr, Trp, Asp, Asn, His, Gly, Cys, Ser, Pro, Gln, or Glu
SXANDPIFVX

SEQ ID NO: 197706 - protein, 11 aa, Artificial Sequence
  Description of Artificial Sequence: Synthetic peptide
  Seed: SAANDPIFVVL (TYRP2_HUMAN)
  misc_feature (2)..(2): Xaa can be Thr, Ala, Ser, Val, Met, Ile, Gly, Leu, Gln, Arg, Cys, Pro, Tyr, Asp, Glu, Phe, Trp, Asn, or His
  misc_feature (11)..(11): Xaa can be Lys, Arg, Leu, Tyr, Phe, Met, His, Ile, Val, or Trp
SXANDPIFVVX

SEQ ID NO: 197707 - protein, 11 aa, Artificial Sequence
  Description of Artificial Sequence: Synthetic peptide
  Seed: SANVCGSQQGR (TYRP2_HUMAN)
  misc_feature (2)..(2): Xaa can be Ala, Thr, Ser, Val, Gln, Ile, Met, Gly, Asn, Leu, Glu, Phe, Cys, Asp, Tyr, Trp, or Pro
  misc_feature (11)..(11): Xaa can be Lys, Arg, Tyr, Phe, Leu, Met, His, or Trp
SXNVCGSQQGX

SEQ ID NO: 197708 - protein, 8 aa, Artificial Sequence
  Description of Artificial Sequence: Synthetic peptide
  Seed: SDQLGYSY (TYRP2_HUMAN)
  misc_feature (2)..(2): Xaa can be Glu, Asp, Gln, Pro, Ala, Met, Thr, Ile, Val, Leu, or Ser
  misc_feature (8)..(8): Xaa can be Tyr, Phe, Leu, Trp, Met, Ile, Val, His, Ala, Cys, or Thr
SXQLGYSX

SEQ ID NO: 197709 - protein, 9 aa, Artificial Sequence
  Description of Artificial Sequence: Synthetic peptide
  Seed: SDQLGYSYA (TYRP2_HUMAN)
  misc_feature (2)..(2): Xaa can be Glu, Asp, or Gln
  misc_feature (9)..(9): Xaa can be Ala, Val, Cys, Leu, Met, Pro, Ile, Gly, Phe, Glu, Trp, Tyr, Asp, Thr, or Ser
SXQLGYSYX

SEQ ID NO: 197710 - protein, 10 aa, Artificial Sequence
  Description of Artificial Sequence: Synthetic peptide
  Seed: SDQLGYSYAI (TYRP2_HUMAN)
  misc_feature (2)..(2): Xaa can be Glu, Met, Leu, Trp, Gly, Ile, Thr, Ala, Cys, Arg, Phe, Asn, Asp, Pro, Gln, His, Val, Ser, Tyr, or Lys
  misc_feature (10)..(10): Xaa can be Val, Leu, Thr, Tyr, Trp, Met, Ala, His, Phe, Ile, Cys, Ser, Gly, or Pro
SXQLGYSYAX

SEQ ID NO: 197711 - protein, 9 aa, Artificial Sequence
  Description of Artificial Sequence: Synthetic peptide
  Seed: SFALPYWNF (TYRP2_HUMAN)
  misc_feature (2)..(2): Xaa can be Tyr, Trp, Arg, Phe, Gln, Met, His, Thr, Ser, Ala, Val, Leu, Gly, Asn, Ile, Glu, Cys, Lys, Asp, or Pro
  misc_feature (9)..(9): Xaa can be Tyr, Phe, Trp, Ile, Leu, Met, Val, Lys, Thr, Ala, Cys, or Gly
SXALPYWNX

SEQ ID NO: 197712 - protein, 9 aa, Artificial Sequence
  Description of Artificial Sequence: Synthetic peptide
  Seed: SFLNGTNAL (TYRP2_HUMAN)
  misc_feature (2)..(2): Xaa can be Ala, Tyr, Ser, Phe, Thr, Val, Arg, Met, Ile, Gln, Leu, Gly, Glu, Cys, Asn, Pro, Trp, Asp, His, or Lys
  misc_feature (9)..(9): Xaa can be Phe, Ile, Val, Met, Tyr, Leu, His, Arg, Lys, Trp, Ala, Cys, Thr, Ser, Gln, Pro, or Gly
SXLNGTNAX

SEQ ID NO: 197713 - protein, 9 aa, Artificial Sequence
  Description of Artificial Sequence: Synthetic peptide
  Seed: SFRNALEGF (TYRP2_HUMAN)
  misc_feature (2)..(2): Xaa can be Ala, Gln, Tyr, Met, Ser, Val, Arg, Phe, Trp, Leu, Thr, Ile, Gly, His, Asn, Glu, Pro, Lys, Cys, or Asp
  misc_feature (9)..(9): Xaa can be Tyr, Phe, Met, Leu, Ile, His, Trp, Val, or Ala
SXRNALEGX

SEQ ID NO: 197714 - protein, 11 aa, Artificial Sequence
  Description of Artificial Sequence: Synthetic peptide
  Seed: SFRNALEGFDK (TYRP2_HUMAN)
  misc_feature (2)..(2): Xaa can be Thr, Ala, Trp, Met, Phe, Tyr, Ser, Val, Gln, Ile, or Leu
  misc_feature (11)..(11): Xaa can be Arg, Lys, or Ala
SXRNALEGFDX

SEQ ID NO: 197715 - protein, 10 aa, Artificial Sequence
  Description of Artificial Sequence: Synthetic peptide
  Seed: SFTDAIFDEW (TYRP2_HUMAN)
  misc_feature (2)..(2): Xaa can be Tyr, Thr, Ser, Trp, Phe, Ala, Met, Gly, Cys, Ile, Val, Leu, Asp, Arg, Glu, His, Lys, Gln, Asn, or Pro
  misc_feature (10)..(10): Xaa can be Trp, Phe, Ile, Leu, Tyr, Met, or Val
SXTDAIFDEX

SEQ ID NO: 197716 - protein, 8 aa, Artificial Sequence
  Description of Artificial Sequence: Synthetic peptide
  Seed: SHQGPAFV (TYRP2_HUMAN)
  misc_feature (2)..(2): Xaa can be , or His
  misc_feature (8)..(8): Xaa can be Val, Ala, or Leu
SXQGPAFX

SEQ ID NO: 197717 - protein, 9 aa, Artificial Sequence
  Description of Artificial Sequence: Synthetic peptide
  Seed: SHQGPAFVT (TYRP2_HUMAN)
  misc_feature (2)..(2): Xaa can be His, Arg, Gln, Glu, Pro, Lys, Asn, or Met
  misc_feature (9)..(9): Xaa can be Leu, Met, Ala, Ile, Val, Phe, Pro, Trp, Cys, Thr, Ser, Gly, or Tyr
SXQGPAFVX

SEQ ID NO: 197718 - protein, 10 aa, Artificial Sequence
  Description of Artificial Sequence: Synthetic peptide
  Seed: SHQGPAFVTW (TYRP2_HUMAN)
  misc_feature (2)..(2): Xaa can be Glu, His, Tyr, Gln, Trp, Met, Phe, Leu, Arg, Ile, Ala, Pro, Val, Thr, Lys, Asn, Ser, Asp, Cys, or Gly
  misc_feature (10)..(10): Xaa can be Trp, Phe, Leu, Tyr, Ile, Met, Val, Cys, Thr, His, Ala, Gln, Arg, or Lys
SXQGPAFVTX

SEQ ID NO: 197719 - protein, 8 aa, Artificial Sequence
  Description of Artificial Sequence: Synthetic peptide
  Seed: SLDDYNHL (TYRP2_HUMAN)
  misc_feature (2)..(2): Xaa can be Ala, Ile, Phe, Gly, Thr, Gln, Tyr, Val, Ser, Leu, Met, His, Trp, Arg, Pro, Cys, Asp, Asn, Glu, or Lys
  misc_feature (8)..(8): Xaa can be Met, Leu, Phe, Ile, Val, Tyr, Lys, Arg, Trp, Cys, or Ala
SXDDYNHX

SEQ ID NO: 197720 - protein, 9 aa, Artificial Sequence
  Description of Artificial Sequence: Synthetic peptide
  Seed: SLDDYNHLV (TYRP2_HUMAN)
  misc_feature (2)..(2): Xaa can be Ala, Met, Thr, Leu, Tyr, Ile, Ser, Phe, Val, Trp, Gly, Gln, Asn, Arg, Cys, His, Pro, Glu, Asp, or Lys
  misc_feature (9)..(9): Xaa can be Arg, Val, Leu, Met, Lys, Phe, Ile, Trp, Tyr, His, Thr, Ala, Cys, Gln, Ser, Pro, Glu, Gly, Asn, or Asp
SXDDYNHLX

SEQ ID NO: 197721 - protein, 10 aa, Artificial Sequence
  Description of Artificial Sequence: Synthetic peptide
  Seed: SLDDYNHLVT (TYRP2_HUMAN)
  misc_feature (2)..(2): Xaa can be Met, Leu, Ala, Ser, Ile, Thr, Val, Gly, Phe, Cys, Tyr, Asn, Trp, Gln, Pro, Asp, His, Lys, Glu, or Arg
  misc_feature (10)..(10): Xaa can be Met, Leu, Phe, Val, Ile, Trp, Tyr, Cys, Ala, Thr, Lys, Gln, Arg, Ser, His, Gly, Pro, Asn, Glu, or Asp
SXDDYNHLVX

SEQ ID NO: 197722 - protein, 11 aa, Artificial Sequence
  Description of Artificial Sequence: Synthetic peptide
  Seed: SLDDYNHLVTL (TYRP2_HUMAN)
  misc_feature (2)..(2): Xaa can be Ala, Thr, Tyr, Ser, Leu, Met, Val, Ile, Trp, Phe, Gly, Arg, Cys, Gln, Asn, Pro, Asp, Glu, His, or Lys
  misc_feature (11)..(11): Xaa can be Met, Ile, Lys, Leu, Phe, Tyr, Trp, Arg, Val, His, Cys, Ala, Thr, Gln, Ser, Glu, Asn, Gly, or Pro
SXDDYNHLVTX

SEQ ID NO: 197723 - protein, 9 aa, Artificial Sequence
  Description of Artificial Sequence: Synthetic peptide
  Seed: SLHNLVHSF (TYRP2_HUMAN)
  misc_feature (2)..(2): Xaa can be Ala, Arg, Gln, Tyr, Ser, Met, Leu, His, Ile, Pro, Thr, Phe, Val, Gly, Trp, Glu, Asn, Cys, Asp, or Lys
  misc_feature (9)..(9): Xaa can be Leu, Trp, Tyr, Val, Phe, Lys, Ile, Met, Arg, His, Cys, Ala, Thr, Ser, Gln, Pro, Gly, Asn, or Glu
SXHNLVHSX

SEQ ID NO: 197724 - protein, 10 aa, Artificial Sequence
  Description of Artificial Sequence: Synthetic peptide
  Seed: SLHNLVHSFL (TYRP2_HUMAN)
  misc_feature (2)..(2): Xaa can be Leu, Met, Gln, Ile, Val, Thr, Ala, Ser, or Glu
  misc_feature (10)..(10): Xaa can be Val, Ile, Leu, Trp, Ala, Met, Phe, Thr, Cys, Ser, or Tyr
SXHNLVHSFX

SEQ ID NO: 197725 - protein, 10 aa, Artificial Sequence
  Description of Artificial Sequence: Synthetic peptide
  Seed: SLQKFDNPPF (TYRP2_HUMAN)
  misc_feature (2)..(2): Xaa can be Gln, Met, Phe, Cys, Arg, Trp, Ala, Thr, Ile, Leu, Gly, Pro, Ser, Lys, Val, Glu, His, Asn, Asp, or Tyr
  misc_feature (10)..(10): Xaa can be Leu, Tyr, Met, Phe, Trp, Ile, or His
SXQKFDNPPX

SEQ ID NO: 197726 - protein, 11 aa, Artificial Sequence
  Description of Artificial Sequence: Synthetic peptide
  Seed: SLQKFDNPPFF (TYRP2_HUMAN)
  misc_feature (2)..(2): Xaa can be Gln, Met, Leu, Arg, Tyr, Asp, Trp, Ile, Pro, Val, Ser, Ala, Asn, Cys, His, Lys, Thr, Phe, Glu, or Gly
  misc_feature (11)..(11): Xaa can be Phe, Tyr, Met, Trp, Leu, or Ile
SXQKFDNPPFX

SEQ ID NO: 197727 - protein, 10 aa, Artificial Sequence
  Description of Artificial Sequence: Synthetic peptide
  Seed: SLSPQEREQF (TYRP2_HUMAN)
  misc_feature (2)..(2): Xaa can be Ala, Gln, Ile, Val, Ser, Leu, Met, Thr, Gly, Tyr, Glu, Arg, Phe, Asn, Cys, Lys, Pro, Asp, Trp, or His
  misc_feature (10)..(10): Xaa can be Tyr, Trp, Phe, Leu, Met, Lys, Ile, Val, Arg, His, or Ala
SXSPQEREQX

SEQ ID NO: 197728 - protein, 11 aa, Artificial Sequence
  Description of Artificial Sequence: Synthetic peptide
  Seed: SLSPQEREQFL (TYRP2_HUMAN)
  misc_feature (2)..(2): Xaa can be Gln, Leu, Met, Ala, Ile, Val, Glu, Thr, or Ser
  misc_feature (11)..(11): Xaa can be Trp, Leu, Phe, Ile, Met, Val, or Tyr
SXSPQEREQFX

SEQ ID NO: 197729 - protein, 10 aa, Artificial Sequence
  Description of Artificial Sequence: Synthetic peptide
  Seed: SLVNKECCPR (TYRP2_HUMAN)
  misc_feature (2)..(2): Xaa can be Val, Thr, Tyr, Asn, Trp, Leu, Glu, Ser, Asp, Ala, Met, Pro, Gln, Gly, Phe, Ile, Cys, Lys, His, or Arg
  misc_feature (10)..(10): Xaa can be Arg, Lys, or Tyr
SXVNKECCPX

SEQ ID NO: 197730 - protein, 11 aa, Artificial Sequence
  Description of Artificial Sequence: Synthetic peptide
  Seed: SLVNKECCPRL (TYRP2_HUMAN)
  misc_feature (2)..(2): Xaa can be Leu, or Met
  misc_feature (11)..(11): Xaa can be Leu, Val, or Ile
SXVNKECCPRX

SEQ ID NO: 197731 - protein, 8 aa, Artificial Sequence
  Description of Artificial Sequence: Synthetic peptide
  Seed: SMKLPTLK (TYRP2_HUMAN)
  misc_feature (2)..(2): Xaa can be Thr, Met, Val, Ile, Ser, Leu, or Ala
  misc_feature (8)..(8): Xaa can be Arg, or Lys
SXKLPTLX

SEQ ID NO: 197732 - protein, 10 aa, Artificial Sequence
  Description of Artificial Sequence: Synthetic peptide
  Seed: SMKLPTLKDI (TYRP2_HUMAN)
  misc_feature (2)..(2): Xaa can be Met, Leu, or Ile
  misc_feature (10)..(10): Xaa can be Val, Ala, Leu, or Ile
SXKLPTLKDX

SEQ ID NO: 197733 - protein, 11 aa, Artificial Sequence
  Description of Artificial Sequence: Synthetic peptide
  Seed: SMKLPTLKDIR (TYRP2_HUMAN)
  misc_feature (2)..(2): Xaa can be Thr, Val, Leu, Phe, Ser, Tyr, Ile, or Met
  misc_feature (11)..(11): Xaa can be Arg, or Lys
SXKLPTLKDIX

SEQ ID NO: 197734 - protein, 8 aa, Artificial Sequence
  Description of Artificial Sequence: Synthetic peptide
  Seed: SPLWWGFL (TYRP2_HUMAN)
  misc_feature (2)..(2): Xaa can be , or Pro
  misc_feature (8)..(8): Xaa can be Met, or Leu
SXLWWGFX

SEQ ID NO: 197735 - protein, 9 aa, Artificial Sequence
  Description of Artificial Sequence: Synthetic peptide
  Seed: SPLWWGFLL (TYRP2_HUMAN)
  misc_feature (2)..(2): Xaa can be Pro, Ala, Val, Ser, Thr, Met, Ile, Leu, Asn, Gly, or Gln
  misc_feature (9)..(9): Xaa can be Val, Ile, Ala, Leu, Trp, Met, Tyr, Thr, Phe, Ser, Gly, Pro, Cys, or His
SXLWWGFLX

SEQ ID NO: 197736 - protein, 10 aa, Artificial Sequence
  Description of Artificial Sequence: Synthetic peptide
  Seed: SPLWWGFLLS (TYRP2_HUMAN)
  misc_feature (2)..(2): Xaa can be Leu, Met, Gln, Ile, Val, Thr, Arg, Phe, Trp, Asp, Glu, Ala, Asn, Ser, Tyr, Lys, His, Pro, Gly, or Cys
  misc_feature (10)..(10): Xaa can be Ser, Leu, Thr, Met, Ala, Ile, Val, Cys, Pro, Gly, Phe, Asn, Asp, Lys, Glu, Trp, His, Tyr, Arg, or Gln
SXLWWGFLLX

SEQ ID NO: 197737 - protein, 11 aa, Artificial Sequence
  Description of Artificial Sequence: Synthetic peptide
  Seed: SPLWWGFLLSC (TYRP2_HUMAN)
  misc_feature (2)..(2): Xaa can be , or Pro
  misc_feature (11)..(11): Xaa can be Cys, Thr, Val, Ala, Ile, Leu, or Met
SXLWWGFLLSX

SEQ ID NO: 197738 - protein, 8 aa, Artificial Sequence
  Description of Artificial Sequence: Synthetic peptide
  Seed: SPQEREQF (TYRP2_HUMAN)
  misc_feature (2)..(2): Xaa can be Pro, Met, Val, Ala, Phe, Ile, or Leu
  misc_feature (8)..(8): Xaa can be Leu, Met, Phe, Ile, Val, or Tyr
SXQEREQX

SEQ ID NO: 197739 - protein, 9 aa, Artificial Sequence
  Description of Artificial Sequence: Synthetic peptide
  Seed: SPQEREQFL (TYRP2_HUMAN)
  misc_feature (2)..(2): Xaa can be Pro, Arg, Tyr, Gln, His, Ala, Val, Asn, Trp, Asp, Ile, Gly, Phe, Glu, Leu, Met, Lys, Thr, Ser, or Cys
  misc_feature (9)..(9): Xaa can be Leu, Met, Val, Phe, Ile, Cys, Tyr, Ala, Pro, Trp, Ser, or Thr
SXQEREQFX

SEQ ID NO: 197740 - protein, 11 aa, Artificial Sequence
  Description of Artificial Sequence: Synthetic peptide
  Seed: SPQEREQFLGA (TYRP2_HUMAN)
  misc_feature (2)..(2): Xaa can be , or Pro
  misc_feature (11)..(11): Xaa can be Ala, Leu, Ile, Met, Val, or Cys
SXQEREQFLGX

SEQ ID NO: 197741 - protein, 11 aa, Artificial Sequence
  Description of Artificial Sequence: Synthetic peptide
  Seed: SQQGRGQCTEV (TYRP2_HUMAN)
  misc_feature (2)..(2): Xaa can be , or Gln
  misc_feature (11)..(11): Xaa can be Leu, Val, or Ile
SXQGRGQCTEX

SEQ ID NO: 197742 - protein, 9 aa, Artificial Sequence
  Description of Artificial Sequence: Synthetic peptide
  Seed: SQVMSLHNL (TYRP2_HUMAN)
  misc_feature (2)..(2): Xaa can be Glu, His, Gln, Arg, Met, Leu, Val, Ala, Ile, Asp, Ser, Thr, Pro, Asn, Lys, Gly, Phe, Tyr, Trp, or Cys
  misc_feature (9)..(9): Xaa can be Phe, Tyr, Leu, Met, Ile, Val, Ala, Trp, Thr, His, Cys, Ser, Arg, Lys, Gly, or Pro
SXVMSLHNX

SEQ ID NO: 197743 - protein, 10 aa, Artificial Sequence
  Description of Artificial Sequence: Synthetic peptide
  Seed: SQVMSLHNLV (TYRP2_HUMAN)
  misc_feature (2)..(2): Xaa can be Leu, Met, Gln, Glu, Thr, Ser, Ile, Val, Ala, Asn, Asp, Tyr, Phe, Trp, Cys, Lys, His, Gly, Arg, or Pro
  misc_feature (10)..(10): Xaa can be Ile, Leu, Val, Ala, Phe, Met, Trp, Tyr, Gln, Pro, Ser, Asn, His, Cys, Lys, Arg, Glu, Gly, Asp, or Thr
SXVMSLHNLX

SEQ ID NO: 197744 - protein, 11 aa, Artificial Sequence
  Description of Artificial Sequence: Synthetic peptide
  Seed: SQVMSLHNLVH (TYRP2_HUMAN)
  misc_feature (2)..(2): Xaa can be Gln, Lys, Trp, Phe, Cys, Thr, Ser, Val, Ala, Ile, Arg, Met, Gly, Leu, Tyr, Glu, Asn, Pro, His, or Asp
  misc_feature (11)..(11): Xaa can be Met, Phe, Tyr, Leu, Ile, His, or Trp
SXVMSLHNLVX

SEQ ID NO: 197745 - protein, 9 aa, Artificial Sequence
  Description of Artificial Sequence: Synthetic peptide
  Seed: SRFSSWETV (TYRP2_HUMAN)
  misc_feature (2)..(2): Xaa can be Arg, His, Gln, Leu, Met, Lys, Glu, Tyr, Asn, Pro, Ala, Thr, Phe, Gly, Ser, Val, Asp, Ile, Trp, or Cys
  misc_feature (9)..(9): Xaa can be Phe, Leu, Tyr, Met, Ile, Val, Ala, Trp, Cys, His, Thr, Pro, Gly, Lys, Ser, Arg, or Gln
SXFSSWETX

SEQ ID NO: 197746 - protein, 10 aa, Artificial Sequence
  Description of Artificial Sequence: Synthetic peptide
  Seed: SRFSSWETVC (TYRP2_HUMAN)
  misc_feature (2)..(2): Xaa can be Arg, His, or Gln
  misc_feature (10)..(10): Xaa can be Leu, Ile, Cys, Val, Met, Phe, Ala, Pro, Gly, Tyr, Ser, Thr, Asp, His, Gln, Asn, Arg, Glu, Trp, or Lys
SXFSSWETVX

SEQ ID NO: 197747 - protein, 9 aa, Artificial Sequence
  Description of Artificial Sequence: Synthetic peptide
  Seed: SRNSRFSSW (TYRP2_HUMAN)
  misc_feature (2)..(2): Xaa can be Gln, Arg, Tyr, Lys, Met, Ala, Gly, His, Leu, Glu, Ser, Asn, Phe, Ile, Val, Thr, Trp, Asp, Cys, or Pro
  misc_feature (9)..(9): Xaa can be Phe, Tyr, Leu, Ile, Met, Val, Trp, His, Lys, Ala, Cys, Arg, Thr, Gly, Gln, Ser, or Asn
SXNSRFSSX

SEQ ID NO: 197748 - protein, 9 aa, Artificial Sequence
  Description of Artificial Sequence: Synthetic peptide
  Seed: SSKRYTEEA (TYRP2_HUMAN)
  misc_feature (2)..(2): Xaa can be Thr, Val, Ser, Met, Tyr, Ile, Phe, Ala, Leu, Trp, Gln, Gly, or Asn
  misc_feature (9)..(9): Xaa can be Lys, Ala, Arg, Val, Ile, Leu, Ser, Tyr, or Met
SXKRYTEEX

SEQ ID NO: 197749 - protein, 10 aa, Artificial Sequence
  Description of Artificial Sequence: Synthetic peptide
  Seed: SSWETVCDSL (TYRP2_HUMAN)
  misc_feature (2)..(2): Xaa can be Val, Met, Thr, Leu, Ala, Ile, Ser, Gln, Gly, Cys, Asp, Tyr, Glu, Pro, Phe, Asn, Lys, or Tr p
  misc_feature (10)..(10): Xaa can be Trp, Leu, Met, Phe, Val, Ile, Ala, Tyr, or Thr
SXWETVCDSX

SEQ ID NO: 197750 - protein, 9 aa, Artificial Sequence
  Description of Artificial Sequence: Synthetic peptide
  Seed: STFSFRNAL (TYRP2_HUMAN)
  misc_feature (2)..(2): Xaa can be Gln, Thr, Pro, Met, Tyr, Ser, Ala, Phe, Leu, Val, Arg, His, Lys, Trp, Ile, Glu, Gly, Cys, Asn, or Asp
  misc_feature (9)..(9): Xaa can be Trp, Leu, Phe, Val, Tyr, Ile, Lys, Met, His, Arg, Ala, Cys, Thr, Gly, Ser, Gln, Pro, Glu, Asn, or Asp
SXFSFRNAX

SEQ ID NO: 197751 - protein, 9 aa, Artificial Sequence
  Description of Artificial Sequence: Synthetic peptide
  Seed: SVRDTLLGP (TYRP2_HUMAN)
  misc_feature (2)..(2): Xaa can be Thr, Ser, Val, Ala, Met, Tyr, Phe, Ile, Gln, Trp, Leu, Gly, Asn, His, or Cys
  misc_feature (9)..(9): Xaa can be Lys, Val, Ala, Ile, Leu, Met, Gly, Arg, Ser, Tyr, Thr, Cys, Asn, Pro, Phe, His, Gln, or Gl u
SXRDTLLGX

SEQ ID NO: 197752 - protein, 10 aa, Artificial Sequence
  Description of Artificial Sequence: Synthetic peptide
  Seed: SVRDTLLGPG (TYRP2_HUMAN)
  misc_feature (2)..(2): Xaa can be Thr, Ser, Val, Met, Tyr, Ile, Ala, Phe, Trp, Gln, Gly, Leu, Asn, His, or Cys
  misc_feature (10)..(10): Xaa can be Lys, Ala, Val, Ile, Leu, Gly, Met, Tyr, Arg, Ser, Thr, Phe, Cys, Pro, Asn, or His
SXRDTLLGPX

SEQ ID NO: 197753 - protein, 11 aa, Artificial Sequence
  Description of Artificial Sequence: Synthetic peptide
  Seed: SVRDTLLGPGR (TYRP2_HUMAN)
  misc_feature (2)..(2): Xaa can be Met, Ile, Gln, Phe, Thr, Gly, Ala, Ser, Tyr, Leu, Val, Trp, or Asn
  misc_feature (11)..(11): Xaa can be Arg, or Lys
SXRDTLLGPGX

SEQ ID NO: 197754 - protein, 8 aa, Artificial Sequence
  Description of Artificial Sequence: Synthetic peptide
  Seed: SVYDFFVW (TYRP2_HUMAN)
  misc_feature (2)..(2): Xaa can be Ser, Thr, Ala, His, Gln, Phe, Gly, Asn, Ile, Arg, Tyr, Val, Trp, Lys, Leu, Met, or Cys
  misc_feature (8)..(8): Xaa can be Trp, Phe, Tyr, Met, or Leu
SXYDFFVX

SEQ ID NO: 197755 - protein, 9 aa, Artificial Sequence
  Description of Artificial Sequence: Synthetic peptide
  Seed: SVYDFFVWL (TYRP2_HUMAN)
  misc_feature (2)..(2): Xaa can be Leu, Met, Gln, Val, Thr, Ile, Ala, Ser, Arg, Gly, Pro, Glu, Phe, Cys, Asn, Tyr, His, Lys, Trp, or Asp
  misc_feature (9)..(9): Xaa can be Lys, Trp, Tyr, Val, Leu, Ile, Arg, Met, Phe, Ala, His, Cys, Ser, Thr, Gly, Pro, Glu, Asn, Asp, or Gln
SXYDFFVWX

SEQ ID NO: 197756 - protein, 10 aa, Artificial Sequence
  Description of Artificial Sequence: Synthetic peptide
  Seed: SVYDFFVWLH (TYRP2_HUMAN)
  misc_feature (2)..(2): Xaa can be Met, Leu, Thr, Val, Ile, Gln, Trp, Ala, Ser, Phe, Tyr, Gly, Asp, Glu, Asn, Arg, Pro, His, Lys, or Cys
  misc_feature (10)..(10): Xaa can be Tyr, Arg, Lys, Phe, His, Met, Leu, Val, Ala, Ile, Gln, Thr, or Trp
SXYDFFVWLX

SEQ ID NO: 197757 - protein, 11 aa, Artificial Sequence
  Description of Artificial Sequence: Synthetic peptide
  Seed: SVYDFFVWLHY (TYRP2_HUMAN)
  misc_feature (2)..(2): Xaa can be Ser, Thr, Gln, Ala, Val, Met, Leu, Ile, Phe, Asn, Trp, Gly, Tyr, His, Glu, or Pro
  misc_feature (11)..(11): Xaa can be Tyr, Phe, Lys, Arg, Trp, Met, Leu, or Ile
SXYDFFVWLHX

SEQ ID NO: 197758 - protein, 9 aa, Artificial Sequence
  Description of Artificial Sequence: Synthetic peptide
  Seed: SWETVCDSL (TYRP2_HUMAN)
  misc_feature (2)..(2): Xaa can be Arg, Trp, Tyr, Phe, Thr, Ser, Met, Val, Leu, Ala, Ile, Gly, Cys, His, Asn, Gln, Glu, or Pr o
  misc_feature (9)..(9): Xaa can be Leu, Met, Phe, Ile, Val, Tyr, Trp, Arg, or Lys
SXETVCDSX

SEQ ID NO: 197759 - protein, 8 aa, Artificial Sequence
  Description of Artificial Sequence: Synthetic peptide
  Seed: SYAIDLPV (TYRP2_HUMAN)
  misc_feature (2)..(2): Xaa can be Tyr, Phe, or Trp
  misc_feature (8)..(8): Xaa can be Phe, Met, Tyr, Leu, Ile, or Val
SXAIDLPX

SEQ ID NO: 197760 - protein, 10 aa, Artificial Sequence
  Description of Artificial Sequence: Synthetic peptide
  Seed: SYAIDLPVSV (TYRP2_HUMAN)
  misc_feature (2)..(2): Xaa can be Leu, Met, Tyr, Trp, Thr, Gln, Ile, Val, Phe, Ser, Ala, Pro, His, Arg, Gly, Lys, Asp, Cys, Glu, or Asn
  misc_feature (10)..(10): Xaa can be Tyr, Val, Met, Leu, Phe, Ile, Ala, Trp, Thr, Cys, or Ser
SXAIDLPVSX

SEQ ID NO: 197761 - protein, 8 aa, Artificial Sequence
  Description of Artificial Sequence: Synthetic peptide
  Seed: TDAIFDEW (TYRP2_HUMAN)
  misc_feature (2)..(2): Xaa can be Glu, Cys, Ala, Phe, Met, Thr, Ile, Val, Pro, Asn, Leu, Ser, Gln, Asp, or Gly
  misc_feature (8)..(8): Xaa can be Trp, Phe, Tyr, or Leu
TXAIFDEX

SEQ ID NO: 197762 - protein, 10 aa, Artificial Sequence
  Description of Artificial Sequence: Synthetic peptide
  Seed: TDAIFDEWMK (TYRP2_HUMAN)
  misc_feature (2)..(2): Xaa can be Leu, Ala, Gln, Ser, Met, Thr, Ile, Val, Asn, Glu, Cys, Arg, His, Tyr, Pro, Gly, Lys, Trp, Phe, or Asp
  misc_feature (10)..(10): Xaa can be Lys, Arg, or Tyr
TXAIFDEWMX

SEQ ID NO: 197763 - protein, 11 aa, Artificial Sequence
  Description of Artificial Sequence: Synthetic peptide
  Seed: TDAIFDEWMKR (TYRP2_HUMAN)
  misc_feature (2)..(2): Xaa can be Cys, Tyr, Trp, His, Thr, Glu, Val, Asn, Arg, Ser, Leu, Gly, Met, Ala, Phe, Asp, Pro, Gln, Lys, or Ile
  misc_feature (11)..(11): Xaa can be Lys, or Arg
TXAIFDEWMKX

SEQ ID NO: 197764 - protein, 9 aa, Artificial Sequence
  Description of Artificial Sequence: Synthetic peptide
  Seed: TDQLFGAAR (TYRP2_HUMAN)
  misc_feature (2)..(2): Xaa can be Ala, Ser, Thr, Val, Ile, Met, Gly, Leu, Phe, Pro, Gln, Asn, Asp, Cys, Glu, Tyr, Trp, or Hi s
  misc_feature (9)..(9): Xaa can be Arg, Lys, Leu, Met, Phe, Tyr, Ile, Ala, or Val
TXQLFGAAX

SEQ ID NO: 197765 - protein, 9 aa, Artificial Sequence
  Description of Artificial Sequence: Synthetic peptide
  Seed: TEVRADTRP (TYRP2_HUMAN)
  misc_feature (2)..(2): Xaa can be Glu, or Asp
  misc_feature (9)..(9): Xaa can be Val, Ala, Ile, Leu, Phe, Met, Gly, Cys, Pro, Thr, or Ser
TXVRADTRX

SEQ ID NO: 197766 - protein, 10 aa, Artificial Sequence
  Description of Artificial Sequence: Synthetic peptide
  Seed: TEVRADTRPW (TYRP2_HUMAN)
  misc_feature (2)..(2): Xaa can be Glu, or Gln
  misc_feature (10)..(10): Xaa can be Trp, Phe, Met, Tyr, or Leu
TXVRADTRPX

SEQ ID NO: 197767 - protein, 8 aa, Artificial Sequence
  Description of Artificial Sequence: Synthetic peptide
  Seed: TFSFRNAL (TYRP2_HUMAN)
  misc_feature (2)..(2): Xaa can be Tyr, Phe, Pro, Trp, Met, Leu, Val, Gln, Gly, Ile, Ser, or Ala
  misc_feature (8)..(8): Xaa can be Leu, Met, Ile, Phe, Tyr, or Val
TXSFRNAX

SEQ ID NO: 197768 - protein, 11 aa, Artificial Sequence
  Description of Artificial Sequence: Synthetic peptide
  Seed: TFSFRNALEGF (TYRP2_HUMAN)
  misc_feature (2)..(2): Xaa can be Tyr, Arg, Ser, Met, Lys, Phe, Trp, Thr, Leu, His, Val, Ala, or Ile
  misc_feature (11)..(11): Xaa can be Trp, Phe, Tyr, Leu, or Ile
TXSFRNALEGX

SEQ ID NO: 197769 - protein, 8 aa, Artificial Sequence
  Description of Artificial Sequence: Synthetic peptide
  Seed: THLSSKRY (TYRP2_HUMAN)
  misc_feature (2)..(2): Xaa can be , or His
  misc_feature (8)..(8): Xaa can be , or Tyr
TXLSSKRX

SEQ ID NO: 197770 - protein, 10 aa, Artificial Sequence
  Description of Artificial Sequence: Synthetic peptide
  Seed: TLCNGTYEGL (TYRP2_HUMAN)
  misc_feature (2)..(2): Xaa can be Leu, Gln, Met, Ile, Val, Ala, Thr, Ser, or Glu
  misc_feature (10)..(10): Xaa can be Trp, Val, Leu, Ile, Phe, Met, Ala, Thr, or Tyr
TXCNGTYEGX

SEQ ID NO: 197771 - protein, 11 aa, Artificial Sequence
  Description of Artificial Sequence: Synthetic peptide
  Seed: TLCNGTYEGLL (TYRP2_HUMAN)
  misc_feature (2)..(2): Xaa can be Met, or Leu
  misc_feature (11)..(11): Xaa can be Ile, Leu, or Val
TXCNGTYEGLX

SEQ ID NO: 197772 - protein, 9 aa, Artificial Sequence
  Description of Artificial Sequence: Synthetic peptide
  Seed: TLDSQVMSL (TYRP2_HUMAN)
  misc_feature (2)..(2): Xaa can be Phe, Ala, Tyr, Thr, Ile, Trp, Ser, Val, Glu, Met, Leu, Cys, Gly, Arg, Pro, Asn, Gln, His, Asp, or Lys
  misc_feature (9)..(9): Xaa can be Trp, Lys, Val, Met, Phe, Arg, Leu, Tyr, Ile, Ala, Cys, Thr, His, Ser, Gln, Pro, Gly, Glu, or Asn
TXDSQVMSX

SEQ ID NO: 197773 - protein, 10 aa, Artificial Sequence
  Description of Artificial Sequence: Synthetic peptide
  Seed: TLDSQVMSLH (TYRP2_HUMAN)
  misc_feature (2)..(2): Xaa can be Thr, Val, Ser, Met, Ile, Ala, Leu, Gln, Cys, Phe, Gly, Asn, Tyr, Glu, Asp, Trp, His, Lys, or Pro
  misc_feature (10)..(10): Xaa can be Tyr, Lys, Arg, Phe, His, Trp, Met, Gln, Leu, Glu, Val, or Ile
TXDSQVMSLX

SEQ ID NO: 197774 - protein, 9 aa, Artificial Sequence
  Description of Artificial Sequence: Synthetic peptide
  Seed: TLISRNSRF (TYRP2_HUMAN)
  misc_feature (2)..(2): Xaa can be Gln, Ala, Thr, Tyr, Ser, Leu, Met, Val, Phe, Trp, Ile, Gly, Glu, Cys, His, Lys, Pro, Arg, Asn, or Asp
  misc_feature (9)..(9): Xaa can be Tyr, Phe, Leu, Met, Trp, Ile, Val, or His
TXISRNSRX

SEQ ID NO: 197775 - protein, 9 aa, Artificial Sequence
  Description of Artificial Sequence: Synthetic peptide
  Seed: TLKDIRDCL (TYRP2_HUMAN)
  misc_feature (2)..(2): Xaa can be Ala, Leu, Met, Val, Ile, Gln, Ser, Tyr, Thr, Arg, Glu, Phe, Pro, Gly, Trp, His, Asn, Asp, Cys, or Lys
  misc_feature (9)..(9): Xaa can be Tyr, Leu, Phe, Met, Val, Ile, His, Trp, Ala, or Lys
TXKDIRDCX

SEQ ID NO: 197776 - protein, 11 aa, Artificial Sequence
  Description of Artificial Sequence: Synthetic peptide
  Seed: TLKDIRDCLSL (TYRP2_HUMAN)
  misc_feature (2)..(2): Xaa can be Gln, Leu, Met, Val, or Ile
  misc_feature (11)..(11): Xaa can be Trp, Phe, Leu, Ile, Val, or Met
TXKDIRDCLSX

SEQ ID NO: 197777 - protein, 9 aa, Artificial Sequence
  Description of Artificial Sequence: Synthetic peptide
  Seed: TLLGPGRPY (TYRP2_HUMAN)
  misc_feature (2)..(2): Xaa can be Ala, Ser, Val, Tyr, Pro, Arg, Gln, Ile, Thr, Phe, Gly, Met, Leu, Trp, Cys, His, Glu, Asn, Asp, or Lys
  misc_feature (9)..(9): Xaa can be Tyr, Leu, Phe, Met, Lys, His, Arg, Ile, Trp, Val, Ala, Cys, Thr, Ser, Gln, Pro, Gly, Asn, or Glu
TXLGPGRPX

SEQ ID NO: 197778 - protein, 10 aa, Artificial Sequence
  Description of Artificial Sequence: Synthetic peptide
  Seed: TLLGPGRPYR (TYRP2_HUMAN)
  misc_feature (2)..(2): Xaa can be Met, Leu, Val, Thr, Ile, Ala, Ser, Cys, Asp, Phe, Lys, Gln, His, Asn, Tyr, Trp, Arg, Gly, Glu, or Pro
  misc_feature (10)..(10): Xaa can be Arg, Lys, Tyr, Met, His, Leu, Phe, or Val
TXLGPGRPYX

SEQ ID NO: 197779 - protein, 9 aa, Artificial Sequence
  Description of Artificial Sequence: Synthetic peptide
  Seed: TLLVVMGTL (TYRP2_HUMAN)
  misc_feature (2)..(2): Xaa can be Gln, Met, Leu, Val, Ile, Ser, Thr, Ala, Glu, Gly, Asn, Phe, Lys, Asp, Tyr, Arg, Cys, His, or Pro
  misc_feature (9)..(9): Xaa can be Tyr, Phe, Ile, Val, Leu, Met, Ala, Trp, Cys, Thr, or His
TXLVVMGTX

SEQ ID NO: 197780 - protein, 10 aa, Artificial Sequence
  Description of Artificial Sequence: Synthetic peptide
  Seed: TLLVVMGTLV (TYRP2_HUMAN)
  misc_feature (2)..(2): Xaa can be Leu, Met, Phe, Tyr, Gln, Trp, Arg, Lys, Ser, Val, Ile, Cys, Ala, Gly, Pro, Thr, His, Asp, Asn, or Glu
  misc_feature (10)..(10): Xaa can be Val, Leu, Ile, Ala, or Met
TXLVVMGTLX

SEQ ID NO: 197781 - protein, 9 aa, Artificial Sequence
  Description of Artificial Sequence: Synthetic peptide
  Seed: TLVALVGLF (TYRP2_HUMAN)
  misc_feature (2)..(2): Xaa can be Tyr, Gln, Phe, Leu, Met, Trp, Ala, Ser, Ile, Val, Lys, Thr, Pro, Glu, His, Asp, Arg, Asn, Gly, or Cys
  misc_feature (9)..(9): Xaa can be Tyr, Phe, Met, Trp, Leu, Ile, Val, His, or Cys
TXVALVGLX

SEQ ID NO: 197782 - protein, 10 aa, Artificial Sequence
  Description of Artificial Sequence: Synthetic peptide
  Seed: TLVALVGLFV (TYRP2_HUMAN)
  misc_feature (2)..(2): Xaa can be Thr, Leu, Met, Gln, Ser, Glu, Ile, Ala, Val, Cys, Pro, His, Asn, Phe, Tyr, Gly, Lys, Arg, Asp, or Trp
  misc_feature (10)..(10): Xaa can be Ala, Ile, Val, Leu, Met, or Thr
TXVALVGLFX

SEQ ID NO: 197783 - protein, 11 aa, Artificial Sequence
  Description of Artificial Sequence: Synthetic peptide
  Seed: TLVALVGLFVL (TYRP2_HUMAN)
  misc_feature (2)..(2): Xaa can be Met, or Leu
  misc_feature (11)..(11): Xaa can be Leu, Val, Ile, or Ala
TXVALVGLFVX

SEQ ID NO: 197784 - protein, 9 aa, Artificial Sequence
  Description of Artificial Sequence: Synthetic peptide
  Seed: TNALPHSAA (TYRP2_HUMAN)
  misc_feature (2)..(2): Xaa can be His, Arg, Gln, Pro, Glu, Lys, Ala, or Asn
  misc_feature (9)..(9): Xaa can be Ala, Ile, Val, Leu, Met, Cys, Thr, Pro, Ser, Phe, Gly, or Tyr
TXALPHSAX

SEQ ID NO: 197785 - protein, 8 aa, Artificial Sequence
  Description of Artificial Sequence: Synthetic peptide
  Seed: TPGWPTTL (TYRP2_HUMAN)
  misc_feature (2)..(2): Xaa can be Pro, Ala, Arg, Ser, Gly, Gln, Tyr, His, Phe, Thr, Leu, Trp, Met, Asn, Glu, Cys, Val, Ile, or Asp
  misc_feature (8)..(8): Xaa can be Leu, Met, Ile, Val, Phe, Tyr, Thr, Cys, Ser, Pro, or Ala
TXGWPTTX

SEQ ID NO: 197786 - protein, 9 aa, Artificial Sequence
  Description of Artificial Sequence: Synthetic peptide
  Seed: TPGWPTTLL (TYRP2_HUMAN)
  misc_feature (2)..(2): Xaa can be Pro, Ala, Ser, Val, Ile, Thr, Gly, Gln, Arg, Phe, His, Tyr, Met, Leu, Asn, Asp, Glu, Cys, Trp, or Lys
  misc_feature (9)..(9): Xaa can be Leu, Met, Ile, Lys, Phe, Val, Arg, Trp, Tyr, Ala, Cys, Gly, Ser, Thr, His, or Pro
TXGWPTTLX

SEQ ID NO: 197787 - protein, 10 aa, Artificial Sequence
  Description of Artificial Sequence: Synthetic peptide
  Seed: TPGWPTTLLV (TYRP2_HUMAN)
  misc_feature (2)..(2): Xaa can be , or Pro
  misc_feature (10)..(10): Xaa can be Ile, Pro, Phe, Cys, Thr, Tyr, Ala, Val, Met, or Leu
TXGWPTTLLX

SEQ ID NO: 197788 - protein, 11 aa, Artificial Sequence
  Description of Artificial Sequence: Synthetic peptide
  Seed: TPGWPTTLLVV (TYRP2_HUMAN)
  misc_feature (2)..(2): Xaa can be , or Pro
  misc_feature (11)..(11): Xaa can be Gly, Met, Ala, Thr, Pro, Ile, Val, Cys, Leu, Ser, or Phe
TXGWPTTLLVX

SEQ ID NO: 197789 - protein, 8 aa, Artificial Sequence
  Description of Artificial Sequence: Synthetic peptide
  Seed: TPLMETHL (TYRP2_HUMAN)
  misc_feature (2)..(2): Xaa can be , or Pro
  misc_feature (8)..(8): Xaa can be Met, Ile, Val, Ala, or Leu
TXLMETHX

SEQ ID NO: 197790 - protein, 9 aa, Artificial Sequence
  Description of Artificial Sequence: Synthetic peptide
  Seed: TPLMETHLS (TYRP2_HUMAN)
  misc_feature (2)..(2): Xaa can be , or Pro
  misc_feature (9)..(9): Xaa can be Leu, Cys, Val, Tyr, Ile, Pro, Met, Phe, Thr, Ser, Ala, or Gly
TXLMETHLX

SEQ ID NO: 197791 - protein, 10 aa, Artificial Sequence
  Description of Artificial Sequence: Synthetic peptide
  Seed: TPLMETHLSS (TYRP2_HUMAN)
  misc_feature (2)..(2): Xaa can be , or Pro
  misc_feature (10)..(10): Xaa can be Thr, Val, Leu, Phe, Cys, Ile, Ala, Ser, Met, or Pro
TXLMETHLSX

SEQ ID NO: 197792 - protein, 8 aa, Artificial Sequence
  Description of Artificial Sequence: Synthetic peptide
  Seed: TQHWLGLL (TYRP2_HUMAN)
  misc_feature (2)..(2): Xaa can be Gln, or Ala
  misc_feature (8)..(8): Xaa can be Ile, Leu, or Val
TXHWLGLX

SEQ ID NO: 197793 - protein, 9 aa, Artificial Sequence
  Description of Artificial Sequence: Synthetic peptide
  Seed: TQHWLGLLG (TYRP2_HUMAN)
  misc_feature (2)..(2): Xaa can be Gln, Met, Lys, His, Glu, Arg, Ser, Val, Thr, Ala, Leu, Phe, Asn, Tyr, Ile, or Gly
  misc_feature (9)..(9): Xaa can be Phe, Tyr, Met, His, Leu, Ile, Trp, Val, Ala, or Gly
TXHWLGLLX

SEQ ID NO: 197794 - protein, 10 aa, Artificial Sequence
  Description of Artificial Sequence: Synthetic peptide
  Seed: TQPQFANCSV (TYRP2_HUMAN)
  misc_feature (2)..(2): Xaa can be Leu, Val, Met, Ile, Arg, Trp, Tyr, Asp, His, Pro, Gln, Glu, Ser, Thr, Phe, Gly, Cys, Ala, Lys, or Asn
  misc_feature (10)..(10): Xaa can be Ile, Phe, Val, Met, Leu, Ala, or Thr
TXPQFANCSX

SEQ ID NO: 197795 - protein, 11 aa, Artificial Sequence
  Description of Artificial Sequence: Synthetic peptide
  Seed: TQPQFANCSVY (TYRP2_HUMAN)
  misc_feature (2)..(2): Xaa can be Met, Arg, Asp, Thr, Ile, Cys, His, Ser, Trp, Ala, Asn, Glu, Leu, Tyr, Pro, Val, Gly, Gln, Phe, or Lys
  misc_feature (11)..(11): Xaa can be Trp, Met, Phe, Leu, Tyr, His, or Ile
TXPQFANCSVX

SEQ ID NO: 197796 - protein, 8 aa, Artificial Sequence
  Description of Artificial Sequence: Synthetic peptide
  Seed: TRPWSGPY (TYRP2_HUMAN)
  misc_feature (2)..(2): Xaa can be , or Arg
  misc_feature (8)..(8): Xaa can be Tyr, or Phe
TXPWSGPX

SEQ ID NO: 197797 - protein, 9 aa, Artificial Sequence
  Description of Artificial Sequence: Synthetic peptide
  Seed: TRPWSGPYI (TYRP2_HUMAN)
  misc_feature (2)..(2): Xaa can be His, Arg, Ala, Tyr, Gln, Phe, Gly, Met, Trp, Ser, Val, Ile, Thr, Leu, Asn, Pro, Lys, Cys, Glu, or Asp
  misc_feature (9)..(9): Xaa can be Leu, Met, Phe, Tyr, Ile, Val, Trp, Ala, or Cys
TXPWSGPYX

SEQ ID NO: 197798 - protein, 10 aa, Artificial Sequence
  Description of Artificial Sequence: Synthetic peptide
  Seed: TRPWSGPYIL (TYRP2_HUMAN)
  misc_feature (2)..(2): Xaa can be Phe, Arg, Met, Tyr, His, Glu, Thr, Asp, Asn, Leu, Ile, Gly, Ala, Cys, Pro, Gln, Val, Ser, Lys, or Trp
  misc_feature (10)..(10): Xaa can be Ile, Leu, Met, Tyr, Ala, Phe, Val, Trp, His, Arg, or Lys
TXPWSGPYIX

SEQ ID NO: 197799 - protein, 11 aa, Artificial Sequence
  Description of Artificial Sequence: Synthetic peptide
  Seed: TRPWSGPYILR (TYRP2_HUMAN)
  misc_feature (2)..(2): Xaa can be Arg, Met, Phe, Tyr, Ala, His, Leu, Ile, Lys, Ser, Gly, Asn, Thr, Gln, Trp, or Val
  misc_feature (11)..(11): Xaa can be Arg, Lys, Val, Asp, Cys, Thr, Leu, Gln, Phe, Met, His, Asn, Ile, Gly, Trp, Tyr, Ala, Pro, Ser, or Glu
TXPWSGPYILX

SEQ ID NO: 197800 - protein, 9 aa, Artificial Sequence
  Description of Artificial Sequence: Synthetic peptide
  Seed: TSDQLGYSY (TYRP2_HUMAN)
  misc_feature (2)..(2): Xaa can be Ile, Thr, Ser, Ala, Val, Leu, Phe, Tyr, Met, Cys, Gly, Gln, Pro, Arg, Trp, Asp, Asn, Glu, His, or Lys
  misc_feature (9)..(9): Xaa can be Met, Leu, Phe, Tyr, Trp, Ile, Val, Lys, Arg, Cys, Ala, His, Thr, Gln, or Ser
TXDQLGYSX

SEQ ID NO: 197801 - protein, 10 aa, Artificial Sequence
  Description of Artificial Sequence: Synthetic peptide
  Seed: TSDQLGYSYA (TYRP2_HUMAN)
  misc_feature (2)..(2): Xaa can be Thr, Ser, Met, Asn, Val, Ile, Cys, Ala, Gly, Gln, or Leu
  misc_feature (10)..(10): Xaa can be Tyr, Ser, Val, Asn, Cys, Ile, Asp, Gly, Ala, Pro, Glu, Gln, His, Arg, Trp, Leu, Phe, Met, Lys, or Thr
TXDQLGYSYX

SEQ ID NO: 197802 - protein, 11 aa, Artificial Sequence
  Description of Artificial Sequence: Synthetic peptide
  Seed: TSDQLGYSYAI (TYRP2_HUMAN)
  misc_feature (2)..(2): Xaa can be Ser, Ala, Ile, Gly, Thr, Met, Val, Cys, Leu, Tyr, Glu, Asn, Phe, Lys, Trp, Pro, Asp, Arg, His, or Gln
  misc_feature (11)..(11): Xaa can be Val, Ile, Leu, Met, Phe, or Ala
TXDQLGYSYAX

SEQ ID NO: 197803 - protein, 9 aa, Artificial Sequence
  Description of Artificial Sequence: Synthetic peptide
  Seed: TTLLVVMGT (TYRP2_HUMAN)
  misc_feature (2)..(2): Xaa can be Thr, Val, Ala, Ser, Ile, Gly, Leu, Met, Asn, or Pro
  misc_feature (9)..(9): Xaa can be Val, Ala, Ile, Leu, Met, or Thr
TXLLVVMGX

SEQ ID NO: 197804 - protein, 10 aa, Artificial Sequence
  Description of Artificial Sequence: Synthetic peptide
  Seed: TTLLVVMGTL (TYRP2_HUMAN)
  misc_feature (2)..(2): Xaa can be Thr, Ile, Val, Ala, or Ser
  misc_feature (10)..(10): Xaa can be Val, Leu, Ala, or Ile
TXLLVVMGTX

SEQ ID NO: 197805 - protein, 9 aa, Artificial Sequence
  Description of Artificial Sequence: Synthetic peptide
  Seed: TTQHWLGLL (TYRP2_HUMAN)
  misc_feature (2)..(2): Xaa can be Met, Val, Thr, Ile, Leu, Ala, Ser, Gln, Gly, Phe, Cys, Tyr, Asn, Pro, Asp, or Trp
  misc_feature (9)..(9): Xaa can be Trp, Leu, Phe, Val, Ile, Tyr, Met, Ala, or Thr
TXQHWLGLX

SEQ ID NO: 197806 - protein, 9 aa, Artificial Sequence
  Description of Artificial Sequence: Synthetic peptide
  Seed: TVCDSLDDY (TYRP2_HUMAN)
  misc_feature (2)..(2): Xaa can be Ala, Thr, Val, Ser, Pro, Ile, Gln, Met, Leu, Phe, Gly, Glu, Asp, Cys, Trp, Tyr, or Asn
  misc_feature (9)..(9): Xaa can be Tyr, Phe, Lys, Met, Arg, Leu, Trp, or His
TXCDSLDDX

SEQ ID NO: 197807 - protein, 11 aa, Artificial Sequence
  Description of Artificial Sequence: Synthetic peptide
  Seed: TVCDSLDDYNH (TYRP2_HUMAN)
  misc_feature (2)..(2): Xaa can be Thr, Val, Ser, Ile, Met, Ala, Leu, Asn, Gly, Gln, Cys, Asp, Tyr, Phe, Glu, or Trp
  misc_feature (11)..(11): Xaa can be Lys, Tyr, Arg, His, Phe, or Trp
TXCDSLDDYNX

SEQ ID NO: 197808 - protein, 8 aa, Artificial Sequence
  Description of Artificial Sequence: Synthetic peptide
  Seed: TVDSLVNK (TYRP2_HUMAN)
  misc_feature (2)..(2): Xaa can be Ala, Thr, Ser, Phe, Val, Ile, Tyr, Met, Gly, Leu, Gln, Asn, Trp, Glu, Asp, or Cys
  misc_feature (8)..(8): Xaa can be Tyr, Lys, Arg, Leu, Phe, Met, Ile, His, or Val
TXDSLVNX

SEQ ID NO: 197809 - protein, 10 aa, Artificial Sequence
  Description of Artificial Sequence: Synthetic peptide
  Seed: TVDSLVNKEC (TYRP2_HUMAN)
  misc_feature (2)..(2): Xaa can be Ala, Ile, Leu, Ser, Thr, Met, Val, Gly, Pro, Phe, Cys, Tyr, Gln, Asn, Trp, Asp, or Glu
  misc_feature (10)..(10): Xaa can be Leu, Phe, Met, Ile, Val, Tyr, Trp, Cys, or Ala
TXDSLVNKEX

SEQ ID NO: 197810 - protein, 10 aa, Artificial Sequence
  Description of Artificial Sequence: Synthetic peptide
  Seed: TWHRYHLLCL (TYRP2_HUMAN)
  misc_feature (2)..(2): Xaa can be Tyr, Trp, Phe, or Met
  misc_feature (10)..(10): Xaa can be Phe, Trp, Met, Leu, Ile, or Val
TXHRYHLLCX

SEQ ID NO: 197811 - protein, 8 aa, Artificial Sequence
  Description of Artificial Sequence: Synthetic peptide
  Seed: VALVGLFV (TYRP2_HUMAN)
  misc_feature (2)..(2): Xaa can be Ser, Ala, Pro, Thr, Gln, Glu, Gly, Met, or Asn
  misc_feature (8)..(8): Xaa can be Val, Ile, Leu, Met, Tyr, or Phe
VXLVGLFX

SEQ ID NO: 197812 - protein, 9 aa, Artificial Sequence
  Description of Artificial Sequence: Synthetic peptide
  Seed: VALVGLFVL (TYRP2_HUMAN)
  misc_feature (2)..(2): Xaa can be Gln, Pro, Ser, Met, Thr, Leu, Ala, Val, Ile, Gly, Glu, Arg, Asn, Asp, Cys, or Phe
  misc_feature (9)..(9): Xaa can be Trp, Val, Ile, Phe, Leu, Met, Tyr, Ala, Cys, Thr, or His
VXLVGLFVX

SEQ ID NO: 197813 - protein, 10 aa, Artificial Sequence
  Description of Artificial Sequence: Synthetic peptide
  Seed: VALVGLFVLL (TYRP2_HUMAN)
  misc_feature (2)..(2): Xaa can be Met, Ser, Leu, Ala, Thr, Ile, Gln, Gly, Tyr, Phe, Val, Cys, Pro, Asn, His, Arg, Lys, Trp, Asp, or Glu
  misc_feature (10)..(10): Xaa can be Ala, Val, Leu, Ile, Met, Trp, Phe, Thr, Tyr, or Ser
VXLVGLFVLX

SEQ ID NO: 197814 - protein, 11 aa, Artificial Sequence
  Description of Artificial Sequence: Synthetic peptide
  Seed: VCDSLDDYNHL (TYRP2_HUMAN)
  misc_feature (2)..(2): Xaa can be Ala, Tyr, Phe, Ser, Thr, Val, Leu, Trp, Ile, Gly, Met, Pro, Cys, Gln, Asn, Glu, His, or As p
  misc_feature (11)..(11): Xaa can be Met, Leu, Trp, Phe, Ile, Val, Tyr, Cys, Ala, or Thr
VXDSLDDYNHX

SEQ ID NO: 197815 - protein, 11 aa, Artificial Sequence
  Description of Artificial Sequence: Synthetic peptide
  Seed: VCMTVDSLVNK (TYRP2_HUMAN)
  misc_feature (2)..(2): Xaa can be Thr, Ala, Ile, Met, Leu, Val, Ser, Asn, Tyr, Asp, Glu, Phe, Gly, Trp, Gln, Cys, Arg, Lys, Pro, or His
  misc_feature (11)..(11): Xaa can be Lys, Arg, Tyr, Leu, Met, His, or Phe
VXMTVDSLVNX

SEQ ID NO: 197816 - protein, 9 aa, Artificial Sequence
  Description of Artificial Sequence: Synthetic peptide
  Seed: VDSLVNKEC (TYRP2_HUMAN)
  misc_feature (2)..(2): Xaa can be Glu, Asp, or Gln
  misc_feature (9)..(9): Xaa can be Ala, Val, Leu, Phe, Ile, Cys, Met, Tyr, Trp, Pro, Asp, Glu, Lys, Ser, Gly, Gln, Thr, or Ar g
VXSLVNKEX

SEQ ID NO: 197817 - protein, 9 aa, Artificial Sequence
  Description of Artificial Sequence: Synthetic peptide
  Seed: VEETPGWPT (TYRP2_HUMAN)
  misc_feature (2)..(2): Xaa can be Glu, or Asp
  misc_feature (9)..(9): Xaa can be Val, Ile, Met, Leu, Ala, Pro, Gly, Tyr, Cys, Ser, Thr, or Phe
VXETPGWPX

SEQ ID NO: 197818 - protein, 10 aa, Artificial Sequence
  Description of Artificial Sequence: Synthetic peptide
  Seed: VEETPGWPTT (TYRP2_HUMAN)
  misc_feature (2)..(2): Xaa can be Glu, Asp, or Gln
  misc_feature (10)..(10): Xaa can be Leu, Ala, Val, Cys, Tyr, Ser, Gly, Met, Ile, Pro, Phe, or Thr
VXETPGWPTX

SEQ ID NO: 197819 - protein, 11 aa, Artificial Sequence
  Description of Artificial Sequence: Synthetic peptide
  Seed: VEETPGWPTTL (TYRP2_HUMAN)
  misc_feature (2)..(2): Xaa can be Glu, Gln, Asp, Tyr, Phe, Arg, Ala, His, Gly, Trp, Met, Ser, Val, Asn, Ile, Pro, Leu, Thr, or Lys
  misc_feature (11)..(11): Xaa can be Leu, Met, Phe, Ile, Trp, Cys, Tyr, Val, Ala, Thr, Pro, Gly, or Ser
VXETPGWPTTX

SEQ ID NO: 197820 - protein, 9 aa, Artificial Sequence
  Description of Artificial Sequence: Synthetic peptide
  Seed: VGLFVLLAF (TYRP2_HUMAN)
  misc_feature (2)..(2): Xaa can be Gln, Ala, Met, Ser, Lys, Thr, Gly, Arg, Val, His, Pro, Ile, Glu, Leu, Asn, Cys, Phe, Asp, Tyr, or Trp
  misc_feature (9)..(9): Xaa can be Tyr, Phe, Trp, Met, Leu, His, Val, Ile, Ala, or Gly
VXLFVLLAX

SEQ ID NO: 197821 - protein, 10 aa, Artificial Sequence
  Description of Artificial Sequence: Synthetic peptide
  Seed: VGLFVLLAFL (TYRP2_HUMAN)
  misc_feature (2)..(2): Xaa can be Tyr, Met, Leu, Phe, Ser, Asn, Gly, Asp, Arg, Trp, Pro, Glu, His, Lys, Val, Cys, Thr, Ile, Gln, or Ala
  misc_feature (10)..(10): Xaa can be Leu, Val, Met, Ile, Ala, or Thr
VXLFVLLAFX

SEQ ID NO: 197822 - protein, 9 aa, Artificial Sequence
  Description of Artificial Sequence: Synthetic peptide
  Seed: VHPDYVITT (TYRP2_HUMAN)
  misc_feature (2)..(2): Xaa can be Arg, His, Ala, Gln, Tyr, Phe, Gly, Ser, Ile, Thr, Trp, Leu, Asn, Val, Glu, Met, Lys, Pro, Cys, or Asp
  misc_feature (9)..(9): Xaa can be Leu, Phe, Met, Val, Ile, Cys, Ala, Tyr, Thr, Trp, Ser, Pro, Lys, Gly, or Arg
VXPDYVITX

SEQ ID NO: 197823 - protein, 10 aa, Artificial Sequence
  Description of Artificial Sequence: Synthetic peptide
  Seed: VHSFLNGTNA (TYRP2_HUMAN)
  misc_feature (2)..(2): Xaa can be , or His
  misc_feature (10)..(10): Xaa can be Ile, Ala, Cys, Val, or Leu
VXSFLNGTNX

SEQ ID NO: 197824 - protein, 11 aa, Artificial Sequence
  Description of Artificial Sequence: Synthetic peptide
  Seed: VHSFLNGTNAL (TYRP2_HUMAN)
  misc_feature (2)..(2): Xaa can be His, Cys, Thr, Phe, Arg, Leu, Gln, Met, Trp, Lys, Asp, Glu, Pro, Ala, Gly, Asn, Tyr, Ile, Val, or Ser
  misc_feature (11)..(11): Xaa can be Tyr, Phe, Met, Leu, Val, Cys, Trp, Ile, or Ala
VXSFLNGTNAX

SEQ ID NO: 197825 - protein, 9 aa, Artificial Sequence
  Description of Artificial Sequence: Synthetic peptide
  Seed: VIRQNIHSL (TYRP2_HUMAN)
  misc_feature (2)..(2): Xaa can be Thr, Pro, Ala, Met, Ser, Val, Tyr, Ile, Phe, Leu, Gln, Arg, Gly, Glu, Trp, Asn, His, Asp, Cys, or Lys
  misc_feature (9)..(9): Xaa can be Lys, Met, Ile, Tyr, Leu, Phe, Val, Arg, Trp, Ala, His, Cys, Ser, Thr, Gly, Gln, Pro, Asn, or Glu
VXRQNIHSX

SEQ ID NO: 197826 - protein, 9 aa, Artificial Sequence
  Description of Artificial Sequence: Synthetic peptide
  Seed: VLHSFTDAI (TYRP2_HUMAN)
  misc_feature (2)..(2): Xaa can be Gln, Met, Leu, Ala, Val, Thr, Ile, Ser, Lys, Phe, Tyr, Glu, Asn, Gly, Arg, Pro, His, Trp, Asp, or Cys
  misc_feature (9)..(9): Xaa can be Tyr, Phe, Met, Leu, Ile, Val, Trp, Arg, Lys, Ala, His, Thr, Gly, Cys, or Ser
VXHSFTDAX

SEQ ID NO: 197827 - protein, 10 aa, Artificial Sequence
  Description of Artificial Sequence: Synthetic peptide
  Seed: VLHSFTDAIF (TYRP2_HUMAN)
  misc_feature (2)..(2): Xaa can be Met, Val, Leu, Gln, Ile, Ala, Ser, Thr, Gly, His, Glu, Lys, Arg, Asn, Phe, Tyr, Asp, Pro, Trp, or Cys
  misc_feature (10)..(10): Xaa can be Leu, Tyr, Phe, Met, Trp, Lys, His, Val, Ile, Arg, Ala, or Thr
VXHSFTDAIX

SEQ ID NO: 197828 - protein, 8 aa, Artificial Sequence
  Description of Artificial Sequence: Synthetic peptide
  Seed: VLLAFLQY (TYRP2_HUMAN)
  misc_feature (2)..(2): Xaa can be Gln, Met, Ser, Leu, Thr, Phe, or Ala
  misc_feature (8)..(8): Xaa can be Tyr, Phe, or Met
VXLAFLQX

SEQ ID NO: 197829 - protein, 9 aa, Artificial Sequence
  Description of Artificial Sequence: Synthetic peptide
  Seed: VLLAFLQYR (TYRP2_HUMAN)
  misc_feature (2)..(2): Xaa can be Leu, Met, Ile, Thr, Val, Gln, Ala, Ser, Trp, Phe, Tyr, Gly, Asn, Pro, His, Asp, Glu, Cys, Lys, or Arg
  misc_feature (9)..(9): Xaa can be Arg, Lys, His, Tyr, Leu, Val, Met, Ile, Phe, or Ala
VXLAFLQYX

SEQ ID NO: 197830 - protein, 10 aa, Artificial Sequence
  Description of Artificial Sequence: Synthetic peptide
  Seed: VLLAFLQYRR (TYRP2_HUMAN)
  misc_feature (2)..(2): Xaa can be Gln, Ser, Tyr, Val, Leu, Ala, Ile, Trp, Met, Thr, Phe, Arg, His, Cys, Asp, Pro, Asn, Gly, Glu, or Lys
  misc_feature (10)..(10): Xaa can be Lys, Arg, Leu, Val, Gly, Phe, Ala, Thr, Tyr, Met, Asn, Asp, Pro, Ser, Cys, Ile, Glu, His, Gln, or Trp
VXLAFLQYRX

SEQ ID NO: 197831 - protein, 11 aa, Artificial Sequence
  Description of Artificial Sequence: Synthetic peptide
  Seed: VLLAFLQYRRL (TYRP2_HUMAN)
  misc_feature (2)..(2): Xaa can be Met, Leu, Ile, Tyr, Phe, Gln, Thr, Val, or Ser
  misc_feature (11)..(11): Xaa can be Val, Leu, Ile, Ala, or Met
VXLAFLQYRRX

SEQ ID NO: 197832 - protein, 8 aa, Artificial Sequence
  Description of Artificial Sequence: Synthetic peptide
  Seed: VMGTLVAL (TYRP2_HUMAN)
  misc_feature (2)..(2): Xaa can be Ala, Gly, Ser, Thr, Val, Ile, Gln, Met, Leu, Asn, Pro, His, Glu, Arg, Asp, Cys, Phe, or Ty r
  misc_feature (8)..(8): Xaa can be Leu, Ile, Val, Tyr, Phe, Met, Lys, Arg, His, or Trp
VXGTLVAX

SEQ ID NO: 197833 - protein, 9 aa, Artificial Sequence
  Description of Artificial Sequence: Synthetic peptide
  Seed: VMGTLVALV (TYRP2_HUMAN)
  misc_feature (2)..(2): Xaa can be Met, Leu, Ile, Val, Gln, Thr, Ala, Ser, Glu, Gly, Phe, Tyr, Trp, Asn, Asp, or Cys
  misc_feature (9)..(9): Xaa can be Arg, Lys, Val, Ile, Leu, Ala, Met, Tyr, Cys, Thr, Ser, or Phe
VXGTLVALX

SEQ ID NO: 197834 - protein, 10 aa, Artificial Sequence
  Description of Artificial Sequence: Synthetic peptide
  Seed: VMGTLVALVG (TYRP2_HUMAN)
  misc_feature (2)..(2): Xaa can be Met, Leu, Ile, or Val
  misc_feature (10)..(10): Xaa can be Val, Leu, Asp, Met, Pro, Asn, Tyr, Ile, Glu, Phe, Lys, Cys, Gly, Ser, Trp, Ala, His, Gln, Arg, or Thr
VXGTLVALVX

SEQ ID NO: 197835 - protein, 11 aa, Artificial Sequence
  Description of Artificial Sequence: Synthetic peptide
  Seed: VMGTLVALVGL (TYRP2_HUMAN)
  misc_feature (2)..(2): Xaa can be Leu, or Met
  misc_feature (11)..(11): Xaa can be Leu, Ile, Val, or Met
VXGTLVALVGX

SEQ ID NO: 197836 - protein, 8 aa, Artificial Sequence
  Description of Artificial Sequence: Synthetic peptide
  Seed: VMSLHNLV (TYRP2_HUMAN)
  misc_feature (2)..(2): Xaa can be Gln, Ser, Ala, Glu, Met, or Gly
  misc_feature (8)..(8): Xaa can be Ile, Val, Leu, Phe, or Met
VXSLHNLX

SEQ ID NO: 197837 - protein, 9 aa, Artificial Sequence
  Description of Artificial Sequence: Synthetic peptide
  Seed: VMSLHNLVH (TYRP2_HUMAN)
  misc_feature (2)..(2): Xaa can be Gln, Ala, Met, Ser, Ile, Thr, Leu, Val, Lys, His, Gly, Arg, Glu, Asn, Phe, Cys, Tyr, Trp, Asp, or Pro
  misc_feature (9)..(9): Xaa can be Tyr, Phe, Met, Leu, His, Lys, Trp, Ile, Val, Arg, Ala, Cys, Thr, Gly, Ser, or Gln
VXSLHNLVX

SEQ ID NO: 197838 - protein, 11 aa, Artificial Sequence
  Description of Artificial Sequence: Synthetic peptide
  Seed: VMSLHNLVHSF (TYRP2_HUMAN)
  misc_feature (2)..(2): Xaa can be Thr, Gln, Ser, Met, Lys, Ile, Val, Ala, Arg, His, Phe, Pro, Leu, Tyr, Trp, Asp, Gly, Cys, Glu, or Asn
  misc_feature (11)..(11): Xaa can be Tyr, Phe, Trp, Met, or Leu
VXSLHNLVHSX

SEQ ID NO: 197839 - protein, 9 aa, Artificial Sequence
  Description of Artificial Sequence: Synthetic peptide
  Seed: VNKECCPRL (TYRP2_HUMAN)
  misc_feature (2)..(2): Xaa can be Arg, Met, Leu, Ala, Ile, Asn, Gln, or Gly
  misc_feature (9)..(9): Xaa can be Leu, Met, Phe, Val, Tyr, Lys, Ile, or Arg
VXKECCPRX

SEQ ID NO: 197840 - protein, 8 aa, Artificial Sequence
  Description of Artificial Sequence: Synthetic peptide
  Seed: VPFFPPVT (TYRP2_HUMAN)
  misc_feature (2)..(2): Xaa can be Pro, Ala, Gly, or Ser
  misc_feature (8)..(8): Xaa can be Ile, Leu, Val, Met, Ala, Ser, Cys, Gln, Pro, Thr, Phe, Lys, Gly, or Tyr
VXFFPPVX

SEQ ID NO: 197841 - protein, 9 aa, Artificial Sequence
  Description of Artificial Sequence: Synthetic peptide
  Seed: VPFFPPVTN (TYRP2_HUMAN)
  misc_feature (2)..(2): Xaa can be Pro, Ala, Val, Thr, Ile, Ser, Gly, Leu, Gln, Met, Cys, Asp, Phe, Tyr, Asn, or Glu
  misc_feature (9)..(9): Xaa can be Tyr, Phe, Ala, Leu, Met, Cys, Ile, Val, Thr, Pro, Ser, His, Trp, Gly, Glu, Lys, Asn, Arg, Asp, or Gln
VXFFPPVTX

SEQ ID NO: 197842 - protein, 10 aa, Artificial Sequence
  Description of Artificial Sequence: Synthetic peptide
  Seed: VRDTLLGPGR (TYRP2_HUMAN)
  misc_feature (2)..(2): Xaa can be Arg, Tyr, Phe, or Trp
  misc_feature (10)..(10): Xaa can be Phe, Leu, Tyr, Trp, Ile, Arg, Lys, or Met
VXDTLLGPGX

SEQ ID NO: 197843 - protein, 9 aa, Artificial Sequence
  Description of Artificial Sequence: Synthetic peptide
  Seed: VSVEETPGW (TYRP2_HUMAN)
  misc_feature (2)..(2): Xaa can be Ser, Thr, Gln, Leu, Ala, Val, Met, Ile, Phe, Tyr, Gly, Pro, Glu, Asn, Cys, Asp, Trp, or Hi s
  misc_feature (9)..(9): Xaa can be Trp, Lys, Phe, Leu, Arg, Met, Tyr, Ile, or Val
VXVEETPGX

SEQ ID NO: 197844 - protein, 8 aa, Artificial Sequence
  Description of Artificial Sequence: Synthetic peptide
  Seed: VTLCNGTY (TYRP2_HUMAN)
  misc_feature (2)..(2): Xaa can be Thr, or Ser
  misc_feature (8)..(8): Xaa can be Phe, Trp, or Tyr
VXLCNGTX

SEQ ID NO: 197845 - protein, 11 aa, Artificial Sequence
  Description of Artificial Sequence: Synthetic peptide
  Seed: VTLCNGTYEGL (TYRP2_HUMAN)
  misc_feature (2)..(2): Xaa can be Thr, Ser, Cys, Val, Ala, Gly, Asp, Pro, Asn, Ile, Met, Leu, or Gln
  misc_feature (11)..(11): Xaa can be Trp, Phe, Leu, Tyr, or Met
VXLCNGTYEGX

SEQ ID NO: 197846 - protein, 8 aa, Artificial Sequence
  Description of Artificial Sequence: Synthetic peptide
  Seed: VTNEELFL (TYRP2_HUMAN)
  misc_feature (2)..(2): Xaa can be Ser, Thr, Ala, Val, Ile, Asn, Gly, Gln, Met, Leu, Glu, Phe, or Asp
  misc_feature (8)..(8): Xaa can be Lys, Leu, Trp, Arg, Ile, Tyr, Met, Phe, or Val
VXNEELFX

SEQ ID NO: 197847 - protein, 9 aa, Artificial Sequence
  Description of Artificial Sequence: Synthetic peptide
  Seed: VTNEELFLT (TYRP2_HUMAN)
  misc_feature (2)..(2): Xaa can be Met, Leu, Ile, Gln, Val, Thr, Ser, Ala, Phe, Gly, Asn, Cys, or Glu
  misc_feature (9)..(9): Xaa can be Val, Met, Ala, Leu, Ile, Thr, Cys, Phe, Ser, or Gly
VXNEELFLX

SEQ ID NO: 197848 - protein, 8 aa, Artificial Sequence
  Description of Artificial Sequence: Synthetic peptide
  Seed: VTWHRYHL (TYRP2_HUMAN)
  misc_feature (2)..(2): Xaa can be Ala, Ser, Thr, Gly, Met, Gln, Val, Ile, Pro, Leu, Asn, Cys, or Asp
  misc_feature (8)..(8): Xaa can be Trp, Leu, Tyr, Phe, Met, Ile, or Val
VXWHRYHX

SEQ ID NO: 197849 - protein, 9 aa, Artificial Sequence
  Description of Artificial Sequence: Synthetic peptide
  Seed: VTWHRYHLL (TYRP2_HUMAN)
  misc_feature (2)..(2): Xaa can be Leu, Met, Tyr, Ile, Thr, Ser, Ala, Gln, Val, Arg, Phe, Trp, Asn, Gly, Glu, Cys, Pro, Asp, His, or Lys
  misc_feature (9)..(9): Xaa can be Leu, Trp, Tyr, Phe, Met, Lys, Arg, Val, Ile, His, Ala, Cys, Thr, Ser, Pro, or Gly
VXWHRYHLX

SEQ ID NO: 197850 - protein, 9 aa, Artificial Sequence
  Description of Artificial Sequence: Synthetic peptide
  Seed: VVLHSFTDA (TYRP2_HUMAN)
  misc_feature (2)..(2): Xaa can be Leu, Met, Val, Gln, Ile, Thr, Ala, or Ser
  misc_feature (9)..(9): Xaa can be Val, Ile, Leu, Ala, or Met
VXLHSFTDX

SEQ ID NO: 197851 - protein, 10 aa, Artificial Sequence
  Description of Artificial Sequence: Synthetic peptide
  Seed: VVLHSFTDAI (TYRP2_HUMAN)
  misc_feature (2)..(2): Xaa can be Phe, Asn, Lys, His, Leu, Glu, Pro, Tyr, Gln, Arg, Trp, Met, Ile, Val, Asp, Thr, Gly, Ala, Cys, or Ser
  misc_feature (10)..(10): Xaa can be Leu, Ala, Met, Ile, or Val
VXLHSFTDAX

SEQ ID NO: 197852 - protein, 9 aa, Artificial Sequence
  Description of Artificial Sequence: Synthetic peptide
  Seed: VVMGTLVAL (TYRP2_HUMAN)
  misc_feature (2)..(2): Xaa can be Pro, Ala, Gln, Met, Tyr, Leu, Arg, Ser, Thr, Ile, Val, Phe, Lys, Asn, Gly, Cys, Glu, Trp, His, or Asp
  misc_feature (9)..(9): Xaa can be Phe, Arg, Met, Ile, Val, Leu, Tyr, Trp, His, Lys, Ala, Cys, Thr, Ser, Gly, Gln, Pro, Asn, Glu, or Asp
VXMGTLVAX

SEQ ID NO: 197853 - protein, 10 aa, Artificial Sequence
  Description of Artificial Sequence: Synthetic peptide
  Seed: VVMGTLVALV (TYRP2_HUMAN)
  misc_feature (2)..(2): Xaa can be Gln, Leu, Met, Val, Ile, Thr, Ser, Tyr, Lys, Pro, Arg, Cys, Gly, Asp, Glu, His, Ala, Phe, Asn, or Trp
  misc_feature (10)..(10): Xaa can be Leu, Val, Ala, Met, Ile, Ser, Gln, Pro, Lys, Cys, Asp, Thr, Trp, Tyr, His, Phe, Gly, Arg, Glu, or Asn
VXMGTLVALX

SEQ ID NO: 197854 - protein, 11 aa, Artificial Sequence
  Description of Artificial Sequence: Synthetic peptide
  Seed: VVMGTLVALVG (TYRP2_HUMAN)
  misc_feature (2)..(2): Xaa can be Gln, Met, Val, Leu, Ile, Thr, Ala, or Ser
  misc_feature (11)..(11): Xaa can be Val, Ile, Leu, Met, Ala, Glu, Tyr, Gly, Lys, Ser, Phe, Trp, Cys, Pro, Gln, His, Asp, Thr, Arg, or Asn
VXMGTLVALVX

SEQ ID NO: 197855 - protein, 9 aa, Artificial Sequence
  Description of Artificial Sequence: Synthetic peptide
  Seed: VWLHYYSVR (TYRP2_HUMAN)
  misc_feature (2)..(2): Xaa can be Trp, Tyr, Gln, Leu, Met, Ile, Val, Thr, Ala, Ser, Phe, Asn, Gly, His, Asp, Pro, Cys, or Gl u
  misc_feature (9)..(9): Xaa can be Arg, or Lys
VXLHYYSVX

SEQ ID NO: 197856 - protein, 8 aa, Artificial Sequence
  Description of Artificial Sequence: Synthetic peptide
  Seed: VYDFFVWL (TYRP2_HUMAN)
  misc_feature (2)..(2): Xaa can be Tyr, Phe, Trp, Arg, Ala, or His
  misc_feature (8)..(8): Xaa can be Leu, Met, Ile, or Phe
VXDFFVWX

SEQ ID NO: 197857 - protein, 9 aa, Artificial Sequence
  Description of Artificial Sequence: Synthetic peptide
  Seed: VYDFFVWLH (TYRP2_HUMAN)
  misc_feature (2)..(2): Xaa can be Tyr, Phe, Ile, Gln, Thr, Met, Ser, Ala, Trp, Val, Leu, Cys, Asn, Pro, Gly, Glu, Arg, Lys, His, or Asp
  misc_feature (9)..(9): Xaa can be Tyr, Phe, Trp, Met, or His
VXDFFVWLX

SEQ ID NO: 197858 - protein, 10 aa, Artificial Sequence
  Description of Artificial Sequence: Synthetic peptide
  Seed: VYDFFVWLHY (TYRP2_HUMAN)
  misc_feature (2)..(2): Xaa can be Thr, Ser, Ala, Met, Val, Ile, Tyr, Leu, Phe, Gly, Gln, Trp, Asn, Lys, Pro, Asp, His, Cys, Glu, or Arg
  misc_feature (10)..(10): Xaa can be Tyr, Phe, Lys, Arg, His, Met, Leu, Trp, or Gln
VXDFFVWLHX

SEQ ID NO: 197859 - protein, 11 aa, Artificial Sequence
  Description of Artificial Sequence: Synthetic peptide
  Seed: VYDFFVWLHYY (TYRP2_HUMAN)
  misc_feature (2)..(2): Xaa can be Cys, Arg, Gly, Lys, Ser, His, Val, Glu, Gln, Phe, Thr, Ala, Asn, Met, Ile, Trp, Leu, Asp, Pro, or Tyr
  misc_feature (11)..(11): Xaa can be , or Tyr
VXDFFVWLHYX

SEQ ID NO: 197860 - protein, 8 aa, Artificial Sequence
  Description of Artificial Sequence: Synthetic peptide
  Seed: WETVCDSL (TYRP2_HUMAN)
  misc_feature (2)..(2): Xaa can be , or Glu
  misc_feature (8)..(8): Xaa can be Ala, Val, Leu, Ile, or Met
WXTVCDSX

SEQ ID NO: 197861 - protein, 9 aa, Artificial Sequence
  Description of Artificial Sequence: Synthetic peptide
  Seed: WHRYHLLCL (TYRP2_HUMAN)
  misc_feature (2)..(2): Xaa can be Met, Gln, His, Pro, Leu, Lys, Ala, Asn, Ile, Ser, Gly, Arg, Val, Phe, Thr, Tyr, Trp, Glu, Cys, or Asp
  misc_feature (9)..(9): Xaa can be Leu, Met, Tyr, Phe, Ile, Val, Ala, Cys, Trp, His, Thr, Gly, or Ser
WXRYHLLCX

SEQ ID NO: 197862 - protein, 11 aa, Artificial Sequence
  Description of Artificial Sequence: Synthetic peptide
  Seed: WLHYYSVRDTL (TYRP2_HUMAN)
  misc_feature (2)..(2): Xaa can be Met, Leu, Thr, Asn, Asp, Phe, Tyr, His, Val, Gly, Ala, Trp, Cys, Arg, Lys, Pro, Glu, Ile, Ser, or Gln
  misc_feature (11)..(11): Xaa can be Leu, Trp, Tyr, Phe, Met, Ile, Val, or Ala
WXHYYSVRDTX

SEQ ID NO: 197863 - protein, 9 aa, Artificial Sequence
  Description of Artificial Sequence: Synthetic peptide
  Seed: WMKRFNPPA (TYRP2_HUMAN)
  misc_feature (2)..(2): Xaa can be Thr, Gln, Met, Ser, Leu, Val, Phe, Ala, Lys, Trp, Tyr, Ile, Pro, Gly, Arg, His, Asn, Glu, or Cys
  misc_feature (9)..(9): Xaa can be Phe, Tyr, Met, Lys, Leu, Ala, Val, Ile, Arg, Thr, Trp, His, Ser, Gly, Cys, or Pro
WXKRFNPPX

SEQ ID NO: 197864 - protein, 8 aa, Artificial Sequence
  Description of Artificial Sequence: Synthetic peptide
  Seed: WPQELAPI (TYRP2_HUMAN)
  misc_feature (2)..(2): Xaa can be , or Pro
  misc_feature (8)..(8): Xaa can be Met, Val, Ile, Ala, Leu, or Phe
WXQELAPX

SEQ ID NO: 197865 - protein, 9 aa, Artificial Sequence
  Description of Artificial Sequence: Synthetic peptide
  Seed: WPQELAPIG (TYRP2_HUMAN)
  misc_feature (2)..(2): Xaa can be Pro, Ala, Ser, Leu, Val, Ile, Thr, Met, Gly, Cys, Gln, or Phe
  misc_feature (9)..(9): Xaa can be Tyr, Phe, Met, His, Ala, Trp, Leu, Gly, Thr, Glu, Arg, Lys, Ser, Cys, Ile, Pro, Val, or Gl n
WXQELAPIX

SEQ ID NO: 197866 - protein, 9 aa, Artificial Sequence
  Description of Artificial Sequence: Synthetic peptide
  Seed: WPRKFFHRT (TYRP2_HUMAN)
  misc_feature (2)..(2): Xaa can be Pro, Ala, Val, Leu, Ile, Met, Thr, or Ser
  misc_feature (9)..(9): Xaa can be Leu, Met, Ala, Ile, Thr, Ser, Cys, Phe, Pro, Tyr, Val, Gly, or Trp
WXRKFFHRX

SEQ ID NO: 197867 - protein, 10 aa, Artificial Sequence
  Description of Artificial Sequence: Synthetic peptide
  Seed: WPRKFFHRTC (TYRP2_HUMAN)
  misc_feature (2)..(2): Xaa can be Pro, Ala, Val, Ile, Met, or Leu
  misc_feature (10)..(10): Xaa can be Leu, Met, Tyr, Ala, Thr, Ile, Ser, Phe, Val, or Cys
WXRKFFHRTX

SEQ ID NO: 197868 - protein, 8 aa, Artificial Sequence
  Description of Artificial Sequence: Synthetic peptide
  Seed: WPTTLLVV (TYRP2_HUMAN)
  misc_feature (2)..(2): Xaa can be , or Pro
  misc_feature (8)..(8): Xaa can be Ala, Val, Ile, Leu, or Met
WXTTLLVX

SEQ ID NO: 197869 - protein, 9 aa, Artificial Sequence
  Description of Artificial Sequence: Synthetic peptide
  Seed: WPTTLLVVM (TYRP2_HUMAN)
  misc_feature (2)..(2): Xaa can be Pro, Ala, His, Gln, Arg, Val, Met, Thr, Lys, Ser, Gly, Ile, Leu, Glu, Asp, Cys, Asn, or Ph e
  misc_feature (9)..(9): Xaa can be Tyr, Phe, Met, Trp, Leu, Val, Ile, Ala, His, Thr, Glu, Gly, Gln, Asn, Cys, Ser, or Pro
WXTTLLVVX

SEQ ID NO: 197870 - protein, 10 aa, Artificial Sequence
  Description of Artificial Sequence: Synthetic peptide
  Seed: WPTTLLVVMG (TYRP2_HUMAN)
  misc_feature (2)..(2): Xaa can be Pro, or Ala
  misc_feature (10)..(10): Xaa can be Tyr, Met, Arg, His, Asn, Asp, Lys, Pro, Glu, Thr, Val, Gly, Leu, Ala, Trp, Cys, Gln, Ser, Ile, or Phe
WXTTLLVVMX

SEQ ID NO: 197871 - protein, 9 aa, Artificial Sequence
  Description of Artificial Sequence: Synthetic peptide
  Seed: WTGPNCERK (TYRP2_HUMAN)
  misc_feature (2)..(2): Xaa can be Thr, Ser, Leu, Met, Ile, Val, Ala, Asp, Asn, or Gly
  misc_feature (9)..(9): Xaa can be Tyr, Lys, or Arg
WXGPNCERX

SEQ ID NO: 197872 - protein, 10 aa, Artificial Sequence
  Description of Artificial Sequence: Synthetic peptide
  Seed: WTGPNCERKK (TYRP2_HUMAN)
  misc_feature (2)..(2): Xaa can be Ile, Thr, or Val
  misc_feature (10)..(10): Xaa can be , or Lys
WXGPNCERKX

SEQ ID NO: 197873 - protein, 9 aa, Artificial Sequence
  Description of Artificial Sequence: Synthetic peptide
  Seed: YAIDLPVSV (TYRP2_HUMAN)
  misc_feature (2)..(2): Xaa can be Leu, Met, Pro, His, Val, Tyr, Ala, Ser, Arg, Thr, Gln, Ile, Phe, Gly, Trp, Glu, Lys, Cys, Asn, or Asp
  misc_feature (9)..(9): Xaa can be Tyr, Leu, Arg, Val, His, Phe, Trp, Ile, Lys, Ala, Met, Cys, Thr, Pro, Gln, Ser, Asn, Gly, Glu, or Asp
YXIDLPVSX

SEQ ID NO: 197874 - protein, 10 aa, Artificial Sequence
  Description of Artificial Sequence: Synthetic peptide
  Seed: YAIDLPVSVE (TYRP2_HUMAN)
  misc_feature (2)..(2): Xaa can be Ile, Gln, Val, Met, Thr, Leu, Ala, Ser, Phe, Gly, or Trp
  misc_feature (10)..(10): Xaa can be Val, Thr, Phe, Met, Ile, Leu, Ala, Cys, Glu, Ser, Tyr, Pro, Gln, Arg, Asp, Gly, Asn, Trp, His, or Lys
YXIDLPVSVX

SEQ ID NO: 197875 - protein, 9 aa, Artificial Sequence
  Description of Artificial Sequence: Synthetic peptide
  Seed: YDFFVWLHY (TYRP2_HUMAN)
  misc_feature (2)..(2): Xaa can be Glu, Met, Phe, Gln, Tyr, Thr, Trp, Ser, Val, Leu, Asp, Ala, Ile, Pro, Asn, Lys, Arg, His, Cys, or Gly
  misc_feature (9)..(9): Xaa can be Tyr, Phe, Met, Leu, His, Trp, Val, Lys, Ile, Ala, Arg, Gly, Ser, Pro, Asn, Thr, or Gln
YXFFVWLHX

SEQ ID NO: 197876 - protein, 10 aa, Artificial Sequence
  Description of Artificial Sequence: Synthetic peptide
  Seed: YDFFVWLHYY (TYRP2_HUMAN)
  misc_feature (2)..(2): Xaa can be Phe, Ser, Leu, Trp, Met, Tyr, Asn, Val, Ala, Gln, Thr, Ile, His, Glu, Pro, Gly, Asp, Arg, Cys, or Lys
  misc_feature (10)..(10): Xaa can be Phe, Met, Tyr, His, Leu, Ile, Lys, Trp, Val, Arg, Ala, Ser, Pro, Gly, Glu, Thr, Gln, Cys, Asn, or Asp
YXFFVWLHYX

SEQ ID NO: 197877 - protein, 10 aa, Artificial Sequence
  Description of Artificial Sequence: Synthetic peptide
  Seed: YEGLLRRNQM (TYRP2_HUMAN)
  misc_feature (2)..(2): Xaa can be Glu, Pro, Met, Leu, Ala, Ile, Gln, Val, Asp, Phe, Arg, Tyr, Thr, Ser, Asn, His, Trp, Lys, Cys, or Gly
  misc_feature (10)..(10): Xaa can be Leu, Met, Ile, Phe, Val, Ala, Trp, Cys, Tyr, or Thr
YXGLLRRNQX

SEQ ID NO: 197878 - protein, 10 aa, Artificial Sequence
  Description of Artificial Sequence: Synthetic peptide
  Seed: YHLLCLERDL (TYRP2_HUMAN)
  misc_feature (2)..(2): Xaa can be Leu, Met, Pro, Ser, Ala, Phe, Tyr, His, Gln, Glu, Asp, Arg, Val, Ile, Gly, Cys, Trp, Asn, Thr, or Lys
  misc_feature (10)..(10): Xaa can be Val, Leu, Ile, Ala, or Met
YXLLCLERDX

SEQ ID NO: 197879 - protein, 9 aa, Artificial Sequence
  Description of Artificial Sequence: Synthetic peptide
  Seed: YILRNQDDR (TYRP2_HUMAN)
  misc_feature (2)..(2): Xaa can be Ile, Val, Met, Phe, Tyr, or Thr
  misc_feature (9)..(9): Xaa can be , or Arg
YXLRNQDDX

SEQ ID NO: 197880 - protein, 10 aa, Artificial Sequence
  Description of Artificial Sequence: Synthetic peptide
  Seed: YNCGDCKFGW (TYRP2_HUMAN)
  misc_feature (2)..(2): Xaa can be Thr, Ser, Ala, Leu, Met, Ile, Gly, Val, Cys, Asp, Arg, Trp, Tyr, Glu, Gln, Phe, Lys, Asn, or Pro
  misc_feature (10)..(10): Xaa can be Trp, Phe, Leu, Tyr, Met, or Ile
YXCGDCKFGX

SEQ ID NO: 197881 - protein, 10 aa, Artificial Sequence
  Description of Artificial Sequence: Synthetic peptide
  Seed: YNMVPFFPPV (TYRP2_HUMAN)
  misc_feature (2)..(2): Xaa can be Leu, Met, Gln, Val, Lys, Glu, His, Asp, Cys, Thr, Phe, Ser, Trp, Ala, Pro, Tyr, Ile, Gly, Asn, or Arg
  misc_feature (10)..(10): Xaa can be Leu, Met, Pro, Ala, Val, Ser, Ile, Phe, Thr, Cys, Gly, Glu, Lys, Asp, Gln, Trp, Tyr, Asn, or Arg
YXMVPFFPPX

SEQ ID NO: 197882 - protein, 11 aa, Artificial Sequence
  Description of Artificial Sequence: Synthetic peptide
  Seed: YNMVPFFPPVT (TYRP2_HUMAN)
  misc_feature (2)..(2): Xaa can be Asp, Lys, Val, Trp, Ile, Arg, Gln, Pro, Leu, Gly, Tyr, Phe, Ala, Met, Cys, Ser, His, Thr, Asn, or Glu
  misc_feature (11)..(11): Xaa can be Asp, Thr, His, Trp, Ser, Phe, Met, Leu, Cys, Arg, Gly, Gln, Lys, Asn, Ala, Pro, Glu, Val, Ile, or Tyr
YXMVPFFPPVX

SEQ ID NO: 197883 - protein, 11 aa, Artificial Sequence
  Description of Artificial Sequence: Synthetic peptide
  Seed: YRRLRKGYTPL (TYRP2_HUMAN)
  misc_feature (2)..(2): Xaa can be Arg, Met, Pro, Leu, Ala, Asn, Gly, Val, Ile, Ser, Phe, Thr, Gln, Cys, Tyr, His, Glu, Lys, Trp, or Asp
  misc_feature (11)..(11): Xaa can be Ala, Met, Val, Leu, Ile, Phe, Arg, Cys, Lys, or Thr
YXRLRKGYTPX

SEQ ID NO: 197884 - protein, 8 aa, Artificial Sequence
  Description of Artificial Sequence: Synthetic peptide
  Seed: YSVRDTLL (TYRP2_HUMAN)
  misc_feature (2)..(2): Xaa can be Ala, Ser, Thr, Ile, Val, or Gly
  misc_feature (8)..(8): Xaa can be Leu, Ile, Phe, Lys, Met, Tyr, or Val
YXVRDTLX

SEQ ID NO: 197885 - protein, 9 aa, Artificial Sequence
  Description of Artificial Sequence: Synthetic peptide
  Seed: YSVRDTLLG (TYRP2_HUMAN)
  misc_feature (2)..(2): Xaa can be Ser, Ala, Thr, Val, Met, Ile, Cys, Gly, Gln, Trp, Tyr, Leu, Phe, His, Asn, Asp, Glu, Lys, or Pro
  misc_feature (9)..(9): Xaa can be Trp, Phe, Tyr, Met, Leu, Ile, Gly, or Val
YXVRDTLLX

SEQ ID NO: 197886 - protein, 9 aa, Artificial Sequence
  Description of Artificial Sequence: Synthetic peptide
  Seed: YSYAIDLPV (TYRP2_HUMAN)
  misc_feature (2)..(2): Xaa can be Leu, Ala, Met, Pro, Gln, Tyr, Ser, Val, Lys, Thr, Phe, Ile, Gly, Asn, Arg, Glu, His, Cys, Asp, or Trp
  misc_feature (9)..(9): Xaa can be Phe, Leu, Met, Trp, Ile, Val, Tyr, His, Ala, Lys, Gly, Arg, Cys, Ser, Thr, Gln, Asn, Pro, Glu, or Asp
YXYAIDLPX

SEQ ID NO: 197887 - protein, 10 aa, Artificial Sequence
  Description of Artificial Sequence: Synthetic peptide
  Seed: YSYAIDLPVS (TYRP2_HUMAN)
  misc_feature (2)..(2): Xaa can be Leu, Gln, Ala, Thr, Met, Val, Ile, Ser, Trp, Gly, or Phe
  misc_feature (10)..(10): Xaa can be Val, Trp, Arg, Ser, Ile, Glu, Phe, Lys, Asn, Gln, His, Cys, Asp, Thr, Ala, Leu, Tyr, Pro, Met, or Gly
YXYAIDLPVX

SEQ ID NO: 197888 - protein, 11 aa, Artificial Sequence
  Description of Artificial Sequence: Synthetic peptide
  Seed: YSYAIDLPVSV (TYRP2_HUMAN)
  misc_feature (2)..(2): Xaa can be Met, Leu, Val, Thr, Ile, Ala, Ser, Gln, Gly, Asn, Asp, Glu, Lys, His, Arg, Trp, Pro, Phe, Cys, or Tyr
  misc_feature (11)..(11): Xaa can be Val, Phe, Leu, Tyr, Met, Lys, Ile, Trp, Arg, Ala, Thr, His, Cys, Asp, Gly, Glu, Gln, Pro, Ser, or Asn
YXYAIDLPVSX

SEQ ID NO: 197889 - protein, 9 aa, Artificial Sequence
  Description of Artificial Sequence: Synthetic peptide
  Seed: YTPLMETHL (TYRP2_HUMAN)
  misc_feature (2)..(2): Xaa can be Ala, Ile, Thr, Val, Arg, Leu, Met, Tyr, Phe, Ser, Gln, Trp, Gly, Asn, Cys, His, Glu, Pro, Asp, or Lys
  misc_feature (9)..(9): Xaa can be Met, Phe, Leu, Tyr, Ile, Trp, Val, Arg, His, Ala, Lys, or Cys
YXPLMETHX

SEQ ID NO: 197890 - protein, 11 aa, Artificial Sequence
  Description of Artificial Sequence: Synthetic peptide
  Seed: YTPLMETHLSS (TYRP2_HUMAN)
  misc_feature (2)..(2): Xaa can be Gln, Tyr, Thr, Asp, Lys, Ile, Met, Phe, Ala, Trp, Ser, Val, His, Gly, Glu, Cys, Pro, Asn, Leu, or Arg
  misc_feature (11)..(11): Xaa can be Met, Phe, Ala, Ser, Thr, Ile, Cys, Val, or Leu
YXPLMETHLSX

SEQ ID NO: 197891 - protein, 8 aa, Artificial Sequence
  Description of Artificial Sequence: Synthetic peptide
  Seed: YVITTQHW (TYRP2_HUMAN)
  misc_feature (2)..(2): Xaa can be Thr, Ser, Ala, Cys, Asp, Val, Met, Ile, Gly, Glu, Asn, Phe, Gln, Leu, Trp, or Pro
  misc_feature (8)..(8): Xaa can be Trp, Phe, Tyr, or Leu
YXITTQHX

SEQ ID NO: 197892 - protein, 9 aa, Artificial Sequence
  Description of Artificial Sequence: Synthetic peptide
  Seed: YVITTQHWL (TYRP2_HUMAN)
  misc_feature (2)..(2): Xaa can be Leu, Met, Gln, Thr, Ser, Ile, Val, Ala, Asn, Gly, Phe, Cys, Tyr, Glu, Trp, Pro, Asp, His, Lys, or Arg
  misc_feature (9)..(9): Xaa can be Trp, Val, Phe, Tyr, Met, Leu, Lys, Arg, Ile, Ala, Thr, Cys, His, Ser, or Gly
YXITTQHWX

SEQ ID NO: 197893 - protein, 11 aa, Artificial Sequence
  Description of Artificial Sequence: Synthetic peptide
  Seed: YVITTQHWLGL (TYRP2_HUMAN)
  misc_feature (2)..(2): Xaa can be Met, Leu, Gln, Val, Thr, Ile, Ala, or Ser
  misc_feature (11)..(11): Xaa can be Val, Leu, Ile, Ala, or Met
YXITTQHWLGX

SEQ ID NO: 197894 - protein, 8 aa, Artificial Sequence
  Description of Artificial Sequence: Synthetic peptide
  Seed: YWNFATGR (TYRP2_HUMAN)
  misc_feature (2)..(2): Xaa can be Tyr, Trp, Met, or Phe
  misc_feature (8)..(8): Xaa can be , or Arg
YXNFATGX

SEQ ID NO: 197895 - protein, 8 aa, Artificial Sequence
  Description of Artificial Sequence: Synthetic peptide
  Seed: YYSVRDTL (TYRP2_HUMAN)
  misc_feature (2)..(2): Xaa can be Ala, Tyr, Phe, Ser, Met, Trp, Gln, Thr, Arg, Ile, Gly, Val, His, Leu, Asn, Glu, Asp, Cys, Pro, or Lys
  misc_feature (8)..(8): Xaa can be Leu, Phe, Met, Ile, Tyr, Trp, or Val
YXSVRDTX

SEQ ID NO: 197896 - protein, 9 aa, Artificial Sequence
  Description of Artificial Sequence: Synthetic peptide
  Seed: YYSVRDTLL (TYRP2_HUMAN)
  misc_feature (2)..(2): Xaa can be Arg, Ala, Tyr, Ser, Thr, Gly, Ile, Val, Phe, Asn, Pro, Trp, Leu, Met, Glu, Gln, His, Asp, Cys, or Lys
  misc_feature (9)..(9): Xaa can be Leu, Phe, Ile, Met, Val, Tyr, Trp, Lys, Arg, His, Cys, or Ala
YXSVRDTLX

SEQ ID NO: 197897 - protein, 15 aa, Artificial Sequence
  Description of Artificial Sequence: Synthetic peptide
  Seed: KEFTVSGNILTIRLT (CTG1B_HUMAN)
KEFIVSGNALTARLT

SEQ ID NO: 197898 - protein, 15 aa, Artificial Sequence
  Description of Artificial Sequence: Synthetic peptide
  Seed: KEFTVSGNILTIRLT (CTG1B_HUMAN)
KEFTVHGSILVIRLT

SEQ ID NO: 197899 - protein, 15 aa, Artificial Sequence
  Description of Artificial Sequence: Synthetic peptide
  Seed: KEFTVSGNILTIRLT (CTG1B_HUMAN)
KEFTVMGSILHIRLT

SEQ ID NO: 197900 - protein, 15 aa, Artificial Sequence
  Description of Artificial Sequence: Synthetic peptide
  Seed: RLLEFYLAMPFATPM (CTG1B_HUMAN)
RLFEFHLFMPLATPM

SEQ ID NO: 197901 - protein, 15 aa, Artificial Sequence
  Description of Artificial Sequence: Synthetic peptide
  Seed: RLLEFYLAMPFATPM (CTG1B_HUMAN)
RLLEFFLATPFATVM

SEQ ID NO: 197902 - protein, 25 aa, Homo sapiens
  Native (CTG1B_HUMAN)
EFYLAMPFATPMEAELARRSLAQDA

SEQ ID NO: 197903 - protein, 19 aa, Homo sapiens
  Native (CTG1B_HUMAN)
GEAGATGGRGPRGAGAARA

SEQ ID NO: 197904 - protein, 24 aa, Homo sapiens
  Native (CTG1B_HUMAN)
GRGPRGAGAARASGPGGGAPRGPH

SEQ ID NO: 197905 - protein, 15 aa, Homo sapiens
  Native (CTG1B_HUMAN)
HRQLQLSISSCLQQL

SEQ ID NO: 197906 - protein, 15 aa, Homo sapiens
  Native (CTG1B_HUMAN)
LLKEFTVSGNILTIR

SEQ ID NO: 197907 - protein, 15 aa, Homo sapiens
  Native (CTG1B_HUMAN)
MWITQCFLPVFLAQP

SEQ ID NO: 197908 - protein, 15 aa, Homo sapiens
  Native (CTG1B_HUMAN)
NILTIRLTAADHRQL

SEQ ID NO: 197909 - protein, 15 aa, Homo sapiens
  Native (CTG1B_HUMAN)
RGPHGGAASGLNGCC

SEQ ID NO: 197910 - protein, 15 aa, Homo sapiens
  Native (CTG1B_HUMAN)
SRLLEFYLAMPFATP

SEQ ID NO: 197911 - protein, 15 aa, Homo sapiens
  Native (CTG1B_HUMAN)
AADHRQLQLSISSCL

SEQ ID NO: 197912 - protein, 16 aa, Homo sapiens
  Native (CTG1B_HUMAN)
AADHRQLQLSISSCLQ

SEQ ID NO: 197913 - protein, 17 aa, Homo sapiens
  Native (CTG1B_HUMAN)
AADHRQLQLSISSCLQQ

SEQ ID NO: 197914 - protein, 18 aa, Homo sapiens
  Native (CTG1B_HUMAN)
AADHRQLQLSISSCLQQL

SEQ ID NO: 197915 - protein, 19 aa, Homo sapiens
  Native (CTG1B_HUMAN)
AADHRQLQLSISSCLQQLS

SEQ ID NO: 197916 - protein, 20 aa, Homo sapiens
  Native (CTG1B_HUMAN)
AADHRQLQLSISSCLQQLSL

SEQ ID NO: 197917 - protein, 21 aa, Homo sapiens
  Native (CTG1B_HUMAN)
AADHRQLQLSISSCLQQLSLL

SEQ ID NO: 197918 - protein, 22 aa, Homo sapiens
  Native (CTG1B_HUMAN)
AADHRQLQLSISSCLQQLSLLM

SEQ ID NO: 197919 - protein, 23 aa, Homo sapiens
  Native (CTG1B_HUMAN)
AADHRQLQLSISSCLQQLSLLMW

SEQ ID NO: 197920 - protein, 24 aa, Homo sapiens
  Native (CTG1B_HUMAN)
AADHRQLQLSISSCLQQLSLLMWI

SEQ ID NO: 197921 - protein, 25 aa, Homo sapiens
  Native (CTG1B_HUMAN)
AADHRQLQLSISSCLQQLSLLMWIT

SEQ ID NO: 197922 - protein, 15 aa, Homo sapiens
  Native (CTG1B_HUMAN)
AARASGPGGGAPRGP

SEQ ID NO: 197923 - protein, 16 aa, Homo sapiens
  Native (CTG1B_HUMAN)
AARASGPGGGAPRGPH

SEQ ID NO: 197924 - protein, 17 aa, Homo sapiens
  Native (CTG1B_HUMAN)
AARASGPGGGAPRGPHG

SEQ ID NO: 197925 - protein, 19 aa, Homo sapiens
  Native (CTG1B_HUMAN)
AARASGPGGGAPRGPHGGA

SEQ ID NO: 197926 - protein, 20 aa, Homo sapiens
  Native (CTG1B_HUMAN)
AARASGPGGGAPRGPHGGAA

SEQ ID NO: 197927 - protein, 23 aa, Homo sapiens
  Native (CTG1B_HUMAN)
AARASGPGGGAPRGPHGGAASGL

SEQ ID NO: 197928 - protein, 24 aa, Homo sapiens
  Native (CTG1B_HUMAN)
AARASGPGGGAPRGPHGGAASGLN

SEQ ID NO: 197929 - protein, 25 aa, Homo sapiens
  Native (CTG1B_HUMAN)
AARASGPGGGAPRGPHGGAASGLNG

SEQ ID NO: 197930 - protein, 14 aa, Homo sapiens
  Native (CTG1B_HUMAN)
ADHRQLQLSISSCL

SEQ ID NO: 197931 - protein, 15 aa, Homo sapiens
  Native (CTG1B_HUMAN)
ADHRQLQLSISSCLQ

SEQ ID NO: 197932 - protein, 16 aa, Homo sapiens
  Native (CTG1B_HUMAN)
ADHRQLQLSISSCLQQ

SEQ ID NO: 197933 - protein, 17 aa, Homo sapiens
  Native (CTG1B_HUMAN)
ADHRQLQLSISSCLQQL

SEQ ID NO: 197934 - protein, 18 aa, Homo sapiens
  Native (CTG1B_HUMAN)
ADHRQLQLSISSCLQQLS

SEQ ID NO: 197935 - protein, 19 aa, Homo sapiens
  Native (CTG1B_HUMAN)
ADHRQLQLSISSCLQQLSL

SEQ ID NO: 197936 - protein, 20 aa, Homo sapiens
  Native (CTG1B_HUMAN)
ADHRQLQLSISSCLQQLSLL

SEQ ID NO: 197937 - protein, 21 aa, Homo sapiens
  Native (CTG1B_HUMAN)
ADHRQLQLSISSCLQQLSLLM

SEQ ID NO: 197938 - protein, 22 aa, Homo sapiens
  Native (CTG1B_HUMAN)
ADHRQLQLSISSCLQQLSLLMW

SEQ ID NO: 197939 - protein, 23 aa, Homo sapiens
  Native (CTG1B_HUMAN)
ADHRQLQLSISSCLQQLSLLMWI

SEQ ID NO: 197940 - protein, 24 aa, Homo sapiens
  Native (CTG1B_HUMAN)
ADHRQLQLSISSCLQQLSLLMWIT

SEQ ID NO: 197941 - protein, 25 aa, Homo sapiens
  Native (CTG1B_HUMAN)
ADHRQLQLSISSCLQQLSLLMWITQ

SEQ ID NO: 197942 - protein, 14 aa, Homo sapiens
  Native (CTG1B_HUMAN)
AELARRSLAQDAPP

SEQ ID NO: 197943 - protein, 15 aa, Homo sapiens
  Native (CTG1B_HUMAN)
AELARRSLAQDAPPL

SEQ ID NO: 197944 - protein, 16 aa, Homo sapiens
  Native (CTG1B_HUMAN)
AELARRSLAQDAPPLP

SEQ ID NO: 197945 - protein, 17 aa, Homo sapiens
  Native (CTG1B_HUMAN)
AELARRSLAQDAPPLPV

SEQ ID NO: 197946 - protein, 18 aa, Homo sapiens
  Native (CTG1B_HUMAN)
AELARRSLAQDAPPLPVP

SEQ ID NO: 197947 - protein, 19 aa, Homo sapiens
  Native (CTG1B_HUMAN)
AELARRSLAQDAPPLPVPG

SEQ ID NO: 197948 - protein, 20 aa, Homo sapiens
  Native (CTG1B_HUMAN)
AELARRSLAQDAPPLPVPGV

SEQ ID NO: 197949 - protein, 21 aa, Homo sapiens
  Native (CTG1B_HUMAN)
AELARRSLAQDAPPLPVPGVL

SEQ ID NO: 197950 - protein, 22 aa, Homo sapiens
  Native (CTG1B_HUMAN)
AELARRSLAQDAPPLPVPGVLL

SEQ ID NO: 197951 - protein, 23 aa, Homo sapiens
  Native (CTG1B_HUMAN)
AELARRSLAQDAPPLPVPGVLLK

SEQ ID NO: 197952 - protein, 24 aa, Homo sapiens
  Native (CTG1B_HUMAN)
AELARRSLAQDAPPLPVPGVLLKE

SEQ ID NO: 197953 - protein, 25 aa, Homo sapiens
  Native (CTG1B_HUMAN)
AELARRSLAQDAPPLPVPGVLLKEF

SEQ ID NO: 197954 - protein, 14 aa, Homo sapiens
  Native (CTG1B_HUMAN)
AGAARASGPGGGAP

SEQ ID NO: 197955 - protein, 15 aa, Homo sapiens
  Native (CTG1B_HUMAN)
AGAARASGPGGGAPR

SEQ ID NO: 197956 - protein, 16 aa, Homo sapiens
  Native (CTG1B_HUMAN)
AGAARASGPGGGAPRG

SEQ ID NO: 197957 - protein, 17 aa, Homo sapiens
  Native (CTG1B_HUMAN)
AGAARASGPGGGAPRGP

SEQ ID NO: 197958 - protein, 19 aa, Homo sapiens
  Native (CTG1B_HUMAN)
AGAARASGPGGGAPRGPHG

SEQ ID NO: 197959 - protein, 20 aa, Homo sapiens
  Native (CTG1B_HUMAN)
AGAARASGPGGGAPRGPHGG

SEQ ID NO: 197960 - protein, 21 aa, Homo sapiens
  Native (CTG1B_HUMAN)
AGAARASGPGGGAPRGPHGGA

SEQ ID NO: 197961 - protein, 22 aa, Homo sapiens
  Native (CTG1B_HUMAN)
AGAARASGPGGGAPRGPHGGAA

SEQ ID NO: 197962 - protein, 23 aa, Homo sapiens
  Native (CTG1B_HUMAN)
AGAARASGPGGGAPRGPHGGAAS

SEQ ID NO: 197963 - protein, 24 aa, Homo sapiens
  Native (CTG1B_HUMAN)
AGAARASGPGGGAPRGPHGGAASG

SEQ ID NO: 197964 - protein, 25 aa, Homo sapiens
  Native (CTG1B_HUMAN)
AGAARASGPGGGAPRGPHGGAASGL

SEQ ID NO: 197965 - protein, 17 aa, Homo sapiens
  Native (CTG1B_HUMAN)
AGATGGRGPRGAGAARA

SEQ ID NO: 197966 - protein, 18 aa, Homo sapiens
  Native (CTG1B_HUMAN)
AGATGGRGPRGAGAARAS

SEQ ID NO: 197967 - protein, 19 aa, Homo sapiens
  Native (CTG1B_HUMAN)
AGATGGRGPRGAGAARASG

SEQ ID NO: 197968 - protein, 20 aa, Homo sapiens
  Native (CTG1B_HUMAN)
AGATGGRGPRGAGAARASGP

SEQ ID NO: 197969 - protein, 21 aa, Homo sapiens
  Native (CTG1B_HUMAN)
AGATGGRGPRGAGAARASGPG

SEQ ID NO: 197970 - protein, 22 aa, Homo sapiens
  Native (CTG1B_HUMAN)
AGATGGRGPRGAGAARASGPGG

SEQ ID NO: 197971 - protein, 23 aa, Homo sapiens
  Native (CTG1B_HUMAN)
AGATGGRGPRGAGAARASGPGGG

SEQ ID NO: 197972 - protein, 24 aa, Homo sapiens
  Native (CTG1B_HUMAN)
AGATGGRGPRGAGAARASGPGGGA

SEQ ID NO: 197973 - protein, 25 aa, Homo sapiens
  Native (CTG1B_HUMAN)
AGATGGRGPRGAGAARASGPGGGAP

SEQ ID NO: 197974 - protein, 15 aa, Homo sapiens
  Native (CTG1B_HUMAN)
AGGPGEAGATGGRGP

SEQ ID NO: 197975 - protein, 23 aa, Homo sapiens
  Native (CTG1B_HUMAN)
AGGPGEAGATGGRGPRGAGAARA

SEQ ID NO: 197976 - protein, 24 aa, Homo sapiens
  Native (CTG1B_HUMAN)
AGGPGEAGATGGRGPRGAGAARAS

SEQ ID NO: 197977 - protein, 25 aa, Homo sapiens
  Native (CTG1B_HUMAN)
AGGPGEAGATGGRGPRGAGAARASG

SEQ ID NO: 197978 - protein, 14 aa, Homo sapiens
  Native (CTG1B_HUMAN)
AMPFATPMEAELAR

SEQ ID NO: 197979 - protein, 15 aa, Homo sapiens
  Native (CTG1B_HUMAN)
AMPFATPMEAELARR

SEQ ID NO: 197980 - protein, 16 aa, Homo sapiens
  Native (CTG1B_HUMAN)
AMPFATPMEAELARRS

SEQ ID NO: 197981 - protein, 17 aa, Homo sapiens
  Native (CTG1B_HUMAN)
AMPFATPMEAELARRSL

SEQ ID NO: 197982 - protein, 18 aa, Homo sapiens
  Native (CTG1B_HUMAN)
AMPFATPMEAELARRSLA

SEQ ID NO: 197983 - protein, 19 aa, Homo sapiens
  Native (CTG1B_HUMAN)
AMPFATPMEAELARRSLAQ

SEQ ID NO: 197984 - protein, 20 aa, Homo sapiens
  Native (CTG1B_HUMAN)
AMPFATPMEAELARRSLAQD

SEQ ID NO: 197985 - protein, 21 aa, Homo sapiens
  Native (CTG1B_HUMAN)
AMPFATPMEAELARRSLAQDA

SEQ ID NO: 197986 - protein, 22 aa, Homo sapiens
  Native (CTG1B_HUMAN)
AMPFATPMEAELARRSLAQDAP

SEQ ID NO: 197987 - protein, 23 aa, Homo sapiens
  Native (CTG1B_HUMAN)
AMPFATPMEAELARRSLAQDAPP

SEQ ID NO: 197988 - protein, 24 aa, Homo sapiens
  Native (CTG1B_HUMAN)
AMPFATPMEAELARRSLAQDAPPL

SEQ ID NO: 197989 - protein, 25 aa, Homo sapiens
  Native (CTG1B_HUMAN)
AMPFATPMEAELARRSLAQDAPPLP

SEQ ID NO: 197990 - protein, 15 aa, Homo sapiens
  Native (CTG1B_HUMAN)
APPLPVPGVLLKEFT

SEQ ID NO: 197991 - protein, 17 aa, Homo sapiens
  Native (CTG1B_HUMAN)
APPLPVPGVLLKEFTVS

SEQ ID NO: 197992 - protein, 19 aa, Homo sapiens
  Native (CTG1B_HUMAN)
APPLPVPGVLLKEFTVSGN

SEQ ID NO: 197993 - protein, 20 aa, Homo sapiens
  Native (CTG1B_HUMAN)
APPLPVPGVLLKEFTVSGNI

SEQ ID NO: 197994 - protein, 21 aa, Homo sapiens
  Native (CTG1B_HUMAN)
APPLPVPGVLLKEFTVSGNIL

SEQ ID NO: 197995 - protein, 22 aa, Homo sapiens
  Native (CTG1B_HUMAN)
APPLPVPGVLLKEFTVSGNILT

SEQ ID NO: 197996 - protein, 23 aa, Homo sapiens
  Native (CTG1B_HUMAN)
APPLPVPGVLLKEFTVSGNILTI

SEQ ID NO: 197997 - protein, 24 aa, Homo sapiens
  Native (CTG1B_HUMAN)
APPLPVPGVLLKEFTVSGNILTIR

SEQ ID NO: 197998 - protein, 25 aa, Homo sapiens
  Native (CTG1B_HUMAN)
APPLPVPGVLLKEFTVSGNILTIRL

SEQ ID NO: 197999 - protein, 13 aa, Homo sapiens
  Native (CTG1B_HUMAN)
APRGPHGGAASGL

SEQ ID NO: 198000 - protein, 14 aa, Homo sapiens
  Native (CTG1B_HUMAN)
APRGPHGGAASGLN

SEQ ID NO: 198001 - protein, 15 aa, Homo sapiens
  Native (CTG1B_HUMAN)
APRGPHGGAASGLNG

SEQ ID NO: 198002 - protein, 16 aa, Homo sapiens
  Native (CTG1B_HUMAN)
APRGPHGGAASGLNGC

SEQ ID NO: 198003 - protein, 17 aa, Homo sapiens
  Native (CTG1B_HUMAN)
APRGPHGGAASGLNGCC

SEQ ID NO: 198004 - protein, 18 aa, Homo sapiens
  Native (CTG1B_HUMAN)
APRGPHGGAASGLNGCCR

SEQ ID NO: 198005 - protein, 19 aa, Homo sapiens
  Native (CTG1B_HUMAN)
APRGPHGGAASGLNGCCRC

SEQ ID NO: 198006 - protein, 20 aa, Homo sapiens
  Native (CTG1B_HUMAN)
APRGPHGGAASGLNGCCRCG

SEQ ID NO: 198007 - protein, 21 aa, Homo sapiens
  Native (CTG1B_HUMAN)
APRGPHGGAASGLNGCCRCGA

SEQ ID NO: 198008 - protein, 22 aa, Homo sapiens
  Native (CTG1B_HUMAN)
APRGPHGGAASGLNGCCRCGAR

SEQ ID NO: 198009 - protein, 23 aa, Homo sapiens
  Native (CTG1B_HUMAN)
APRGPHGGAASGLNGCCRCGARG

SEQ ID NO: 198010 - protein, 24 aa, Homo sapiens
  Native (CTG1B_HUMAN)
APRGPHGGAASGLNGCCRCGARGP

SEQ ID NO: 198011 - protein, 25 aa, Homo sapiens
  Native (CTG1B_HUMAN)
APRGPHGGAASGLNGCCRCGARGPE

SEQ ID NO: 198012 - protein, 15 aa, Homo sapiens
  Native (CTG1B_HUMAN)
AQDAPPLPVPGVLLK

SEQ ID NO: 198013 - protein, 20 aa, Homo sapiens
  Native (CTG1B_HUMAN)
AQDAPPLPVPGVLLKEFTVS

SEQ ID NO: 198014 - protein, 21 aa, Homo sapiens
  Native (CTG1B_HUMAN)
AQDAPPLPVPGVLLKEFTVSG

SEQ ID NO: 198015 - protein, 22 aa, Homo sapiens
  Native (CTG1B_HUMAN)
AQDAPPLPVPGVLLKEFTVSGN

SEQ ID NO: 198016 - protein, 23 aa, Homo sapiens
  Native (CTG1B_HUMAN)
AQDAPPLPVPGVLLKEFTVSGNI

SEQ ID NO: 198017 - protein, 24 aa, Homo sapiens
  Native (CTG1B_HUMAN)
AQDAPPLPVPGVLLKEFTVSGNIL

SEQ ID NO: 198018 - protein, 25 aa, Homo sapiens
  Native (CTG1B_HUMAN)
AQDAPPLPVPGVLLKEFTVSGNILT

SEQ ID NO: 198019 - protein, 14 aa, Homo sapiens
  Native (CTG1B_HUMAN)
ARASGPGGGAPRGP

SEQ ID NO: 198020 - protein, 15 aa, Homo sapiens
  Native (CTG1B_HUMAN)
ARASGPGGGAPRGPH

SEQ ID NO: 198021 - protein, 16 aa, Homo sapiens
  Native (CTG1B_HUMAN)
ARASGPGGGAPRGPHG

SEQ ID NO: 198022 - protein, 17 aa, Homo sapiens
  Native (CTG1B_HUMAN)
ARASGPGGGAPRGPHGG

SEQ ID NO: 198023 - protein, 20 aa, Homo sapiens
  Native (CTG1B_HUMAN)
ARASGPGGGAPRGPHGGAAS

SEQ ID NO: 198024 - protein, 22 aa, Homo sapiens
  Native (CTG1B_HUMAN)
ARASGPGGGAPRGPHGGAASGL

SEQ ID NO: 198025 - protein, 23 aa, Homo sapiens
  Native (CTG1B_HUMAN)
ARASGPGGGAPRGPHGGAASGLN

SEQ ID NO: 198026 - protein, 24 aa, Homo sapiens
  Native (CTG1B_HUMAN)
ARASGPGGGAPRGPHGGAASGLNG

SEQ ID NO: 198027 - protein, 25 aa, Homo sapiens
  Native (CTG1B_HUMAN)
ARASGPGGGAPRGPHGGAASGLNGC

SEQ ID NO: 198028 - protein, 14 aa, Homo sapiens
  Native (CTG1B_HUMAN)
ARGPESRLLEFYLA

SEQ ID NO: 198029 - protein, 15 aa, Homo sapiens
  Native (CTG1B_HUMAN)
ARGPESRLLEFYLAM

SEQ ID NO: 198030 - protein, 16 aa, Homo sapiens
  Native (CTG1B_HUMAN)
ARGPESRLLEFYLAMP

SEQ ID NO: 198031 - protein, 17 aa, Homo sapiens
  Native (CTG1B_HUMAN)
ARGPESRLLEFYLAMPF

SEQ ID NO: 198032 - protein, 18 aa, Homo sapiens
  Native (CTG1B_HUMAN)
ARGPESRLLEFYLAMPFA

SEQ ID NO: 198033 - protein, 19 aa, Homo sapiens
  Native (CTG1B_HUMAN)
ARGPESRLLEFYLAMPFAT

SEQ ID NO: 198034 - protein, 20 aa, Homo sapiens
  Native (CTG1B_HUMAN)
ARGPESRLLEFYLAMPFATP

SEQ ID NO: 198035 - protein, 21 aa, Homo sapiens
  Native (CTG1B_HUMAN)
ARGPESRLLEFYLAMPFATPM

SEQ ID NO: 198036 - protein, 22 aa, Homo sapiens
  Native (CTG1B_HUMAN)
ARGPESRLLEFYLAMPFATPME

SEQ ID NO: 198037 - protein, 23 aa, Homo sapiens
  Native (CTG1B_HUMAN)
ARGPESRLLEFYLAMPFATPMEA

SEQ ID NO: 198038 - protein, 24 aa, Homo sapiens
  Native (CTG1B_HUMAN)
ARGPESRLLEFYLAMPFATPMEAE

SEQ ID NO: 198039 - protein, 25 aa, Homo sapiens
  Native (CTG1B_HUMAN)
ARGPESRLLEFYLAMPFATPMEAEL

SEQ ID NO: 198040 - protein, 14 aa, Homo sapiens
  Native (CTG1B_HUMAN)
ARRSLAQDAPPLPV

SEQ ID NO: 198041 - protein, 15 aa, Homo sapiens
  Native (CTG1B_HUMAN)
ARRSLAQDAPPLPVP

SEQ ID NO: 198042 - protein, 16 aa, Homo sapiens
  Native (CTG1B_HUMAN)
ARRSLAQDAPPLPVPG

SEQ ID NO: 198043 - protein, 17 aa, Homo sapiens
  Native (CTG1B_HUMAN)
ARRSLAQDAPPLPVPGV

SEQ ID NO: 198044 - protein, 20 aa, Homo sapiens
  Native (CTG1B_HUMAN)
ARRSLAQDAPPLPVPGVLLK

SEQ ID NO: 198045 - protein, 24 aa, Homo sapiens
  Native (CTG1B_HUMAN)
ARRSLAQDAPPLPVPGVLLKEFTV

SEQ ID NO: 198046 - protein, 25 aa, Homo sapiens
  Native (CTG1B_HUMAN)
ARRSLAQDAPPLPVPGVLLKEFTVS

SEQ ID NO: 198047 - protein, 14 aa, Homo sapiens
  Native (CTG1B_HUMAN)
ASGPGGGAPRGPHG

SEQ ID NO: 198048 - protein, 15 aa, Homo sapiens
  Native (CTG1B_HUMAN)
ASGPGGGAPRGPHGG

SEQ ID NO: 198049 - protein, 16 aa, Homo sapiens
  Native (CTG1B_HUMAN)
ASGPGGGAPRGPHGGA

SEQ ID NO: 198050 - protein, 20 aa, Homo sapiens
  Native (CTG1B_HUMAN)
ASGPGGGAPRGPHGGAASGL

SEQ ID NO: 198051 - protein, 21 aa, Homo sapiens
  Native (CTG1B_HUMAN)
ASGPGGGAPRGPHGGAASGLN

SEQ ID NO: 198052 - protein, 22 aa, Homo sapiens
  Native (CTG1B_HUMAN)
ASGPGGGAPRGPHGGAASGLNG

SEQ ID NO: 198053 - protein, 23 aa, Homo sapiens
  Native (CTG1B_HUMAN)
ASGPGGGAPRGPHGGAASGLNGC

SEQ ID NO: 198054 - protein, 24 aa, Homo sapiens
  Native (CTG1B_HUMAN)
ASGPGGGAPRGPHGGAASGLNGCC

SEQ ID NO: 198055 - protein, 25 aa, Homo sapiens
  Native (CTG1B_HUMAN)
ASGPGGGAPRGPHGGAASGLNGCCR

SEQ ID NO: 198056 - protein, 15 aa, Homo sapiens
  Native (CTG1B_HUMAN)
ATGGRGPRGAGAARA

SEQ ID NO: 198057 - protein, 16 aa, Homo sapiens
  Native (CTG1B_HUMAN)
ATGGRGPRGAGAARAS

SEQ ID NO: 198058 - protein, 17 aa, Homo sapiens
  Native (CTG1B_HUMAN)
ATGGRGPRGAGAARASG

SEQ ID NO: 198059 - protein, 18 aa, Homo sapiens
  Native (CTG1B_HUMAN)
ATGGRGPRGAGAARASGP

SEQ ID NO: 198060 - protein, 19 aa, Homo sapiens
  Native (CTG1B_HUMAN)
ATGGRGPRGAGAARASGPG

SEQ ID NO: 198061 - protein, 20 aa, Homo sapiens
  Native (CTG1B_HUMAN)
ATGGRGPRGAGAARASGPGG

SEQ ID NO: 198062 - protein, 21 aa, Homo sapiens
  Native (CTG1B_HUMAN)
ATGGRGPRGAGAARASGPGGG

SEQ ID NO: 198063 - protein, 22 aa, Homo sapiens
  Native (CTG1B_HUMAN)
ATGGRGPRGAGAARASGPGGGA

SEQ ID NO: 198064 - protein, 23 aa, Homo sapiens
  Native (CTG1B_HUMAN)
ATGGRGPRGAGAARASGPGGGAP

SEQ ID NO: 198065 - protein, 24 aa, Homo sapiens
  Native (CTG1B_HUMAN)
ATGGRGPRGAGAARASGPGGGAPR

SEQ ID NO: 198066 - protein, 25 aa, Homo sapiens
  Native (CTG1B_HUMAN)
ATGGRGPRGAGAARASGPGGGAPRG

SEQ ID NO: 198067 - protein, 14 aa, Homo sapiens
  Native (CTG1B_HUMAN)
ATPMEAELARRSLA

SEQ ID NO: 198068 - protein, 15 aa, Homo sapiens
  Native (CTG1B_HUMAN)
ATPMEAELARRSLAQ

SEQ ID NO: 198069 - protein, 16 aa, Homo sapiens
  Native (CTG1B_HUMAN)
ATPMEAELARRSLAQD

SEQ ID NO: 198070 - protein, 17 aa, Homo sapiens
  Native (CTG1B_HUMAN)
ATPMEAELARRSLAQDA

SEQ ID NO: 198071 - protein, 18 aa, Homo sapiens
  Native (CTG1B_HUMAN)
ATPMEAELARRSLAQDAP

SEQ ID NO: 198072 - protein, 19 aa, Homo sapiens
  Native (CTG1B_HUMAN)
ATPMEAELARRSLAQDAPP

SEQ ID NO: 198073 - protein, 20 aa, Homo sapiens
  Native (CTG1B_HUMAN)
ATPMEAELARRSLAQDAPPL

SEQ ID NO: 198074 - protein, 21 aa, Homo sapiens
  Native (CTG1B_HUMAN)
ATPMEAELARRSLAQDAPPLP

SEQ ID NO: 198075 - protein, 22 aa, Homo sapiens
  Native (CTG1B_HUMAN)
ATPMEAELARRSLAQDAPPLPV

SEQ ID NO: 198076 - protein, 23 aa, Homo sapiens
  Native (CTG1B_HUMAN)
ATPMEAELARRSLAQDAPPLPVP

SEQ ID NO: 198077 - protein, 24 aa, Homo sapiens
  Native (CTG1B_HUMAN)
ATPMEAELARRSLAQDAPPLPVPG

SEQ ID NO: 198078 - protein, 25 aa, Homo sapiens
  Native (CTG1B_HUMAN)
ATPMEAELARRSLAQDAPPLPVPGV

SEQ ID NO: 198079 - protein, 19 aa, Homo sapiens
  Native (CTG1B_HUMAN)
CCRCGARGPESRLLEFYLA

SEQ ID NO: 198080 - protein, 20 aa, Homo sapiens
  Native (CTG1B_HUMAN)
CCRCGARGPESRLLEFYLAM

SEQ ID NO: 198081 - protein, 21 aa, Homo sapiens
  Native (CTG1B_HUMAN)
CCRCGARGPESRLLEFYLAMP

SEQ ID NO: 198082 - protein, 22 aa, Homo sapiens
  Native (CTG1B_HUMAN)
CCRCGARGPESRLLEFYLAMPF

SEQ ID NO: 198083 - protein, 23 aa, Homo sapiens
  Native (CTG1B_HUMAN)
CCRCGARGPESRLLEFYLAMPFA

SEQ ID NO: 198084 - protein, 24 aa, Homo sapiens
  Native (CTG1B_HUMAN)
CCRCGARGPESRLLEFYLAMPFAT

SEQ ID NO: 198085 - protein, 25 aa, Homo sapiens
  Native (CTG1B_HUMAN)
CCRCGARGPESRLLEFYLAMPFATP

SEQ ID NO: 198086 - protein, 13 aa, Homo sapiens
  Native (CTG1B_HUMAN)
CFLPVFLAQPPSG

SEQ ID NO: 198087 - protein, 14 aa, Homo sapiens
  Native (CTG1B_HUMAN)
CFLPVFLAQPPSGQ

SEQ ID NO: 198088 - protein, 15 aa, Homo sapiens
  Native (CTG1B_HUMAN)
CFLPVFLAQPPSGQR

SEQ ID NO: 198089 - protein, 16 aa, Homo sapiens
  Native (CTG1B_HUMAN)
CFLPVFLAQPPSGQRR

SEQ ID NO: 198090 - protein, 16 aa, Homo sapiens
  Native (CTG1B_HUMAN)
CGARGPESRLLEFYLA

SEQ ID NO: 198091 - protein, 17 aa, Homo sapiens
  Native (CTG1B_HUMAN)
CGARGPESRLLEFYLAM

SEQ ID NO: 198092 - protein, 18 aa, Homo sapiens
  Native (CTG1B_HUMAN)
CGARGPESRLLEFYLAMP

SEQ ID NO: 198093 - protein, 19 aa, Homo sapiens
  Native (CTG1B_HUMAN)
CGARGPESRLLEFYLAMPF

SEQ ID NO: 198094 - protein, 20 aa, Homo sapiens
  Native (CTG1B_HUMAN)
CGARGPESRLLEFYLAMPFA

SEQ ID NO: 198095 - protein, 21 aa, Homo sapiens
  Native (CTG1B_HUMAN)
CGARGPESRLLEFYLAMPFAT

SEQ ID NO: 198096 - protein, 22 aa, Homo sapiens
  Native (CTG1B_HUMAN)
CGARGPESRLLEFYLAMPFATP

SEQ ID NO: 198097 - protein, 23 aa, Homo sapiens
  Native (CTG1B_HUMAN)
CGARGPESRLLEFYLAMPFATPM

SEQ ID NO: 198098 - protein, 24 aa, Homo sapiens
  Native (CTG1B_HUMAN)
CGARGPESRLLEFYLAMPFATPME

SEQ ID NO: 198099 - protein, 25 aa, Homo sapiens
  Native (CTG1B_HUMAN)
CGARGPESRLLEFYLAMPFATPMEA

SEQ ID NO: 198100 - protein, 15 aa, Homo sapiens
  Native (CTG1B_HUMAN)
CLQQLSLLMWITQCF

SEQ ID NO: 198101 - protein, 16 aa, Homo sapiens
  Native (CTG1B_HUMAN)
CLQQLSLLMWITQCFL

SEQ ID NO: 198102 - protein, 17 aa, Homo sapiens
  Native (CTG1B_HUMAN)
CLQQLSLLMWITQCFLP

SEQ ID NO: 198103 - protein, 18 aa, Homo sapiens
  Native (CTG1B_HUMAN)
CLQQLSLLMWITQCFLPV

SEQ ID NO: 198104 - protein, 19 aa, Homo sapiens
  Native (CTG1B_HUMAN)
CLQQLSLLMWITQCFLPVF

SEQ ID NO: 198105 - protein, 20 aa, Homo sapiens
  Native (CTG1B_HUMAN)
CLQQLSLLMWITQCFLPVFL

SEQ ID NO: 198106 - protein, 21 aa, Homo sapiens
  Native (CTG1B_HUMAN)
CLQQLSLLMWITQCFLPVFLA

SEQ ID NO: 198107 - protein, 22 aa, Homo sapiens
  Native (CTG1B_HUMAN)
CLQQLSLLMWITQCFLPVFLAQ

SEQ ID NO: 198108 - protein, 23 aa, Homo sapiens
  Native (CTG1B_HUMAN)
CLQQLSLLMWITQCFLPVFLAQP

SEQ ID NO: 198109 - protein, 24 aa, Homo sapiens
  Native (CTG1B_HUMAN)
CLQQLSLLMWITQCFLPVFLAQPP

SEQ ID NO: 198110 - protein, 25 aa, Homo sapiens
  Native (CTG1B_HUMAN)
CLQQLSLLMWITQCFLPVFLAQPPS

SEQ ID NO: 198111 - protein, 19 aa, Homo sapiens
  Native (CTG1B_HUMAN)
CRCGARGPESRLLEFYLAM

SEQ ID NO: 198112 - protein, 20 aa, Homo sapiens
  Native (CTG1B_HUMAN)
CRCGARGPESRLLEFYLAMP

SEQ ID NO: 198113 - protein, 21 aa, Homo sapiens
  Native (CTG1B_HUMAN)
CRCGARGPESRLLEFYLAMPF

SEQ ID NO: 198114 - protein, 22 aa, Homo sapiens
  Native (CTG1B_HUMAN)
CRCGARGPESRLLEFYLAMPFA

SEQ ID NO: 198115 - protein, 23 aa, Homo sapiens
  Native (CTG1B_HUMAN)
CRCGARGPESRLLEFYLAMPFAT

SEQ ID NO: 198116 - protein, 24 aa, Homo sapiens
  Native (CTG1B_HUMAN)
CRCGARGPESRLLEFYLAMPFATP

SEQ ID NO: 198117 - protein, 25 aa, Homo sapiens
  Native (CTG1B_HUMAN)
CRCGARGPESRLLEFYLAMPFATPM

SEQ ID NO: 198118 - protein, 15 aa, Homo sapiens
  Native (CTG1B_HUMAN)
DAPPLPVPGVLLKEF

SEQ ID NO: 198119 - protein, 19 aa, Homo sapiens
  Native (CTG1B_HUMAN)
DAPPLPVPGVLLKEFTVSG

SEQ ID NO: 198120 - protein, 20 aa, Homo sapiens
  Native (CTG1B_HUMAN)
DAPPLPVPGVLLKEFTVSGN

SEQ ID NO: 198121 - protein, 21 aa, Homo sapiens
  Native (CTG1B_HUMAN)
DAPPLPVPGVLLKEFTVSGNI

SEQ ID NO: 198122 - protein, 22 aa, Homo sapiens
  Native (CTG1B_HUMAN)
DAPPLPVPGVLLKEFTVSGNIL

SEQ ID NO: 198123 - protein, 23 aa, Homo sapiens
  Native (CTG1B_HUMAN)
DAPPLPVPGVLLKEFTVSGNILT

SEQ ID NO: 198124 - protein, 24 aa, Homo sapiens
  Native (CTG1B_HUMAN)
DAPPLPVPGVLLKEFTVSGNILTI

SEQ ID NO: 198125 - protein, 25 aa, Homo sapiens
  Native (CTG1B_HUMAN)
DAPPLPVPGVLLKEFTVSGNILTIR

SEQ ID NO: 198126 - protein, 13 aa, Homo sapiens
  Native (CTG1B_HUMAN)
DHRQLQLSISSCL

SEQ ID NO: 198127 - protein, 14 aa, Homo sapiens
  Native (CTG1B_HUMAN)
DHRQLQLSISSCLQ

SEQ ID NO: 198128 - protein, 15 aa, Homo sapiens
  Native (CTG1B_HUMAN)
DHRQLQLSISSCLQQ

SEQ ID NO: 198129 - protein, 16 aa, Homo sapiens
  Native (CTG1B_HUMAN)
DHRQLQLSISSCLQQL

SEQ ID NO: 198130 - protein, 17 aa, Homo sapiens
  Native (CTG1B_HUMAN)
DHRQLQLSISSCLQQLS

SEQ ID NO: 198131 - protein, 18 aa, Homo sapiens
  Native (CTG1B_HUMAN)
DHRQLQLSISSCLQQLSL

SEQ ID NO: 198132 - protein, 19 aa, Homo sapiens
  Native (CTG1B_HUMAN)
DHRQLQLSISSCLQQLSLL

SEQ ID NO: 198133 - protein, 20 aa, Homo sapiens
  Native (CTG1B_HUMAN)
DHRQLQLSISSCLQQLSLLM

SEQ ID NO: 198134 - protein, 21 aa, Homo sapiens
  Native (CTG1B_HUMAN)
DHRQLQLSISSCLQQLSLLMW

SEQ ID NO: 198135 - protein, 22 aa, Homo sapiens
  Native (CTG1B_HUMAN)
DHRQLQLSISSCLQQLSLLMWI

SEQ ID NO: 198136 - protein, 23 aa, Homo sapiens
  Native (CTG1B_HUMAN)
DHRQLQLSISSCLQQLSLLMWIT

SEQ ID NO: 198137 - protein, 24 aa, Homo sapiens
  Native (CTG1B_HUMAN)
DHRQLQLSISSCLQQLSLLMWITQ

SEQ ID NO: 198138 - protein, 25 aa, Homo sapiens
  Native (CTG1B_HUMAN)
DHRQLQLSISSCLQQLSLLMWITQC

SEQ ID NO: 198139 - protein, 14 aa, Homo sapiens
  Native (CTG1B_HUMAN)
EAELARRSLAQDAP

SEQ ID NO: 198140 - protein, 15 aa, Homo sapiens
  Native (CTG1B_HUMAN)
EAELARRSLAQDAPP

SEQ ID NO: 198141 - protein, 16 aa, Homo sapiens
  Native (CTG1B_HUMAN)
EAELARRSLAQDAPPL

SEQ ID NO: 198142 - protein, 17 aa, Homo sapiens
  Native (CTG1B_HUMAN)
EAELARRSLAQDAPPLP

SEQ ID NO: 198143 - protein, 18 aa, Homo sapiens
  Native (CTG1B_HUMAN)
EAELARRSLAQDAPPLPV

SEQ ID NO: 198144 - protein, 19 aa, Homo sapiens
  Native (CTG1B_HUMAN)
EAELARRSLAQDAPPLPVP

SEQ ID NO: 198145 - protein, 20 aa, Homo sapiens
  Native (CTG1B_HUMAN)
EAELARRSLAQDAPPLPVPG

SEQ ID NO: 198146 - protein, 21 aa, Homo sapiens
  Native (CTG1B_HUMAN)
EAELARRSLAQDAPPLPVPGV

SEQ ID NO: 198147 - protein, 22 aa, Homo sapiens
  Native (CTG1B_HUMAN)
EAELARRSLAQDAPPLPVPGVL

SEQ ID NO: 198148 - protein, 23 aa, Homo sapiens
  Native (CTG1B_HUMAN)
EAELARRSLAQDAPPLPVPGVLL

SEQ ID NO: 198149 - protein, 24 aa, Homo sapiens
  Native (CTG1B_HUMAN)
EAELARRSLAQDAPPLPVPGVLLK

SEQ ID NO: 198150 - protein, 25 aa, Homo sapiens
  Native (CTG1B_HUMAN)
EAELARRSLAQDAPPLPVPGVLLKE

SEQ ID NO: 198151 - protein, 18 aa, Homo sapiens
  Native (CTG1B_HUMAN)
EAGATGGRGPRGAGAARA

SEQ ID NO: 198152 - protein, 19 aa, Homo sapiens
  Native (CTG1B_HUMAN)
EAGATGGRGPRGAGAARAS

SEQ ID NO: 198153 - protein, 20 aa, Homo sapiens
  Native (CTG1B_HUMAN)
EAGATGGRGPRGAGAARASG

SEQ ID NO: 198154 - protein, 21 aa, Homo sapiens
  Native (CTG1B_HUMAN)
EAGATGGRGPRGAGAARASGP

SEQ ID NO: 198155 - protein, 22 aa, Homo sapiens
  Native (CTG1B_HUMAN)
EAGATGGRGPRGAGAARASGPG

SEQ ID NO: 198156 - protein, 23 aa, Homo sapiens
  Native (CTG1B_HUMAN)
EAGATGGRGPRGAGAARASGPGG

SEQ ID NO: 198157 - protein, 24 aa, Homo sapiens
  Native (CTG1B_HUMAN)
EAGATGGRGPRGAGAARASGPGGG

SEQ ID NO: 198158 - protein, 25 aa, Homo sapiens
  Native (CTG1B_HUMAN)
EAGATGGRGPRGAGAARASGPGGGA

SEQ ID NO: 198159 - protein, 13 aa, Homo sapiens
  Native (CTG1B_HUMAN)
EFTVSGNILTIRL

SEQ ID NO: 198160 - protein, 14 aa, Homo sapiens
  Native (CTG1B_HUMAN)
EFTVSGNILTIRLT

SEQ ID NO: 198161 - protein, 15 aa, Homo sapiens
  Native (CTG1B_HUMAN)
EFTVSGNILTIRLTA

SEQ ID NO: 198162 - protein, 16 aa, Homo sapiens
  Native (CTG1B_HUMAN)
EFTVSGNILTIRLTAA

SEQ ID NO: 198163 - protein, 17 aa, Homo sapiens
  Native (CTG1B_HUMAN)
EFTVSGNILTIRLTAAD

SEQ ID NO: 198164 - protein, 18 aa, Homo sapiens
  Native (CTG1B_HUMAN)
EFTVSGNILTIRLTAADH

SEQ ID NO: 198165 - protein, 19 aa, Homo sapiens
  Native (CTG1B_HUMAN)
EFTVSGNILTIRLTAADHR

SEQ ID NO: 198166 - protein, 20 aa, Homo sapiens
  Native (CTG1B_HUMAN)
EFTVSGNILTIRLTAADHRQ

SEQ ID NO: 198167 - protein, 21 aa, Homo sapiens
  Native (CTG1B_HUMAN)
EFTVSGNILTIRLTAADHRQL

SEQ ID NO: 198168 - protein, 22 aa, Homo sapiens
  Native (CTG1B_HUMAN)
EFTVSGNILTIRLTAADHRQLQ

SEQ ID NO: 198169 - protein, 23 aa, Homo sapiens
  Native (CTG1B_HUMAN)
EFTVSGNILTIRLTAADHRQLQL

SEQ ID NO: 198170 - protein, 24 aa, Homo sapiens
  Native (CTG1B_HUMAN)
EFTVSGNILTIRLTAADHRQLQLS

SEQ ID NO: 198171 - protein, 25 aa, Homo sapiens
  Native (CTG1B_HUMAN)
EFTVSGNILTIRLTAADHRQLQLSI

SEQ ID NO: 198172 - protein, 13 aa, Homo sapiens
  Native (CTG1B_HUMAN)
EFYLAMPFATPME

SEQ ID NO: 198173 - protein, 14 aa, Homo sapiens
  Native (CTG1B_HUMAN)
EFYLAMPFATPMEA

SEQ ID NO: 198174 - protein, 15 aa, Homo sapiens
  Native (CTG1B_HUMAN)
EFYLAMPFATPMEAE

SEQ ID NO: 198175 - protein, 16 aa, Homo sapiens
  Native (CTG1B_HUMAN)
EFYLAMPFATPMEAEL

SEQ ID NO: 198176 - protein, 17 aa, Homo sapiens
  Native (CTG1B_HUMAN)
EFYLAMPFATPMEAELA

SEQ ID NO: 198177 - protein, 18 aa, Homo sapiens
  Native (CTG1B_HUMAN)
EFYLAMPFATPMEAELAR

SEQ ID NO: 198178 - protein, 19 aa, Homo sapiens
  Native (CTG1B_HUMAN)
EFYLAMPFATPMEAELARR

SEQ ID NO: 198179 - protein, 20 aa, Homo sapiens
  Native (CTG1B_HUMAN)
EFYLAMPFATPMEAELARRS

SEQ ID NO: 198180 - protein, 21 aa, Homo sapiens
  Native (CTG1B_HUMAN)
EFYLAMPFATPMEAELARRSL

SEQ ID NO: 198181 - protein, 22 aa, Homo sapiens
  Native (CTG1B_HUMAN)
EFYLAMPFATPMEAELARRSLA

SEQ ID NO: 198182 - protein, 23 aa, Homo sapiens
  Native (CTG1B_HUMAN)
EFYLAMPFATPMEAELARRSLAQ

SEQ ID NO: 198183 - protein, 24 aa, Homo sapiens
  Native (CTG1B_HUMAN)
EFYLAMPFATPMEAELARRSLAQD

SEQ ID NO: 198184 - protein, 14 aa, Homo sapiens
  Native (CTG1B_HUMAN)
ELARRSLAQDAPPL

SEQ ID NO: 198185 - protein, 15 aa, Homo sapiens
  Native (CTG1B_HUMAN)
ELARRSLAQDAPPLP

SEQ ID NO: 198186 - protein, 16 aa, Homo sapiens
  Native (CTG1B_HUMAN)
ELARRSLAQDAPPLPV

SEQ ID NO: 198187 - protein, 17 aa, Homo sapiens
  Native (CTG1B_HUMAN)
ELARRSLAQDAPPLPVP

SEQ ID NO: 198188 - protein, 19 aa, Homo sapiens
  Native (CTG1B_HUMAN)
ELARRSLAQDAPPLPVPGV

SEQ ID NO: 198189 - protein, 20 aa, Homo sapiens
  Native (CTG1B_HUMAN)
ELARRSLAQDAPPLPVPGVL

SEQ ID NO: 198190 - protein, 21 aa, Homo sapiens
  Native (CTG1B_HUMAN)
ELARRSLAQDAPPLPVPGVLL

SEQ ID NO: 198191 - protein, 22 aa, Homo sapiens
  Native (CTG1B_HUMAN)
ELARRSLAQDAPPLPVPGVLLK

SEQ ID NO: 198192 - protein, 23 aa, Homo sapiens
  Native (CTG1B_HUMAN)
ELARRSLAQDAPPLPVPGVLLKE

SEQ ID NO: 198193 - protein, 24 aa, Homo sapiens
  Native (CTG1B_HUMAN)
ELARRSLAQDAPPLPVPGVLLKEF

SEQ ID NO: 198194 - protein, 25 aa, Homo sapiens
  Native (CTG1B_HUMAN)
ELARRSLAQDAPPLPVPGVLLKEFT

SEQ ID NO: 198195 - protein, 13 aa, Homo sapiens
  Native (CTG1B_HUMAN)
ESRLLEFYLAMPF

SEQ ID NO: 198196 - protein, 14 aa, Homo sapiens
  Native (CTG1B_HUMAN)
ESRLLEFYLAMPFA

SEQ ID NO: 198197 - protein, 15 aa, Homo sapiens
  Native (CTG1B_HUMAN)
ESRLLEFYLAMPFAT

SEQ ID NO: 198198 - protein, 16 aa, Homo sapiens
  Native (CTG1B_HUMAN)
ESRLLEFYLAMPFATP

SEQ ID NO: 198199 - protein, 17 aa, Homo sapiens
  Native (CTG1B_HUMAN)
ESRLLEFYLAMPFATPM

SEQ ID NO: 198200 - protein, 18 aa, Homo sapiens
  Native (CTG1B_HUMAN)
ESRLLEFYLAMPFATPME

SEQ ID NO: 198201 - protein, 19 aa, Homo sapiens
  Native (CTG1B_HUMAN)
ESRLLEFYLAMPFATPMEA

SEQ ID NO: 198202 - protein, 20 aa, Homo sapiens
  Native (CTG1B_HUMAN)
ESRLLEFYLAMPFATPMEAE

SEQ ID NO: 198203 - protein, 21 aa, Homo sapiens
  Native (CTG1B_HUMAN)
ESRLLEFYLAMPFATPMEAEL

SEQ ID NO: 198204 - protein, 22 aa, Homo sapiens
  Native (CTG1B_HUMAN)
ESRLLEFYLAMPFATPMEAELA

SEQ ID NO: 198205 - protein, 23 aa, Homo sapiens
  Native (CTG1B_HUMAN)
ESRLLEFYLAMPFATPMEAELAR

SEQ ID NO: 198206 - protein, 24 aa, Homo sapiens
  Native (CTG1B_HUMAN)
ESRLLEFYLAMPFATPMEAELARR

SEQ ID NO: 198207 - protein, 25 aa, Homo sapiens
  Native (CTG1B_HUMAN)
ESRLLEFYLAMPFATPMEAELARRS

SEQ ID NO: 198208 - protein, 14 aa, Homo sapiens
  Native (CTG1B_HUMAN)
FATPMEAELARRSL

SEQ ID NO: 198209 - protein, 15 aa, Homo sapiens
  Native (CTG1B_HUMAN)
FATPMEAELARRSLA

SEQ ID NO: 198210 - protein, 16 aa, Homo sapiens
  Native (CTG1B_HUMAN)
FATPMEAELARRSLAQ

SEQ ID NO: 198211 - protein, 17 aa, Homo sapiens
  Native (CTG1B_HUMAN)
FATPMEAELARRSLAQD

SEQ ID NO: 198212 - protein, 18 aa, Homo sapiens
  Native (CTG1B_HUMAN)
FATPMEAELARRSLAQDA

SEQ ID NO: 198213 - protein, 19 aa, Homo sapiens
  Native (CTG1B_HUMAN)
FATPMEAELARRSLAQDAP

SEQ ID NO: 198214 - protein, 20 aa, Homo sapiens
  Native (CTG1B_HUMAN)
FATPMEAELARRSLAQDAPP

SEQ ID NO: 198215 - protein, 21 aa, Homo sapiens
  Native (CTG1B_HUMAN)
FATPMEAELARRSLAQDAPPL

SEQ ID NO: 198216 - protein, 22 aa, Homo sapiens
  Native (CTG1B_HUMAN)
FATPMEAELARRSLAQDAPPLP

SEQ ID NO: 198217 - protein, 23 aa, Homo sapiens
  Native (CTG1B_HUMAN)
FATPMEAELARRSLAQDAPPLPV

SEQ ID NO: 198218 - protein, 24 aa, Homo sapiens
  Native (CTG1B_HUMAN)
FATPMEAELARRSLAQDAPPLPVP

SEQ ID NO: 198219 - protein, 25 aa, Homo sapiens
  Native (CTG1B_HUMAN)
FATPMEAELARRSLAQDAPPLPVPG

SEQ ID NO: 198220 - protein, 13 aa, Homo sapiens
  Native (CTG1B_HUMAN)
FLPVFLAQPPSGQ

SEQ ID NO: 198221 - protein, 14 aa, Homo sapiens
  Native (CTG1B_HUMAN)
FLPVFLAQPPSGQR

SEQ ID NO: 198222 - protein, 15 aa, Homo sapiens
  Native (CTG1B_HUMAN)
FLPVFLAQPPSGQRR

SEQ ID NO: 198223 - protein, 13 aa, Homo sapiens
  Native (CTG1B_HUMAN)
FTVSGNILTIRLT

SEQ ID NO: 198224 - protein, 14 aa, Homo sapiens
  Native (CTG1B_HUMAN)
FTVSGNILTIRLTA

SEQ ID NO: 198225 - protein, 15 aa, Homo sapiens
  Native (CTG1B_HUMAN)
FTVSGNILTIRLTAA

SEQ ID NO: 198226 - protein, 16 aa, Homo sapiens
  Native (CTG1B_HUMAN)
FTVSGNILTIRLTAAD

SEQ ID NO: 198227 - protein, 17 aa, Homo sapiens
  Native (CTG1B_HUMAN)
FTVSGNILTIRLTAADH

SEQ ID NO: 198228 - protein, 18 aa, Homo sapiens
  Native (CTG1B_HUMAN)
FTVSGNILTIRLTAADHR

SEQ ID NO: 198229 - protein, 19 aa, Homo sapiens
  Native (CTG1B_HUMAN)
FTVSGNILTIRLTAADHRQ

SEQ ID NO: 198230 - protein, 20 aa, Homo sapiens
  Native (CTG1B_HUMAN)
FTVSGNILTIRLTAADHRQL

SEQ ID NO: 198231 - protein, 21 aa, Homo sapiens
  Native (CTG1B_HUMAN)
FTVSGNILTIRLTAADHRQLQ

SEQ ID NO: 198232 - protein, 22 aa, Homo sapiens
  Native (CTG1B_HUMAN)
FTVSGNILTIRLTAADHRQLQL

SEQ ID NO: 198233 - protein, 23 aa, Homo sapiens
  Native (CTG1B_HUMAN)
FTVSGNILTIRLTAADHRQLQLS

SEQ ID NO: 198234 - protein, 24 aa, Homo sapiens
  Native (CTG1B_HUMAN)
FTVSGNILTIRLTAADHRQLQLSI

SEQ ID NO: 198235 - protein, 25 aa, Homo sapiens
  Native (CTG1B_HUMAN)
FTVSGNILTIRLTAADHRQLQLSIS

SEQ ID NO: 198236 - protein, 13 aa, Homo sapiens
  Native (CTG1B_HUMAN)
FYLAMPFATPMEA

SEQ ID NO: 198237 - protein, 14 aa, Homo sapiens
  Native (CTG1B_HUMAN)
FYLAMPFATPMEAE

SEQ ID NO: 198238 - protein, 15 aa, Homo sapiens
  Native (CTG1B_HUMAN)
FYLAMPFATPMEAEL

SEQ ID NO: 198239 - protein, 16 aa, Homo sapiens
  Native (CTG1B_HUMAN)
FYLAMPFATPMEAELA

SEQ ID NO: 198240 - protein, 17 aa, Homo sapiens
  Native (CTG1B_HUMAN)
FYLAMPFATPMEAELAR

SEQ ID NO: 198241 - protein, 18 aa, Homo sapiens
  Native (CTG1B_HUMAN)
FYLAMPFATPMEAELARR

SEQ ID NO: 198242 - protein, 19 aa, Homo sapiens
  Native (CTG1B_HUMAN)
FYLAMPFATPMEAELARRS

SEQ ID NO: 198243 - protein, 20 aa, Homo sapiens
  Native (CTG1B_HUMAN)
FYLAMPFATPMEAELARRSL

SEQ ID NO: 198244 - protein, 21 aa, Homo sapiens
  Native (CTG1B_HUMAN)
FYLAMPFATPMEAELARRSLA

SEQ ID NO: 198245 - protein, 22 aa, Homo sapiens
  Native (CTG1B_HUMAN)
FYLAMPFATPMEAELARRSLAQ

SEQ ID NO: 198246 - protein, 23 aa, Homo sapiens
  Native (CTG1B_HUMAN)
FYLAMPFATPMEAELARRSLAQD

SEQ ID NO: 198247 - protein, 24 aa, Homo sapiens
  Native (CTG1B_HUMAN)
FYLAMPFATPMEAELARRSLAQDA

SEQ ID NO: 198248 - protein, 25 aa, Homo sapiens
  Native (CTG1B_HUMAN)
FYLAMPFATPMEAELARRSLAQDAP

SEQ ID NO: 198249 - protein, 14 aa, Homo sapiens
  Native (CTG1B_HUMAN)
GAARASGPGGGAPR

SEQ ID NO: 198250 - protein, 15 aa, Homo sapiens
  Native (CTG1B_HUMAN)
GAARASGPGGGAPRG

SEQ ID NO: 198251 - protein, 16 aa, Homo sapiens
  Native (CTG1B_HUMAN)
GAARASGPGGGAPRGP

SEQ ID NO: 198252 - protein, 17 aa, Homo sapiens
  Native (CTG1B_HUMAN)
GAARASGPGGGAPRGPH

SEQ ID NO: 198253 - protein, 19 aa, Homo sapiens
  Native (CTG1B_HUMAN)
GAARASGPGGGAPRGPHGG

SEQ ID NO: 198254 - protein, 20 aa, Homo sapiens
  Native (CTG1B_HUMAN)
GAARASGPGGGAPRGPHGGA

SEQ ID NO: 198255 - protein, 21 aa, Homo sapiens
  Native (CTG1B_HUMAN)
GAARASGPGGGAPRGPHGGAA

SEQ ID NO: 198256 - protein, 22 aa, Homo sapiens
  Native (CTG1B_HUMAN)
GAARASGPGGGAPRGPHGGAAS

SEQ ID NO: 198257 - protein, 23 aa, Homo sapiens
  Native (CTG1B_HUMAN)
GAARASGPGGGAPRGPHGGAASG

SEQ ID NO: 198258 - protein, 24 aa, Homo sapiens
  Native (CTG1B_HUMAN)
GAARASGPGGGAPRGPHGGAASGL

SEQ ID NO: 198259 - protein, 25 aa, Homo sapiens
  Native (CTG1B_HUMAN)
GAARASGPGGGAPRGPHGGAASGLN

SEQ ID NO: 198260 - protein, 14 aa, Homo sapiens
  Native (CTG1B_HUMAN)
GAGAARASGPGGGA

SEQ ID NO: 198261 - protein, 15 aa, Homo sapiens
  Native (CTG1B_HUMAN)
GAGAARASGPGGGAP

SEQ ID NO: 198262 - protein, 16 aa, Homo sapiens
  Native (CTG1B_HUMAN)
GAGAARASGPGGGAPR

SEQ ID NO: 198263 - protein, 17 aa, Homo sapiens
  Native (CTG1B_HUMAN)
GAGAARASGPGGGAPRG

SEQ ID NO: 198264 - protein, 19 aa, Homo sapiens
  Native (CTG1B_HUMAN)
GAGAARASGPGGGAPRGPH

SEQ ID NO: 198265 - protein, 20 aa, Homo sapiens
  Native (CTG1B_HUMAN)
GAGAARASGPGGGAPRGPHG

SEQ ID NO: 198266 - protein, 21 aa, Homo sapiens
  Native (CTG1B_HUMAN)
GAGAARASGPGGGAPRGPHGG

SEQ ID NO: 198267 - protein, 22 aa, Homo sapiens
  Native (CTG1B_HUMAN)
GAGAARASGPGGGAPRGPHGGA

SEQ ID NO: 198268 - protein, 23 aa, Homo sapiens
  Native (CTG1B_HUMAN)
GAGAARASGPGGGAPRGPHGGAA

SEQ ID NO: 198269 - protein, 24 aa, Homo sapiens
  Native (CTG1B_HUMAN)
GAGAARASGPGGGAPRGPHGGAAS

SEQ ID NO: 198270 - protein, 25 aa, Homo sapiens
  Native (CTG1B_HUMAN)
GAGAARASGPGGGAPRGPHGGAASG

SEQ ID NO: 198271 - protein, 14 aa, Homo sapiens
  Native (CTG1B_HUMAN)
GAPRGPHGGAASGL

SEQ ID NO: 198272 - protein, 15 aa, Homo sapiens
  Native (CTG1B_HUMAN)
GAPRGPHGGAASGLN

SEQ ID NO: 198273 - protein, 16 aa, Homo sapiens
  Native (CTG1B_HUMAN)
GAPRGPHGGAASGLNG

SEQ ID NO: 198274 - protein, 17 aa, Homo sapiens
  Native (CTG1B_HUMAN)
GAPRGPHGGAASGLNGC

SEQ ID NO: 198275 - protein, 18 aa, Homo sapiens
  Native (CTG1B_HUMAN)
GAPRGPHGGAASGLNGCC

SEQ ID NO: 198276 - protein, 19 aa, Homo sapiens
  Native (CTG1B_HUMAN)
GAPRGPHGGAASGLNGCCR

SEQ ID NO: 198277 - protein, 20 aa, Homo sapiens
  Native (CTG1B_HUMAN)
GAPRGPHGGAASGLNGCCRC

SEQ ID NO: 198278 - protein, 21 aa, Homo sapiens
  Native (CTG1B_HUMAN)
GAPRGPHGGAASGLNGCCRCG

SEQ ID NO: 198279 - protein, 22 aa, Homo sapiens
  Native (CTG1B_HUMAN)
GAPRGPHGGAASGLNGCCRCGA

SEQ ID NO: 198280 - protein, 23 aa, Homo sapiens
  Native (CTG1B_HUMAN)
GAPRGPHGGAASGLNGCCRCGAR

SEQ ID NO: 198281 - protein, 24 aa, Homo sapiens
  Native (CTG1B_HUMAN)
GAPRGPHGGAASGLNGCCRCGARG

SEQ ID NO: 198282 - protein, 25 aa, Homo sapiens
  Native (CTG1B_HUMAN)
GAPRGPHGGAASGLNGCCRCGARGP

SEQ ID NO: 198283 - protein, 15 aa, Homo sapiens
  Native (CTG1B_HUMAN)
GARGPESRLLEFYLA

SEQ ID NO: 198284 - protein, 16 aa, Homo sapiens
  Native (CTG1B_HUMAN)
GARGPESRLLEFYLAM

SEQ ID NO: 198285 - protein, 17 aa, Homo sapiens
  Native (CTG1B_HUMAN)
GARGPESRLLEFYLAMP

SEQ ID NO: 198286 - protein, 18 aa, Homo sapiens
  Native (CTG1B_HUMAN)
GARGPESRLLEFYLAMPF

SEQ ID NO: 198287 - protein, 19 aa, Homo sapiens
  Native (CTG1B_HUMAN)
GARGPESRLLEFYLAMPFA

SEQ ID NO: 198288 - protein, 20 aa, Homo sapiens
  Native (CTG1B_HUMAN)
GARGPESRLLEFYLAMPFAT

SEQ ID NO: 198289 - protein, 21 aa, Homo sapiens
  Native (CTG1B_HUMAN)
GARGPESRLLEFYLAMPFATP

SEQ ID NO: 198290 - protein, 22 aa, Homo sapiens
  Native (CTG1B_HUMAN)
GARGPESRLLEFYLAMPFATPM

SEQ ID NO: 198291 - protein, 23 aa, Homo sapiens
  Native (CTG1B_HUMAN)
GARGPESRLLEFYLAMPFATPME

SEQ ID NO: 198292 - protein, 24 aa, Homo sapiens
  Native (CTG1B_HUMAN)
GARGPESRLLEFYLAMPFATPMEA

SEQ ID NO: 198293 - protein, 25 aa, Homo sapiens
  Native (CTG1B_HUMAN)
GARGPESRLLEFYLAMPFATPMEAE

SEQ ID NO: 198294 - protein, 16 aa, Homo sapiens
  Native (CTG1B_HUMAN)
GATGGRGPRGAGAARA

SEQ ID NO: 198295 - protein, 17 aa, Homo sapiens
  Native (CTG1B_HUMAN)
GATGGRGPRGAGAARAS

SEQ ID NO: 198296 - protein, 18 aa, Homo sapiens
  Native (CTG1B_HUMAN)
GATGGRGPRGAGAARASG

SEQ ID NO: 198297 - protein, 19 aa, Homo sapiens
  Native (CTG1B_HUMAN)
GATGGRGPRGAGAARASGP

SEQ ID NO: 198298 - protein, 20 aa, Homo sapiens
  Native (CTG1B_HUMAN)
GATGGRGPRGAGAARASGPG

SEQ ID NO: 198299 - protein, 21 aa, Homo sapiens
  Native (CTG1B_HUMAN)
GATGGRGPRGAGAARASGPGG

SEQ ID NO: 198300 - protein, 22 aa, Homo sapiens
  Native (CTG1B_HUMAN)
GATGGRGPRGAGAARASGPGGG

SEQ ID NO: 198301 - protein, 23 aa, Homo sapiens
  Native (CTG1B_HUMAN)
GATGGRGPRGAGAARASGPGGGA

SEQ ID NO: 198302 - protein, 24 aa, Homo sapiens
  Native (CTG1B_HUMAN)
GATGGRGPRGAGAARASGPGGGAP

SEQ ID NO: 198303 - protein, 25 aa, Homo sapiens
  Native (CTG1B_HUMAN)
GATGGRGPRGAGAARASGPGGGAPR

SEQ ID NO: 198304 - protein, 20 aa, Homo sapiens
  Native (CTG1B_HUMAN)
GCCRCGARGPESRLLEFYLA

SEQ ID NO: 198305 - protein, 21 aa, Homo sapiens
  Native (CTG1B_HUMAN)
GCCRCGARGPESRLLEFYLAM

SEQ ID NO: 198306 - protein, 22 aa, Homo sapiens
  Native (CTG1B_HUMAN)
GCCRCGARGPESRLLEFYLAMP

SEQ ID NO: 198307 - protein, 23 aa, Homo sapiens
  Native (CTG1B_HUMAN)
GCCRCGARGPESRLLEFYLAMPF

SEQ ID NO: 198308 - protein, 24 aa, Homo sapiens
  Native (CTG1B_HUMAN)
GCCRCGARGPESRLLEFYLAMPFA

SEQ ID NO: 198309 - protein, 25 aa, Homo sapiens
  Native (CTG1B_HUMAN)
GCCRCGARGPESRLLEFYLAMPFAT

SEQ ID NO: 198310 - protein, 20 aa, Homo sapiens
  Native (CTG1B_HUMAN)
GEAGATGGRGPRGAGAARAS

SEQ ID NO: 198311 - protein, 21 aa, Homo sapiens
  Native (CTG1B_HUMAN)
GEAGATGGRGPRGAGAARASG

SEQ ID NO: 198312 - protein, 22 aa, Homo sapiens
  Native (CTG1B_HUMAN)
GEAGATGGRGPRGAGAARASGP

SEQ ID NO: 198313 - protein, 23 aa, Homo sapiens
  Native (CTG1B_HUMAN)
GEAGATGGRGPRGAGAARASGPG

SEQ ID NO: 198314 - protein, 24 aa, Homo sapiens
  Native (CTG1B_HUMAN)
GEAGATGGRGPRGAGAARASGPGG

SEQ ID NO: 198315 - protein, 25 aa, Homo sapiens
  Native (CTG1B_HUMAN)
GEAGATGGRGPRGAGAARASGPGGG

SEQ ID NO: 198316 - protein, 15 aa, Homo sapiens
  Native (CTG1B_HUMAN)
GGAPRGPHGGAASGL

SEQ ID NO: 198317 - protein, 16 aa, Homo sapiens
  Native (CTG1B_HUMAN)
GGAPRGPHGGAASGLN

SEQ ID NO: 198318 - protein, 17 aa, Homo sapiens
  Native (CTG1B_HUMAN)
GGAPRGPHGGAASGLNG

SEQ ID NO: 198319 - protein, 18 aa, Homo sapiens
  Native (CTG1B_HUMAN)
GGAPRGPHGGAASGLNGC

SEQ ID NO: 198320 - protein, 19 aa, Homo sapiens
  Native (CTG1B_HUMAN)
GGAPRGPHGGAASGLNGCC

SEQ ID NO: 198321 - protein, 20 aa, Homo sapiens
  Native (CTG1B_HUMAN)
GGAPRGPHGGAASGLNGCCR

SEQ ID NO: 198322 - protein, 21 aa, Homo sapiens
  Native (CTG1B_HUMAN)
GGAPRGPHGGAASGLNGCCRC

SEQ ID NO: 198323 - protein, 22 aa, Homo sapiens
  Native (CTG1B_HUMAN)
GGAPRGPHGGAASGLNGCCRCG

SEQ ID NO: 198324 - protein, 23 aa, Homo sapiens
  Native (CTG1B_HUMAN)
GGAPRGPHGGAASGLNGCCRCGA

SEQ ID NO: 198325 - protein, 24 aa, Homo sapiens
  Native (CTG1B_HUMAN)
GGAPRGPHGGAASGLNGCCRCGAR

SEQ ID NO: 198326 - protein, 25 aa, Homo sapiens
  Native (CTG1B_HUMAN)
GGAPRGPHGGAASGLNGCCRCGARG

SEQ ID NO: 198327 - protein, 16 aa, Homo sapiens
  Native (CTG1B_HUMAN)
GGGAPRGPHGGAASGL

SEQ ID NO: 198328 - protein, 17 aa, Homo sapiens
  Native (CTG1B_HUMAN)
GGGAPRGPHGGAASGLN

SEQ ID NO: 198329 - protein, 18 aa, Homo sapiens
  Native (CTG1B_HUMAN)
GGGAPRGPHGGAASGLNG

SEQ ID NO: 198330 - protein, 19 aa, Homo sapiens
  Native (CTG1B_HUMAN)
GGGAPRGPHGGAASGLNGC

SEQ ID NO: 198331 - protein, 20 aa, Homo sapiens
  Native (CTG1B_HUMAN)
GGGAPRGPHGGAASGLNGCC

SEQ ID NO: 198332 - protein, 21 aa, Homo sapiens
  Native (CTG1B_HUMAN)
GGGAPRGPHGGAASGLNGCCR

SEQ ID NO: 198333 - protein, 22 aa, Homo sapiens
  Native (CTG1B_HUMAN)
GGGAPRGPHGGAASGLNGCCRC

SEQ ID NO: 198334 - protein, 23 aa, Homo sapiens
  Native (CTG1B_HUMAN)
GGGAPRGPHGGAASGLNGCCRCG

SEQ ID NO: 198335 - protein, 24 aa, Homo sapiens
  Native (CTG1B_HUMAN)
GGGAPRGPHGGAASGLNGCCRCGA

SEQ ID NO: 198336 - protein, 25 aa, Homo sapiens
  Native (CTG1B_HUMAN)
GGGAPRGPHGGAASGLNGCCRCGAR

SEQ ID NO: 198337 - protein, 15 aa, Homo sapiens
  Native (CTG1B_HUMAN)
GGNAGGPGEAGATGG

SEQ ID NO: 198338 - protein, 16 aa, Homo sapiens
  Native (CTG1B_HUMAN)
GGPGEAGATGGRGPRG

SEQ ID NO: 198339 - protein, 22 aa, Homo sapiens
  Native (CTG1B_HUMAN)
GGPGEAGATGGRGPRGAGAARA

SEQ ID NO: 198340 - protein, 23 aa, Homo sapiens
  Native (CTG1B_HUMAN)
GGPGEAGATGGRGPRGAGAARAS

SEQ ID NO: 198341 - protein, 24 aa, Homo sapiens
  Native (CTG1B_HUMAN)
GGPGEAGATGGRGPRGAGAARASG

SEQ ID NO: 198342 - protein, 25 aa, Homo sapiens
  Native (CTG1B_HUMAN)
GGPGEAGATGGRGPRGAGAARASGP

SEQ ID NO: 198343 - protein, 13 aa, Homo sapiens
  Native (CTG1B_HUMAN)
GGRGPRGAGAARA

SEQ ID NO: 198344 - protein, 14 aa, Homo sapiens
  Native (CTG1B_HUMAN)
GGRGPRGAGAARAS

SEQ ID NO: 198345 - protein, 15 aa, Homo sapiens
  Native (CTG1B_HUMAN)
GGRGPRGAGAARASG

SEQ ID NO: 198346 - protein, 16 aa, Homo sapiens
  Native (CTG1B_HUMAN)
GGRGPRGAGAARASGP

SEQ ID NO: 198347 - protein, 17 aa, Homo sapiens
  Native (CTG1B_HUMAN)
GGRGPRGAGAARASGPG

SEQ ID NO: 198348 - protein, 18 aa, Homo sapiens
  Native (CTG1B_HUMAN)
GGRGPRGAGAARASGPGG

SEQ ID NO: 198349 - protein, 19 aa, Homo sapiens
  Native (CTG1B_HUMAN)
GGRGPRGAGAARASGPGGG

SEQ ID NO: 198350 - protein, 20 aa, Homo sapiens
  Native (CTG1B_HUMAN)
GGRGPRGAGAARASGPGGGA

SEQ ID NO: 198351 - protein, 21 aa, Homo sapiens
  Native (CTG1B_HUMAN)
GGRGPRGAGAARASGPGGGAP

SEQ ID NO: 198352 - protein, 22 aa, Homo sapiens
  Native (CTG1B_HUMAN)
GGRGPRGAGAARASGPGGGAPR

SEQ ID NO: 198353 - protein, 23 aa, Homo sapiens
  Native (CTG1B_HUMAN)
GGRGPRGAGAARASGPGGGAPRG

SEQ ID NO: 198354 - protein, 24 aa, Homo sapiens
  Native (CTG1B_HUMAN)
GGRGPRGAGAARASGPGGGAPRGP

SEQ ID NO: 198355 - protein, 25 aa, Homo sapiens
  Native (CTG1B_HUMAN)
GGRGPRGAGAARASGPGGGAPRGPH

SEQ ID NO: 198356 - protein, 24 aa, Homo sapiens
  Native (CTG1B_HUMAN)
GLNGCCRCGARGPESRLLEFYLAM

SEQ ID NO: 198357 - protein, 25 aa, Homo sapiens
  Native (CTG1B_HUMAN)
GLNGCCRCGARGPESRLLEFYLAMP

SEQ ID NO: 198358 - protein, 15 aa, Homo sapiens
  Native (CTG1B_HUMAN)
GNAGGPGEAGATGGR

SEQ ID NO: 198359 - protein, 25 aa, Homo sapiens
  Native (CTG1B_HUMAN)
GNAGGPGEAGATGGRGPRGAGAARA

SEQ ID NO: 198360 - protein, 13 aa, Homo sapiens
  Native (CTG1B_HUMAN)
GNILTIRLTAADH

SEQ ID NO: 198361 - protein, 14 aa, Homo sapiens
  Native (CTG1B_HUMAN)
GNILTIRLTAADHR

SEQ ID NO: 198362 - protein, 15 aa, Homo sapiens
  Native (CTG1B_HUMAN)
GNILTIRLTAADHRQ

SEQ ID NO: 198363 - protein, 16 aa, Homo sapiens
  Native (CTG1B_HUMAN)
GNILTIRLTAADHRQL

SEQ ID NO: 198364 - protein, 17 aa, Homo sapiens
  Native (CTG1B_HUMAN)
GNILTIRLTAADHRQLQ

SEQ ID NO: 198365 - protein, 18 aa, Homo sapiens
  Native (CTG1B_HUMAN)
GNILTIRLTAADHRQLQL

SEQ ID NO: 198366 - protein, 19 aa, Homo sapiens
  Native (CTG1B_HUMAN)
GNILTIRLTAADHRQLQLS

SEQ ID NO: 198367 - protein, 20 aa, Homo sapiens
  Native (CTG1B_HUMAN)
GNILTIRLTAADHRQLQLSI

SEQ ID NO: 198368 - protein, 21 aa, Homo sapiens
  Native (CTG1B_HUMAN)
GNILTIRLTAADHRQLQLSIS

SEQ ID NO: 198369 - protein, 22 aa, Homo sapiens
  Native (CTG1B_HUMAN)
GNILTIRLTAADHRQLQLSISS

SEQ ID NO: 198370 - protein, 23 aa, Homo sapiens
  Native (CTG1B_HUMAN)
GNILTIRLTAADHRQLQLSISSC

SEQ ID NO: 198371 - protein, 24 aa, Homo sapiens
  Native (CTG1B_HUMAN)
GNILTIRLTAADHRQLQLSISSCL

SEQ ID NO: 198372 - protein, 25 aa, Homo sapiens
  Native (CTG1B_HUMAN)
GNILTIRLTAADHRQLQLSISSCLQ

SEQ ID NO: 198373 - protein, 13 aa, Homo sapiens
  Native (CTG1B_HUMAN)
GPESRLLEFYLAM

SEQ ID NO: 198374 - protein, 14 aa, Homo sapiens
  Native (CTG1B_HUMAN)
GPESRLLEFYLAMP

SEQ ID NO: 198375 - protein, 15 aa, Homo sapiens
  Native (CTG1B_HUMAN)
GPESRLLEFYLAMPF

SEQ ID NO: 198376 - protein, 16 aa, Homo sapiens
  Native (CTG1B_HUMAN)
GPESRLLEFYLAMPFA

SEQ ID NO: 198377 - protein, 17 aa, Homo sapiens
  Native (CTG1B_HUMAN)
GPESRLLEFYLAMPFAT

SEQ ID NO: 198378 - protein, 18 aa, Homo sapiens
  Native (CTG1B_HUMAN)
GPESRLLEFYLAMPFATP

SEQ ID NO: 198379 - protein, 19 aa, Homo sapiens
  Native (CTG1B_HUMAN)
GPESRLLEFYLAMPFATPM

SEQ ID NO: 198380 - protein, 20 aa, Homo sapiens
  Native (CTG1B_HUMAN)
GPESRLLEFYLAMPFATPME

SEQ ID NO: 198381 - protein, 21 aa, Homo sapiens
  Native (CTG1B_HUMAN)
GPESRLLEFYLAMPFATPMEA

SEQ ID NO: 198382 - protein, 22 aa, Homo sapiens
  Native (CTG1B_HUMAN)
GPESRLLEFYLAMPFATPMEAE

SEQ ID NO: 198383 - protein, 23 aa, Homo sapiens
  Native (CTG1B_HUMAN)
GPESRLLEFYLAMPFATPMEAEL

SEQ ID NO: 198384 - protein, 24 aa, Homo sapiens
  Native (CTG1B_HUMAN)
GPESRLLEFYLAMPFATPMEAELA

SEQ ID NO: 198385 - protein, 25 aa, Homo sapiens
  Native (CTG1B_HUMAN)
GPESRLLEFYLAMPFATPMEAELAR

SEQ ID NO: 198386 - protein, 21 aa, Homo sapiens
  Native (CTG1B_HUMAN)
GPGEAGATGGRGPRGAGAARA

SEQ ID NO: 198387 - protein, 22 aa, Homo sapiens
  Native (CTG1B_HUMAN)
GPGEAGATGGRGPRGAGAARAS

SEQ ID NO: 198388 - protein, 23 aa, Homo sapiens
  Native (CTG1B_HUMAN)
GPGEAGATGGRGPRGAGAARASG

SEQ ID NO: 198389 - protein, 24 aa, Homo sapiens
  Native (CTG1B_HUMAN)
GPGEAGATGGRGPRGAGAARASGP

SEQ ID NO: 198390 - protein, 25 aa, Homo sapiens
  Native (CTG1B_HUMAN)
GPGEAGATGGRGPRGAGAARASGPG

SEQ ID NO: 198391 - protein, 18 aa, Homo sapiens
  Native (CTG1B_HUMAN)
GPGGGAPRGPHGGAASGL

SEQ ID NO: 198392 - protein, 19 aa, Homo sapiens
  Native (CTG1B_HUMAN)
GPGGGAPRGPHGGAASGLN

SEQ ID NO: 198393 - protein, 20 aa, Homo sapiens
  Native (CTG1B_HUMAN)
GPGGGAPRGPHGGAASGLNG

SEQ ID NO: 198394 - protein, 21 aa, Homo sapiens
  Native (CTG1B_HUMAN)
GPGGGAPRGPHGGAASGLNGC

SEQ ID NO: 198395 - protein, 22 aa, Homo sapiens
  Native (CTG1B_HUMAN)
GPGGGAPRGPHGGAASGLNGCC

SEQ ID NO: 198396 - protein, 23 aa, Homo sapiens
  Native (CTG1B_HUMAN)
GPGGGAPRGPHGGAASGLNGCCR

SEQ ID NO: 198397 - protein, 24 aa, Homo sapiens
  Native (CTG1B_HUMAN)
GPGGGAPRGPHGGAASGLNGCCRC

SEQ ID NO: 198398 - protein, 25 aa, Homo sapiens
  Native (CTG1B_HUMAN)
GPGGGAPRGPHGGAASGLNGCCRCG

SEQ ID NO: 198399 - protein, 15 aa, Homo sapiens
  Native (CTG1B_HUMAN)
GPGGNAGGPGEAGAT

SEQ ID NO: 198400 - protein, 13 aa, Homo sapiens
  Native (CTG1B_HUMAN)
GPHGGAASGLNGC

SEQ ID NO: 198401 - protein, 14 aa, Homo sapiens
  Native (CTG1B_HUMAN)
GPHGGAASGLNGCC

SEQ ID NO: 198402 - protein, 15 aa, Homo sapiens
  Native (CTG1B_HUMAN)
GPHGGAASGLNGCCR

SEQ ID NO: 198403 - protein, 16 aa, Homo sapiens
  Native (CTG1B_HUMAN)
GPHGGAASGLNGCCRC

SEQ ID NO: 198404 - protein, 17 aa, Homo sapiens
  Native (CTG1B_HUMAN)
GPHGGAASGLNGCCRCG

SEQ ID NO: 198405 - protein, 18 aa, Homo sapiens
  Native (CTG1B_HUMAN)
GPHGGAASGLNGCCRCGA

SEQ ID NO: 198406 - protein, 19 aa, Homo sapiens
  Native (CTG1B_HUMAN)
GPHGGAASGLNGCCRCGAR

SEQ ID NO: 198407 - protein, 20 aa, Homo sapiens
  Native (CTG1B_HUMAN)
GPHGGAASGLNGCCRCGARG

SEQ ID NO: 198408 - protein, 21 aa, Homo sapiens
  Native (CTG1B_HUMAN)
GPHGGAASGLNGCCRCGARGP

SEQ ID NO: 198409 - protein, 22 aa, Homo sapiens
  Native (CTG1B_HUMAN)
GPHGGAASGLNGCCRCGARGPE

SEQ ID NO: 198410 - protein, 23 aa, Homo sapiens
  Native (CTG1B_HUMAN)
GPHGGAASGLNGCCRCGARGPES

SEQ ID NO: 198411 - protein, 24 aa, Homo sapiens
  Native (CTG1B_HUMAN)
GPHGGAASGLNGCCRCGARGPESR

SEQ ID NO: 198412 - protein, 25 aa, Homo sapiens
  Native (CTG1B_HUMAN)
GPHGGAASGLNGCCRCGARGPESRL

SEQ ID NO: 198413 - protein, 13 aa, Homo sapiens
  Native (CTG1B_HUMAN)
GPRGAGAARASGP

SEQ ID NO: 198414 - protein, 14 aa, Homo sapiens
  Native (CTG1B_HUMAN)
GPRGAGAARASGPG

SEQ ID NO: 198415 - protein, 15 aa, Homo sapiens
  Native (CTG1B_HUMAN)
GPRGAGAARASGPGG

SEQ ID NO: 198416 - protein, 16 aa, Homo sapiens
  Native (CTG1B_HUMAN)
GPRGAGAARASGPGGG

SEQ ID NO: 198417 - protein, 17 aa, Homo sapiens
  Native (CTG1B_HUMAN)
GPRGAGAARASGPGGGA

SEQ ID NO: 198418 - protein, 18 aa, Homo sapiens
  Native (CTG1B_HUMAN)
GPRGAGAARASGPGGGAP

SEQ ID NO: 198419 - protein, 19 aa, Homo sapiens
  Native (CTG1B_HUMAN)
GPRGAGAARASGPGGGAPR

SEQ ID NO: 198420 - protein, 20 aa, Homo sapiens
  Native (CTG1B_HUMAN)
GPRGAGAARASGPGGGAPRG

SEQ ID NO: 198421 - protein, 21 aa, Homo sapiens
  Native (CTG1B_HUMAN)
GPRGAGAARASGPGGGAPRGP

SEQ ID NO: 198422 - protein, 22 aa, Homo sapiens
  Native (CTG1B_HUMAN)
GPRGAGAARASGPGGGAPRGPH

SEQ ID NO: 198423 - protein, 23 aa, Homo sapiens
  Native (CTG1B_HUMAN)
GPRGAGAARASGPGGGAPRGPHG

SEQ ID NO: 198424 - protein, 24 aa, Homo sapiens
  Native (CTG1B_HUMAN)
GPRGAGAARASGPGGGAPRGPHGG

SEQ ID NO: 198425 - protein, 25 aa, Homo sapiens
  Native (CTG1B_HUMAN)
GPRGAGAARASGPGGGAPRGPHGGA

SEQ ID NO: 198426 - protein, 13 aa, Homo sapiens
  Native (CTG1B_HUMAN)
GRGPRGAGAARAS

SEQ ID NO: 198427 - protein, 14 aa, Homo sapiens
  Native (CTG1B_HUMAN)
GRGPRGAGAARASG

SEQ ID NO: 198428 - protein, 15 aa, Homo sapiens
  Native (CTG1B_HUMAN)
GRGPRGAGAARASGP

SEQ ID NO: 198429 - protein, 16 aa, Homo sapiens
  Native (CTG1B_HUMAN)
GRGPRGAGAARASGPG

SEQ ID NO: 198430 - protein, 17 aa, Homo sapiens
  Native (CTG1B_HUMAN)
GRGPRGAGAARASGPGG

SEQ ID NO: 198431 - protein, 18 aa, Homo sapiens
  Native (CTG1B_HUMAN)
GRGPRGAGAARASGPGGG

SEQ ID NO: 198432 - protein, 19 aa, Homo sapiens
  Native (CTG1B_HUMAN)
GRGPRGAGAARASGPGGGA

SEQ ID NO: 198433 - protein, 20 aa, Homo sapiens
  Native (CTG1B_HUMAN)
GRGPRGAGAARASGPGGGAP

SEQ ID NO: 198434 - protein, 21 aa, Homo sapiens
  Native (CTG1B_HUMAN)
GRGPRGAGAARASGPGGGAPR

SEQ ID NO: 198435 - protein, 22 aa, Homo sapiens
  Native (CTG1B_HUMAN)
GRGPRGAGAARASGPGGGAPRG

SEQ ID NO: 198436 - protein, 23 aa, Homo sapiens
  Native (CTG1B_HUMAN)
GRGPRGAGAARASGPGGGAPRGP

SEQ ID NO: 198437 - protein, 25 aa, Homo sapiens
  Native (CTG1B_HUMAN)
GRGPRGAGAARASGPGGGAPRGPHG

SEQ ID NO: 198438 - protein, 13 aa, Homo sapiens
  Native (CTG1B_HUMAN)
GVLLKEFTVSGNI

SEQ ID NO: 198439 - protein, 14 aa, Homo sapiens
  Native (CTG1B_HUMAN)
GVLLKEFTVSGNIL

SEQ ID NO: 198440 - protein, 15 aa, Homo sapiens
  Native (CTG1B_HUMAN)
GVLLKEFTVSGNILT

SEQ ID NO: 198441 - protein, 16 aa, Homo sapiens
  Native (CTG1B_HUMAN)
GVLLKEFTVSGNILTI

SEQ ID NO: 198442 - protein, 17 aa, Homo sapiens
  Native (CTG1B_HUMAN)
GVLLKEFTVSGNILTIR

SEQ ID NO: 198443 - protein, 18 aa, Homo sapiens
  Native (CTG1B_HUMAN)
GVLLKEFTVSGNILTIRL

SEQ ID NO: 198444 - protein, 19 aa, Homo sapiens
  Native (CTG1B_HUMAN)
GVLLKEFTVSGNILTIRLT

SEQ ID NO: 198445 - protein, 20 aa, Homo sapiens
  Native (CTG1B_HUMAN)
GVLLKEFTVSGNILTIRLTA

SEQ ID NO: 198446 - protein, 21 aa, Homo sapiens
  Native (CTG1B_HUMAN)
GVLLKEFTVSGNILTIRLTAA

SEQ ID NO: 198447 - protein, 22 aa, Homo sapiens
  Native (CTG1B_HUMAN)
GVLLKEFTVSGNILTIRLTAAD

SEQ ID NO: 198448 - protein, 23 aa, Homo sapiens
  Native (CTG1B_HUMAN)
GVLLKEFTVSGNILTIRLTAADH

SEQ ID NO: 198449 - protein, 24 aa, Homo sapiens
  Native (CTG1B_HUMAN)
GVLLKEFTVSGNILTIRLTAADHR

SEQ ID NO: 198450 - protein, 25 aa, Homo sapiens
  Native (CTG1B_HUMAN)
GVLLKEFTVSGNILTIRLTAADHRQ

SEQ ID NO: 198451 - protein, 13 aa, Homo sapiens
  Native (CTG1B_HUMAN)
HRQLQLSISSCLQ

SEQ ID NO: 198452 - protein, 14 aa, Homo sapiens
  Native (CTG1B_HUMAN)
HRQLQLSISSCLQQ

SEQ ID NO: 198453 - protein, 16 aa, Homo sapiens
  Native (CTG1B_HUMAN)
HRQLQLSISSCLQQLS

SEQ ID NO: 198454 - protein, 17 aa, Homo sapiens
  Native (CTG1B_HUMAN)
HRQLQLSISSCLQQLSL

SEQ ID NO: 198455 - protein, 18 aa, Homo sapiens
  Native (CTG1B_HUMAN)
HRQLQLSISSCLQQLSLL

SEQ ID NO: 198456 - protein, 19 aa, Homo sapiens
  Native (CTG1B_HUMAN)
HRQLQLSISSCLQQLSLLM

SEQ ID NO: 198457 - protein, 20 aa, Homo sapiens
  Native (CTG1B_HUMAN)
HRQLQLSISSCLQQLSLLMW

SEQ ID NO: 198458 - protein, 21 aa, Homo sapiens
  Native (CTG1B_HUMAN)
HRQLQLSISSCLQQLSLLMWI

SEQ ID NO: 198459 - protein, 22 aa, Homo sapiens
  Native (CTG1B_HUMAN)
HRQLQLSISSCLQQLSLLMWIT

SEQ ID NO: 198460 - protein, 23 aa, Homo sapiens
  Native (CTG1B_HUMAN)
HRQLQLSISSCLQQLSLLMWITQ

SEQ ID NO: 198461 - protein, 24 aa, Homo sapiens
  Native (CTG1B_HUMAN)
HRQLQLSISSCLQQLSLLMWITQC

SEQ ID NO: 198462 - protein, 25 aa, Homo sapiens
  Native (CTG1B_HUMAN)
HRQLQLSISSCLQQLSLLMWITQCF

SEQ ID NO: 198463 - protein, 13 aa, Homo sapiens
  Native (CTG1B_HUMAN)
ILTIRLTAADHRQ

SEQ ID NO: 198464 - protein, 14 aa, Homo sapiens
  Native (CTG1B_HUMAN)
ILTIRLTAADHRQL

SEQ ID NO: 198465 - protein, 15 aa, Homo sapiens
  Native (CTG1B_HUMAN)
ILTIRLTAADHRQLQ

SEQ ID NO: 198466 - protein, 16 aa, Homo sapiens
  Native (CTG1B_HUMAN)
ILTIRLTAADHRQLQL

SEQ ID NO: 198467 - protein, 17 aa, Homo sapiens
  Native (CTG1B_HUMAN)
ILTIRLTAADHRQLQLS

SEQ ID NO: 198468 - protein, 18 aa, Homo sapiens
  Native (CTG1B_HUMAN)
ILTIRLTAADHRQLQLSI

SEQ ID NO: 198469 - protein, 19 aa, Homo sapiens
  Native (CTG1B_HUMAN)
ILTIRLTAADHRQLQLSIS

SEQ ID NO: 198470 - protein, 20 aa, Homo sapiens
  Native (CTG1B_HUMAN)
ILTIRLTAADHRQLQLSISS

SEQ ID NO: 198471 - protein, 21 aa, Homo sapiens
  Native (CTG1B_HUMAN)
ILTIRLTAADHRQLQLSISSC

SEQ ID NO: 198472 - protein, 22 aa, Homo sapiens
  Native (CTG1B_HUMAN)
ILTIRLTAADHRQLQLSISSCL

SEQ ID NO: 198473 - protein, 23 aa, Homo sapiens
  Native (CTG1B_HUMAN)
ILTIRLTAADHRQLQLSISSCLQ

SEQ ID NO: 198474 - protein, 24 aa, Homo sapiens
  Native (CTG1B_HUMAN)
ILTIRLTAADHRQLQLSISSCLQQ

SEQ ID NO: 198475 - protein, 25 aa, Homo sapiens
  Native (CTG1B_HUMAN)
ILTIRLTAADHRQLQLSISSCLQQL

SEQ ID NO: 198476 - protein, 14 aa, Homo sapiens
  Native (CTG1B_HUMAN)
IRLTAADHRQLQLS

SEQ ID NO: 198477 - protein, 15 aa, Homo sapiens
  Native (CTG1B_HUMAN)
IRLTAADHRQLQLSI

SEQ ID NO: 198478 - protein, 16 aa, Homo sapiens
  Native (CTG1B_HUMAN)
IRLTAADHRQLQLSIS

SEQ ID NO: 198479 - protein, 17 aa, Homo sapiens
  Native (CTG1B_HUMAN)
IRLTAADHRQLQLSISS

SEQ ID NO: 198480 - protein, 19 aa, Homo sapiens
  Native (CTG1B_HUMAN)
IRLTAADHRQLQLSISSCL

SEQ ID NO: 198481 - protein, 20 aa, Homo sapiens
  Native (CTG1B_HUMAN)
IRLTAADHRQLQLSISSCLQ

SEQ ID NO: 198482 - protein, 21 aa, Homo sapiens
  Native (CTG1B_HUMAN)
IRLTAADHRQLQLSISSCLQQ

SEQ ID NO: 198483 - protein, 22 aa, Homo sapiens
  Native (CTG1B_HUMAN)
IRLTAADHRQLQLSISSCLQQL

SEQ ID NO: 198484 - protein, 23 aa, Homo sapiens
  Native (CTG1B_HUMAN)
IRLTAADHRQLQLSISSCLQQLS

SEQ ID NO: 198485 - protein, 24 aa, Homo sapiens
  Native (CTG1B_HUMAN)
IRLTAADHRQLQLSISSCLQQLSL

SEQ ID NO: 198486 - protein, 25 aa, Homo sapiens
  Native (CTG1B_HUMAN)
IRLTAADHRQLQLSISSCLQQLSLL

SEQ ID NO: 198487 - protein, 13 aa, Homo sapiens
  Native (CTG1B_HUMAN)
ISSCLQQLSLLMW

SEQ ID NO: 198488 - protein, 14 aa, Homo sapiens
  Native (CTG1B_HUMAN)
ISSCLQQLSLLMWI

SEQ ID NO: 198489 - protein, 15 aa, Homo sapiens
  Native (CTG1B_HUMAN)
ISSCLQQLSLLMWIT

SEQ ID NO: 198490 - protein, 16 aa, Homo sapiens
  Native (CTG1B_HUMAN)
ISSCLQQLSLLMWITQ

SEQ ID NO: 198491 - protein, 17 aa, Homo sapiens
  Native (CTG1B_HUMAN)
ISSCLQQLSLLMWITQC

SEQ ID NO: 198492 - protein, 18 aa, Homo sapiens
  Native (CTG1B_HUMAN)
ISSCLQQLSLLMWITQCF

SEQ ID NO: 198493 - protein, 19 aa, Homo sapiens
  Native (CTG1B_HUMAN)
ISSCLQQLSLLMWITQCFL

SEQ ID NO: 198494 - protein, 20 aa, Homo sapiens
  Native (CTG1B_HUMAN)
ISSCLQQLSLLMWITQCFLP

SEQ ID NO: 198495 - protein, 21 aa, Homo sapiens
  Native (CTG1B_HUMAN)
ISSCLQQLSLLMWITQCFLPV

SEQ ID NO: 198496 - protein, 22 aa, Homo sapiens
  Native (CTG1B_HUMAN)
ISSCLQQLSLLMWITQCFLPVF

SEQ ID NO: 198497 - protein, 23 aa, Homo sapiens
  Native (CTG1B_HUMAN)
ISSCLQQLSLLMWITQCFLPVFL

SEQ ID NO: 198498 - protein, 24 aa, Homo sapiens
  Native (CTG1B_HUMAN)
ISSCLQQLSLLMWITQCFLPVFLA

SEQ ID NO: 198499 - protein, 25 aa, Homo sapiens
  Native (CTG1B_HUMAN)
ISSCLQQLSLLMWITQCFLPVFLAQ

SEQ ID NO: 198500 - protein, 13 aa, Homo sapiens
  Native (CTG1B_HUMAN)
ITQCFLPVFLAQP

SEQ ID NO: 198501 - protein, 14 aa, Homo sapiens
  Native (CTG1B_HUMAN)
ITQCFLPVFLAQPP

SEQ ID NO: 198502 - protein, 15 aa, Homo sapiens
  Native (CTG1B_HUMAN)
ITQCFLPVFLAQPPS

SEQ ID NO: 198503 - protein, 16 aa, Homo sapiens
  Native (CTG1B_HUMAN)
ITQCFLPVFLAQPPSG

SEQ ID NO: 198504 - protein, 17 aa, Homo sapiens
  Native (CTG1B_HUMAN)
ITQCFLPVFLAQPPSGQ

SEQ ID NO: 198505 - protein, 18 aa, Homo sapiens
  Native (CTG1B_HUMAN)
ITQCFLPVFLAQPPSGQR

SEQ ID NO: 198506 - protein, 19 aa, Homo sapiens
  Native (CTG1B_HUMAN)
ITQCFLPVFLAQPPSGQRR

SEQ ID NO: 198507 - protein, 13 aa, Homo sapiens
  Native (CTG1B_HUMAN)
KEFTVSGNILTIR

SEQ ID NO: 198508 - protein, 14 aa, Homo sapiens
  Native (CTG1B_HUMAN)
KEFTVSGNILTIRL

SEQ ID NO: 198509 - protein, 15 aa, Homo sapiens
  Native (CTG1B_HUMAN)
KEFTVSGNILTIRLT

SEQ ID NO: 198510 - protein, 16 aa, Homo sapiens
  Native (CTG1B_HUMAN)
KEFTVSGNILTIRLTA

SEQ ID NO: 198511 - protein, 17 aa, Homo sapiens
  Native (CTG1B_HUMAN)
KEFTVSGNILTIRLTAA

SEQ ID NO: 198512 - protein, 18 aa, Homo sapiens
  Native (CTG1B_HUMAN)
KEFTVSGNILTIRLTAAD

SEQ ID NO: 198513 - protein, 19 aa, Homo sapiens
  Native (CTG1B_HUMAN)
KEFTVSGNILTIRLTAADH

SEQ ID NO: 198514 - protein, 20 aa, Homo sapiens
  Native (CTG1B_HUMAN)
KEFTVSGNILTIRLTAADHR

SEQ ID NO: 198515 - protein, 21 aa, Homo sapiens
  Native (CTG1B_HUMAN)
KEFTVSGNILTIRLTAADHRQ

SEQ ID NO: 198516 - protein, 22 aa, Homo sapiens
  Native (CTG1B_HUMAN)
KEFTVSGNILTIRLTAADHRQL

SEQ ID NO: 198517 - protein, 23 aa, Homo sapiens
  Native (CTG1B_HUMAN)
KEFTVSGNILTIRLTAADHRQLQ

SEQ ID NO: 198518 - protein, 24 aa, Homo sapiens
  Native (CTG1B_HUMAN)
KEFTVSGNILTIRLTAADHRQLQL

SEQ ID NO: 198519 - protein, 25 aa, Homo sapiens
  Native (CTG1B_HUMAN)
KEFTVSGNILTIRLTAADHRQLQLS

SEQ ID NO: 198520 - protein, 14 aa, Homo sapiens
  Native (CTG1B_HUMAN)
LAMPFATPMEAELA

SEQ ID NO: 198521 - protein, 15 aa, Homo sapiens
  Native (CTG1B_HUMAN)
LAMPFATPMEAELAR

SEQ ID NO: 198522 - protein, 16 aa, Homo sapiens
  Native (CTG1B_HUMAN)
LAMPFATPMEAELARR

SEQ ID NO: 198523 - protein, 17 aa, Homo sapiens
  Native (CTG1B_HUMAN)
LAMPFATPMEAELARRS

SEQ ID NO: 198524 - protein, 18 aa, Homo sapiens
  Native (CTG1B_HUMAN)
LAMPFATPMEAELARRSL

SEQ ID NO: 198525 - protein, 19 aa, Homo sapiens
  Native (CTG1B_HUMAN)
LAMPFATPMEAELARRSLA

SEQ ID NO: 198526 - protein, 20 aa, Homo sapiens
  Native (CTG1B_HUMAN)
LAMPFATPMEAELARRSLAQ

SEQ ID NO: 198527 - protein, 21 aa, Homo sapiens
  Native (CTG1B_HUMAN)
LAMPFATPMEAELARRSLAQD

SEQ ID NO: 198528 - protein, 22 aa, Homo sapiens
  Native (CTG1B_HUMAN)
LAMPFATPMEAELARRSLAQDA

SEQ ID NO: 198529 - protein, 23 aa, Homo sapiens
  Native (CTG1B_HUMAN)
LAMPFATPMEAELARRSLAQDAP

SEQ ID NO: 198530 - protein, 24 aa, Homo sapiens
  Native (CTG1B_HUMAN)
LAMPFATPMEAELARRSLAQDAPP

SEQ ID NO: 198531 - protein, 25 aa, Homo sapiens
  Native (CTG1B_HUMAN)
LAMPFATPMEAELARRSLAQDAPPL

SEQ ID NO: 198532 - protein, 20 aa, Homo sapiens
  Native (CTG1B_HUMAN)
LAQDAPPLPVPGVLLKEFTV

SEQ ID NO: 198533 - protein, 22 aa, Homo sapiens
  Native (CTG1B_HUMAN)
LAQDAPPLPVPGVLLKEFTVSG

SEQ ID NO: 198534 - protein, 23 aa, Homo sapiens
  Native (CTG1B_HUMAN)
LAQDAPPLPVPGVLLKEFTVSGN

SEQ ID NO: 198535 - protein, 24 aa, Homo sapiens
  Native (CTG1B_HUMAN)
LAQDAPPLPVPGVLLKEFTVSGNI

SEQ ID NO: 198536 - protein, 25 aa, Homo sapiens
  Native (CTG1B_HUMAN)
LAQDAPPLPVPGVLLKEFTVSGNIL

SEQ ID NO: 198537 - protein, 14 aa, Homo sapiens
  Native (CTG1B_HUMAN)
LARRSLAQDAPPLP

SEQ ID NO: 198538 - protein, 15 aa, Homo sapiens
  Native (CTG1B_HUMAN)
LARRSLAQDAPPLPV

SEQ ID NO: 198539 - protein, 16 aa, Homo sapiens
  Native (CTG1B_HUMAN)
LARRSLAQDAPPLPVP

SEQ ID NO: 198540 - protein, 17 aa, Homo sapiens
  Native (CTG1B_HUMAN)
LARRSLAQDAPPLPVPG

SEQ ID NO: 198541 - protein, 19 aa, Homo sapiens
  Native (CTG1B_HUMAN)
LARRSLAQDAPPLPVPGVL

SEQ ID NO: 198542 - protein, 20 aa, Homo sapiens
  Native (CTG1B_HUMAN)
LARRSLAQDAPPLPVPGVLL

SEQ ID NO: 198543 - protein, 25 aa, Homo sapiens
  Native (CTG1B_HUMAN)
LARRSLAQDAPPLPVPGVLLKEFTV

SEQ ID NO: 198544 - protein, 13 aa, Homo sapiens
  Native (CTG1B_HUMAN)
LEFYLAMPFATPM

SEQ ID NO: 198545 - protein, 14 aa, Homo sapiens
  Native (CTG1B_HUMAN)
LEFYLAMPFATPME

SEQ ID NO: 198546 - protein, 15 aa, Homo sapiens
  Native (CTG1B_HUMAN)
LEFYLAMPFATPMEA

SEQ ID NO: 198547 - protein, 16 aa, Homo sapiens
  Native (CTG1B_HUMAN)
LEFYLAMPFATPMEAE

SEQ ID NO: 198548 - protein, 17 aa, Homo sapiens
  Native (CTG1B_HUMAN)
LEFYLAMPFATPMEAEL

SEQ ID NO: 198549 - protein, 18 aa, Homo sapiens
  Native (CTG1B_HUMAN)
LEFYLAMPFATPMEAELA

SEQ ID NO: 198550 - protein, 19 aa, Homo sapiens
  Native (CTG1B_HUMAN)
LEFYLAMPFATPMEAELAR

SEQ ID NO: 198551 - protein, 20 aa, Homo sapiens
  Native (CTG1B_HUMAN)
LEFYLAMPFATPMEAELARR

SEQ ID NO: 198552 - protein, 21 aa, Homo sapiens
  Native (CTG1B_HUMAN)
LEFYLAMPFATPMEAELARRS

SEQ ID NO: 198553 - protein, 22 aa, Homo sapiens
  Native (CTG1B_HUMAN)
LEFYLAMPFATPMEAELARRSL

SEQ ID NO: 198554 - protein, 23 aa, Homo sapiens
  Native (CTG1B_HUMAN)
LEFYLAMPFATPMEAELARRSLA

SEQ ID NO: 198555 - protein, 24 aa, Homo sapiens
  Native (CTG1B_HUMAN)
LEFYLAMPFATPMEAELARRSLAQ

SEQ ID NO: 198556 - protein, 25 aa, Homo sapiens
  Native (CTG1B_HUMAN)
LEFYLAMPFATPMEAELARRSLAQD

SEQ ID NO: 198557 - protein, 13 aa, Homo sapiens
  Native (CTG1B_HUMAN)
LKEFTVSGNILTI

SEQ ID NO: 198558 - protein, 14 aa, Homo sapiens
  Native (CTG1B_HUMAN)
LKEFTVSGNILTIR

SEQ ID NO: 198559 - protein, 15 aa, Homo sapiens
  Native (CTG1B_HUMAN)
LKEFTVSGNILTIRL

SEQ ID NO: 198560 - protein, 16 aa, Homo sapiens
  Native (CTG1B_HUMAN)
LKEFTVSGNILTIRLT

SEQ ID NO: 198561 - protein, 17 aa, Homo sapiens
  Native (CTG1B_HUMAN)
LKEFTVSGNILTIRLTA

SEQ ID NO: 198562 - protein, 18 aa, Homo sapiens
  Native (CTG1B_HUMAN)
LKEFTVSGNILTIRLTAA

SEQ ID NO: 198563 - protein, 19 aa, Homo sapiens
  Native (CTG1B_HUMAN)
LKEFTVSGNILTIRLTAAD

SEQ ID NO: 198564 - protein, 20 aa, Homo sapiens
  Native (CTG1B_HUMAN)
LKEFTVSGNILTIRLTAADH

SEQ ID NO: 198565 - protein, 21 aa, Homo sapiens
  Native (CTG1B_HUMAN)
LKEFTVSGNILTIRLTAADHR

SEQ ID NO: 198566 - protein, 22 aa, Homo sapiens
  Native (CTG1B_HUMAN)
LKEFTVSGNILTIRLTAADHRQ

SEQ ID NO: 198567 - protein, 23 aa, Homo sapiens
  Native (CTG1B_HUMAN)
LKEFTVSGNILTIRLTAADHRQL

SEQ ID NO: 198568 - protein, 24 aa, Homo sapiens
  Native (CTG1B_HUMAN)
LKEFTVSGNILTIRLTAADHRQLQ

SEQ ID NO: 198569 - protein, 25 aa, Homo sapiens
  Native (CTG1B_HUMAN)
LKEFTVSGNILTIRLTAADHRQLQL

SEQ ID NO: 198570 - protein, 13 aa, Homo sapiens
  Native (CTG1B_HUMAN)
LLEFYLAMPFATP

SEQ ID NO: 198571 - protein, 14 aa, Homo sapiens
  Native (CTG1B_HUMAN)
LLEFYLAMPFATPM

SEQ ID NO: 198572 - protein, 15 aa, Homo sapiens
  Native (CTG1B_HUMAN)
LLEFYLAMPFATPME

SEQ ID NO: 198573 - protein, 16 aa, Homo sapiens
  Native (CTG1B_HUMAN)
LLEFYLAMPFATPMEA

SEQ ID NO: 198574 - protein, 17 aa, Homo sapiens
  Native (CTG1B_HUMAN)
LLEFYLAMPFATPMEAE

SEQ ID NO: 198575 - protein, 18 aa, Homo sapiens
  Native (CTG1B_HUMAN)
LLEFYLAMPFATPMEAEL

SEQ ID NO: 198576 - protein, 19 aa, Homo sapiens
  Native (CTG1B_HUMAN)
LLEFYLAMPFATPMEAELA

SEQ ID NO: 198577 - protein, 20 aa, Homo sapiens
  Native (CTG1B_HUMAN)
LLEFYLAMPFATPMEAELAR

SEQ ID NO: 198578 - protein, 21 aa, Homo sapiens
  Native (CTG1B_HUMAN)
LLEFYLAMPFATPMEAELARR

SEQ ID NO: 198579 - protein, 22 aa, Homo sapiens
  Native (CTG1B_HUMAN)
LLEFYLAMPFATPMEAELARRS

SEQ ID NO: 198580 - protein, 23 aa, Homo sapiens
  Native (CTG1B_HUMAN)
LLEFYLAMPFATPMEAELARRSL

SEQ ID NO: 198581 - protein, 24 aa, Homo sapiens
  Native (CTG1B_HUMAN)
LLEFYLAMPFATPMEAELARRSLA

SEQ ID NO: 198582 - protein, 25 aa, Homo sapiens
  Native (CTG1B_HUMAN)
LLEFYLAMPFATPMEAELARRSLAQ

SEQ ID NO: 198583 - protein, 13 aa, Homo sapiens
  Native (CTG1B_HUMAN)
LLKEFTVSGNILT

SEQ ID NO: 198584 - protein, 14 aa, Homo sapiens
  Native (CTG1B_HUMAN)
LLKEFTVSGNILTI

SEQ ID NO: 198585 - protein, 16 aa, Homo sapiens
  Native (CTG1B_HUMAN)
LLKEFTVSGNILTIRL

SEQ ID NO: 198586 - protein, 17 aa, Homo sapiens
  Native (CTG1B_HUMAN)
LLKEFTVSGNILTIRLT

SEQ ID NO: 198587 - protein, 18 aa, Homo sapiens
  Native (CTG1B_HUMAN)
LLKEFTVSGNILTIRLTA

SEQ ID NO: 198588 - protein, 19 aa, Homo sapiens
  Native (CTG1B_HUMAN)
LLKEFTVSGNILTIRLTAA

SEQ ID NO: 198589 - protein, 20 aa, Homo sapiens
  Native (CTG1B_HUMAN)
LLKEFTVSGNILTIRLTAAD

SEQ ID NO: 198590 - protein, 21 aa, Homo sapiens
  Native (CTG1B_HUMAN)
LLKEFTVSGNILTIRLTAADH

SEQ ID NO: 198591 - protein, 22 aa, Homo sapiens
  Native (CTG1B_HUMAN)
LLKEFTVSGNILTIRLTAADHR

SEQ ID NO: 198592 - protein, 23 aa, Homo sapiens
  Native (CTG1B_HUMAN)
LLKEFTVSGNILTIRLTAADHRQ

SEQ ID NO: 198593 - protein, 24 aa, Homo sapiens
  Native (CTG1B_HUMAN)
LLKEFTVSGNILTIRLTAADHRQL

SEQ ID NO: 198594 - protein, 25 aa, Homo sapiens
  Native (CTG1B_HUMAN)
LLKEFTVSGNILTIRLTAADHRQLQ

SEQ ID NO: 198595 - protein, 13 aa, Homo sapiens
  Native (CTG1B_HUMAN)
LLMWITQCFLPVF

SEQ ID NO: 198596 - protein, 14 aa, Homo sapiens
  Native (CTG1B_HUMAN)
LLMWITQCFLPVFL

SEQ ID NO: 198597 - protein, 15 aa, Homo sapiens
  Native (CTG1B_HUMAN)
LLMWITQCFLPVFLA

SEQ ID NO: 198598 - protein, 16 aa, Homo sapiens
  Native (CTG1B_HUMAN)
LLMWITQCFLPVFLAQ

SEQ ID NO: 198599 - protein, 17 aa, Homo sapiens
  Native (CTG1B_HUMAN)
LLMWITQCFLPVFLAQP

SEQ ID NO: 198600 - protein, 18 aa, Homo sapiens
  Native (CTG1B_HUMAN)
LLMWITQCFLPVFLAQPP

SEQ ID NO: 198601 - protein, 19 aa, Homo sapiens
  Native (CTG1B_HUMAN)
LLMWITQCFLPVFLAQPPS

SEQ ID NO: 198602 - protein, 20 aa, Homo sapiens
  Native (CTG1B_HUMAN)
LLMWITQCFLPVFLAQPPSG

SEQ ID NO: 198603 - protein, 21 aa, Homo sapiens
  Native (CTG1B_HUMAN)
LLMWITQCFLPVFLAQPPSGQ

SEQ ID NO: 198604 - protein, 22 aa, Homo sapiens
  Native (CTG1B_HUMAN)
LLMWITQCFLPVFLAQPPSGQR

SEQ ID NO: 198605 - protein, 23 aa, Homo sapiens
  Native (CTG1B_HUMAN)
LLMWITQCFLPVFLAQPPSGQRR

SEQ ID NO: 198606 - protein, 13 aa, Homo sapiens
  Native (CTG1B_HUMAN)
LMWITQCFLPVFL

SEQ ID NO: 198607 - protein, 14 aa, Homo sapiens
  Native (CTG1B_HUMAN)
LMWITQCFLPVFLA

SEQ ID NO: 198608 - protein, 15 aa, Homo sapiens
  Native (CTG1B_HUMAN)
LMWITQCFLPVFLAQ

SEQ ID NO: 198609 - protein, 16 aa, Homo sapiens
  Native (CTG1B_HUMAN)
LMWITQCFLPVFLAQP

SEQ ID NO: 198610 - protein, 17 aa, Homo sapiens
  Native (CTG1B_HUMAN)
LMWITQCFLPVFLAQPP

SEQ ID NO: 198611 - protein, 18 aa, Homo sapiens
  Native (CTG1B_HUMAN)
LMWITQCFLPVFLAQPPS

SEQ ID NO: 198612 - protein, 19 aa, Homo sapiens
  Native (CTG1B_HUMAN)
LMWITQCFLPVFLAQPPSG

SEQ ID NO: 198613 - protein, 20 aa, Homo sapiens
  Native (CTG1B_HUMAN)
LMWITQCFLPVFLAQPPSGQ

SEQ ID NO: 198614 - protein, 21 aa, Homo sapiens
  Native (CTG1B_HUMAN)
LMWITQCFLPVFLAQPPSGQR

SEQ ID NO: 198615 - protein, 22 aa, Homo sapiens
  Native (CTG1B_HUMAN)
LMWITQCFLPVFLAQPPSGQRR

SEQ ID NO: 198616 - protein, 23 aa, Homo sapiens
  Native (CTG1B_HUMAN)
LNGCCRCGARGPESRLLEFYLAM

SEQ ID NO: 198617 - protein, 24 aa, Homo sapiens
  Native (CTG1B_HUMAN)
LNGCCRCGARGPESRLLEFYLAMP

SEQ ID NO: 198618 - protein, 25 aa, Homo sapiens
  Native (CTG1B_HUMAN)
LNGCCRCGARGPESRLLEFYLAMPF

SEQ ID NO: 198619 - protein, 13 aa, Homo sapiens
  Native (CTG1B_HUMAN)
LPVFLAQPPSGQR

SEQ ID NO: 198620 - protein, 14 aa, Homo sapiens
  Native (CTG1B_HUMAN)
LPVFLAQPPSGQRR

SEQ ID NO: 198621 - protein, 14 aa, Homo sapiens
  Native (CTG1B_HUMAN)
LPVPGVLLKEFTVS

SEQ ID NO: 198622 - protein, 15 aa, Homo sapiens
  Native (CTG1B_HUMAN)
LPVPGVLLKEFTVSG

SEQ ID NO: 198623 - protein, 16 aa, Homo sapiens
  Native (CTG1B_HUMAN)
LPVPGVLLKEFTVSGN

SEQ ID NO: 198624 - protein, 17 aa, Homo sapiens
  Native (CTG1B_HUMAN)
LPVPGVLLKEFTVSGNI

SEQ ID NO: 198625 - protein, 18 aa, Homo sapiens
  Native (CTG1B_HUMAN)
LPVPGVLLKEFTVSGNIL

SEQ ID NO: 198626 - protein, 19 aa, Homo sapiens
  Native (CTG1B_HUMAN)
LPVPGVLLKEFTVSGNILT

SEQ ID NO: 198627 - protein, 20 aa, Homo sapiens
  Native (CTG1B_HUMAN)
LPVPGVLLKEFTVSGNILTI

SEQ ID NO: 198628 - protein, 21 aa, Homo sapiens
  Native (CTG1B_HUMAN)
LPVPGVLLKEFTVSGNILTIR

SEQ ID NO: 198629 - protein, 22 aa, Homo sapiens
  Native (CTG1B_HUMAN)
LPVPGVLLKEFTVSGNILTIRL

SEQ ID NO: 198630 - protein, 23 aa, Homo sapiens
  Native (CTG1B_HUMAN)
LPVPGVLLKEFTVSGNILTIRLT

SEQ ID NO: 198631 - protein, 24 aa, Homo sapiens
  Native (CTG1B_HUMAN)
LPVPGVLLKEFTVSGNILTIRLTA

SEQ ID NO: 198632 - protein, 25 aa, Homo sapiens
  Native (CTG1B_HUMAN)
LPVPGVLLKEFTVSGNILTIRLTAA

SEQ ID NO: 198633 - protein, 13 aa, Homo sapiens
  Native (CTG1B_HUMAN)
LQLSISSCLQQLS

SEQ ID NO: 198634 - protein, 14 aa, Homo sapiens
  Native (CTG1B_HUMAN)
LQLSISSCLQQLSL

SEQ ID NO: 198635 - protein, 15 aa, Homo sapiens
  Native (CTG1B_HUMAN)
LQLSISSCLQQLSLL

SEQ ID NO: 198636 - protein, 16 aa, Homo sapiens
  Native (CTG1B_HUMAN)
LQLSISSCLQQLSLLM

SEQ ID NO: 198637 - protein, 17 aa, Homo sapiens
  Native (CTG1B_HUMAN)
LQLSISSCLQQLSLLMW

SEQ ID NO: 198638 - protein, 18 aa, Homo sapiens
  Native (CTG1B_HUMAN)
LQLSISSCLQQLSLLMWI

SEQ ID NO: 198639 - protein, 19 aa, Homo sapiens
  Native (CTG1B_HUMAN)
LQLSISSCLQQLSLLMWIT

SEQ ID NO: 198640 - protein, 20 aa, Homo sapiens
  Native (CTG1B_HUMAN)
LQLSISSCLQQLSLLMWITQ

SEQ ID NO: 198641 - protein, 21 aa, Homo sapiens
  Native (CTG1B_HUMAN)
LQLSISSCLQQLSLLMWITQC

SEQ ID NO: 198642 - protein, 22 aa, Homo sapiens
  Native (CTG1B_HUMAN)
LQLSISSCLQQLSLLMWITQCF

SEQ ID NO: 198643 - protein, 23 aa, Homo sapiens
  Native (CTG1B_HUMAN)
LQLSISSCLQQLSLLMWITQCFL

SEQ ID NO: 198644 - protein, 24 aa, Homo sapiens
  Native (CTG1B_HUMAN)
LQLSISSCLQQLSLLMWITQCFLP

SEQ ID NO: 198645 - protein, 25 aa, Homo sapiens
  Native (CTG1B_HUMAN)
LQLSISSCLQQLSLLMWITQCFLPV

SEQ ID NO: 198646 - protein, 14 aa, Homo sapiens
  Native (CTG1B_HUMAN)
LQQLSLLMWITQCF

SEQ ID NO: 198647 - protein, 15 aa, Homo sapiens
  Native (CTG1B_HUMAN)
LQQLSLLMWITQCFL

SEQ ID NO: 198648 - protein, 16 aa, Homo sapiens
  Native (CTG1B_HUMAN)
LQQLSLLMWITQCFLP

SEQ ID NO: 198649 - protein, 17 aa, Homo sapiens
  Native (CTG1B_HUMAN)
LQQLSLLMWITQCFLPV

SEQ ID NO: 198650 - protein, 18 aa, Homo sapiens
  Native (CTG1B_HUMAN)
LQQLSLLMWITQCFLPVF

SEQ ID NO: 198651 - protein, 19 aa, Homo sapiens
  Native (CTG1B_HUMAN)
LQQLSLLMWITQCFLPVFL

SEQ ID NO: 198652 - protein, 20 aa, Homo sapiens
  Native (CTG1B_HUMAN)
LQQLSLLMWITQCFLPVFLA

SEQ ID NO: 198653 - protein, 21 aa, Homo sapiens
  Native (CTG1B_HUMAN)
LQQLSLLMWITQCFLPVFLAQ

SEQ ID NO: 198654 - protein, 22 aa, Homo sapiens
  Native (CTG1B_HUMAN)
LQQLSLLMWITQCFLPVFLAQP

SEQ ID NO: 198655 - protein, 23 aa, Homo sapiens
  Native (CTG1B_HUMAN)
LQQLSLLMWITQCFLPVFLAQPP

SEQ ID NO: 198656 - protein, 24 aa, Homo sapiens
  Native (CTG1B_HUMAN)
LQQLSLLMWITQCFLPVFLAQPPS

SEQ ID NO: 198657 - protein, 25 aa, Homo sapiens
  Native (CTG1B_HUMAN)
LQQLSLLMWITQCFLPVFLAQPPSG

SEQ ID NO: 198658 - protein, 13 aa, Homo sapiens
  Native (CTG1B_HUMAN)
LSISSCLQQLSLL

SEQ ID NO: 198659 - protein, 14 aa, Homo sapiens
  Native (CTG1B_HUMAN)
LSISSCLQQLSLLM

SEQ ID NO: 198660 - protein, 15 aa, Homo sapiens
  Native (CTG1B_HUMAN)
LSISSCLQQLSLLMW

SEQ ID NO: 198661 - protein, 16 aa, Homo sapiens
  Native (CTG1B_HUMAN)
LSISSCLQQLSLLMWI

SEQ ID NO: 198662 - protein, 17 aa, Homo sapiens
  Native (CTG1B_HUMAN)
LSISSCLQQLSLLMWIT

SEQ ID NO: 198663 - protein, 18 aa, Homo sapiens
  Native (CTG1B_HUMAN)
LSISSCLQQLSLLMWITQ

SEQ ID NO: 198664 - protein, 19 aa, Homo sapiens
  Native (CTG1B_HUMAN)
LSISSCLQQLSLLMWITQC

SEQ ID NO: 198665 - protein, 20 aa, Homo sapiens
  Native (CTG1B_HUMAN)
LSISSCLQQLSLLMWITQCF

SEQ ID NO: 198666 - protein, 21 aa, Homo sapiens
  Native (CTG1B_HUMAN)
LSISSCLQQLSLLMWITQCFL

SEQ ID NO: 198667 - protein, 22 aa, Homo sapiens
  Native (CTG1B_HUMAN)
LSISSCLQQLSLLMWITQCFLP

SEQ ID NO: 198668 - protein, 23 aa, Homo sapiens
  Native (CTG1B_HUMAN)
LSISSCLQQLSLLMWITQCFLPV

SEQ ID NO: 198669 - protein, 24 aa, Homo sapiens
  Native (CTG1B_HUMAN)
LSISSCLQQLSLLMWITQCFLPVF

SEQ ID NO: 198670 - protein, 25 aa, Homo sapiens
  Native (CTG1B_HUMAN)
LSISSCLQQLSLLMWITQCFLPVFL

SEQ ID NO: 198671 - protein, 13 aa, Homo sapiens
  Native (CTG1B_HUMAN)
LSLLMWITQCFLP

SEQ ID NO: 198672 - protein, 14 aa, Homo sapiens
  Native (CTG1B_HUMAN)
LSLLMWITQCFLPV

SEQ ID NO: 198673 - protein, 15 aa, Homo sapiens
  Native (CTG1B_HUMAN)
LSLLMWITQCFLPVF

SEQ ID NO: 198674 - protein, 16 aa, Homo sapiens
  Native (CTG1B_HUMAN)
LSLLMWITQCFLPVFL

SEQ ID NO: 198675 - protein, 17 aa, Homo sapiens
  Native (CTG1B_HUMAN)
LSLLMWITQCFLPVFLA

SEQ ID NO: 198676 - protein, 18 aa, Homo sapiens
  Native (CTG1B_HUMAN)
LSLLMWITQCFLPVFLAQ

SEQ ID NO: 198677 - protein, 19 aa, Homo sapiens
  Native (CTG1B_HUMAN)
LSLLMWITQCFLPVFLAQP

SEQ ID NO: 198678 - protein, 20 aa, Homo sapiens
  Native (CTG1B_HUMAN)
LSLLMWITQCFLPVFLAQPP

SEQ ID NO: 198679 - protein, 21 aa, Homo sapiens
  Native (CTG1B_HUMAN)
LSLLMWITQCFLPVFLAQPPS

SEQ ID NO: 198680 - protein, 22 aa, Homo sapiens
  Native (CTG1B_HUMAN)
LSLLMWITQCFLPVFLAQPPSG

SEQ ID NO: 198681 - protein, 23 aa, Homo sapiens
  Native (CTG1B_HUMAN)
LSLLMWITQCFLPVFLAQPPSGQ

SEQ ID NO: 198682 - protein, 24 aa, Homo sapiens
  Native (CTG1B_HUMAN)
LSLLMWITQCFLPVFLAQPPSGQR

SEQ ID NO: 198683 - protein, 25 aa, Homo sapiens
  Native (CTG1B_HUMAN)
LSLLMWITQCFLPVFLAQPPSGQRR

SEQ ID NO: 198684 - protein, 15 aa, Homo sapiens
  Native (CTG1B_HUMAN)
LTAADHRQLQLSISS

SEQ ID NO: 198685 - protein, 17 aa, Homo sapiens
  Native (CTG1B_HUMAN)
LTAADHRQLQLSISSCL

SEQ ID NO: 198686 - protein, 18 aa, Homo sapiens
  Native (CTG1B_HUMAN)
LTAADHRQLQLSISSCLQ

SEQ ID NO: 198687 - protein, 19 aa, Homo sapiens
  Native (CTG1B_HUMAN)
LTAADHRQLQLSISSCLQQ

SEQ ID NO: 198688 - protein, 20 aa, Homo sapiens
  Native (CTG1B_HUMAN)
LTAADHRQLQLSISSCLQQL

SEQ ID NO: 198689 - protein, 21 aa, Homo sapiens
  Native (CTG1B_HUMAN)
LTAADHRQLQLSISSCLQQLS

SEQ ID NO: 198690 - protein, 22 aa, Homo sapiens
  Native (CTG1B_HUMAN)
LTAADHRQLQLSISSCLQQLSL

SEQ ID NO: 198691 - protein, 23 aa, Homo sapiens
  Native (CTG1B_HUMAN)
LTAADHRQLQLSISSCLQQLSLL

SEQ ID NO: 198692 - protein, 24 aa, Homo sapiens
  Native (CTG1B_HUMAN)
LTAADHRQLQLSISSCLQQLSLLM

SEQ ID NO: 198693 - protein, 25 aa, Homo sapiens
  Native (CTG1B_HUMAN)
LTAADHRQLQLSISSCLQQLSLLMW

SEQ ID NO: 198694 - protein, 14 aa, Homo sapiens
  Native (CTG1B_HUMAN)
LTIRLTAADHRQLQ

SEQ ID NO: 198695 - protein, 15 aa, Homo sapiens
  Native (CTG1B_HUMAN)
LTIRLTAADHRQLQL

SEQ ID NO: 198696 - protein, 16 aa, Homo sapiens
  Native (CTG1B_HUMAN)
LTIRLTAADHRQLQLS

SEQ ID NO: 198697 - protein, 17 aa, Homo sapiens
  Native (CTG1B_HUMAN)
LTIRLTAADHRQLQLSI

SEQ ID NO: 198698 - protein, 18 aa, Homo sapiens
  Native (CTG1B_HUMAN)
LTIRLTAADHRQLQLSIS

SEQ ID NO: 198699 - protein, 19 aa, Homo sapiens
  Native (CTG1B_HUMAN)
LTIRLTAADHRQLQLSISS

SEQ ID NO: 198700 - protein, 20 aa, Homo sapiens
  Native (CTG1B_HUMAN)
LTIRLTAADHRQLQLSISSC

SEQ ID NO: 198701 - protein, 21 aa, Homo sapiens
  Native (CTG1B_HUMAN)
LTIRLTAADHRQLQLSISSCL

SEQ ID NO: 198702 - protein, 22 aa, Homo sapiens
  Native (CTG1B_HUMAN)
LTIRLTAADHRQLQLSISSCLQ

SEQ ID NO: 198703 - protein, 23 aa, Homo sapiens
  Native (CTG1B_HUMAN)
LTIRLTAADHRQLQLSISSCLQQ

SEQ ID NO: 198704 - protein, 24 aa, Homo sapiens
  Native (CTG1B_HUMAN)
LTIRLTAADHRQLQLSISSCLQQL

SEQ ID NO: 198705 - protein, 25 aa, Homo sapiens
  Native (CTG1B_HUMAN)
LTIRLTAADHRQLQLSISSCLQQLS

SEQ ID NO: 198706 - protein, 14 aa, Homo sapiens
  Native (CTG1B_HUMAN)
MEAELARRSLAQDA

SEQ ID NO: 198707 - protein, 15 aa, Homo sapiens
  Native (CTG1B_HUMAN)
MEAELARRSLAQDAP

SEQ ID NO: 198708 - protein, 16 aa, Homo sapiens
  Native (CTG1B_HUMAN)
MEAELARRSLAQDAPP

SEQ ID NO: 198709 - protein, 17 aa, Homo sapiens
  Native (CTG1B_HUMAN)
MEAELARRSLAQDAPPL

SEQ ID NO: 198710 - protein, 18 aa, Homo sapiens
  Native (CTG1B_HUMAN)
MEAELARRSLAQDAPPLP

SEQ ID NO: 198711 - protein, 19 aa, Homo sapiens
  Native (CTG1B_HUMAN)
MEAELARRSLAQDAPPLPV

SEQ ID NO: 198712 - protein, 20 aa, Homo sapiens
  Native (CTG1B_HUMAN)
MEAELARRSLAQDAPPLPVP

SEQ ID NO: 198713 - protein, 21 aa, Homo sapiens
  Native (CTG1B_HUMAN)
MEAELARRSLAQDAPPLPVPG

SEQ ID NO: 198714 - protein, 22 aa, Homo sapiens
  Native (CTG1B_HUMAN)
MEAELARRSLAQDAPPLPVPGV

SEQ ID NO: 198715 - protein, 23 aa, Homo sapiens
  Native (CTG1B_HUMAN)
MEAELARRSLAQDAPPLPVPGVL

SEQ ID NO: 198716 - protein, 24 aa, Homo sapiens
  Native (CTG1B_HUMAN)
MEAELARRSLAQDAPPLPVPGVLL

SEQ ID NO: 198717 - protein, 25 aa, Homo sapiens
  Native (CTG1B_HUMAN)
MEAELARRSLAQDAPPLPVPGVLLK

SEQ ID NO: 198718 - protein, 14 aa, Homo sapiens
  Native (CTG1B_HUMAN)
MPFATPMEAELARR

SEQ ID NO: 198719 - protein, 15 aa, Homo sapiens
  Native (CTG1B_HUMAN)
MPFATPMEAELARRS

SEQ ID NO: 198720 - protein, 16 aa, Homo sapiens
  Native (CTG1B_HUMAN)
MPFATPMEAELARRSL

SEQ ID NO: 198721 - protein, 17 aa, Homo sapiens
  Native (CTG1B_HUMAN)
MPFATPMEAELARRSLA

SEQ ID NO: 198722 - protein, 19 aa, Homo sapiens
  Native (CTG1B_HUMAN)
MPFATPMEAELARRSLAQD

SEQ ID NO: 198723 - protein, 20 aa, Homo sapiens
  Native (CTG1B_HUMAN)
MPFATPMEAELARRSLAQDA

SEQ ID NO: 198724 - protein, 21 aa, Homo sapiens
  Native (CTG1B_HUMAN)
MPFATPMEAELARRSLAQDAP

SEQ ID NO: 198725 - protein, 22 aa, Homo sapiens
  Native (CTG1B_HUMAN)
MPFATPMEAELARRSLAQDAPP

SEQ ID NO: 198726 - protein, 23 aa, Homo sapiens
  Native (CTG1B_HUMAN)
MPFATPMEAELARRSLAQDAPPL

SEQ ID NO: 198727 - protein, 24 aa, Homo sapiens
  Native (CTG1B_HUMAN)
MPFATPMEAELARRSLAQDAPPLP

SEQ ID NO: 198728 - protein, 25 aa, Homo sapiens
  Native (CTG1B_HUMAN)
MPFATPMEAELARRSLAQDAPPLPV

SEQ ID NO: 198729 - protein, 13 aa, Homo sapiens
  Native (CTG1B_HUMAN)
MWITQCFLPVFLA

SEQ ID NO: 198730 - protein, 14 aa, Homo sapiens
  Native (CTG1B_HUMAN)
MWITQCFLPVFLAQ

SEQ ID NO: 198731 - protein, 16 aa, Homo sapiens
  Native (CTG1B_HUMAN)
MWITQCFLPVFLAQPP

SEQ ID NO: 198732 - protein, 17 aa, Homo sapiens
  Native (CTG1B_HUMAN)
MWITQCFLPVFLAQPPS

SEQ ID NO: 198733 - protein, 18 aa, Homo sapiens
  Native (CTG1B_HUMAN)
MWITQCFLPVFLAQPPSG

SEQ ID NO: 198734 - protein, 19 aa, Homo sapiens
  Native (CTG1B_HUMAN)
MWITQCFLPVFLAQPPSGQ

SEQ ID NO: 198735 - protein, 20 aa, Homo sapiens
  Native (CTG1B_HUMAN)
MWITQCFLPVFLAQPPSGQR

SEQ ID NO: 198736 - protein, 21 aa, Homo sapiens
  Native (CTG1B_HUMAN)
MWITQCFLPVFLAQPPSGQRR

SEQ ID NO: 198737 - protein, 15 aa, Homo sapiens
  Native (CTG1B_HUMAN)
NAGGPGEAGATGGRG

SEQ ID NO: 198738 - protein, 24 aa, Homo sapiens
  Native (CTG1B_HUMAN)
NAGGPGEAGATGGRGPRGAGAARA

SEQ ID NO: 198739 - protein, 25 aa, Homo sapiens
  Native (CTG1B_HUMAN)
NAGGPGEAGATGGRGPRGAGAARAS

SEQ ID NO: 198740 - protein, 22 aa, Homo sapiens
  Native (CTG1B_HUMAN)
NGCCRCGARGPESRLLEFYLAM

SEQ ID NO: 198741 - protein, 23 aa, Homo sapiens
  Native (CTG1B_HUMAN)
NGCCRCGARGPESRLLEFYLAMP

SEQ ID NO: 198742 - protein, 24 aa, Homo sapiens
  Native (CTG1B_HUMAN)
NGCCRCGARGPESRLLEFYLAMPF

SEQ ID NO: 198743 - protein, 25 aa, Homo sapiens
  Native (CTG1B_HUMAN)
NGCCRCGARGPESRLLEFYLAMPFA

SEQ ID NO: 198744 - protein, 13 aa, Homo sapiens
  Native (CTG1B_HUMAN)
NILTIRLTAADHR

SEQ ID NO: 198745 - protein, 14 aa, Homo sapiens
  Native (CTG1B_HUMAN)
NILTIRLTAADHRQ

SEQ ID NO: 198746 - protein, 16 aa, Homo sapiens
  Native (CTG1B_HUMAN)
NILTIRLTAADHRQLQ

SEQ ID NO: 198747 - protein, 17 aa, Homo sapiens
  Native (CTG1B_HUMAN)
NILTIRLTAADHRQLQL

SEQ ID NO: 198748 - protein, 18 aa, Homo sapiens
  Native (CTG1B_HUMAN)
NILTIRLTAADHRQLQLS

SEQ ID NO: 198749 - protein, 19 aa, Homo sapiens
  Native (CTG1B_HUMAN)
NILTIRLTAADHRQLQLSI

SEQ ID NO: 198750 - protein, 20 aa, Homo sapiens
  Native (CTG1B_HUMAN)
NILTIRLTAADHRQLQLSIS

SEQ ID NO: 198751 - protein, 21 aa, Homo sapiens
  Native (CTG1B_HUMAN)
NILTIRLTAADHRQLQLSISS

SEQ ID NO: 198752 - protein, 22 aa, Homo sapiens
  Native (CTG1B_HUMAN)
NILTIRLTAADHRQLQLSISSC

SEQ ID NO: 198753 - protein, 23 aa, Homo sapiens
  Native (CTG1B_HUMAN)
NILTIRLTAADHRQLQLSISSCL

SEQ ID NO: 198754 - protein, 24 aa, Homo sapiens
  Native (CTG1B_HUMAN)
NILTIRLTAADHRQLQLSISSCLQ

SEQ ID NO: 198755 - protein, 25 aa, Homo sapiens
  Native (CTG1B_HUMAN)
NILTIRLTAADHRQLQLSISSCLQQ

SEQ ID NO: 198756 - protein, 13 aa, Homo sapiens
  Native (CTG1B_HUMAN)
PESRLLEFYLAMP

SEQ ID NO: 198757 - protein, 14 aa, Homo sapiens
  Native (CTG1B_HUMAN)
PESRLLEFYLAMPF

SEQ ID NO: 198758 - protein, 15 aa, Homo sapiens
  Native (CTG1B_HUMAN)
PESRLLEFYLAMPFA

SEQ ID NO: 198759 - protein, 16 aa, Homo sapiens
  Native (CTG1B_HUMAN)
PESRLLEFYLAMPFAT

SEQ ID NO: 198760 - protein, 17 aa, Homo sapiens
  Native (CTG1B_HUMAN)
PESRLLEFYLAMPFATP

SEQ ID NO: 198761 - protein, 18 aa, Homo sapiens
  Native (CTG1B_HUMAN)
PESRLLEFYLAMPFATPM

SEQ ID NO: 198762 - protein, 19 aa, Homo sapiens
  Native (CTG1B_HUMAN)
PESRLLEFYLAMPFATPME

SEQ ID NO: 198763 - protein, 20 aa, Homo sapiens
  Native (CTG1B_HUMAN)
PESRLLEFYLAMPFATPMEA

SEQ ID NO: 198764 - protein, 21 aa, Homo sapiens
  Native (CTG1B_HUMAN)
PESRLLEFYLAMPFATPMEAE

SEQ ID NO: 198765 - protein, 22 aa, Homo sapiens
  Native (CTG1B_HUMAN)
PESRLLEFYLAMPFATPMEAEL

SEQ ID NO: 198766 - protein, 23 aa, Homo sapiens
  Native (CTG1B_HUMAN)
PESRLLEFYLAMPFATPMEAELA

SEQ ID NO: 198767 - protein, 24 aa, Homo sapiens
  Native (CTG1B_HUMAN)
PESRLLEFYLAMPFATPMEAELAR

SEQ ID NO: 198768 - protein, 25 aa, Homo sapiens
  Native (CTG1B_HUMAN)
PESRLLEFYLAMPFATPMEAELARR

SEQ ID NO: 198769 - protein, 15 aa, Homo sapiens
  Native (CTG1B_HUMAN)
PFATPMEAELARRSL

SEQ ID NO: 198770 - protein, 16 aa, Homo sapiens
  Native (CTG1B_HUMAN)
PFATPMEAELARRSLA

SEQ ID NO: 198771 - protein, 17 aa, Homo sapiens
  Native (CTG1B_HUMAN)
PFATPMEAELARRSLAQ

SEQ ID NO: 198772 - protein, 19 aa, Homo sapiens
  Native (CTG1B_HUMAN)
PFATPMEAELARRSLAQDA

SEQ ID NO: 198773 - protein, 20 aa, Homo sapiens
  Native (CTG1B_HUMAN)
PFATPMEAELARRSLAQDAP

SEQ ID NO: 198774 - protein, 21 aa, Homo sapiens
  Native (CTG1B_HUMAN)
PFATPMEAELARRSLAQDAPP

SEQ ID NO: 198775 - protein, 22 aa, Homo sapiens
  Native (CTG1B_HUMAN)
PFATPMEAELARRSLAQDAPPL

SEQ ID NO: 198776 - protein, 23 aa, Homo sapiens
  Native (CTG1B_HUMAN)
PFATPMEAELARRSLAQDAPPLP

SEQ ID NO: 198777 - protein, 24 aa, Homo sapiens
  Native (CTG1B_HUMAN)
PFATPMEAELARRSLAQDAPPLPV

SEQ ID NO: 198778 - protein, 25 aa, Homo sapiens
  Native (CTG1B_HUMAN)
PFATPMEAELARRSLAQDAPPLPVP

SEQ ID NO: 198779 - protein, 20 aa, Homo sapiens
  Native (CTG1B_HUMAN)
PGEAGATGGRGPRGAGAARA

SEQ ID NO: 198780 - protein, 21 aa, Homo sapiens
  Native (CTG1B_HUMAN)
PGEAGATGGRGPRGAGAARAS

SEQ ID NO: 198781 - protein, 22 aa, Homo sapiens
  Native (CTG1B_HUMAN)
PGEAGATGGRGPRGAGAARASG

SEQ ID NO: 198782 - protein, 23 aa, Homo sapiens
  Native (CTG1B_HUMAN)
PGEAGATGGRGPRGAGAARASGP

SEQ ID NO: 198783 - protein, 24 aa, Homo sapiens
  Native (CTG1B_HUMAN)
PGEAGATGGRGPRGAGAARASGPG

SEQ ID NO: 198784 - protein, 25 aa, Homo sapiens
  Native (CTG1B_HUMAN)
PGEAGATGGRGPRGAGAARASGPGG

SEQ ID NO: 198785 - protein, 17 aa, Homo sapiens
  Native (CTG1B_HUMAN)
PGGGAPRGPHGGAASGL

SEQ ID NO: 198786 - protein, 18 aa, Homo sapiens
  Native (CTG1B_HUMAN)
PGGGAPRGPHGGAASGLN

SEQ ID NO: 198787 - protein, 19 aa, Homo sapiens
  Native (CTG1B_HUMAN)
PGGGAPRGPHGGAASGLNG

SEQ ID NO: 198788 - protein, 20 aa, Homo sapiens
  Native (CTG1B_HUMAN)
PGGGAPRGPHGGAASGLNGC

SEQ ID NO: 198789 - protein, 21 aa, Homo sapiens
  Native (CTG1B_HUMAN)
PGGGAPRGPHGGAASGLNGCC

SEQ ID NO: 198790 - protein, 22 aa, Homo sapiens
  Native (CTG1B_HUMAN)
PGGGAPRGPHGGAASGLNGCCR

SEQ ID NO: 198791 - protein, 23 aa, Homo sapiens
  Native (CTG1B_HUMAN)
PGGGAPRGPHGGAASGLNGCCRC

SEQ ID NO: 198792 - protein, 24 aa, Homo sapiens
  Native (CTG1B_HUMAN)
PGGGAPRGPHGGAASGLNGCCRCG

SEQ ID NO: 198793 - protein, 25 aa, Homo sapiens
  Native (CTG1B_HUMAN)
PGGGAPRGPHGGAASGLNGCCRCGA

SEQ ID NO: 198794 - protein, 15 aa, Homo sapiens
  Native (CTG1B_HUMAN)
PGGNAGGPGEAGATG

SEQ ID NO: 198795 - protein, 13 aa, Homo sapiens
  Native (CTG1B_HUMAN)
PGVLLKEFTVSGN

SEQ ID NO: 198796 - protein, 14 aa, Homo sapiens
  Native (CTG1B_HUMAN)
PGVLLKEFTVSGNI

SEQ ID NO: 198797 - protein, 15 aa, Homo sapiens
  Native (CTG1B_HUMAN)
PGVLLKEFTVSGNIL

SEQ ID NO: 198798 - protein, 16 aa, Homo sapiens
  Native (CTG1B_HUMAN)
PGVLLKEFTVSGNILT

SEQ ID NO: 198799 - protein, 17 aa, Homo sapiens
  Native (CTG1B_HUMAN)
PGVLLKEFTVSGNILTI

SEQ ID NO: 198800 - protein, 18 aa, Homo sapiens
  Native (CTG1B_HUMAN)
PGVLLKEFTVSGNILTIR

SEQ ID NO: 198801 - protein, 19 aa, Homo sapiens
  Native (CTG1B_HUMAN)
PGVLLKEFTVSGNILTIRL

SEQ ID NO: 198802 - protein, 20 aa, Homo sapiens
  Native (CTG1B_HUMAN)
PGVLLKEFTVSGNILTIRLT

SEQ ID NO: 198803 - protein, 21 aa, Homo sapiens
  Native (CTG1B_HUMAN)
PGVLLKEFTVSGNILTIRLTA

SEQ ID NO: 198804 - protein, 22 aa, Homo sapiens
  Native (CTG1B_HUMAN)
PGVLLKEFTVSGNILTIRLTAA

SEQ ID NO: 198805 - protein, 23 aa, Homo sapiens
  Native (CTG1B_HUMAN)
PGVLLKEFTVSGNILTIRLTAAD

SEQ ID NO: 198806 - protein, 24 aa, Homo sapiens
  Native (CTG1B_HUMAN)
PGVLLKEFTVSGNILTIRLTAADH

SEQ ID NO: 198807 - protein, 25 aa, Homo sapiens
  Native (CTG1B_HUMAN)
PGVLLKEFTVSGNILTIRLTAADHR

SEQ ID NO: 198808 - protein, 14 aa, Homo sapiens
  Native (CTG1B_HUMAN)
PHGGAASGLNGCCR

SEQ ID NO: 198809 - protein, 15 aa, Homo sapiens
  Native (CTG1B_HUMAN)
PHGGAASGLNGCCRC

SEQ ID NO: 198810 - protein, 16 aa, Homo sapiens
  Native (CTG1B_HUMAN)
PHGGAASGLNGCCRCG

SEQ ID NO: 198811 - protein, 17 aa, Homo sapiens
  Native (CTG1B_HUMAN)
PHGGAASGLNGCCRCGA

SEQ ID NO: 198812 - protein, 20 aa, Homo sapiens
  Native (CTG1B_HUMAN)
PHGGAASGLNGCCRCGARGP

SEQ ID NO: 198813 - protein, 15 aa, Homo sapiens
  Native (CTG1B_HUMAN)
PLPVPGVLLKEFTVS

SEQ ID NO: 198814 - protein, 16 aa, Homo sapiens
  Native (CTG1B_HUMAN)
PLPVPGVLLKEFTVSG

SEQ ID NO: 198815 - protein, 17 aa, Homo sapiens
  Native (CTG1B_HUMAN)
PLPVPGVLLKEFTVSGN

SEQ ID NO: 198816 - protein, 19 aa, Homo sapiens
  Native (CTG1B_HUMAN)
PLPVPGVLLKEFTVSGNIL

SEQ ID NO: 198817 - protein, 20 aa, Homo sapiens
  Native (CTG1B_HUMAN)
PLPVPGVLLKEFTVSGNILT

SEQ ID NO: 198818 - protein, 21 aa, Homo sapiens
  Native (CTG1B_HUMAN)
PLPVPGVLLKEFTVSGNILTI

SEQ ID NO: 198819 - protein, 22 aa, Homo sapiens
  Native (CTG1B_HUMAN)
PLPVPGVLLKEFTVSGNILTIR

SEQ ID NO: 198820 - protein, 23 aa, Homo sapiens
  Native (CTG1B_HUMAN)
PLPVPGVLLKEFTVSGNILTIRL

SEQ ID NO: 198821 - protein, 24 aa, Homo sapiens
  Native (CTG1B_HUMAN)
PLPVPGVLLKEFTVSGNILTIRLT

SEQ ID NO: 198822 - protein, 25 aa, Homo sapiens
  Native (CTG1B_HUMAN)
PLPVPGVLLKEFTVSGNILTIRLTA

SEQ ID NO: 198823 - protein, 15 aa, Homo sapiens
  Native (CTG1B_HUMAN)
PMEAELARRSLAQDA

SEQ ID NO: 198824 - protein, 16 aa, Homo sapiens
  Native (CTG1B_HUMAN)
PMEAELARRSLAQDAP

SEQ ID NO: 198825 - protein, 17 aa, Homo sapiens
  Native (CTG1B_HUMAN)
PMEAELARRSLAQDAPP

SEQ ID NO: 198826 - protein, 18 aa, Homo sapiens
  Native (CTG1B_HUMAN)
PMEAELARRSLAQDAPPL

SEQ ID NO: 198827 - protein, 19 aa, Homo sapiens
  Native (CTG1B_HUMAN)
PMEAELARRSLAQDAPPLP

SEQ ID NO: 198828 - protein, 20 aa, Homo sapiens
  Native (CTG1B_HUMAN)
PMEAELARRSLAQDAPPLPV

SEQ ID NO: 198829 - protein, 21 aa, Homo sapiens
  Native (CTG1B_HUMAN)
PMEAELARRSLAQDAPPLPVP

SEQ ID NO: 198830 - protein, 22 aa, Homo sapiens
  Native (CTG1B_HUMAN)
PMEAELARRSLAQDAPPLPVPG

SEQ ID NO: 198831 - protein, 23 aa, Homo sapiens
  Native (CTG1B_HUMAN)
PMEAELARRSLAQDAPPLPVPGV

SEQ ID NO: 198832 - protein, 24 aa, Homo sapiens
  Native (CTG1B_HUMAN)
PMEAELARRSLAQDAPPLPVPGVL

SEQ ID NO: 198833 - protein, 25 aa, Homo sapiens
  Native (CTG1B_HUMAN)
PMEAELARRSLAQDAPPLPVPGVLL

SEQ ID NO: 198834 - protein, 15 aa, Homo sapiens
  Native (CTG1B_HUMAN)
PPLPVPGVLLKEFTV

SEQ ID NO: 198835 - protein, 16 aa, Homo sapiens
  Native (CTG1B_HUMAN)
PPLPVPGVLLKEFTVS

SEQ ID NO: 198836 - protein, 17 aa, Homo sapiens
  Native (CTG1B_HUMAN)
PPLPVPGVLLKEFTVSG

SEQ ID NO: 198837 - protein, 19 aa, Homo sapiens
  Native (CTG1B_HUMAN)
PPLPVPGVLLKEFTVSGNI

SEQ ID NO: 198838 - protein, 20 aa, Homo sapiens
  Native (CTG1B_HUMAN)
PPLPVPGVLLKEFTVSGNIL

SEQ ID NO: 198839 - protein, 21 aa, Homo sapiens
  Native (CTG1B_HUMAN)
PPLPVPGVLLKEFTVSGNILT

SEQ ID NO: 198840 - protein, 22 aa, Homo sapiens
  Native (CTG1B_HUMAN)
PPLPVPGVLLKEFTVSGNILTI

SEQ ID NO: 198841 - protein, 23 aa, Homo sapiens
  Native (CTG1B_HUMAN)
PPLPVPGVLLKEFTVSGNILTIR

SEQ ID NO: 198842 - protein, 24 aa, Homo sapiens
  Native (CTG1B_HUMAN)
PPLPVPGVLLKEFTVSGNILTIRL

SEQ ID NO: 198843 - protein, 25 aa, Homo sapiens
  Native (CTG1B_HUMAN)
PPLPVPGVLLKEFTVSGNILTIRLT

SEQ ID NO: 198844 - protein, 13 aa, Homo sapiens
  Native (CTG1B_HUMAN)
PRGAGAARASGPG

SEQ ID NO: 198845 - protein, 14 aa, Homo sapiens
  Native (CTG1B_HUMAN)
PRGAGAARASGPGG

SEQ ID NO: 198846 - protein, 15 aa, Homo sapiens
  Native (CTG1B_HUMAN)
PRGAGAARASGPGGG

SEQ ID NO: 198847 - protein, 16 aa, Homo sapiens
  Native (CTG1B_HUMAN)
PRGAGAARASGPGGGA

SEQ ID NO: 198848 - protein, 17 aa, Homo sapiens
  Native (CTG1B_HUMAN)
PRGAGAARASGPGGGAP

SEQ ID NO: 198849 - protein, 18 aa, Homo sapiens
  Native (CTG1B_HUMAN)
PRGAGAARASGPGGGAPR

SEQ ID NO: 198850 - protein, 19 aa, Homo sapiens
  Native (CTG1B_HUMAN)
PRGAGAARASGPGGGAPRG

SEQ ID NO: 198851 - protein, 20 aa, Homo sapiens
  Native (CTG1B_HUMAN)
PRGAGAARASGPGGGAPRGP

SEQ ID NO: 198852 - protein, 21 aa, Homo sapiens
  Native (CTG1B_HUMAN)
PRGAGAARASGPGGGAPRGPH

SEQ ID NO: 198853 - protein, 22 aa, Homo sapiens
  Native (CTG1B_HUMAN)
PRGAGAARASGPGGGAPRGPHG

SEQ ID NO: 198854 - protein, 23 aa, Homo sapiens
  Native (CTG1B_HUMAN)
PRGAGAARASGPGGGAPRGPHGG

SEQ ID NO: 198855 - protein, 24 aa, Homo sapiens
  Native (CTG1B_HUMAN)
PRGAGAARASGPGGGAPRGPHGGA

SEQ ID NO: 198856 - protein, 25 aa, Homo sapiens
  Native (CTG1B_HUMAN)
PRGAGAARASGPGGGAPRGPHGGAA

SEQ ID NO: 198857 - protein, 13 aa, Homo sapiens
  Native (CTG1B_HUMAN)
PRGPHGGAASGLN

SEQ ID NO: 198858 - protein, 14 aa, Homo sapiens
  Native (CTG1B_HUMAN)
PRGPHGGAASGLNG

SEQ ID NO: 198859 - protein, 15 aa, Homo sapiens
  Native (CTG1B_HUMAN)
PRGPHGGAASGLNGC

SEQ ID NO: 198860 - protein, 16 aa, Homo sapiens
  Native (CTG1B_HUMAN)
PRGPHGGAASGLNGCC

SEQ ID NO: 198861 - protein, 17 aa, Homo sapiens
  Native (CTG1B_HUMAN)
PRGPHGGAASGLNGCCR

SEQ ID NO: 198862 - protein, 18 aa, Homo sapiens
  Native (CTG1B_HUMAN)
PRGPHGGAASGLNGCCRC

SEQ ID NO: 198863 - protein, 19 aa, Homo sapiens
  Native (CTG1B_HUMAN)
PRGPHGGAASGLNGCCRCG

SEQ ID NO: 198864 - protein, 20 aa, Homo sapiens
  Native (CTG1B_HUMAN)
PRGPHGGAASGLNGCCRCGA

SEQ ID NO: 198865 - protein, 21 aa, Homo sapiens
  Native (CTG1B_HUMAN)
PRGPHGGAASGLNGCCRCGAR

SEQ ID NO: 198866 - protein, 22 aa, Homo sapiens
  Native (CTG1B_HUMAN)
PRGPHGGAASGLNGCCRCGARG

SEQ ID NO: 198867 - protein, 23 aa, Homo sapiens
  Native (CTG1B_HUMAN)
PRGPHGGAASGLNGCCRCGARGP

SEQ ID NO: 198868 - protein, 24 aa, Homo sapiens
  Native (CTG1B_HUMAN)
PRGPHGGAASGLNGCCRCGARGPE

SEQ ID NO: 198869 - protein, 25 aa, Homo sapiens
  Native (CTG1B_HUMAN)
PRGPHGGAASGLNGCCRCGARGPES

SEQ ID NO: 198870 - protein, 13 aa, Homo sapiens
  Native (CTG1B_HUMAN)
PVFLAQPPSGQRR

SEQ ID NO: 198871 - protein, 14 aa, Homo sapiens
  Native (CTG1B_HUMAN)
PVPGVLLKEFTVSG

SEQ ID NO: 198872 - protein, 15 aa, Homo sapiens
  Native (CTG1B_HUMAN)
PVPGVLLKEFTVSGN

SEQ ID NO: 198873 - protein, 16 aa, Homo sapiens
  Native (CTG1B_HUMAN)
PVPGVLLKEFTVSGNI

SEQ ID NO: 198874 - protein, 17 aa, Homo sapiens
  Native (CTG1B_HUMAN)
PVPGVLLKEFTVSGNIL

SEQ ID NO: 198875 - protein, 18 aa, Homo sapiens
  Native (CTG1B_HUMAN)
PVPGVLLKEFTVSGNILT

SEQ ID NO: 198876 - protein, 19 aa, Homo sapiens
  Native (CTG1B_HUMAN)
PVPGVLLKEFTVSGNILTI

SEQ ID NO: 198877 - protein, 20 aa, Homo sapiens
  Native (CTG1B_HUMAN)
PVPGVLLKEFTVSGNILTIR

SEQ ID NO: 198878 - protein, 21 aa, Homo sapiens
  Native (CTG1B_HUMAN)
PVPGVLLKEFTVSGNILTIRL

SEQ ID NO: 198879 - protein, 22 aa, Homo sapiens
  Native (CTG1B_HUMAN)
PVPGVLLKEFTVSGNILTIRLT

SEQ ID NO: 198880 - protein, 23 aa, Homo sapiens
  Native (CTG1B_HUMAN)
PVPGVLLKEFTVSGNILTIRLTA

SEQ ID NO: 198881 - protein, 24 aa, Homo sapiens
  Native (CTG1B_HUMAN)
PVPGVLLKEFTVSGNILTIRLTAA

SEQ ID NO: 198882 - protein, 25 aa, Homo sapiens
  Native (CTG1B_HUMAN)
PVPGVLLKEFTVSGNILTIRLTAAD

SEQ ID NO: 198883 - protein, 13 aa, Homo sapiens
  Native (CTG1B_HUMAN)
QCFLPVFLAQPPS

SEQ ID NO: 198884 - protein, 14 aa, Homo sapiens
  Native (CTG1B_HUMAN)
QCFLPVFLAQPPSG

SEQ ID NO: 198885 - protein, 15 aa, Homo sapiens
  Native (CTG1B_HUMAN)
QCFLPVFLAQPPSGQ

SEQ ID NO: 198886 - protein, 16 aa, Homo sapiens
  Native (CTG1B_HUMAN)
QCFLPVFLAQPPSGQR

SEQ ID NO: 198887 - protein, 17 aa, Homo sapiens
  Native (CTG1B_HUMAN)
QCFLPVFLAQPPSGQRR

SEQ ID NO: 198888 - protein, 15 aa, Homo sapiens
  Native (CTG1B_HUMAN)
QDAPPLPVPGVLLKE

SEQ ID NO: 198889 - protein, 19 aa, Homo sapiens
  Native (CTG1B_HUMAN)
QDAPPLPVPGVLLKEFTVS

SEQ ID NO: 198890 - protein, 20 aa, Homo sapiens
  Native (CTG1B_HUMAN)
QDAPPLPVPGVLLKEFTVSG

SEQ ID NO: 198891 - protein, 21 aa, Homo sapiens
  Native (CTG1B_HUMAN)
QDAPPLPVPGVLLKEFTVSGN

SEQ ID NO: 198892 - protein, 22 aa, Homo sapiens
  Native (CTG1B_HUMAN)
QDAPPLPVPGVLLKEFTVSGNI

SEQ ID NO: 198893 - protein, 23 aa, Homo sapiens
  Native (CTG1B_HUMAN)
QDAPPLPVPGVLLKEFTVSGNIL

SEQ ID NO: 198894 - protein, 24 aa, Homo sapiens
  Native (CTG1B_HUMAN)
QDAPPLPVPGVLLKEFTVSGNILT

SEQ ID NO: 198895 - protein, 25 aa, Homo sapiens
  Native (CTG1B_HUMAN)
QDAPPLPVPGVLLKEFTVSGNILTI

SEQ ID NO: 198896 - protein, 13 aa, Homo sapiens
  Native (CTG1B_HUMAN)
QLQLSISSCLQQL

SEQ ID NO: 198897 - protein, 14 aa, Homo sapiens
  Native (CTG1B_HUMAN)
QLQLSISSCLQQLS

SEQ ID NO: 198898 - protein, 15 aa, Homo sapiens
  Native (CTG1B_HUMAN)
QLQLSISSCLQQLSL

SEQ ID NO: 198899 - protein, 16 aa, Homo sapiens
  Native (CTG1B_HUMAN)
QLQLSISSCLQQLSLL

SEQ ID NO: 198900 - protein, 17 aa, Homo sapiens
  Native (CTG1B_HUMAN)
QLQLSISSCLQQLSLLM

SEQ ID NO: 198901 - protein, 18 aa, Homo sapiens
  Native (CTG1B_HUMAN)
QLQLSISSCLQQLSLLMW

SEQ ID NO: 198902 - protein, 19 aa, Homo sapiens
  Native (CTG1B_HUMAN)
QLQLSISSCLQQLSLLMWI

SEQ ID NO: 198903 - protein, 20 aa, Homo sapiens
  Native (CTG1B_HUMAN)
QLQLSISSCLQQLSLLMWIT

SEQ ID NO: 198904 - protein, 21 aa, Homo sapiens
  Native (CTG1B_HUMAN)
QLQLSISSCLQQLSLLMWITQ

SEQ ID NO: 198905 - protein, 22 aa, Homo sapiens
  Native (CTG1B_HUMAN)
QLQLSISSCLQQLSLLMWITQC

SEQ ID NO: 198906 - protein, 23 aa, Homo sapiens
  Native (CTG1B_HUMAN)
QLQLSISSCLQQLSLLMWITQCF

SEQ ID NO: 198907 - protein, 24 aa, Homo sapiens
  Native (CTG1B_HUMAN)
QLQLSISSCLQQLSLLMWITQCFL

SEQ ID NO: 198908 - protein, 25 aa, Homo sapiens
  Native (CTG1B_HUMAN)
QLQLSISSCLQQLSLLMWITQCFLP

SEQ ID NO: 198909 - protein, 13 aa, Homo sapiens
  Native (CTG1B_HUMAN)
QLSISSCLQQLSL

SEQ ID NO: 198910 - protein, 14 aa, Homo sapiens
  Native (CTG1B_HUMAN)
QLSISSCLQQLSLL

SEQ ID NO: 198911 - protein, 15 aa, Homo sapiens
  Native (CTG1B_HUMAN)
QLSISSCLQQLSLLM

SEQ ID NO: 198912 - protein, 16 aa, Homo sapiens
  Native (CTG1B_HUMAN)
QLSISSCLQQLSLLMW

SEQ ID NO: 198913 - protein, 17 aa, Homo sapiens
  Native (CTG1B_HUMAN)
QLSISSCLQQLSLLMWI

SEQ ID NO: 198914 - protein, 18 aa, Homo sapiens
  Native (CTG1B_HUMAN)
QLSISSCLQQLSLLMWIT

SEQ ID NO: 198915 - protein, 19 aa, Homo sapiens
  Native (CTG1B_HUMAN)
QLSISSCLQQLSLLMWITQ

SEQ ID NO: 198916 - protein, 20 aa, Homo sapiens
  Native (CTG1B_HUMAN)
QLSISSCLQQLSLLMWITQC

SEQ ID NO: 198917 - protein, 21 aa, Homo sapiens
  Native (CTG1B_HUMAN)
QLSISSCLQQLSLLMWITQCF

SEQ ID NO: 198918 - protein, 22 aa, Homo sapiens
  Native (CTG1B_HUMAN)
QLSISSCLQQLSLLMWITQCFL

SEQ ID NO: 198919 - protein, 23 aa, Homo sapiens
  Native (CTG1B_HUMAN)
QLSISSCLQQLSLLMWITQCFLP

SEQ ID NO: 198920 - protein, 24 aa, Homo sapiens
  Native (CTG1B_HUMAN)
QLSISSCLQQLSLLMWITQCFLPV

SEQ ID NO: 198921 - protein, 25 aa, Homo sapiens
  Native (CTG1B_HUMAN)
QLSISSCLQQLSLLMWITQCFLPVF

SEQ ID NO: 198922 - protein, 13 aa, Homo sapiens
  Native (CTG1B_HUMAN)
QLSLLMWITQCFL

SEQ ID NO: 198923 - protein, 14 aa, Homo sapiens
  Native (CTG1B_HUMAN)
QLSLLMWITQCFLP

SEQ ID NO: 198924 - protein, 15 aa, Homo sapiens
  Native (CTG1B_HUMAN)
QLSLLMWITQCFLPV

SEQ ID NO: 198925 - protein, 16 aa, Homo sapiens
  Native (CTG1B_HUMAN)
QLSLLMWITQCFLPVF

SEQ ID NO: 198926 - protein, 17 aa, Homo sapiens
  Native (CTG1B_HUMAN)
QLSLLMWITQCFLPVFL

SEQ ID NO: 198927 - protein, 18 aa, Homo sapiens
  Native (CTG1B_HUMAN)
QLSLLMWITQCFLPVFLA

SEQ ID NO: 198928 - protein, 19 aa, Homo sapiens
  Native (CTG1B_HUMAN)
QLSLLMWITQCFLPVFLAQ

SEQ ID NO: 198929 - protein, 20 aa, Homo sapiens
  Native (CTG1B_HUMAN)
QLSLLMWITQCFLPVFLAQP

SEQ ID NO: 198930 - protein, 21 aa, Homo sapiens
  Native (CTG1B_HUMAN)
QLSLLMWITQCFLPVFLAQPP

SEQ ID NO: 198931 - protein, 22 aa, Homo sapiens
  Native (CTG1B_HUMAN)
QLSLLMWITQCFLPVFLAQPPS

SEQ ID NO: 198932 - protein, 23 aa, Homo sapiens
  Native (CTG1B_HUMAN)
QLSLLMWITQCFLPVFLAQPPSG

SEQ ID NO: 198933 - protein, 24 aa, Homo sapiens
  Native (CTG1B_HUMAN)
QLSLLMWITQCFLPVFLAQPPSGQ

SEQ ID NO: 198934 - protein, 25 aa, Homo sapiens
  Native (CTG1B_HUMAN)
QLSLLMWITQCFLPVFLAQPPSGQR

SEQ ID NO: 198935 - protein, 13 aa, Homo sapiens
  Native (CTG1B_HUMAN)
QQLSLLMWITQCF

SEQ ID NO: 198936 - protein, 14 aa, Homo sapiens
  Native (CTG1B_HUMAN)
QQLSLLMWITQCFL

SEQ ID NO: 198937 - protein, 15 aa, Homo sapiens
  Native (CTG1B_HUMAN)
QQLSLLMWITQCFLP

SEQ ID NO: 198938 - protein, 16 aa, Homo sapiens
  Native (CTG1B_HUMAN)
QQLSLLMWITQCFLPV

SEQ ID NO: 198939 - protein, 17 aa, Homo sapiens
  Native (CTG1B_HUMAN)
QQLSLLMWITQCFLPVF

SEQ ID NO: 198940 - protein, 18 aa, Homo sapiens
  Native (CTG1B_HUMAN)
QQLSLLMWITQCFLPVFL

SEQ ID NO: 198941 - protein, 19 aa, Homo sapiens
  Native (CTG1B_HUMAN)
QQLSLLMWITQCFLPVFLA

SEQ ID NO: 198942 - protein, 20 aa, Homo sapiens
  Native (CTG1B_HUMAN)
QQLSLLMWITQCFLPVFLAQ

SEQ ID NO: 198943 - protein, 21 aa, Homo sapiens
  Native (CTG1B_HUMAN)
QQLSLLMWITQCFLPVFLAQP

SEQ ID NO: 198944 - protein, 22 aa, Homo sapiens
  Native (CTG1B_HUMAN)
QQLSLLMWITQCFLPVFLAQPP

SEQ ID NO: 198945 - protein, 23 aa, Homo sapiens
  Native (CTG1B_HUMAN)
QQLSLLMWITQCFLPVFLAQPPS

SEQ ID NO: 198946 - protein, 24 aa, Homo sapiens
  Native (CTG1B_HUMAN)
QQLSLLMWITQCFLPVFLAQPPSG

SEQ ID NO: 198947 - protein, 25 aa, Homo sapiens
  Native (CTG1B_HUMAN)
QQLSLLMWITQCFLPVFLAQPPSGQ

SEQ ID NO: 198948 - protein, 14 aa, Homo sapiens
  Native (CTG1B_HUMAN)
RASGPGGGAPRGPH

SEQ ID NO: 198949 - protein, 15 aa, Homo sapiens
  Native (CTG1B_HUMAN)
RASGPGGGAPRGPHG

SEQ ID NO: 198950 - protein, 16 aa, Homo sapiens
  Native (CTG1B_HUMAN)
RASGPGGGAPRGPHGG

SEQ ID NO: 198951 - protein, 17 aa, Homo sapiens
  Native (CTG1B_HUMAN)
RASGPGGGAPRGPHGGA

SEQ ID NO: 198952 - protein, 21 aa, Homo sapiens
  Native (CTG1B_HUMAN)
RASGPGGGAPRGPHGGAASGL

SEQ ID NO: 198953 - protein, 22 aa, Homo sapiens
  Native (CTG1B_HUMAN)
RASGPGGGAPRGPHGGAASGLN

SEQ ID NO: 198954 - protein, 23 aa, Homo sapiens
  Native (CTG1B_HUMAN)
RASGPGGGAPRGPHGGAASGLNG

SEQ ID NO: 198955 - protein, 24 aa, Homo sapiens
  Native (CTG1B_HUMAN)
RASGPGGGAPRGPHGGAASGLNGC

SEQ ID NO: 198956 - protein, 25 aa, Homo sapiens
  Native (CTG1B_HUMAN)
RASGPGGGAPRGPHGGAASGLNGCC

SEQ ID NO: 198957 - protein, 17 aa, Homo sapiens
  Native (CTG1B_HUMAN)
RCGARGPESRLLEFYLA

SEQ ID NO: 198958 - protein, 18 aa, Homo sapiens
  Native (CTG1B_HUMAN)
RCGARGPESRLLEFYLAM

SEQ ID NO: 198959 - protein, 19 aa, Homo sapiens
  Native (CTG1B_HUMAN)
RCGARGPESRLLEFYLAMP

SEQ ID NO: 198960 - protein, 20 aa, Homo sapiens
  Native (CTG1B_HUMAN)
RCGARGPESRLLEFYLAMPF

SEQ ID NO: 198961 - protein, 21 aa, Homo sapiens
  Native (CTG1B_HUMAN)
RCGARGPESRLLEFYLAMPFA

SEQ ID NO: 198962 - protein, 22 aa, Homo sapiens
  Native (CTG1B_HUMAN)
RCGARGPESRLLEFYLAMPFAT

SEQ ID NO: 198963 - protein, 23 aa, Homo sapiens
  Native (CTG1B_HUMAN)
RCGARGPESRLLEFYLAMPFATP

SEQ ID NO: 198964 - protein, 24 aa, Homo sapiens
  Native (CTG1B_HUMAN)
RCGARGPESRLLEFYLAMPFATPM

SEQ ID NO: 198965 - protein, 25 aa, Homo sapiens
  Native (CTG1B_HUMAN)
RCGARGPESRLLEFYLAMPFATPME

SEQ ID NO: 198966 - protein, 13 aa, Homo sapiens
  Native (CTG1B_HUMAN)
RGAGAARASGPGG

SEQ ID NO: 198967 - protein, 14 aa, Homo sapiens
  Native (CTG1B_HUMAN)
RGAGAARASGPGGG

SEQ ID NO: 198968 - protein, 15 aa, Homo sapiens
  Native (CTG1B_HUMAN)
RGAGAARASGPGGGA

SEQ ID NO: 198969 - protein, 16 aa, Homo sapiens
  Native (CTG1B_HUMAN)
RGAGAARASGPGGGAP

SEQ ID NO: 198970 - protein, 17 aa, Homo sapiens
  Native (CTG1B_HUMAN)
RGAGAARASGPGGGAPR

SEQ ID NO: 198971 - protein, 18 aa, Homo sapiens
  Native (CTG1B_HUMAN)
RGAGAARASGPGGGAPRG

SEQ ID NO: 198972 - protein, 19 aa, Homo sapiens
  Native (CTG1B_HUMAN)
RGAGAARASGPGGGAPRGP

SEQ ID NO: 198973 - protein, 20 aa, Homo sapiens
  Native (CTG1B_HUMAN)
RGAGAARASGPGGGAPRGPH

SEQ ID NO: 198974 - protein, 21 aa, Homo sapiens
  Native (CTG1B_HUMAN)
RGAGAARASGPGGGAPRGPHG

SEQ ID NO: 198975 - protein, 22 aa, Homo sapiens
  Native (CTG1B_HUMAN)
RGAGAARASGPGGGAPRGPHGG

SEQ ID NO: 198976 - protein, 23 aa, Homo sapiens
  Native (CTG1B_HUMAN)
RGAGAARASGPGGGAPRGPHGGA

SEQ ID NO: 198977 - protein, 24 aa, Homo sapiens
  Native (CTG1B_HUMAN)
RGAGAARASGPGGGAPRGPHGGAA

SEQ ID NO: 198978 - protein, 25 aa, Homo sapiens
  Native (CTG1B_HUMAN)
RGAGAARASGPGGGAPRGPHGGAAS

SEQ ID NO: 198979 - protein, 14 aa, Homo sapiens
  Native (CTG1B_HUMAN)
RGPESRLLEFYLAM

SEQ ID NO: 198980 - protein, 15 aa, Homo sapiens
  Native (CTG1B_HUMAN)
RGPESRLLEFYLAMP

SEQ ID NO: 198981 - protein, 16 aa, Homo sapiens
  Native (CTG1B_HUMAN)
RGPESRLLEFYLAMPF

SEQ ID NO: 198982 - protein, 17 aa, Homo sapiens
  Native (CTG1B_HUMAN)
RGPESRLLEFYLAMPFA

SEQ ID NO: 198983 - protein, 18 aa, Homo sapiens
  Native (CTG1B_HUMAN)
RGPESRLLEFYLAMPFAT

SEQ ID NO: 198984 - protein, 19 aa, Homo sapiens
  Native (CTG1B_HUMAN)
RGPESRLLEFYLAMPFATP

SEQ ID NO: 198985 - protein, 20 aa, Homo sapiens
  Native (CTG1B_HUMAN)
RGPESRLLEFYLAMPFATPM

SEQ ID NO: 198986 - protein, 21 aa, Homo sapiens
  Native (CTG1B_HUMAN)
RGPESRLLEFYLAMPFATPME

SEQ ID NO: 198987 - protein, 22 aa, Homo sapiens
  Native (CTG1B_HUMAN)
RGPESRLLEFYLAMPFATPMEA

SEQ ID NO: 198988 - protein, 23 aa, Homo sapiens
  Native (CTG1B_HUMAN)
RGPESRLLEFYLAMPFATPMEAE

SEQ ID NO: 198989 - protein, 24 aa, Homo sapiens
  Native (CTG1B_HUMAN)
RGPESRLLEFYLAMPFATPMEAEL

SEQ ID NO: 198990 - protein, 25 aa, Homo sapiens
  Native (CTG1B_HUMAN)
RGPESRLLEFYLAMPFATPMEAELA

SEQ ID NO: 198991 - protein, 13 aa, Homo sapiens
  Native (CTG1B_HUMAN)
RGPHGGAASGLNG

SEQ ID NO: 198992 - protein, 14 aa, Homo sapiens
  Native (CTG1B_HUMAN)
RGPHGGAASGLNGC

SEQ ID NO: 198993 - protein, 16 aa, Homo sapiens
  Native (CTG1B_HUMAN)
RGPHGGAASGLNGCCR

SEQ ID NO: 198994 - protein, 17 aa, Homo sapiens
  Native (CTG1B_HUMAN)
RGPHGGAASGLNGCCRC

SEQ ID NO: 198995 - protein, 18 aa, Homo sapiens
  Native (CTG1B_HUMAN)
RGPHGGAASGLNGCCRCG

SEQ ID NO: 198996 - protein, 19 aa, Homo sapiens
  Native (CTG1B_HUMAN)
RGPHGGAASGLNGCCRCGA

SEQ ID NO: 198997 - protein, 20 aa, Homo sapiens
  Native (CTG1B_HUMAN)
RGPHGGAASGLNGCCRCGAR

SEQ ID NO: 198998 - protein, 21 aa, Homo sapiens
  Native (CTG1B_HUMAN)
RGPHGGAASGLNGCCRCGARG

SEQ ID NO: 198999 - protein, 22 aa, Homo sapiens
  Native (CTG1B_HUMAN)
RGPHGGAASGLNGCCRCGARGP

SEQ ID NO: 199000 - protein, 23 aa, Homo sapiens
  Native (CTG1B_HUMAN)
RGPHGGAASGLNGCCRCGARGPE

SEQ ID NO: 199001 - protein, 24 aa, Homo sapiens
  Native (CTG1B_HUMAN)
RGPHGGAASGLNGCCRCGARGPES

SEQ ID NO: 199002 - protein, 25 aa, Homo sapiens
  Native (CTG1B_HUMAN)
RGPHGGAASGLNGCCRCGARGPESR

SEQ ID NO: 199003 - protein, 13 aa, Homo sapiens
  Native (CTG1B_HUMAN)
RGPRGAGAARASG

SEQ ID NO: 199004 - protein, 14 aa, Homo sapiens
  Native (CTG1B_HUMAN)
RGPRGAGAARASGP

SEQ ID NO: 199005 - protein, 15 aa, Homo sapiens
  Native (CTG1B_HUMAN)
RGPRGAGAARASGPG

SEQ ID NO: 199006 - protein, 16 aa, Homo sapiens
  Native (CTG1B_HUMAN)
RGPRGAGAARASGPGG

SEQ ID NO: 199007 - protein, 17 aa, Homo sapiens
  Native (CTG1B_HUMAN)
RGPRGAGAARASGPGGG

SEQ ID NO: 199008 - protein, 18 aa, Homo sapiens
  Native (CTG1B_HUMAN)
RGPRGAGAARASGPGGGA

SEQ ID NO: 199009 - protein, 19 aa, Homo sapiens
  Native (CTG1B_HUMAN)
RGPRGAGAARASGPGGGAP

SEQ ID NO: 199010 - protein, 20 aa, Homo sapiens
  Native (CTG1B_HUMAN)
RGPRGAGAARASGPGGGAPR

SEQ ID NO: 199011 - protein, 21 aa, Homo sapiens
  Native (CTG1B_HUMAN)
RGPRGAGAARASGPGGGAPRG

SEQ ID NO: 199012 - protein, 22 aa, Homo sapiens
  Native (CTG1B_HUMAN)
RGPRGAGAARASGPGGGAPRGP

SEQ ID NO: 199013 - protein, 23 aa, Homo sapiens
  Native (CTG1B_HUMAN)
RGPRGAGAARASGPGGGAPRGPH

SEQ ID NO: 199014 - protein, 24 aa, Homo sapiens
  Native (CTG1B_HUMAN)
RGPRGAGAARASGPGGGAPRGPHG

SEQ ID NO: 199015 - protein, 25 aa, Homo sapiens
  Native (CTG1B_HUMAN)
RGPRGAGAARASGPGGGAPRGPHGG

SEQ ID NO: 199016 - protein, 13 aa, Homo sapiens
  Native (CTG1B_HUMAN)
RLLEFYLAMPFAT

SEQ ID NO: 199017 - protein, 14 aa, Homo sapiens
  Native (CTG1B_HUMAN)
RLLEFYLAMPFATP

SEQ ID NO: 199018 - protein, 15 aa, Homo sapiens
  Native (CTG1B_HUMAN)
RLLEFYLAMPFATPM

SEQ ID NO: 199019 - protein, 16 aa, Homo sapiens
  Native (CTG1B_HUMAN)
RLLEFYLAMPFATPME

SEQ ID NO: 199020 - protein, 17 aa, Homo sapiens
  Native (CTG1B_HUMAN)
RLLEFYLAMPFATPMEA

SEQ ID NO: 199021 - protein, 18 aa, Homo sapiens
  Native (CTG1B_HUMAN)
RLLEFYLAMPFATPMEAE

SEQ ID NO: 199022 - protein, 19 aa, Homo sapiens
  Native (CTG1B_HUMAN)
RLLEFYLAMPFATPMEAEL

SEQ ID NO: 199023 - protein, 20 aa, Homo sapiens
  Native (CTG1B_HUMAN)
RLLEFYLAMPFATPMEAELA

SEQ ID NO: 199024 - protein, 21 aa, Homo sapiens
  Native (CTG1B_HUMAN)
RLLEFYLAMPFATPMEAELAR

SEQ ID NO: 199025 - protein, 22 aa, Homo sapiens
  Native (CTG1B_HUMAN)
RLLEFYLAMPFATPMEAELARR

SEQ ID NO: 199026 - protein, 23 aa, Homo sapiens
  Native (CTG1B_HUMAN)
RLLEFYLAMPFATPMEAELARRS

SEQ ID NO: 199027 - protein, 24 aa, Homo sapiens
  Native (CTG1B_HUMAN)
RLLEFYLAMPFATPMEAELARRSL

SEQ ID NO: 199028 - protein, 25 aa, Homo sapiens
  Native (CTG1B_HUMAN)
RLLEFYLAMPFATPMEAELARRSLA

SEQ ID NO: 199029 - protein, 15 aa, Homo sapiens
  Native (CTG1B_HUMAN)
RLTAADHRQLQLSIS

SEQ ID NO: 199030 - protein, 17 aa, Homo sapiens
  Native (CTG1B_HUMAN)
RLTAADHRQLQLSISSC

SEQ ID NO: 199031 - protein, 18 aa, Homo sapiens
  Native (CTG1B_HUMAN)
RLTAADHRQLQLSISSCL

SEQ ID NO: 199032 - protein, 19 aa, Homo sapiens
  Native (CTG1B_HUMAN)
RLTAADHRQLQLSISSCLQ

SEQ ID NO: 199033 - protein, 20 aa, Homo sapiens
  Native (CTG1B_HUMAN)
RLTAADHRQLQLSISSCLQQ

SEQ ID NO: 199034 - protein, 21 aa, Homo sapiens
  Native (CTG1B_HUMAN)
RLTAADHRQLQLSISSCLQQL

SEQ ID NO: 199035 - protein, 22 aa, Homo sapiens
  Native (CTG1B_HUMAN)
RLTAADHRQLQLSISSCLQQLS

SEQ ID NO: 199036 - protein, 23 aa, Homo sapiens
  Native (CTG1B_HUMAN)
RLTAADHRQLQLSISSCLQQLSL

SEQ ID NO: 199037 - protein, 24 aa, Homo sapiens
  Native (CTG1B_HUMAN)
RLTAADHRQLQLSISSCLQQLSLL

SEQ ID NO: 199038 - protein, 25 aa, Homo sapiens
  Native (CTG1B_HUMAN)
RLTAADHRQLQLSISSCLQQLSLLM

SEQ ID NO: 199039 - protein, 13 aa, Homo sapiens
  Native (CTG1B_HUMAN)
RQLQLSISSCLQQ

SEQ ID NO: 199040 - protein, 14 aa, Homo sapiens
  Native (CTG1B_HUMAN)
RQLQLSISSCLQQL

SEQ ID NO: 199041 - protein, 15 aa, Homo sapiens
  Native (CTG1B_HUMAN)
RQLQLSISSCLQQLS

SEQ ID NO: 199042 - protein, 16 aa, Homo sapiens
  Native (CTG1B_HUMAN)
RQLQLSISSCLQQLSL

SEQ ID NO: 199043 - protein, 17 aa, Homo sapiens
  Native (CTG1B_HUMAN)
RQLQLSISSCLQQLSLL

SEQ ID NO: 199044 - protein, 18 aa, Homo sapiens
  Native (CTG1B_HUMAN)
RQLQLSISSCLQQLSLLM

SEQ ID NO: 199045 - protein, 19 aa, Homo sapiens
  Native (CTG1B_HUMAN)
RQLQLSISSCLQQLSLLMW

SEQ ID NO: 199046 - protein, 20 aa, Homo sapiens
  Native (CTG1B_HUMAN)
RQLQLSISSCLQQLSLLMWI

SEQ ID NO: 199047 - protein, 21 aa, Homo sapiens
  Native (CTG1B_HUMAN)
RQLQLSISSCLQQLSLLMWIT

SEQ ID NO: 199048 - protein, 22 aa, Homo sapiens
  Native (CTG1B_HUMAN)
RQLQLSISSCLQQLSLLMWITQ

SEQ ID NO: 199049 - protein, 23 aa, Homo sapiens
  Native (CTG1B_HUMAN)
RQLQLSISSCLQQLSLLMWITQC

SEQ ID NO: 199050 - protein, 24 aa, Homo sapiens
  Native (CTG1B_HUMAN)
RQLQLSISSCLQQLSLLMWITQCF

SEQ ID NO: 199051 - protein, 25 aa, Homo sapiens
  Native (CTG1B_HUMAN)
RQLQLSISSCLQQLSLLMWITQCFL

SEQ ID NO: 199052 - protein, 24 aa, Homo sapiens
  Native (CTG1B_HUMAN)
RRSLAQDAPPLPVPGVLLKEFTVS

SEQ ID NO: 199053 - protein, 25 aa, Homo sapiens
  Native (CTG1B_HUMAN)
RRSLAQDAPPLPVPGVLLKEFTVSG

SEQ ID NO: 199054 - protein, 15 aa, Homo sapiens
  Native (CTG1B_HUMAN)
RSLAQDAPPLPVPGV

SEQ ID NO: 199055 - protein, 20 aa, Homo sapiens
  Native (CTG1B_HUMAN)
RSLAQDAPPLPVPGVLLKEF

SEQ ID NO: 199056 - protein, 23 aa, Homo sapiens
  Native (CTG1B_HUMAN)
RSLAQDAPPLPVPGVLLKEFTVS

SEQ ID NO: 199057 - protein, 24 aa, Homo sapiens
  Native (CTG1B_HUMAN)
RSLAQDAPPLPVPGVLLKEFTVSG

SEQ ID NO: 199058 - protein, 25 aa, Homo sapiens
  Native (CTG1B_HUMAN)
RSLAQDAPPLPVPGVLLKEFTVSGN

SEQ ID NO: 199059 - protein, 13 aa, Homo sapiens
  Native (CTG1B_HUMAN)
SCLQQLSLLMWIT

SEQ ID NO: 199060 - protein, 14 aa, Homo sapiens
  Native (CTG1B_HUMAN)
SCLQQLSLLMWITQ

SEQ ID NO: 199061 - protein, 15 aa, Homo sapiens
  Native (CTG1B_HUMAN)
SCLQQLSLLMWITQC

SEQ ID NO: 199062 - protein, 16 aa, Homo sapiens
  Native (CTG1B_HUMAN)
SCLQQLSLLMWITQCF

SEQ ID NO: 199063 - protein, 17 aa, Homo sapiens
  Native (CTG1B_HUMAN)
SCLQQLSLLMWITQCFL

SEQ ID NO: 199064 - protein, 18 aa, Homo sapiens
  Native (CTG1B_HUMAN)
SCLQQLSLLMWITQCFLP

SEQ ID NO: 199065 - protein, 19 aa, Homo sapiens
  Native (CTG1B_HUMAN)
SCLQQLSLLMWITQCFLPV

SEQ ID NO: 199066 - protein, 20 aa, Homo sapiens
  Native (CTG1B_HUMAN)
SCLQQLSLLMWITQCFLPVF

SEQ ID NO: 199067 - protein, 21 aa, Homo sapiens
  Native (CTG1B_HUMAN)
SCLQQLSLLMWITQCFLPVFL

SEQ ID NO: 199068 - protein, 22 aa, Homo sapiens
  Native (CTG1B_HUMAN)
SCLQQLSLLMWITQCFLPVFLA

SEQ ID NO: 199069 - protein, 23 aa, Homo sapiens
  Native (CTG1B_HUMAN)
SCLQQLSLLMWITQCFLPVFLAQ

SEQ ID NO: 199070 - protein, 24 aa, Homo sapiens
  Native (CTG1B_HUMAN)
SCLQQLSLLMWITQCFLPVFLAQP

SEQ ID NO: 199071 - protein, 25 aa, Homo sapiens
  Native (CTG1B_HUMAN)
SCLQQLSLLMWITQCFLPVFLAQPP

SEQ ID NO: 199072 - protein, 25 aa, Homo sapiens
  Native (CTG1B_HUMAN)
SGLNGCCRCGARGPESRLLEFYLAM

SEQ ID NO: 199073 - protein, 13 aa, Homo sapiens
  Native (CTG1B_HUMAN)
SGNILTIRLTAAD

SEQ ID NO: 199074 - protein, 14 aa, Homo sapiens
  Native (CTG1B_HUMAN)
SGNILTIRLTAADH

SEQ ID NO: 199075 - protein, 15 aa, Homo sapiens
  Native (CTG1B_HUMAN)
SGNILTIRLTAADHR

SEQ ID NO: 199076 - protein, 16 aa, Homo sapiens
  Native (CTG1B_HUMAN)
SGNILTIRLTAADHRQ

SEQ ID NO: 199077 - protein, 17 aa, Homo sapiens
  Native (CTG1B_HUMAN)
SGNILTIRLTAADHRQL

SEQ ID NO: 199078 - protein, 18 aa, Homo sapiens
  Native (CTG1B_HUMAN)
SGNILTIRLTAADHRQLQ

SEQ ID NO: 199079 - protein, 19 aa, Homo sapiens
  Native (CTG1B_HUMAN)
SGNILTIRLTAADHRQLQL

SEQ ID NO: 199080 - protein, 20 aa, Homo sapiens
  Native (CTG1B_HUMAN)
SGNILTIRLTAADHRQLQLS

SEQ ID NO: 199081 - protein, 21 aa, Homo sapiens
  Native (CTG1B_HUMAN)
SGNILTIRLTAADHRQLQLSI

SEQ ID NO: 199082 - protein, 22 aa, Homo sapiens
  Native (CTG1B_HUMAN)
SGNILTIRLTAADHRQLQLSIS

SEQ ID NO: 199083 - protein, 23 aa, Homo sapiens
  Native (CTG1B_HUMAN)
SGNILTIRLTAADHRQLQLSISS

SEQ ID NO: 199084 - protein, 24 aa, Homo sapiens
  Native (CTG1B_HUMAN)
SGNILTIRLTAADHRQLQLSISSC

SEQ ID NO: 199085 - protein, 25 aa, Homo sapiens
  Native (CTG1B_HUMAN)
SGNILTIRLTAADHRQLQLSISSCL

SEQ ID NO: 199086 - protein, 15 aa, Homo sapiens
  Native (CTG1B_HUMAN)
SGPGGGAPRGPHGGA

SEQ ID NO: 199087 - protein, 19 aa, Homo sapiens
  Native (CTG1B_HUMAN)
SGPGGGAPRGPHGGAASGL

SEQ ID NO: 199088 - protein, 20 aa, Homo sapiens
  Native (CTG1B_HUMAN)
SGPGGGAPRGPHGGAASGLN

SEQ ID NO: 199089 - protein, 21 aa, Homo sapiens
  Native (CTG1B_HUMAN)
SGPGGGAPRGPHGGAASGLNG

SEQ ID NO: 199090 - protein, 22 aa, Homo sapiens
  Native (CTG1B_HUMAN)
SGPGGGAPRGPHGGAASGLNGC

SEQ ID NO: 199091 - protein, 23 aa, Homo sapiens
  Native (CTG1B_HUMAN)
SGPGGGAPRGPHGGAASGLNGCC

SEQ ID NO: 199092 - protein, 24 aa, Homo sapiens
  Native (CTG1B_HUMAN)
SGPGGGAPRGPHGGAASGLNGCCR

SEQ ID NO: 199093 - protein, 25 aa, Homo sapiens
  Native (CTG1B_HUMAN)
SGPGGGAPRGPHGGAASGLNGCCRC

SEQ ID NO: 199094 - protein, 13 aa, Homo sapiens
  Native (CTG1B_HUMAN)
SISSCLQQLSLLM

SEQ ID NO: 199095 - protein, 14 aa, Homo sapiens
  Native (CTG1B_HUMAN)
SISSCLQQLSLLMW

SEQ ID NO: 199096 - protein, 15 aa, Homo sapiens
  Native (CTG1B_HUMAN)
SISSCLQQLSLLMWI

SEQ ID NO: 199097 - protein, 16 aa, Homo sapiens
  Native (CTG1B_HUMAN)
SISSCLQQLSLLMWIT

SEQ ID NO: 199098 - protein, 17 aa, Homo sapiens
  Native (CTG1B_HUMAN)
SISSCLQQLSLLMWITQ

SEQ ID NO: 199099 - protein, 18 aa, Homo sapiens
  Native (CTG1B_HUMAN)
SISSCLQQLSLLMWITQC

SEQ ID NO: 199100 - protein, 19 aa, Homo sapiens
  Native (CTG1B_HUMAN)
SISSCLQQLSLLMWITQCF

SEQ ID NO: 199101 - protein, 20 aa, Homo sapiens
  Native (CTG1B_HUMAN)
SISSCLQQLSLLMWITQCFL

SEQ ID NO: 199102 - protein, 21 aa, Homo sapiens
  Native (CTG1B_HUMAN)
SISSCLQQLSLLMWITQCFLP

SEQ ID NO: 199103 - protein, 22 aa, Homo sapiens
  Native (CTG1B_HUMAN)
SISSCLQQLSLLMWITQCFLPV

SEQ ID NO: 199104 - protein, 23 aa, Homo sapiens
  Native (CTG1B_HUMAN)
SISSCLQQLSLLMWITQCFLPVF

SEQ ID NO: 199105 - protein, 24 aa, Homo sapiens
  Native (CTG1B_HUMAN)
SISSCLQQLSLLMWITQCFLPVFL

SEQ ID NO: 199106 - protein, 25 aa, Homo sapiens
  Native (CTG1B_HUMAN)
SISSCLQQLSLLMWITQCFLPVFLA

SEQ ID NO: 199107 - protein, 15 aa, Homo sapiens
  Native (CTG1B_HUMAN)
SLAQDAPPLPVPGVL

SEQ ID NO: 199108 - protein, 23 aa, Homo sapiens
  Native (CTG1B_HUMAN)
SLAQDAPPLPVPGVLLKEFTVSG

SEQ ID NO: 199109 - protein, 24 aa, Homo sapiens
  Native (CTG1B_HUMAN)
SLAQDAPPLPVPGVLLKEFTVSGN

SEQ ID NO: 199110 - protein, 25 aa, Homo sapiens
  Native (CTG1B_HUMAN)
SLAQDAPPLPVPGVLLKEFTVSGNI

SEQ ID NO: 199111 - protein, 13 aa, Homo sapiens
  Native (CTG1B_HUMAN)
SLLMWITQCFLPV

SEQ ID NO: 199112 - protein, 14 aa, Homo sapiens
  Native (CTG1B_HUMAN)
SLLMWITQCFLPVF

SEQ ID NO: 199113 - protein, 15 aa, Homo sapiens
  Native (CTG1B_HUMAN)
SLLMWITQCFLPVFL

SEQ ID NO: 199114 - protein, 16 aa, Homo sapiens
  Native (CTG1B_HUMAN)
SLLMWITQCFLPVFLA

SEQ ID NO: 199115 - protein, 17 aa, Homo sapiens
  Native (CTG1B_HUMAN)
SLLMWITQCFLPVFLAQ

SEQ ID NO: 199116 - protein, 18 aa, Homo sapiens
  Native (CTG1B_HUMAN)
SLLMWITQCFLPVFLAQP

SEQ ID NO: 199117 - protein, 19 aa, Homo sapiens
  Native (CTG1B_HUMAN)
SLLMWITQCFLPVFLAQPP

SEQ ID NO: 199118 - protein, 20 aa, Homo sapiens
  Native (CTG1B_HUMAN)
SLLMWITQCFLPVFLAQPPS

SEQ ID NO: 199119 - protein, 21 aa, Homo sapiens
  Native (CTG1B_HUMAN)
SLLMWITQCFLPVFLAQPPSG

SEQ ID NO: 199120 - protein, 22 aa, Homo sapiens
  Native (CTG1B_HUMAN)
SLLMWITQCFLPVFLAQPPSGQ

SEQ ID NO: 199121 - protein, 23 aa, Homo sapiens
  Native (CTG1B_HUMAN)
SLLMWITQCFLPVFLAQPPSGQR

SEQ ID NO: 199122 - protein, 24 aa, Homo sapiens
  Native (CTG1B_HUMAN)
SLLMWITQCFLPVFLAQPPSGQRR

SEQ ID NO: 199123 - protein, 13 aa, Homo sapiens
  Native (CTG1B_HUMAN)
SRLLEFYLAMPFA

SEQ ID NO: 199124 - protein, 14 aa, Homo sapiens
  Native (CTG1B_HUMAN)
SRLLEFYLAMPFAT

SEQ ID NO: 199125 - protein, 16 aa, Homo sapiens
  Native (CTG1B_HUMAN)
SRLLEFYLAMPFATPM

SEQ ID NO: 199126 - protein, 17 aa, Homo sapiens
  Native (CTG1B_HUMAN)
SRLLEFYLAMPFATPME

SEQ ID NO: 199127 - protein, 18 aa, Homo sapiens
  Native (CTG1B_HUMAN)
SRLLEFYLAMPFATPMEA

SEQ ID NO: 199128 - protein, 19 aa, Homo sapiens
  Native (CTG1B_HUMAN)
SRLLEFYLAMPFATPMEAE

SEQ ID NO: 199129 - protein, 20 aa, Homo sapiens
  Native (CTG1B_HUMAN)
SRLLEFYLAMPFATPMEAEL

SEQ ID NO: 199130 - protein, 21 aa, Homo sapiens
  Native (CTG1B_HUMAN)
SRLLEFYLAMPFATPMEAELA

SEQ ID NO: 199131 - protein, 22 aa, Homo sapiens
  Native (CTG1B_HUMAN)
SRLLEFYLAMPFATPMEAELAR

SEQ ID NO: 199132 - protein, 23 aa, Homo sapiens
  Native (CTG1B_HUMAN)
SRLLEFYLAMPFATPMEAELARR

SEQ ID NO: 199133 - protein, 24 aa, Homo sapiens
  Native (CTG1B_HUMAN)
SRLLEFYLAMPFATPMEAELARRS

SEQ ID NO: 199134 - protein, 25 aa, Homo sapiens
  Native (CTG1B_HUMAN)
SRLLEFYLAMPFATPMEAELARRSL

SEQ ID NO: 199135 - protein, 13 aa, Homo sapiens
  Native (CTG1B_HUMAN)
SSCLQQLSLLMWI

SEQ ID NO: 199136 - protein, 14 aa, Homo sapiens
  Native (CTG1B_HUMAN)
SSCLQQLSLLMWIT

SEQ ID NO: 199137 - protein, 15 aa, Homo sapiens
  Native (CTG1B_HUMAN)
SSCLQQLSLLMWITQ

SEQ ID NO: 199138 - protein, 16 aa, Homo sapiens
  Native (CTG1B_HUMAN)
SSCLQQLSLLMWITQC

SEQ ID NO: 199139 - protein, 17 aa, Homo sapiens
  Native (CTG1B_HUMAN)
SSCLQQLSLLMWITQCF

SEQ ID NO: 199140 - protein, 18 aa, Homo sapiens
  Native (CTG1B_HUMAN)
SSCLQQLSLLMWITQCFL

SEQ ID NO: 199141 - protein, 19 aa, Homo sapiens
  Native (CTG1B_HUMAN)
SSCLQQLSLLMWITQCFLP

SEQ ID NO: 199142 - protein, 20 aa, Homo sapiens
  Native (CTG1B_HUMAN)
SSCLQQLSLLMWITQCFLPV

SEQ ID NO: 199143 - protein, 21 aa, Homo sapiens
  Native (CTG1B_HUMAN)
SSCLQQLSLLMWITQCFLPVF

SEQ ID NO: 199144 - protein, 22 aa, Homo sapiens
  Native (CTG1B_HUMAN)
SSCLQQLSLLMWITQCFLPVFL

SEQ ID NO: 199145 - protein, 23 aa, Homo sapiens
  Native (CTG1B_HUMAN)
SSCLQQLSLLMWITQCFLPVFLA

SEQ ID NO: 199146 - protein, 24 aa, Homo sapiens
  Native (CTG1B_HUMAN)
SSCLQQLSLLMWITQCFLPVFLAQ

SEQ ID NO: 199147 - protein, 25 aa, Homo sapiens
  Native (CTG1B_HUMAN)
SSCLQQLSLLMWITQCFLPVFLAQP

SEQ ID NO: 199148 - protein, 15 aa, Homo sapiens
  Native (CTG1B_HUMAN)
TAADHRQLQLSISSC

SEQ ID NO: 199149 - protein, 16 aa, Homo sapiens
  Native (CTG1B_HUMAN)
TAADHRQLQLSISSCL

SEQ ID NO: 199150 - protein, 17 aa, Homo sapiens
  Native (CTG1B_HUMAN)
TAADHRQLQLSISSCLQ

SEQ ID NO: 199151 - protein, 18 aa, Homo sapiens
  Native (CTG1B_HUMAN)
TAADHRQLQLSISSCLQQ

SEQ ID NO: 199152 - protein, 19 aa, Homo sapiens
  Native (CTG1B_HUMAN)
TAADHRQLQLSISSCLQQL

SEQ ID NO: 199153 - protein, 20 aa, Homo sapiens
  Native (CTG1B_HUMAN)
TAADHRQLQLSISSCLQQLS

SEQ ID NO: 199154 - protein, 21 aa, Homo sapiens
  Native (CTG1B_HUMAN)
TAADHRQLQLSISSCLQQLSL

SEQ ID NO: 199155 - protein, 22 aa, Homo sapiens
  Native (CTG1B_HUMAN)
TAADHRQLQLSISSCLQQLSLL

SEQ ID NO: 199156 - protein, 23 aa, Homo sapiens
  Native (CTG1B_HUMAN)
TAADHRQLQLSISSCLQQLSLLM

SEQ ID NO: 199157 - protein, 24 aa, Homo sapiens
  Native (CTG1B_HUMAN)
TAADHRQLQLSISSCLQQLSLLMW

SEQ ID NO: 199158 - protein, 25 aa, Homo sapiens
  Native (CTG1B_HUMAN)
TAADHRQLQLSISSCLQQLSLLMWI

SEQ ID NO: 199159 - protein, 14 aa, Homo sapiens
  Native (CTG1B_HUMAN)
TGGRGPRGAGAARA

SEQ ID NO: 199160 - protein, 15 aa, Homo sapiens
  Native (CTG1B_HUMAN)
TGGRGPRGAGAARAS

SEQ ID NO: 199161 - protein, 16 aa, Homo sapiens
  Native (CTG1B_HUMAN)
TGGRGPRGAGAARASG

SEQ ID NO: 199162 - protein, 17 aa, Homo sapiens
  Native (CTG1B_HUMAN)
TGGRGPRGAGAARASGP

SEQ ID NO: 199163 - protein, 18 aa, Homo sapiens
  Native (CTG1B_HUMAN)
TGGRGPRGAGAARASGPG

SEQ ID NO: 199164 - protein, 19 aa, Homo sapiens
  Native (CTG1B_HUMAN)
TGGRGPRGAGAARASGPGG

SEQ ID NO: 199165 - protein, 20 aa, Homo sapiens
  Native (CTG1B_HUMAN)
TGGRGPRGAGAARASGPGGG

SEQ ID NO: 199166 - protein, 21 aa, Homo sapiens
  Native (CTG1B_HUMAN)
TGGRGPRGAGAARASGPGGGA

SEQ ID NO: 199167 - protein, 22 aa, Homo sapiens
  Native (CTG1B_HUMAN)
TGGRGPRGAGAARASGPGGGAP

SEQ ID NO: 199168 - protein, 23 aa, Homo sapiens
  Native (CTG1B_HUMAN)
TGGRGPRGAGAARASGPGGGAPR

SEQ ID NO: 199169 - protein, 24 aa, Homo sapiens
  Native (CTG1B_HUMAN)
TGGRGPRGAGAARASGPGGGAPRG

SEQ ID NO: 199170 - protein, 25 aa, Homo sapiens
  Native (CTG1B_HUMAN)
TGGRGPRGAGAARASGPGGGAPRGP

SEQ ID NO: 199171 - protein, 14 aa, Homo sapiens
  Native (CTG1B_HUMAN)
TIRLTAADHRQLQL

SEQ ID NO: 199172 - protein, 15 aa, Homo sapiens
  Native (CTG1B_HUMAN)
TIRLTAADHRQLQLS

SEQ ID NO: 199173 - protein, 16 aa, Homo sapiens
  Native (CTG1B_HUMAN)
TIRLTAADHRQLQLSI

SEQ ID NO: 199174 - protein, 17 aa, Homo sapiens
  Native (CTG1B_HUMAN)
TIRLTAADHRQLQLSIS

SEQ ID NO: 199175 - protein, 19 aa, Homo sapiens
  Native (CTG1B_HUMAN)
TIRLTAADHRQLQLSISSC

SEQ ID NO: 199176 - protein, 20 aa, Homo sapiens
  Native (CTG1B_HUMAN)
TIRLTAADHRQLQLSISSCL

SEQ ID NO: 199177 - protein, 21 aa, Homo sapiens
  Native (CTG1B_HUMAN)
TIRLTAADHRQLQLSISSCLQ

SEQ ID NO: 199178 - protein, 22 aa, Homo sapiens
  Native (CTG1B_HUMAN)
TIRLTAADHRQLQLSISSCLQQ

SEQ ID NO: 199179 - protein, 23 aa, Homo sapiens
  Native (CTG1B_HUMAN)
TIRLTAADHRQLQLSISSCLQQL

SEQ ID NO: 199180 - protein, 24 aa, Homo sapiens
  Native (CTG1B_HUMAN)
TIRLTAADHRQLQLSISSCLQQLS

SEQ ID NO: 199181 - protein, 25 aa, Homo sapiens
  Native (CTG1B_HUMAN)
TIRLTAADHRQLQLSISSCLQQLSL

SEQ ID NO: 199182 - protein, 14 aa, Homo sapiens
  Native (CTG1B_HUMAN)
TPMEAELARRSLAQ

SEQ ID NO: 199183 - protein, 15 aa, Homo sapiens
  Native (CTG1B_HUMAN)
TPMEAELARRSLAQD

SEQ ID NO: 199184 - protein, 16 aa, Homo sapiens
  Native (CTG1B_HUMAN)
TPMEAELARRSLAQDA

SEQ ID NO: 199185 - protein, 17 aa, Homo sapiens
  Native (CTG1B_HUMAN)
TPMEAELARRSLAQDAP

SEQ ID NO: 199186 - protein, 18 aa, Homo sapiens
  Native (CTG1B_HUMAN)
TPMEAELARRSLAQDAPP

SEQ ID NO: 199187 - protein, 19 aa, Homo sapiens
  Native (CTG1B_HUMAN)
TPMEAELARRSLAQDAPPL

SEQ ID NO: 199188 - protein, 20 aa, Homo sapiens
  Native (CTG1B_HUMAN)
TPMEAELARRSLAQDAPPLP

SEQ ID NO: 199189 - protein, 21 aa, Homo sapiens
  Native (CTG1B_HUMAN)
TPMEAELARRSLAQDAPPLPV

SEQ ID NO: 199190 - protein, 22 aa, Homo sapiens
  Native (CTG1B_HUMAN)
TPMEAELARRSLAQDAPPLPVP

SEQ ID NO: 199191 - protein, 23 aa, Homo sapiens
  Native (CTG1B_HUMAN)
TPMEAELARRSLAQDAPPLPVPG

SEQ ID NO: 199192 - protein, 24 aa, Homo sapiens
  Native (CTG1B_HUMAN)
TPMEAELARRSLAQDAPPLPVPGV

SEQ ID NO: 199193 - protein, 25 aa, Homo sapiens
  Native (CTG1B_HUMAN)
TPMEAELARRSLAQDAPPLPVPGVL

SEQ ID NO: 199194 - protein, 13 aa, Homo sapiens
  Native (CTG1B_HUMAN)
TQCFLPVFLAQPP

SEQ ID NO: 199195 - protein, 14 aa, Homo sapiens
  Native (CTG1B_HUMAN)
TQCFLPVFLAQPPS

SEQ ID NO: 199196 - protein, 15 aa, Homo sapiens
  Native (CTG1B_HUMAN)
TQCFLPVFLAQPPSG

SEQ ID NO: 199197 - protein, 16 aa, Homo sapiens
  Native (CTG1B_HUMAN)
TQCFLPVFLAQPPSGQ

SEQ ID NO: 199198 - protein, 17 aa, Homo sapiens
  Native (CTG1B_HUMAN)
TQCFLPVFLAQPPSGQR

SEQ ID NO: 199199 - protein, 18 aa, Homo sapiens
  Native (CTG1B_HUMAN)
TQCFLPVFLAQPPSGQRR

SEQ ID NO: 199200 - protein, 14 aa, Homo sapiens
  Native (CTG1B_HUMAN)
TVSGNILTIRLTAA

SEQ ID NO: 199201 - protein, 15 aa, Homo sapiens
  Native (CTG1B_HUMAN)
TVSGNILTIRLTAAD

SEQ ID NO: 199202 - protein, 16 aa, Homo sapiens
  Native (CTG1B_HUMAN)
TVSGNILTIRLTAADH

SEQ ID NO: 199203 - protein, 17 aa, Homo sapiens
  Native (CTG1B_HUMAN)
TVSGNILTIRLTAADHR

SEQ ID NO: 199204 - protein, 18 aa, Homo sapiens
  Native (CTG1B_HUMAN)
TVSGNILTIRLTAADHRQ

SEQ ID NO: 199205 - protein, 19 aa, Homo sapiens
  Native (CTG1B_HUMAN)
TVSGNILTIRLTAADHRQL

SEQ ID NO: 199206 - protein, 20 aa, Homo sapiens
  Native (CTG1B_HUMAN)
TVSGNILTIRLTAADHRQLQ

SEQ ID NO: 199207 - protein, 21 aa, Homo sapiens
  Native (CTG1B_HUMAN)
TVSGNILTIRLTAADHRQLQL

SEQ ID NO: 199208 - protein, 22 aa, Homo sapiens
  Native (CTG1B_HUMAN)
TVSGNILTIRLTAADHRQLQLS

SEQ ID NO: 199209 - protein, 23 aa, Homo sapiens
  Native (CTG1B_HUMAN)
TVSGNILTIRLTAADHRQLQLSI

SEQ ID NO: 199210 - protein, 24 aa, Homo sapiens
  Native (CTG1B_HUMAN)
TVSGNILTIRLTAADHRQLQLSIS

SEQ ID NO: 199211 - protein, 25 aa, Homo sapiens
  Native (CTG1B_HUMAN)
TVSGNILTIRLTAADHRQLQLSISS

SEQ ID NO: 199212 - protein, 14 aa, Homo sapiens
  Native (CTG1B_HUMAN)
VLLKEFTVSGNILT

SEQ ID NO: 199213 - protein, 15 aa, Homo sapiens
  Native (CTG1B_HUMAN)
VLLKEFTVSGNILTI

SEQ ID NO: 199214 - protein, 16 aa, Homo sapiens
  Native (CTG1B_HUMAN)
VLLKEFTVSGNILTIR

SEQ ID NO: 199215 - protein, 17 aa, Homo sapiens
  Native (CTG1B_HUMAN)
VLLKEFTVSGNILTIRL

SEQ ID NO: 199216 - protein, 18 aa, Homo sapiens
  Native (CTG1B_HUMAN)
VLLKEFTVSGNILTIRLT

SEQ ID NO: 199217 - protein, 19 aa, Homo sapiens
  Native (CTG1B_HUMAN)
VLLKEFTVSGNILTIRLTA

SEQ ID NO: 199218 - protein, 20 aa, Homo sapiens
  Native (CTG1B_HUMAN)
VLLKEFTVSGNILTIRLTAA

SEQ ID NO: 199219 - protein, 21 aa, Homo sapiens
  Native (CTG1B_HUMAN)
VLLKEFTVSGNILTIRLTAAD

SEQ ID NO: 199220 - protein, 22 aa, Homo sapiens
  Native (CTG1B_HUMAN)
VLLKEFTVSGNILTIRLTAADH

SEQ ID NO: 199221 - protein, 23 aa, Homo sapiens
  Native (CTG1B_HUMAN)
VLLKEFTVSGNILTIRLTAADHR

SEQ ID NO: 199222 - protein, 24 aa, Homo sapiens
  Native (CTG1B_HUMAN)
VLLKEFTVSGNILTIRLTAADHRQ

SEQ ID NO: 199223 - protein, 25 aa, Homo sapiens
  Native (CTG1B_HUMAN)
VLLKEFTVSGNILTIRLTAADHRQL

SEQ ID NO: 199224 - protein, 14 aa, Homo sapiens
  Native (CTG1B_HUMAN)
VPGVLLKEFTVSGN

SEQ ID NO: 199225 - protein, 15 aa, Homo sapiens
  Native (CTG1B_HUMAN)
VPGVLLKEFTVSGNI

SEQ ID NO: 199226 - protein, 16 aa, Homo sapiens
  Native (CTG1B_HUMAN)
VPGVLLKEFTVSGNIL

SEQ ID NO: 199227 - protein, 17 aa, Homo sapiens
  Native (CTG1B_HUMAN)
VPGVLLKEFTVSGNILT

SEQ ID NO: 199228 - protein, 18 aa, Homo sapiens
  Native (CTG1B_HUMAN)
VPGVLLKEFTVSGNILTI

SEQ ID NO: 199229 - protein, 19 aa, Homo sapiens
  Native (CTG1B_HUMAN)
VPGVLLKEFTVSGNILTIR

SEQ ID NO: 199230 - protein, 20 aa, Homo sapiens
  Native (CTG1B_HUMAN)
VPGVLLKEFTVSGNILTIRL

SEQ ID NO: 199231 - protein, 21 aa, Homo sapiens
  Native (CTG1B_HUMAN)
VPGVLLKEFTVSGNILTIRLT

SEQ ID NO: 199232 - protein, 22 aa, Homo sapiens
  Native (CTG1B_HUMAN)
VPGVLLKEFTVSGNILTIRLTA

SEQ ID NO: 199233 - protein, 23 aa, Homo sapiens
  Native (CTG1B_HUMAN)
VPGVLLKEFTVSGNILTIRLTAA

SEQ ID NO: 199234 - protein, 24 aa, Homo sapiens
  Native (CTG1B_HUMAN)
VPGVLLKEFTVSGNILTIRLTAAD

SEQ ID NO: 199235 - protein, 25 aa, Homo sapiens
  Native (CTG1B_HUMAN)
VPGVLLKEFTVSGNILTIRLTAADH

SEQ ID NO: 199236 - protein, 13 aa, Homo sapiens
  Native (CTG1B_HUMAN)
VSGNILTIRLTAA

SEQ ID NO: 199237 - protein, 14 aa, Homo sapiens
  Native (CTG1B_HUMAN)
VSGNILTIRLTAAD

SEQ ID NO: 199238 - protein, 15 aa, Homo sapiens
  Native (CTG1B_HUMAN)
VSGNILTIRLTAADH

SEQ ID NO: 199239 - protein, 16 aa, Homo sapiens
  Native (CTG1B_HUMAN)
VSGNILTIRLTAADHR

SEQ ID NO: 199240 - protein, 17 aa, Homo sapiens
  Native (CTG1B_HUMAN)
VSGNILTIRLTAADHRQ

SEQ ID NO: 199241 - protein, 18 aa, Homo sapiens
  Native (CTG1B_HUMAN)
VSGNILTIRLTAADHRQL

SEQ ID NO: 199242 - protein, 19 aa, Homo sapiens
  Native (CTG1B_HUMAN)
VSGNILTIRLTAADHRQLQ

SEQ ID NO: 199243 - protein, 20 aa, Homo sapiens
  Native (CTG1B_HUMAN)
VSGNILTIRLTAADHRQLQL

SEQ ID NO: 199244 - protein, 21 aa, Homo sapiens
  Native (CTG1B_HUMAN)
VSGNILTIRLTAADHRQLQLS

SEQ ID NO: 199245 - protein, 22 aa, Homo sapiens
  Native (CTG1B_HUMAN)
VSGNILTIRLTAADHRQLQLSI

SEQ ID NO: 199246 - protein, 23 aa, Homo sapiens
  Native (CTG1B_HUMAN)
VSGNILTIRLTAADHRQLQLSIS

SEQ ID NO: 199247 - protein, 24 aa, Homo sapiens
  Native (CTG1B_HUMAN)
VSGNILTIRLTAADHRQLQLSISS

SEQ ID NO: 199248 - protein, 25 aa, Homo sapiens
  Native (CTG1B_HUMAN)
VSGNILTIRLTAADHRQLQLSISSC

SEQ ID NO: 199249 - protein, 13 aa, Homo sapiens
  Native (CTG1B_HUMAN)
WITQCFLPVFLAQ

SEQ ID NO: 199250 - protein, 14 aa, Homo sapiens
  Native (CTG1B_HUMAN)
WITQCFLPVFLAQP

SEQ ID NO: 199251 - protein, 15 aa, Homo sapiens
  Native (CTG1B_HUMAN)
WITQCFLPVFLAQPP

SEQ ID NO: 199252 - protein, 16 aa, Homo sapiens
  Native (CTG1B_HUMAN)
WITQCFLPVFLAQPPS

SEQ ID NO: 199253 - protein, 17 aa, Homo sapiens
  Native (CTG1B_HUMAN)
WITQCFLPVFLAQPPSG

SEQ ID NO: 199254 - protein, 18 aa, Homo sapiens
  Native (CTG1B_HUMAN)
WITQCFLPVFLAQPPSGQ

SEQ ID NO: 199255 - protein, 19 aa, Homo sapiens
  Native (CTG1B_HUMAN)
WITQCFLPVFLAQPPSGQR

SEQ ID NO: 199256 - protein, 20 aa, Homo sapiens
  Native (CTG1B_HUMAN)
WITQCFLPVFLAQPPSGQRR

SEQ ID NO: 199257 - protein, 14 aa, Homo sapiens
  Native (CTG1B_HUMAN)
YLAMPFATPMEAEL

SEQ ID NO: 199258 - protein, 15 aa, Homo sapiens
  Native (CTG1B_HUMAN)
YLAMPFATPMEAELA

SEQ ID NO: 199259 - protein, 16 aa, Homo sapiens
  Native (CTG1B_HUMAN)
YLAMPFATPMEAELAR

SEQ ID NO: 199260 - protein, 17 aa, Homo sapiens
  Native (CTG1B_HUMAN)
YLAMPFATPMEAELARR

SEQ ID NO: 199261 - protein, 18 aa, Homo sapiens
  Native (CTG1B_HUMAN)
YLAMPFATPMEAELARRS

SEQ ID NO: 199262 - protein, 19 aa, Homo sapiens
  Native (CTG1B_HUMAN)
YLAMPFATPMEAELARRSL

SEQ ID NO: 199263 - protein, 20 aa, Homo sapiens
  Native (CTG1B_HUMAN)
YLAMPFATPMEAELARRSLA

SEQ ID NO: 199264 - protein, 21 aa, Homo sapiens
  Native (CTG1B_HUMAN)
YLAMPFATPMEAELARRSLAQ

SEQ ID NO: 199265 - protein, 22 aa, Homo sapiens
  Native (CTG1B_HUMAN)
YLAMPFATPMEAELARRSLAQD

SEQ ID NO: 199266 - protein, 23 aa, Homo sapiens
  Native (CTG1B_HUMAN)
YLAMPFATPMEAELARRSLAQDA

SEQ ID NO: 199267 - protein, 24 aa, Homo sapiens
  Native (CTG1B_HUMAN)
YLAMPFATPMEAELARRSLAQDAP

SEQ ID NO: 199268 - protein, 25 aa, Homo sapiens
  Native (CTG1B_HUMAN)
YLAMPFATPMEAELARRSLAQDAPP

SEQ ID NO: 199269 - protein, 15 aa, Artificial Sequence
  Description of Artificial Sequence: Synthetic peptide
  Seed: KEFTVSGNILTIRLT (CTG1B_HUMAN)
  Core: FTVSGNILT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KEXTVXGXILXIRLT

SEQ ID NO: 199270 - protein, 15 aa, Artificial Sequence
  Description of Artificial Sequence: Synthetic peptide
  Seed: KEFTVSGNILTIRLT (CTG1B_HUMAN)
  Core: TVSGNILTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KEFXVSXNXLTXRLT

SEQ ID NO: 199271 - protein, 15 aa, Artificial Sequence
  Description of Artificial Sequence: Synthetic peptide
  Seed: KEFTVSGNILTIRLT (CTG1B_HUMAN)
  Core: VSGNILTIR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KEFTXSGXIXTIXLT

SEQ ID NO: 199272 - protein, 15 aa, Artificial Sequence
  Description of Artificial Sequence: Synthetic peptide
  Seed: RLLEFYLAMPFATPM (CTG1B_HUMAN)
  Core: LEFYLAMPF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXEFXLXMPXATPM

SEQ ID NO: 199273 - protein, 15 aa, Artificial Sequence
  Description of Artificial Sequence: Synthetic peptide
  Seed: RLLEFYLAMPFATPM (CTG1B_HUMAN)
  Core: FYLAMPFAT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLLEXYLXMXFAXPM

SEQ ID NO: 199274 - protein, 15 aa, Artificial Sequence
  Description of Artificial Sequence: Synthetic peptide
  Seed: RLLEFYLAMPFATPM (CTG1B_HUMAN)
  Core: YLAMPFATP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLLEFXLAXPXATXM

SEQ ID NO: 199275 - protein, 15 aa, Artificial Sequence
  Description of Artificial Sequence: Synthetic peptide
  Seed: AADHRQLQLSISSCL (CTG1B_HUMAN)
  Core: HRQLQLSIS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AADXRQXQXSIXSCL

SEQ ID NO: 199276 - protein, 15 aa, Artificial Sequence
  Description of Artificial Sequence: Synthetic peptide
  Seed: AADHRQLQLSISSCL (CTG1B_HUMAN)
  Core: RQLQLSISS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AADHXQLXLXISXCL

SEQ ID NO: 199277 - protein, 15 aa, Artificial Sequence
  Description of Artificial Sequence: Synthetic peptide
  Seed: AADHRQLQLSISSCL (CTG1B_HUMAN)
  Core: LQLSISSCL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AADHRQXQLXIXSCX

SEQ ID NO: 199278 - protein, 16 aa, Artificial Sequence
  Description of Artificial Sequence: Synthetic peptide
  Seed: AADHRQLQLSISSCLQ (CTG1B_HUMAN)
  Core: HRQLQLSIS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AADXRQXQXSIXSCLQ

SEQ ID NO: 199279 - protein, 16 aa, Artificial Sequence
  Description of Artificial Sequence: Synthetic peptide
  Seed: AADHRQLQLSISSCLQ (CTG1B_HUMAN)
  Core: RQLQLSISS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AADHXQLXLXISXCLQ

SEQ ID NO: 199280 - protein, 16 aa, Artificial Sequence
  Description of Artificial Sequence: Synthetic peptide
  Seed: AADHRQLQLSISSCLQ (CTG1B_HUMAN)
  Core: LQLSISSCL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AADHRQXQLXIXSCXQ

SEQ ID NO: 199281 - protein, 17 aa, Artificial Sequence
  Description of Artificial Sequence: Synthetic peptide
  Seed: AADHRQLQLSISSCLQQ (CTG1B_HUMAN)
  Core: HRQLQLSIS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AADXRQXQXSIXSCLQQ

SEQ ID NO: 199282 - protein, 17 aa, Artificial Sequence
  Description of Artificial Sequence: Synthetic peptide
  Seed: AADHRQLQLSISSCLQQ (CTG1B_HUMAN)
  Core: RQLQLSISS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AADHXQLXLXISXCLQQ

SEQ ID NO: 199283 - protein, 17 aa, Artificial Sequence
  Description of Artificial Sequence: Synthetic peptide
  Seed: AADHRQLQLSISSCLQQ (CTG1B_HUMAN)
  Core: QLQLSISSC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AADHRXLQXSXSSXLQQ

SEQ ID NO: 199284 - protein, 17 aa, Artificial Sequence
  Description of Artificial Sequence: Synthetic peptide
  Seed: AADHRQLQLSISSCLQQ (CTG1B_HUMAN)
  Core: LQLSISSCL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AADHRQXQLXIXSCXQQ

SEQ ID NO: 199285 - protein, 17 aa, Artificial Sequence
  Description of Artificial Sequence: Synthetic peptide
  Seed: AADHRQLQLSISSCLQQ (CTG1B_HUMAN)
  Core: QLSISSCLQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AADHRQLXLSXSXCLXQ

SEQ ID NO: 199286 - protein, 18 aa, Artificial Sequence
  Description of Artificial Sequence: Synthetic peptide
  Seed: AADHRQLQLSISSCLQQL (CTG1B_HUMAN)
  Core: HRQLQLSIS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AADXRQXQXSIXSCLQQL

SEQ ID NO: 199287 - protein, 18 aa, Artificial Sequence
  Description of Artificial Sequence: Synthetic peptide
  Seed: AADHRQLQLSISSCLQQL (CTG1B_HUMAN)
  Core: RQLQLSISS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AADHXQLXLXISXCLQQL

SEQ ID NO: 199288 - protein, 18 aa, Artificial Sequence
  Description of Artificial Sequence: Synthetic peptide
  Seed: AADHRQLQLSISSCLQQL (CTG1B_HUMAN)
  Core: LQLSISSCL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AADHRQXQLXIXSCXQQL

SEQ ID NO: 199289 - protein, 18 aa, Artificial Sequence
  Description of Artificial Sequence: Synthetic peptide
  Seed: AADHRQLQLSISSCLQQL (CTG1B_HUMAN)
  Core: QLSISSCLQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AADHRQLXLSXSXCLXQL

SEQ ID NO: 199290 - protein, 18 aa, Artificial Sequence
  Description of Artificial Sequence: Synthetic peptide
  Seed: AADHRQLQLSISSCLQQL (CTG1B_HUMAN)
  Core: LSISSCLQQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AADHRQLQXSIXSXLQXL

SEQ ID NO: 199291 - protein, 19 aa, Artificial Sequence
  Description of Artificial Sequence: Synthetic peptide
  Seed: AADHRQLQLSISSCLQQLS (CTG1B_HUMAN)
  Core: HRQLQLSIS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AADXRQXQXSIXSCLQQLS

SEQ ID NO: 199292 - protein, 19 aa, Artificial Sequence
  Description of Artificial Sequence: Synthetic peptide
  Seed: AADHRQLQLSISSCLQQLS (CTG1B_HUMAN)
  Core: RQLQLSISS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AADHXQLXLXISXCLQQLS

SEQ ID NO: 199293 - protein, 19 aa, Artificial Sequence
  Description of Artificial Sequence: Synthetic peptide
  Seed: AADHRQLQLSISSCLQQLS (CTG1B_HUMAN)
  Core: LQLSISSCL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AADHRQXQLXIXSCXQQLS

SEQ ID NO: 199294 - protein, 19 aa, Artificial Sequence
  Description of Artificial Sequence: Synthetic peptide
  Seed: AADHRQLQLSISSCLQQLS (CTG1B_HUMAN)
  Core: QLSISSCLQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AADHRQLXLSXSXCLXQLS

SEQ ID NO: 199295 - protein, 19 aa, Artificial Sequence
  Description of Artificial Sequence: Synthetic peptide
  Seed: AADHRQLQLSISSCLQQLS (CTG1B_HUMAN)
  Core: LSISSCLQQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AADHRQLQXSIXSXLQXLS

SEQ ID NO: 199296 - protein, 19 aa, Artificial Sequence
  Description of Artificial Sequence: Synthetic peptide
  Seed: AADHRQLQLSISSCLQQLS (CTG1B_HUMAN)
  Core: SISSCLQQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AADHRQLQLXISXCXQQXS

SEQ ID NO: 199297 - protein, 20 aa, Artificial Sequence
  Description of Artificial Sequence: Synthetic peptide
  Seed: AADHRQLQLSISSCLQQLSL (CTG1B_HUMAN)
  Core: HRQLQLSIS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AADXRQXQXSIXSCLQQLSL

SEQ ID NO: 199298 - protein, 20 aa, Artificial Sequence
  Description of Artificial Sequence: Synthetic peptide
  Seed: AADHRQLQLSISSCLQQLSL (CTG1B_HUMAN)
  Core: RQLQLSISS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AADHXQLXLXISXCLQQLSL

SEQ ID NO: 199299 - protein, 20 aa, Artificial Sequence
  Description of Artificial Sequence: Synthetic peptide
  Seed: AADHRQLQLSISSCLQQLSL (CTG1B_HUMAN)
  Core: LQLSISSCL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AADHRQXQLXIXSCXQQLSL

SEQ ID NO: 199300 - protein, 20 aa, Artificial Sequence
  Description of Artificial Sequence: Synthetic peptide
  Seed: AADHRQLQLSISSCLQQLSL (CTG1B_HUMAN)
  Core: QLSISSCLQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AADHRQLXLSXSXCLXQLSL

SEQ ID NO: 199301 - protein, 20 aa, Artificial Sequence
  Description of Artificial Sequence: Synthetic peptide
  Seed: AADHRQLQLSISSCLQQLSL (CTG1B_HUMAN)
  Core: LSISSCLQQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AADHRQLQXSIXSXLQXLSL

SEQ ID NO: 199302 - protein, 20 aa, Artificial Sequence
  Description of Artificial Sequence: Synthetic peptide
  Seed: AADHRQLQLSISSCLQQLSL (CTG1B_HUMAN)
  Core: SISSCLQQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AADHRQLQLXISXCXQQXSL

SEQ ID NO: 199303 - protein, 20 aa, Artificial Sequence
  Description of Artificial Sequence: Synthetic peptide
  Seed: AADHRQLQLSISSCLQQLSL (CTG1B_HUMAN)
  Core: ISSCLQQLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AADHRQLQLSXSSXLXQLXL

SEQ ID NO: 199304 - protein, 21 aa, Artificial Sequence
  Description of Artificial Sequence: Synthetic peptide
  Seed: AADHRQLQLSISSCLQQLSLL (CTG1B_HUMAN)
  Core: RQLQLSISS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AADHXQLXLXISXCLQQLSLL

SEQ ID NO: 199305 - protein, 21 aa, Artificial Sequence
  Description of Artificial Sequence: Synthetic peptide
  Seed: AADHRQLQLSISSCLQQLSLL (CTG1B_HUMAN)
  Core: LQLSISSCL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AADHRQXQLXIXSCXQQLSLL

SEQ ID NO: 199306 - protein, 21 aa, Artificial Sequence
  Description of Artificial Sequence: Synthetic peptide
  Seed: AADHRQLQLSISSCLQQLSLL (CTG1B_HUMAN)
  Core: QLSISSCLQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AADHRQLXLSXSXCLXQLSLL

SEQ ID NO: 199307 - protein, 21 aa, Artificial Sequence
  Description of Artificial Sequence: Synthetic peptide
  Seed: AADHRQLQLSISSCLQQLSLL (CTG1B_HUMAN)
  Core: LSISSCLQQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AADHRQLQXSIXSXLQXLSLL
